United States Patent 12,569,549 (FLAVIVIRUS VACCINE) - sequence listing, part 65

SEQ ID NO: 22557 - RNA, 9876 nt, synthetic construct
  misc_feature 1..9876: note = derived and/or modified CDS sequence (opt6) from DENV-2__EU482585__SS-prME
  source 1..9876: mol_type = other RNA
accgctggggtaataataatgctaattcctaccgctatagcgtttcatctaactacaagaaatggagaacctcacatgattgtcggaaggcaagaaaaaggtaagtcattattattcaaaacggaagatggagtgaacatgtgtacgctcatggcaatcgacttaggagaattgtgcgaagatacaataacatacaagtgccctctactaagacaaaacgaacctgaggatatagattgttggtgcaattcaacaagtacatgggtaacatacggaacatgtacgacaacaggagaacacaggcgggaaaagcgctctgtagcattagtgccgcatgtggggatggggctagaaacaagaactgaaacttggatgtcctctgagggggcttggaaacacgtacagcgaattgaaacgtggattttgagacatcctgggtttactattatggctgcgatcctagcttatactataggaactacacacttccagcgagcactaatcttcattctattaacagctgttgctcccagcatgacgatgcgatgtattggaatttctaaccgtgactttgtcgaaggcgtatcaggagggtcctgggtagatatcgtattggaacatggttcgtgcgttacaactatggcaaaaaataaacctacacttgattttgaattaataaaaacggaagcaaagcaaccagctacattaagaaaatactgtatagaggcaaaattaacgaatacgactacggaatctcgctgcccaacgcagggtgaacccagtttaaatgaagaacaggataaacgattcgtttgtaaacactcaatggttgaccgaggttggggcaacggttgcggactattcggaaaaggaggaattgttacctgcgcaatgttcacttgtaagaaaaacatggaaggaaaagtagttcttccggaaaacttggaatatacaatagtaattacaccacattcaggcgaagaacacgcggtaggaaacgacaccggcaagcacgggaaggaaataaaaatcaccccccaatccagtattacagaagcggagttgactggctacgggacagttacgatggaatgtagcccaagaactggactagactttaacgaaatggtattgttacaaatggaagataaagcatggcttgttcacagacaatggttcttagacctaccactcccatggttacccggcgcagatacccaaggctcaaattggatacaaaaggagacgttagtaacttttaagaacccgcatgccaaaaaacaggatgtggtagttctgggaagccaagaaggtgctatgcacactgccttgaccggcgcaaccgaaatacagatgtcttcaggaaacctactgttcaccggtcacctgaaatgcagactacgaatggataaacttcagctgaaaggaatgtcatacagtatgtgcacaggcaagttcaagatagttaaagagattgcagaaacccaacatggcacaatagtaatcagagttcagtatgagggcgacggtagcccttgcaaaattccctttgaaattatggatttggaaaagcgacacgtattaggaaggctaataacagtgaatcctatagtgacggaaaaagacagtccggtaaatatagaagcagaaccgccctttggagactcttatattattataggggtcgaaccaggtcaacttaaactcaattggtttaaaaagggtagctcaatcggacaaatgttcgaaactaccatgagaggagcaaaacgaatggcgattctcggtgacactgcctgggattttggatcattaggtggagtttttaccagtataggaaaagcgttgcatcaagtattcggagcaatatatggcgctgccttctctggagtaagttggactatgaaaattttaattggggtaattataacatggattggcatgaactccaggagcacttccctatcggtaagcctagttctagtaggagtagtaaccctatatctaggagcaatggtacaagctgattccggctgcgtagtatcgtggaagagtaaagaactaaaatgtggttccggaatattcataactgataacgtacatacctggacagagcaatataaatttcaaccagaatccccgtcaaaactcgcatctgctattcaaaaagcacatgaagaaggaatatgcggaattaggtcagtgacaagacttgaaaaccttatgtggaaacaaataactcccgaactcaaccatatattatcagaaaatgaagtgaaacttaccattatgacaggcggaattaaaggaattatgcaagccggtaagcgaagtctacgccctcagccgacagaacttaagtattcgtggaagacttggggtaaggcaaaaatgttatcgactgagagccacaatcagacttttcttatagacggtccagaaacagccgaatgtcctaatactaatagggcttggaattctctagaggtcgaagactatggatttggagtgttcacaacaaatatatggctaaaattacgtgaaaaacaagatgttttctgtgattctaaactaatgagtgcagcaataaaagacaacagagcggtccatgcggatatgggttattggatagagagcgccctgaacgacacctggaagatggagaaagcatcctttattgaggttaagagttgtcattggccgaagagtcacacgttatggtcaaatggtgtattggaatcggagatggtcatacctaaaaattttgcaggaccggtgagtcagcataactaccggcctgggtatcatactcaaaccgctggcccatggcacctcggaaagctcgaaatggattttgatttttgtgaagggaccaccgtggtagttacagaagattgtggcaatagggggccatcactgagaacaaccaccgctagtggaaaattaataacagaatggtgttgtaggagttgtacactcccaccattgcgttacagaggcgaagatggatgctggtatggcatggaaattcgtccgttaaaggaaaaggaagaaaacttagttaacagtctcgtgacagctggacatggtcaaatagataatttttctttaggagttttaggaatggcactgtttctggaggagatgctacgaacacgagttggaacaaaacacgcgatattattagttgctgtaagctttgtaacgttgataacgggcaacatgagtttcagagatcttggtagagtaatggttatggttggagccaccatgactgatgacatagggatgggggtaacataccttgctctgctagcagcttttaaagtaagaccaacattcgccgccggactattattaaggaaattgacaagcaaagagctaatgatggcaactatagggatagcgttattaagtcaatcaacgattcctgaaacaattttggaacttacagatgcactagcactcgggatgatggtactcaaaatagtaagaaacatggaaaaatatcaattggcagtgactataatggccattagctgtgtccctaatgctgtaattctacagaatgcttggaaagtgtcttgcacaatcttggcagcggtatcagttagtcctctactactcacctcatcacaacaaaaggcggattggataccgttggcactcaccattaagggacttaatcctacagccatatttctaacaaccctaagcaggactagcaaaaaaaggagttggccacttaacgaagcgataatggcggtgggaatggtaagtatacttgcaagtagcttacttaaaaatgatattcctatgactggtcctttagtcgcaggtgggcttcttacagtttgttatgtactaacgggtcgttcagcagacttagagctagagcgtgcggccgacgttaaatgggaagatcaagcggaaataagtggatctagtccaatactgagtataacaatttcagaggacggttcaatgtcaatcaaaaatgaagaggaggaacaaacactcactatacttataaggaccggactattagttatctcaggcgtatttcctgtctcaataccaataactgccgccgcgtggtacctatgggaagtgaagaaacaacgagccggagtattgtgggatgtcccatctcctcccccagtcggaaaggcagagcttgaagacggtgcctatagaataaaacaaagaggaattttgggatacagtcagataggtgcaggggtttacaaagaagggacattccacacgatgtggcacgtcacaagaggagcagttttgatgcatagaggaaagcgcatagaaccatcttgggcagacgtcaaaaaggacctaatctcttatggaggtggttggaagttggagggagagtggaaggagggtgaggaagtacaagtcttagctctcgaacccggtaaaaatccaagggccgtacaaacaaaacctggtctatttaaaaccaacacaggcacgatcggagcagtatcactcgacttcagcccgggtacgagcggaagccctatagtagatcgcaaaggtaaagtagtaggtctttatggaaatggagttgtcacaagatcaggagcctatgttagtgcaatcgcccaaaccgaaaagagtattgaagataacccggagatagaagatgacatatttagaaaaaaaaggctgactataatggacttgcacccaggcgctggtaaaactaaaagatacctacctgccatagttcgagaggcaattaagcgaggcttaagaacactaatattagcaccaacaagagttgtggccgcagaaatggaggaagctctcaggggcctaccaatacgttatcaaacaccagccatacgtgcagagcatactggaagagaaatagttgatctaatgtgccatgcaacttttacaatgagattactttcaccagtcagagtaccaaactataatctcataatcatggacgaagcacactttacagatccggctagtatagccgcaagaggatatataagtacaagggttgaaatgggcgaagccgcaggaatattcatgacggctacgcctcctggatcgcgcgatccttttccacaatctaatgcaccaataatggatgaagaaagagaaataccagagagatcgtggaacagcggtcatgaatgggtaactgactttaagggtaaaacagtatggttcgtaccatcaatcaaagctggtaatgatattgctgcgtgcttgcgtaaaaatggtaagaaagtaatacaacttagtagaaaaacgtttgatagcgaatacgtaaaaacgagagctaatgattgggactttgtagtaaccaccgatatctccgaaatgggggcaaatttcaaggcagagcgagtaatagacccaagaagatgcatgaaaccagttatactaaccgacggcgaagagagggtgattctcgcgggtccaatgcctgttacacactcaagcgctgcacaacgtcgaggtcggatcggtcgaaaccctaagaacgagaatgatcagtatatttacatgggtgaaccattagaaaatgacgaggattgtgcccattggaaggaagctaaaatgttgttagacaatattaatactcccgaaggtataattcctagtatgtttgagccggaaagagaaaaagtagacgctattgatggggagtaccgccttcggggtgaggcaagaaagacttttgtagatctaatgcgaaggggggatctacctgtttggttagcctatagagtagcggctgaaggcatcaactatgctgataggcgatggtgttttgatggaataaaaaacaatcaaattttagaagaaaacgtagaggtggaaatatggacaaaagagggggaaagaaagaaattaaaacctagatggttggacgcacgaatctattcagacccacttgcgttgaaagaatttaaagaattcgctgcaggacggaaaagcttaactctaaacctcataactgaaatggggagattacccacatttatgacacaaaaggctcgagacgctttagacaatctcgccgttttgcacactgcagaagctggaggaagagcctataaccacgccctatctgagctaccagaaacattagaaacattattactattaactttattagctactgtcacggggggaatctttttgtttttgatgagcggtaaagggataggtaaaatgactttaggcatgtgttgtataatcacggctagtattttgctatggtatgcgcaaatacaaccacattggatagcggcatcaatcatattagaattttttctaatcgtacttctaataccggaaccagagaaacaacgaacgccgcaagataatcaattaacatatgtagtaattgcaatactcaccgtagtcgccgccactatggcaaatgaaatgggatttcttgagaaaactaaaaaagacctcggactgggtagtattacaactcaggagtcagaatcgaacattttagatatagatcttcgcccagcatcggcatggacgttatatgccgtagcaacaacgttcgtaacaccaatgttaaggcatagcattgaaaattcgagtgtaaatgtatcactaacggccatcgcgaatcaagcaactgtattaatgggccttggtaaaggttggcctctttcaaagatggacataggtgtgccccttctagccatcggttgttactctcaagtaaacccaattaccttaacagctgccttactattactagtagcgcattatgccatcataggacccggcttacaggcaaaagcaacacgtgaagctcagaagcgggccgccgccggcataatgaaaaatccaactgtagatggtataactgtaatagatttagaaccaattccatatgatccgaaattcgagaaacaactaggacaagtcatgctattaatattgtgcgttacccaagtcttgatgatgcgaaccacctgggcgttatgtgaagcattaactttagccaccgggcccatatctaccctctgggaagggaacccgggtagattttggaacaccacaatagcagtcagtatggccaatatttttcgtggcagttacttagccggtgcgggattattattttcaatcatgaaaaacactaccaacactcgccgcggaactggaaacattggcgaaacattaggtgaaaaatggaaaagccgtctaaatgcattaggaaagagtgagttccaaatttataaaaaatcaggaattcaagaggtggacagaaccttagcaaaagaagggatcaagcggggagagacagaccatcacgcagttagcaggggctctgctaaattacgttggttcgttgaacgtaacatggtcacaccggagggaaaggttgtcgatctcgggtgcggacgaggcggctggagttattattgtgggggactaaagaatgtaagggaagtgaagggactaactaaaggcggaccgggacacgaagagccaatacctatgtctacctatggatggaacctagtaaggttacaatctggggttgacgtattttttacaccgccggaaaagtgcgatactttactatgcgacattggagaatcctctcctaatccaactatagaggccggtagaacactaagagtcctaaatcttgtcgaaaactggttaaacagtaatactcagttctgtataaaagtacttaatccctatatgccttcagtaattgaaaagatggaaacgctacaaagaaaatacggaggggccttagtgagaaatcctttgagcagaaattcaactcacgaaatgtactgggtcagcaacgcgacaggtaatatagtttcaagtgttaacatgataagcagaatgctaataaaccgattcacgatgaaacacaaaaaagcaacatatgaaccagacgtggatctcggtagtgggactcgtaacataggaatagaaagtgagattcctaatctggatataataggaaaaagaattgaaaaaataaaacaagaacacgagacatcatggcattatgatcaagaccacccgtataaaacatgggcttatcacggatcatacgaaactaaacaaaccggaagcgcgtcaagtatggttaacggagtagttaggcttttaacaaaaccatgggacgtagttcccatggttactcaaatggccatgacagacacaacacctttcggtcaacagcgagtgtttaaagaaaaggtagacaccagaactcaggaacctaaggaaggcacgaagaaattaatgaaaataacagcagaatggttgtggaaagagctagggaagaaaaagacaccacgtatgtgcactagagaagagttcacaagaaaggtaagatcaaacgccgcactaggtgccatattcactgatgagaataagtggaaaagtgcacgcgaagctgtagaagacagtagattttgggagctcatagaccgtgagagaaatctgcatttagaaggtaaatgtgaaacgtgcgtgtataatatgatgggaaagcgggagaaaaaacttggagaattcgggaaggccaaagggtccagggcaatctggtatatgtggctaggggcaaggtttttagaattcgaggcgctcgggttccttaacgaagaccattggttcagccggggcaactcgttatccggagtggaaggggaaggattacacaggcttggctacattttgagagatgtctctaagaaagaaggcggggctatgtatgcggacgacacagcaggctgggacacacgcataacactcgaggacttaaaaaacgaagaaatggttactaaccacatgaaaggcgaacacaaaaaattagctgaagctatcttcaaattaacgtatcagaataaagttgtgcgagtccagcgccctacaccccgcggtactgttatggacataattagtaggcgagaccaacgaggtagtggccaagtgggtacatatggacttaacacattcacaaacatggaagcacaactaatccgccagatggaaggtgagggaatatttaaaagtatacaacacttgacagtaacagaagaaatcgctgttcaaaattggcttgcacgggtgggtagggaacgtctttctcgaatggcaatctctggcgatgattgtgtcgttaaacccttagatgacaggtttgcgtcggctctgacggccttaaatgacatgggtaaagtccgaaaggatatacaacaatgggagcctagtcgaggctggaatgattggacacaagtcccattttgttcgcaccactttcacgaactagttatgaaagatggccgagtcctggtagtgccttgccgaaatcaagatgaattaataggtcgagcaagaatatcacagggagcaggatggtcattaaaagagaccgcttgtttaggcaaatcttacgcacaaatgtggaccttgatgtatttccacaggcgtgacttacggttagcagcaaacgcaatttgtagtgcggtgccttctcattgggttccaacatccagaaccacatggtcaattcatgcaaaacatgagtggatgaccactgaagacatgctcgccgtatggaatcgtgtatggatccaagagaatccctggatggaggataagacgccagtggagagttgggaagagataccttatctgggaaaaagagaggaccaatggtgtggttcgttaataggtttgacaagtcgagcaacctgggcaaagaatatacagacagcaatcaaccaagttagaagtcttattggaaatgaggaatataccgattatatgccttcaatgaaaagatttcgcagggaggaagaagaagcgggagttttatggtga

SEQ ID NO: 22558 - RNA, 9876 nt, synthetic construct
  misc_feature 1..9876: note = derived and/or modified CDS sequence (opt6) from DENV-2__EU482587__SS-prME
  source 1..9876: mol_type = other RNA
acggcgggagtaataatcatgcttattcccactgcaatggcatttcacttaactaccaggaacggagaaccacacatgatagtgggaagacaagaaaaaggtaaatcattgttatttaaaaccgaagatggtgtgaacatgtgtaccctaatggctatagacttaggtgaattatgtgaggacaccattacgtataaatgcccattacttagacaaaatgaacctgaagacatagactgttggtgtaactcaacaagtacctgggtgacatacggcacctgtacaaccactggagaacaccggcgagagaaacgatctgtggctttagtcccacatgtcggcatgggactagaaaccagaactgaaacatggatgtcctcagagggcgcatggaagcatgtccaaagaatagaaacgtggatattacgtcatccgggatttacaatcatggccgcaatactagcttacacaattggcactacacattttcaacgcgcgttgatttttatattacttacggctgttgcaccgtcgatgactatgagatgcataggcatatcaaatcgggatttcgtggaaggtgtttctggaggtagctgggtagacattgttttagaacatggaagttgtgttacaaccatggcgaaaaataaaccgacattggattttgagttgataaaaaccgaggctaaacaacctgcaacactacgtaagtattgtatagaagcaaaactaacaaacacaacaaccgaaagtagatgcccaacccaaggagaaccaagtttaaatgaggagcaggacaaaagattcgtatgtaaacattctatggttgataggggatggggcaacggatgcggtctattcggtaagggcggcatagtaacctgtgcgatgtttacatgtaagaaaaatatggaaggaaaagtggtactcccagagaacttagaatacaccattgtgattacaccacattcgggagaagaacacgcggtaggaaacgataccgggaaacatggaaaagaaatcaagataacaccgcagtcctcgataacggaagtggaattaacagggtatgggacagtaaccatggaatgtagcccaaggactggactggactttaacgaaatggtgttattacaaatggaagataaagcatggttagtacatagacaatggtttcttgatttgccattgccatggttacccggtgcagacactcaagggagcaattggattcagaaagaaactttggtcacattcaaaaaccctcatgctaagaagcaggacgtagtagtgctaggaagccaagagggggccatgcataccgcgctaacaggcgcaaccgagatacagatgtcttcaggtaacttactttttactggtcaccttaaatgtagactacgcatggataaacttcaattgaagggtatgtcttatagcatgtgtacaggcaaattcaaaatagtaaaagagattgcggaaacgcaacatggaacgattgtcataagagtacagtatgagggagatgggtccccatgtaaaataccattcgagataatggacctcgaaaaacgacatgtgctaggtcgactgattacggtaaaccctatcgttaccgagaaagactcgccagtgaatatagaggcagaaccaccgtttggagatagttatataattattggggtagaaccaggacaattgaaattgaactggtttaaaaagggatcttcaattggtcaaatgtttgaaacgactatgcgaggagcaaaacgtatggcaatactaggcgacacagcatgggatttcggttcacttggaggggtatttacatcaatagggaaagcccttcatcaagtattcggtgccatttatggagcggcattcagcggcgtgtcttggactatgaaaatactgataggggtgataataacgtggataggcatgaactcaaggtcaacaagcctaagcgtcagtctagtgttagtcggtgtggttactctttatttgggagcgatggtacaggcagacagtggctgtgtggtttcgtggaagtcaagagagttaaaatgtggatcaggcatcttcattacagataatgtacatacttggacagagcaatataaattccaacctgaaagtcccagcaaattggcaagtgcaatccaaaaagcacacgaggaaggtatatgcggtatacggtcggtcaccaggctggagaacctaatgtggaaacagataacaccggaactaaatcacatattaagcgaaaacgaggtaaagttgactataatgactggggatattaaaggaattatgcaagctggcaaacgtagtttaagacctcagcctacagaattaaaatattcttggaaaacctggggaaaagcaaagatgctgagtactgaaagtcacaatcgaacatttctaatagacggtccagagacagcagaatgtcctaatactaacagggcgtggaatagcttagaagttgaggactacggatttggagtgtttactaccaatatatggttgaaactacgagaaaaacaagatgtattctgcgactcaaagttgatgagtgcagccataaaagataatagggctgtccacgccgacatgggatattggatagaaagtgcactaaacgatacatggaaaatggaaaaggcctcgtttatagaggtcaaatcttgtcactggcccaaatcacatacactatggtcaaacggcgttctagaatcggaaatgataatcccaaagaattttgcggggcctgtatcgcaacataattatcgcccgggataccatacccaaaccgccggtccatggcatctaggcaaacttgaaatggattttgacttctgcgaaggaacaacggtagttgtaactgaagactgtggcaacaggggaccgagcctcagaaccacaacagcgtcgggtaagttaatcacagaatggtgttgccggagttgcactttacccccattacgttacagaggtgaggatggctgttggtatggaatggagatacggccattaaaagaaaaggaagaaaatctagttaattcattagtaactgcagggcatggtcaaatagacaacttctcattaggtgtgttgggcatggcactgtttttagaagagatgctaaggacccgggtgggcactaaacatgcaattctcttagttgcagtatcttttgtaacccttataacaggaaacatgagcttcagagacttaggtcgcgtgatggttatggtgggcgcgacgatgaccgacgacatagggatgggcgtgacatatcttgcgttactagctgcgtttaaggttcgtccaacatttgccgcaggactcctcttaagaaaattaacttcgaaagaacttatgatggctacaataggaatcgccctattatcccaaagtacaatacctgaaactatcctagaacttacagatgctctggccttgggaatgatggtgcttaaaatagtcagaaatatggaaaaatatcaactcgctgtaactattatggctatttcatgcgttccaaatgccgttattttacaaaatgcctggaaggtatcctgcaccatattagcagcagtatctgtatcacctttactgctaacaagttctcagcaaaaagcagactggattccccttgctctgactataaaaggtctaaatcctacggcaattttcctaacaacactatccagaacctctaaaaagcgatcctggccattgaacgaggccataatggcagtaggcatggttagtatcttagcaagcagtttacttaaaaatgatatacctatgacaggacccctagttgcagggggcctattaaccgtatgctatgtactcactggtagaagtgcagaccttgaattggaaagagctgcagatgttaaatgggaagatcaagccgaaatttcgggttcatcgccaatattatcaataacgattagtgaagatggttcgatgagtattaaaaatgaagaagaagaacaaacattaacaatattaattcgaacaggtcttttagtcatttcaggtgttttcccagtctctatcccaatcacagctgcggcgtggtatttatgggaggtcaagaaacaaagggccggtgttctgtgggatgtcccttcgcctccgcccgtcgggaaagcggaattggaagatggagcgtatagaattaaacaaagaggaatattaggatactcgcagattggtgcgggagtatataaagaagggacatttcatacaatgtggcacgtaacgagaggggctgtcctaatgcataggggaaaacgaattgaaccgtcatgggcagatgtgaagaaagatttgatctcatacgggggcggctggaaattagagggagaatggaaggaaggcgaagaggtgcaagtgctagctctggagccaggtaagaacccacgagcagtacaaacaaaaccagggctattcaaaactaacactggtactatcggagcagtatcgctggacttcagtcctgggacctcaggctccccgatagttgatagaaaaggcaaggtggtaggtttatatggtaatggtgttgttacacgctcgggtgcatacgtctcagctatagcacaaactgagaaaagcattgaagataacccagaaatagaagatgacatctttaggaagaaacgcttgactattatggatttgcacccaggtgcaggcaagacaaaacgttacttaccggcaattgttcgggaagcaatcaaacgaggtttacgcacgctgatattagcacctacgagagtcgttgcggcagagatggaggaagcattacgagggttacctataagatatcaaactcccgccattcgtgcagaacataccggccgagaaatagtggatttgatgtgccacgccacattcaccatgcggctcctctccccagtgagagtaccaaattacaacctaattattatggatgaagctcacttcacagatccagcatcgatcgctgcaagagggtatatttcgacaagggtagaaatgggtgaggctgcaggcatttttatgacagctacaccacctggttctcgagaccctttccctcaatcaaatgcaccaataatggacgaagaacgtgaaatacccgagaggagctggaactctggtcatgaatgggtgaccgactttaaaggtaaaaccgtatggtttgtacctagtataaaggcaggcaatgatatagcggcgtgcctgaggaaaaatggaaagaaagttatacaattaagtagaaagaccttcgattcagagtacgtaaaaacccgagctaacgactgggacttcgtagttaccactgatatatccgaaatgggggctaactttaaagctgaacgggtgatagatccaagacgatgtatgaaacctgtgattctcacagatggggaggaaagggttatccttgcaggaccaatgccagtaacacacagctcggcagcccagagaagaggacgcataggtagaaaccccaaaaacgaaaacgatcaatatatatatatgggagaaccgttggaaaacgacgaggattgcgctcattggaaagaagcaaagatgctactagacaacataaataccccagagggcataatcccaagtatgtttgaacccgaacgtgaaaaggtcgacgccatagacggagaataccgactacgaggggaggccagaaagacatttgtagacttaatgcgacgaggcgacttacctgtatggttagcttatagggtagcagcagaaggaattaactacgccgatcgtcgatggtgctttgatggcattaaaaacaaccaaatactagaagaaaacgtggaagtagaaatttggactaaggaaggcgaacgaaagaaactcaaacctagatggctagacgctaggatttacagtgaccctctagcactaaaagaatttaaagagttcgcagcaggcaggaaatctctaacattgaatctaataacagaaatggggagactaccaacctttatgacccaaaaagctcgagatgcattggataatttagcagtcttacataccgcagaagcgggaggtagagcctataaccacgcactatcggaattaccggaaacacttgaaacattactacttcttacgttactagcgacagtaacagggggtatatttttatttctgatgagcggaaaaggaataggaaaaatgacactaggtatgtgttgtataattacagcatctatactactatggtatgcacaaatacaaccacattggatcgcagcgtcaataatacttgaatttttcctgatagtactactcatacctgagcccgaaaagcaaagaacgccccaagataatcaacttacttatgttgtaatagccattttaacagtagtggctgcaactatggcgaatgaaatgggcttcctagaaaagacaaagaaagatttaggattgggaagcataaccacccaggaatccgaatcaaatatattggacatagatctaaggccagcctcagcctggacactctatgccgtagccaccacgttcgttacccccatgctaagacatagtatcgaaaatagttcagtgaacgtcagcctgacagctatcgcaaatcaggcaactgtattaatgggattgggaaagggatggccactctccaagatggacataggcgtcccactacttgccataggctgttatagtcaagtcaatcccataacactaacagccgctttactcttgttagtcgcccattacgccattataggcccggggctgcaagctaaagctacacgcgaagctcagaaaagggcggctgccggtataatgaagaatccaaccgttgatggaataacagttattgacttagaaccaattccgtacgacccaaaatttgagaaacaattgggacaagttatgcttctgatcttgtgcgtaacccaagtgctcatgatgcgcacaacgtgggcactttgtgaagccttgacactagccacaggacccataagtacactatgggaaggaaatccaggaagattttggaacacaacaattgcggtgtcaatggctaacatatttcgcggttcatatcttgcgggcgccggtttattattctcaatcatgaaaaatactactaatacaagaaggggcacaggcaatattggagagacattaggtgaaaaatggaaatccagattaaatgcattaggtaagtctgagttccaaatatacaagaaaagtgggattcaagaagtcgatagaaccttagcgaaggaaggaataaagcgtggcgaaactgatcatcacgctgtaagtcgtggatctgcaaaattacgttggtttgtggaacgtaatatggttacaccagaaggtaaggtggtagatcttggttgtggtcgaggtggctggtcatattactgtggcggactgaaaaatgttcgagaagtcaaaggtctaacgaaaggaggtcctggtcatgaagaacctatccccatgtcaacttatggatggaatctagtgcgtttacaatctggcgtggacgtattctttactcctccagagaaatgcgatactcttctatgcgacatcggagaaagttcaccaaatccaaccatagaggcaggcagaacactgagagtgctcaacttggtcgagaattggttaaataataacacacaattctgtataaaagtgctaaacccatatatgcccagtgttattgagaaaatggagactctccaacgaaaatatggaggcgcattagtcagaaacccattgtctagaaattcgacacatgagatgtattgggtttcaaatgcgactgggaatattgtatcaagtgtaaacatgataagtagaatgttgatcaatcggtttactatgaaacataagaaagcaacttacgaacctgatgtcgacctagggtccggaactcgcaatataggaatcgaatcggaaattccaaatcttgacataattggaaaacgaatagagaaaataaagcaggaacacgaaacaagttggcactatgaccaagaccacccctacaaaacgtgggcttaccacgggagttacgaaacgaaacaaactgggtcagcaagttccatggtcaatggagtagttaggcttctcactaagccttgggatgttgtacctatggtgacccaaatggccatgacagacactaccccatttgggcagcagagggtttttaaagaaaaagtcgatacaagaacacaagaaccgaaggagggaaccaagaaattaatgaagataacggcagaatggttatggaaagaacttgggaaaaagaaaacaccccgaatgtgcacgagggaagagttcaccaggaaggttcgctccaatgctgcactgggagcaatcttcacagacgagaacaaatggaagagtgcaagggaagctgtcgaagatagtaggttttgggaattaatagaccgggagaggaacttacaccttgagggtaaatgtgaaacatgtgtatacaacatgatgggcaaacgagagaagaaactaggagagtttgggaaagccaaagggtcacgagctatatggtacatgtggctgggggcccgatttttagagtttgaagcactaggattcttgaatgaagatcattggttctcgcgcgggaatagtctatccggggtcgagggcgaaggattacacagattgggatatatattaagggacgtatcaaagaaagaaggtggagcaatgtatgcagatgatacagctggatgggacacacgtataacattagaagatcttaaaaatgaagaaatggtaactaatcatatgaaaggcgagcacaagaaacttgctgaggctatatttaaactgacgtatcagaacaaagttgttcgagtccaaagacccacgccacggggtaccgtaatggatattatatctcgcagggatcagcgaggttccggtcaagtggggacctatggactaaatacatttacaaacatggaagcacaattaatacgtcaaatggagggagaagggatatttaaatcgattcaacatctaacggtaacagaggagatagccgtacaaaactggctagccagagtcggacgtgaaagactctctcggatggctattagtggagatgattgcgtggtaaaaccattagacgatagattcgctagtgcgttaactgcattaaatgatatggggaaagtcaggaaagatattcagcaatgggaaccgagtagaggttggaatgattggacgcaggtcccattttgttcacatcactttcacgaaatagtaatgaaagatgggagagtattagtagttccctgtagaaaccaagacgagcttattggaagggcaagaatatcccaaggagctggatggtcactaaaagaaaccgcctgccttggaaaatcgtatgcccagatgtggactttaatgtatttccataggagagacttaaggctggcagctaatgctatttgttcagctgtcccgagtcactgggtaccaacttccagaacaacatggagtatacatgcgaaacatgaatggatgacaaccgaagacatgttggcggtttggaatagagtttggattcaggagaatccttggatggaagacaagacaccagtggagtcgtgggaagaagtcccttatctaggaaagagagaagaccaatggtgcggtagtctaataggactaacaagccgagcaacttgggctaaaaacatacaaactgccattaaccaagtgcgttctctgataggcaatgaagagtacacagactatatgccaagtatgaagcgatttcgtagagaagaagaagaggcgggggttctctggtaa

SEQ ID NO: 22559 - RNA, 9876 nt, synthetic construct
  misc_feature 1..9876: note = derived and/or modified CDS sequence (opt6) from DENV-2__EU482588__SS-prME
  source 1..9876: mol_type = other RNA
actgcaggcgtcataatcatgcttataccaaccgccatggccttccatttaactacacgtaacggtgaacctcatatgatcgttggaagacaagaaaaaggaaaatccttattatttaaaaccgaagatggggttaacatgtgtacgttgatggcaatagatctcggagagctatgcgaagatacaataacatataaatgcccactactccgtcaaaatgaaccggaagatatagattgctggtgtaatagtacttctacctgggttacatacggtacctgtaccacaacaggagaacatagaagagaaaaacgttcggtcgccctcgtacctcatgtcggcatgggattagaaacgaggacagaaacgtggatgagtagtgagggagcatggaagcacgtacagaggatcgagacttggatactaagacatccaggattcacaattatggcggcaatcctagcatatacaatcggaacgacccactttcaaagagcactcattttcattttgttaacggcagttgcccctagtatgacgatgcgctgtattgggatttctaatagagactttgtagaaggcgtttcaggaggatcttgggtggacatcgtattagagcatggaagctgcgtcactacgatggcgaaaaataagccgacactagattttgaactaatcaagaccgaagcgaaacaacctgctactctaagaaagtactgtattgaagctaagctaactaacacaactacggaatccagatgtcccacgcaaggcgagccatcattaaatgaagaacaggataaacgttttgtatgtaaacactcaatggtagacagaggttggggaaatgggtgcggattgtttggaaagggcggaatcgttacctgcgctatgttcacatgtaaaaagaatatggaaggaaaggtggtgttacccgaaaacttagagtatacaatcgtgattacacctcacagtggtgaagaacatgccgtaggaaacgatactggcaagcatggaaaggagataaaaataactccgcaaagctcaattaccgaagcagaattaaccggctacggtactgttacaatggagtgttcacctagaactggattagattttaacgaaatggtattgctacaaatggaagataaggcctggttagtacatcggcaatggttcctcgatcttcctcttccctggcttccaggtgccgatactcaagggtcgaactggatccagaaagagactttagtaacttttaaaaatcctcatgcgaaaaagcaagatgtagtagtgttaggtagtcaagaaggcgcaatgcatacggctttaaccggagctacagaaatccagatgtcatcggggaatttgttattcacaggtcacttaaagtgtcgcctgcggatggataaattacagctgaaaggtatgtcatatagtatgtgtacaggaaaatttaaaatagtaaaagaaattgcagagacgcaacacgggactattgttataagggtacagtacgagggagacggatctccatgcaaagtaccattcgaaataatggatctggaaaaacgacatgtattgggacgactcatcacggtaaatccaattgtaacagagaaggacagtcccgtgaacatagaagcagagcctccttttggcgattcatatataataataggagtggaaccaggacagctgaaacttaattggttcaaaaaaggttcttcgataggacaaatgttcgaaacaacaatgagaggcgctaaacgtatggctatactaggcgacacagcttgggattttggtagtctaggtggggtatttaccagcatagggaaggctttacaccaagtgtttggagcaatatatggagctgccttctccggagtctcgtggactatgaagatattaatcggagtcattatcacatggattggcatgaactcgagatcgactagtctctctgtaagtctagtgctagtaggggtagttacattataccttggagctatggtccaagctgactctgggtgcgtagtatcatggaagtcgaaggagttaaaatgtggtagtggaatatttgtaactgataatgtccacacatggactgaacagtataaattccaaccagaatccccatcaaaactagcctccgcgatacaaaaagcacacgaagaagggatttgtggaatcagaagtgtgaccagactagaaaatctaatgtggaagcaaataactcccgaattaaaccatattctatcagaaaacgaggtaaaactcacaataatgactggagatatcaaaggaataatgcaagcaggaaagagatcgctgcgaccacagcctacggaactcaaatactcttggaaaacttggggtaaggctaaaatgctatccactgaaagtcacaatcagacattcttgatagacggtccagaaactgcagaatgtccaaacactaaccgtgcttggaattcgctagaagttgaggactatggttttggagtattcaccactaatatatggctcaagctacgagaaaaacaagacgttttttgtgattcaaagctaatgtccgccgccataaaagataatagagctgtccacgccgatatgggctattggatagaatcagcactaaatgatacatggaagatggaaaaagcgagcttcatagaagtaaaaagttgccactggccaaaatcgcacacattatggtccaatggtgtgttggaaagcgagatgattattcctaaaaatttcgcaggcccagtttcacagcacaactatagaccaggctaccatacgcaaacggcaggaccatggcacctaggaaagttagaaatggattttgatttctgtgaaggtactacggtggtcgtaacagaagattgcggaaatcgaggaccatcattaagaacgaccactgctagtggtaagttaataaccgaatggtgctgcaggagttgtactctgcccccactccgatacagaggagaggacggctgctggtatggaatggaaattcgacccctaaaagagaaagaggaaaatcttgttaacagtttagtcacggctggtcatggacagatcgacaatttcagtctaggcgtactcggtatggcgcttttcttagaagaaatgttacgcacccgtgtaggcacaaaacacgcaatattacttgtagctgttagcttcgtcacactcataaccggaaacatgtccttccgtgatcttggaagggttatggtaatggttggagctactatgacagatgatattggaatgggggtaacctacttagcgctgctggccgctttcaaggtacgacctacatttgctgctgggctattattacgaaaactaacttcaaaagagttaatgatggcaacaatcggtatagctctgctaagccaatcgactatcccagagacaatacttgaactcacagatgcgcttgctttaggaatgatggtattaaagatcgttaggaatatggaaaaatatcagttagcagtcactattatggctatttcctgtgtgccaaatgccgtaatcttacaaaatgcatggaaggtatcatgtactattttggcggcagtatcggtatcacctttgctattgacctcaagccaacaaaaagcagattggataccattagctttaacaattaagggtttgaatccaactgcaatattccttacaacgttgtcacgtacaagcaaaaagcgtagctggccattgaatgaagcaattatggctgttggaatggtatcgatacttgcgagttcgttattaaaaaacgacataccaatgaccggacctctcgtcgcgggtggtttattaactgtgtgttacgttctaacaggcagatcggctgacctagaattagaacgggcagcggacgtcaaatgggaagaccaggcggagatttccggaagttcacctattctatcaatcacaataagtgaagacggatccatgtccataaaaaatgaggaggaagagcaaactctaacaatactaattagaactggcttgttggttattagtggtgtatttccagtaagtattccaattacagcagcggcttggtacttgtgggaagtaaaaaagcaaagagctggtgtattatgggatgttccatcgccgcctccagtcggaaaggcagagttagaggacggtgcgtataggattaaacagcgcggaattctaggctattcacaaattggagctggggtatataaagagggtacatttcacaccatgtggcatgtaaccagaggtgccgtcttaatgcatagagggaaaagaatcgaaccaagttgggcagatgttaaaaaagacctcatctcgtatggtggcgggtggaaactagaaggtgaatggaaagaaggggaggaggtacaagtcctagcactcgaacctggaaaaaatcctagagcagtacaaaccaaaccgggtttgtttaagaccaacacaggaacaattggagctgtctccttggatttttcaccaggaacaagcgggagccctatcgtcgaccgtaagggtaaagtcgttggtctatacgggaatggagtagttaccagaagcggagcatatgtctccgcaatcgcacagaccgaaaaatcgattgaagacaatccggagattgaggatgatatatttcggaaaaaacgactaaccataatggacctccaccctggagcaggaaaaacaaaaagatatttaccagcaatagtgcgagaagctataaagagaggactacggaccctgatcctagcaccaactagagtcgtcgcggcggaaatggaggaggcactaagaggattacccataaggtatcaaacccctgcaattagggcagaacatactggaagagaaattgtagatctaatgtgtcacgctacgttcacaatgaggttgctatctccagtaagggtacccaattataatttgataattatggatgaggctcatttcacggaccctgcatcgatagcagccaggggctacatctcgaccagagtcgaaatgggggaagctgcgggaatatttatgaccgcaacccccccaggttctcgggatccattccctcaatcaaatgcacccattatggacgaggaacgcgaaatacctgagaggtcctggaattcgggacatgaatgggtaacagactttaaaggtaagacagtatggtttgtaccatcgataaaagctggaaatgacattgcagcatgtcttagaaaaaacgggaaaaaagttatccagttaagccgtaaaacctttgatagcgaatatgtaaaaacaagggccaatgattgggatttcgtagtaactacagacattagcgagatgggtgcaaactttaaggctgaacgcgtgatcgacccgcgacgatgcatgaaacccgttatcttaacggatggcgaggaaagggtaattttagctggccccatgcccgtgacgcactccagcgcagcgcaacgaagaggaagaattggtaggaatccaaaaaatgaaaatgaccaatatatttacatgggcgagcccttagagaatgatgaagattgtgcacattggaaagaggcgaaaatgctgttagataatatcaacacaccggaaggaataataccttcaatgttcgagcccgaaagagaaaaagtggacgcaatagacggagaatatcgtctacgaggagaagcccgcaaaaccttcgttgacttaatgagaagaggggacttaccagtttggttagcttaccgagttgcagcggaagggataaattatgcagatcggaggtggtgcttcgacggtataaaaaataaccaaatactggaggaaaacgtagaagttgagatctggactaaagaaggcgaacgtaaaaaactaaaaccacgatggttggatgcacgaatttatagcgatcctctagcactcaaagaatttaaggaattcgcggcaggcaggaaatctctcacattaaacctcataaccgaaatgggcagattaccaacctttatgacccagaaagcaagagatgccctagataatcttgctgtacttcacacggcggaagcaggcgggagggcttataaccacgctttatcagagctgcccgagactctcgagacactattacttctaacactactcgctacagttaccggaggcatttttttgtttctaatgagtggtaaaggaattggtaaaatgacgcttggaatgtgttgcataatcactgcatcaatccttctttggtatgcgcagatacaaccccattggattgccgcgagcataatccttgaatttttcttaatagtcctattaattccagaacccgaaaaacagcgtactcctcaagacaatcaattaacttatgtcgttatagcaatcctcactgtggttgctgcaacaatggccaatgaaatgggattcttggaaaagaccaagaaagacttgggattagggtcaataacaacacaagagtcagaaagcaacattcttgacatagatctccgtccggcatccgcttggaccctatacgctgtagctacgacattcgtaacacctatgctgcgtcatagtatcgaaaactcgagcgtgaacgtaagtttgacagcgatagctaatcaggcaacggtactaatgggtttggggaaaggctggccactcagcaagatggatattggggtgcctttactcgccataggatgttacagtcaagtgaatcccataacactaactgcagccctcctattattagtcgcgcattatgcgataatagggccgggattgcaagctaaagccacaagagaagcacaaaaacgtgctgcagctggcataatgaaaaatcctacagtagatggaattacagtaatagacctagaaccaatcccatatgatccgaagttcgagaagcaactaggccaagtcatgttactaatactttgtgttactcaggtcttgatgatgagaacaacttgggcattatgcgaagcattaactttggcgacgggaccaatctcgactctttgggaggggaaccctggtagattctggaatacaactattgcagtgtctatggccaatatattcaggggctcctacctagcaggtgcaggtctgctttttagtatcatgaaaaatactaccaatacaagacgaggtacgggaaatataggagaaacattaggagaaaaatggaaatctagactgaacgctctaggcaaatcagaattccagatatacaaaaaaagcggaatacaagaggtagacaggaccttagcgaaggaagggattaaaaggggagaaactgatcaccatgccgtttcaaggggatcagcaaaacttcgctggtttgttgaaagaaacatggttaccccagagggtaaagttgtagatctaggttgtgggcgaggaggttggtcgtattattgcggaggattaaagaatgtcagagaagtaaaaggactcactaaaggcggcccaggacacgaagagccaatacccatgtcgacgtatggatggaatttagtgcgattacaatcaggcgtagatgtgttttttaccccgccggaaaaatgcgataccctattatgcgatattggggaatcctcaccaaatcctacaatagaagcgggaagaacattaagagttctcaacttggtggagaactggttaaacaacaacacccaattttgtataaaagtattaaacccatacatgccaagcgttattgaaaagatggaaacgctgcagaggaaatatgggggggccctagttagaaatcctttaagccgaaattcgacacatgaaatgtactgggtgagtaacgctacaggaaatatagtaagttcagttaatatgatctctagaatgttaataaatagattcacaatgaaacacaagaaagcgacgtatgaaccggacgttgatcttggatctggaacgagaaatatcggtattgagtcagagattcctaacttggatattataggcaaacgtattgaaaaaatcaagcaagaacatgaaacaagctggcactacgatcaagaccacccatataagacatgggcatatcatggaagctatgaaacaaagcaaaccggcagtgcctcgtccatggtaaacggagttgtaagattgcttacaaaaccatgggatgtggttcctatggtaacacagatggctatgacagacactactccgttcggtcaacagcgagtgtttaaggaaaaagtagatacgagaacccaagaacctaaggaaggtactaaaaaactaatgaaaattaccgcggaatggctttggaaagaacttgggaaaaaaaagacgcctagaatgtgcacaagagaggaattcacaaggaaggtacgcagcaacgctgctcttggagcaatatttacagatgagaataagtggaagtcagcgagagaagcggtagaagattccagattttgggagctaatagaccgtgagagaaatcttcatttagaaggaaaatgcgaaacctgcgtatacaatatgatgggaaaaagagaaaaaaaattgggcgaatttggaaaagcaaagggatcaagagcaatttggtatatgtggttaggtgccaggtttctagaatttgaagcactaggttttttaaacgaagaccattggttttcaagaggaaactcattaagtggagtagagggggagggcctccacagactcggatacatattaagggatgtcagcaaaaaggagggtggcgccatgtacgctgacgataccgcaggatgggatacaagaataaccttagaagacttaaaaaacgaggagatggtaacgaatcacatgaaaggagaacataaaaaactagccgaagcaatatttaaattaacttatcaaaataaagttgtaagagtacaacgcccgactcctcgagggacggtcatggatataataagccgccgagatcaaagaggtagcggacaagtaggaacctacggtctcaatacgttcaccaatatggaagcccaactcattcgccaaatggaaggcgaaggtatatttaaatcgatacaacatctgactgtaacagaagaaatcgctgtccaaaattggctggcacgggtaggtcgagagagattatcaaggatggcgatatccggtgatgattgcgttgtgaaacccttagacgatagattcgctagcgcgcttactgcccttaatgacatgggtaaagtcagaaaggacatacaacaatgggagcctagccgaggctggaatgattggacccaggtaccattttgctctcaccattttcatgaactagttatgaaggatggcagagtccttgtcgtaccatgtagaaaccaagacgaacttataggacgtgctagaataagccaaggtgcaggatggtcactaaaagagacggcatgtttgggaaaaagttacgcacaaatgtggactttaatgtactttcaccgtagggacctaaggttagctgctaatgctatttgctccgctgtaccaagccactgggtccccacttcaagaaccacatggagtatacatgcaaaacacgagtggatgaccacagaagatatgctcgccgtatggaatcgagtctggatacaagaaaatccgtggatggaagataagactccagtagaaagttgggaagaggtaccctatttgggaaaacgggaagatcaatggtgcggtagcttaataggattaactagcagagcaacgtgggctaaaaatattcaaacagctatcaaccaggttcgatcgttaataggtaacgaagaatataccgattatatgccctctatgaagaggtttcgaagagaagaagaagaagcgggtgttttgtggtaa

SEQ ID NO: 22560 - RNA, 9876 nt, synthetic construct
  misc_feature 1..9876: note = derived and/or modified CDS sequence (opt6) from DENV-2__EU569705__SS-prME
  source 1..9876: mol_type = other RNA
actgctggagtcattataatgctaattccaactgctatggcattccatctcacgacgcgtaatggagaaccacatatgatcgtaggaagacaggaaaaaggaaaatctcttttatttaaaactgaagatggggtgaatatgtgcacacttatggctatagacttgggagaactctgtgaagatactattacgtataaatgtccactcctaaggcagaatgaaccagaagatatagattgttggtgcaattccacatccacatgggttacttatggaacatgtaccacaacaggagaacacaggagagagaaaagatccgtagctctagtaccacacgtgggaatgggactagaaaccagaaccgaaacttggatgtctagtgagggagcttggaaacatgttcaaaggattgaaacttggatactaaggcatccaggctttacaattatggcagcaatcctcgcatacacaataggcacgacacacttccagcgtgcgttaatctttatactattgaccgcagtcgctccatcgatgacgatgcgctgtatagggatatcaaatcgtgattttgtagagggcgtaagtggtggatcatgggtagatatagtacttgaacacggatcatgtgtaacaactatggcgaaaaataaaccgactctcgattttgaactaataaaaaccgaggccaaacagccggcaactctacgaaaatattgcatagaagccaaattaacaaatactactactgaatcaagatgccctactcaaggagaaccttcattgaatgaagaacaagataaaagatttgtttgcaaacatagcatggttgataggggatggggaaatggatgtggactttttgggaagggcggcatagtaacatgcgctatgttcacgtgtaagaaaaacatggaaggaaaagtagttttacccgaaaatctggagtatacgatagtcatcacaccacattcaggggaagaacatgctgtcggtaatgacaccggtaaacatggaaaagaaataaaaattacacctcaatcatccattacggaggctgaactcacaggatacgggaccgtcactatggagtgttcgccacggactggactagactttaacgaaatggtattattacagatggaagacaaagcgtggttagtacatagacagtggttcttagatttgcctcttccttggcttcctggagcggacacacaaggatccaactggattcagaaagaaaccctggtgacatttaaaaatccacacgctaagaaacaagacgttgtcgtattggggagtcaagaaggtgccatgcacacagcattaactggagctacagaaatacaaatgtcgagtggcaacctgttatttaccggtcacctcaaatgtcggttaagaatggataaattacaattaaaaggtatgtcttatagtatgtgtactggtaaattcaaaatcgtaaaagaaattgcagaaacacaacatggaaccatcgtgataagggttcaatatgaaggagatggctctccttgtaaaattccttttgagattatggatttagagaaaagacatgtgctgggaagactaataacagttaatccgatagtcgcagaaaaagactcaccagtaaatatagaagcggaaccaccatttggcgactcctatattattatcggagtggaacccggtcaattaaaattaaattggttcaagaaaggttcatcaataggtcagatgttcgaaaccactatgcgtggggcgaaacgaatggcgattctaggagacacagcgtgggatttcggcagcttgggtggagtatttacctcaatcggaaaagcgctacaccaggtgtttggagccatctatggtgctgcattctctggagtaagctggacaatgaagatcttaataggggtaatcattacgtggattggaatgaactccagaagcacttctttatcggtgtccctagtgctcgtcggagtcgtaactttatatttaggagcaatggtgcaggcagatagtgggtgcgtagtaagttggaaatcaaaggaacttaaatgtggctctggaatctttataacagataatgtgcatacatggaccgagcagtataaattccagccagaatcacccagcaaactagcatccgcgatacagaaagcgcacgaagagggtatatgcggtatacgtagtgttaccaggctcgaaaatttaatgtggaaacagataacaccggaattgaaccatattttgtcggaaaacgaggtaaagttaacaataatgacgggggacattaaaggtatcatgcaagcaggaaaaagatctctaaggccccaaccaaccgaactaaaatatagttggaagacctgggggaaggctaaaatgttatcgacagaatcacataaccaaacatttctgatcgatggtccggagacagccgagtgccccaacacaaacagagcatggaactctttagaagttgaggactacggattcggtgtattcactacgaatatatggctaaagttaagagagaaacaggatgtgttttgtgacagtaaacttatgtcagccgccataaaagataaccgagctgtgcatgccgatatgggttattggattgagagcgcgttaaatgacacctggaagatggaaaaggcttcatttatagaagtaaagagctgtcattggccgaagagtcatacgctctggagcaatggagtattagaaagtgagatgatcatacctaaaaatttcgctggaccagtaagtcaacataactaccggccagggtatcatactcaaacagcaggaccgtggcatttgggcaaactagaaatggacttcgatttttgtgaaggtactacagtcgtagttactgaggactgtggtaataggggtcctagtttacgaaccactactgcttcggggaaactaataacagaatggtgttgtcgaagttgcaccttacctcctctaagataccggggcgaagatggatgttggtatggtatggaaattagacctcttaaagagaaggaagaaaatttggttaactcattagtgacggccggtcacggccaaattgataacttctctctgggtgtattaggaatggcgttatttttggaagaaatgcttcgtacacgagttggcaccaaacacgcaatgctattagttgcagtgtcttttgtgactcttatcaccggaaatatgtcgttcagagatctgggacgcgtaatggtcatggttggagctacaatgacagatgacataggaatgggtataacttacttggccctactagccgcttttaaagttcgtccgacttttgcggcgggcttattgttacggaaattgacatccaaggagttaatgatggcgacgatcggcatagccctactaagtcagtcaacaattccagagacgattctagaattaaccgatgccttagcattaggaatgatggttctaaaaatcgtaagaaatatggaaaaatatcagcttgcagttacgataatggcgatcagctgcgtgcccaatgctgttattttacaaaatgcgtggaaagtatcgtgcacaatacttgccgccgtatcagtaagtcctctcttattgacgagtagccaacagaaagcagattggattccattggcgttaacgataaaaggtttgaatcccacagctatattcctaacaacgttgagccgaaccagtaaaaagcgatcatggcctttaaatgaggccataatggcggtaggcatggtttcgatcctagcaagctcattacttaaaaatgatataccaatgacagggcccctagtcgctggagggttattgacggtgtgttacgtcttaacagggcgatccgcggacttagaattagaaagagcggctgatgttaaatgggaagaccaagcggaaatctcaggtagttcaccgatactcagtataacaatatcagaagatggttcgatgagcattaaaaatgaagaagaagaacaaacccttacaatactcatacgcacaggattattagtaatttcaggggtgttccctgtatcaattcccataactgcggcagcctggtatctttgggaggttaagaaacaaagggcaggggttttatgggatgtgccttcccctcccccagtaggaaaggcagaattagaggacggggcataccgtataaagcaaaggggaatcctgggctattctcaaataggagctggagtatataaagaaggtacttttcacacaatgtggcatgtcacgcgaggggctgtgttaatgcatagaggaaagagaattgaaccaagctgggccgatgtcaaaaaggacctcatctcatacggaggaggttggaaattagaaggggaatggaaagaaggagaagaagtccaggtattggcattagaacccgggaaaaatccccgagcagtacaaacaaaaccagggttgtttaagactaacacggggacaataggagctgtcagcctcgattttagtccaggaacctcaggatcgcccatcgtggatagaaaaggcaaagttgtcggtttatacggaaacggtgttgtaactagatcaggagcgtatgtttcagctattgcgcaaaccgagaagagtattgaggataatcctgaaatagaggatgatatatttcggaagaaaaggctaacaattatggaccttcaccctggagcggggaaaacaaaacggtacctacccgcaatagtaagagaggcaattaaacgaggtctaagaacattgatactagcaccgactcgcgtggtagcggctgagatggaggaagcactaagaggtctacccataagataccagacgccagcaattagagcagaacatacgggaagagaaattgtagatctgatgtgccacgcaacattcacgatgaggttgctaagccccgttagagttcccaattataatttaatcataatggatgaagcccactttacagacccggcatccatagctgctagaggatatatatcgaccagggttgagatgggtgaagccgcagggattttcatgacagctacccctccaggcagccgagacccattcccgcaatcgaacgcccccataatggacgaggagcgtgagatacccgaacgatcctggaactctggacatgaatgggttacggattttaaaggcaaaacagtgtggttcgttccatcgattaaagcaggcaatgacatcgcggcttgcctacgtaaaaatggaaagaaagtcattcaacttagcaggaaaacattcgatagcgaatatgttaagacccgagctaatgattgggattttgtagttacaactgacataagtgaaatgggtgccaactttaaggcggaaagggtaatagatcctaggcgatgtatgaaacccgtgatcctcactgatggcgaggaacgtgtgatattggctggaccaatgcctgtaacccactcgagtgctgctcaaaggagaggaagaattggacgaaatcctaaaaacgaaaatgatcagtacatatatatgggggaacccttagagaatgatgaggattgcgctcattggaaagaggccaaaatgcttctggacaatattaacacacctgaaggaatcattccctcaatgtttgaaccagaacgagaaaaagtagatgctatagacggagagtatagacttcgaggtgaagcacgaaaaacttttgtagatctaatgaggagaggcgatttaccagtctggctcgcatacagagttgcggccgaaggtataaattatgcagacagacgttggtgctttgacggtattaaaaataatcaaatactagaggaaaatgttgaagtggagatatggacaaaagaaggagaaaggaagaaattaaaaccgcgctggcttgacgcgcgaatctatagtgatccgttagccctaaaagagttcaaagaatttgctgccggaagaaaaagtttaacgctaaatctaataaccgagatgggaagacttcctactttcatgactcagaaagctagagatgccctagataatttggctgtgcttcatactgcagaagctggtgggcgcgcatataaccatgcattatcagaactgccagagacactggaaacgttgttattacttactctactagcaactgtcacaggtggcatattcttatttttaatgagcggaaaaggcatcggaaaaatgactttgggaatgtgttgtatcataaccgcatcaattctcctatggtatgctcagattcaaccacattggatagcagcaagcattatactagaatttttcttaatagtacttctaataccagaaccagaaaaacaaagaaccccacaagataatcaattaacatatgtagtaatcgctattttaacagtagtagcagccactatggcaaacgaaatggggttcctggagaaaaccaagaaagacttaggattaggcagtattgcgacacaagagtcagagtctaacattctagatatcgatttaagaccagcatctgcatggacgttatatgccgtagctacaacgttcgtcacgcctatgttgaggcacagtatagaaaattcatcagttaatgtctccttgacggccatcgcgaatcaagcgacagttttaatgggtctaggaaaaggttggccactctcaaaaatggatataggcgtcccattattagcgatcggatgttactcacaagttaatccaataacactcacagcagcacttttattgttggtggcccactacgctattatcggccccggtctacaagccaaagcaacccgtgaagcgcaaaaacgtgcggcagccggaatcatgaaaaatccaactgtagacggcataacggtgatagatttggagcctatcccgtatgatccaaaatttgaaaaacaacttggtcaagttatgcttttaatattatgtgtgactcaagtgttaatgatgagaacaacatgggccctctgtgaagcgctgacactagcaacaggtcctatttcaacattatgggaagggaatccagggcgtttctggaatacgaccatagcagtatctatggcaaatatattcagaggatcttatcttgctggtgccggcttattattctctataatgaaaaatacaacaaatacgcgtagaggaacaggcaacataggagaaactttgggggaaaagtggaaatctagactcaatgcattaggaaaaagcgagttccaaatctataaaaagagtggcatccaagaagtagatagaacgcttgcgaaagaagggataaaaaggggagaaaccgaccatcatgcagttagtagaggcagcgcgaaacttagatggttcgttgagaggaatatggtgacccccgaaggtaaagtagtggacttaggctgtggacgtggaggttggtcatattactgtggcggattgaaaaacgtacgcgaagtaaaaggtttgactaaagggggtcctggacatgaagaaccgataccaatgtcaacatatggctggaacttagttagacttcaaagtggggtagacgtatttttcacccctccagaaaaatgcgacaccctattatgtgacatcggcgaaagtagtccgaacccaaccattgaagctggtaggactttgagagtgcttaacctagtagagaattggctgaataataatactcaattctgcataaaagtattaaacccctacatgccttctgtcatcgaaaagatggagacactccagcgaaagtacggtggtgctctagtaaggaatcctttgagcaggaatagtacgcatgagatgtattgggtaagcaatgcgacaggaaatatagtaagcagtgtaaatatgatatcccgtatgttaattaatagattcacaatgaagcacaaaaaggcaacgtacgaacccgatgttgatctaggatcaggtacaaggaacattgtaatcgagtcagaaattccaaatttagatatcataggaaaacgaatagagaaaataaaacaagaacatgagacctcatggcactacgaccaagatcacccatacaaaacttgggcataccacggaagctatgaaacaaaacaaacaggtagtgctagctcaatggttaatggggtagttagactgttgacaaaaccctgggacgtcgttccaatggttacccagatggctatgactgacaccacacctttcggacagcagcgggtttttaaagaaaaagttgacacgagaacccaggaacccaaggaaggaaccaagaaattgatgaaaataactgcagagtggttgtggaaggaattaggtaagaagaaaacaccgagaatgtgcacgcgcgaagaatttaccagaaaggttcggtctaatgctgccttaggagcaattttcacggatgaaaataaatggaaatcagctcgagaggccgtagaggactcaagattttgggaactaattgatagagaacggaatttacatttagaaggaaaatgtgagacatgtgtatataacatgatgggaaaacgtgaaaagaaattaggcgaatttggaaaagccaaaggcagcagggccatatggtacatgtggcttggggcgcgatttctggagttcgaagctcttggttttctcaatgaagaccattggtttagtaggggaaactcactctctggagtggaaggtgaaggactccacagactggggtatattcttcgcgatgtcagcaaaaaggaagggggagcaatgtacgccgatgacactgccggatgggacactaggatcactcttgaggaccttaaaaatgaagagatggtaactaatcatatgaaaggcgagcataagaaactagccgaggcaatattcaaacttacgtatcaaaataaagtggtaagagtacaaagaccaacccctcgcggcaccgttatggatataatatctcgaagagatcagagagggtcaggccaagtaggcacatatggcctcaatacattcacaaacatggaggctcaattaatacgacagatggaaggagaaggaatttttaagagcattcagcacttaacagtcaccgaagaaatagcagtccaaaactggctagcaagagtcggacgtgaacgactatctcgaatggcaatttcaggtgatgattgtgttgtaaaaccccttgacgaccgattcgcatcggcgttaacggctttaaatgacatgggcaaagtgcgtaaagatattcaacaatgggaaccgtcgcgtggctggaacgattggactcaagtccccttttgtagccaccacttccatgaattagtaatgaaagacggtagagttttagttgttccatgtcgaaatcaagatgaattaataggtagggcaagaatttcacaaggcgcgggctggagtttaaaagaaactgcatgcttgggcaaaagttatgctcagatgtggacacttatgtattttcaccgtagggatctgagactcgctgccaatgcgatctgctcagctgtaccatcccattgggtacctaccagcagaaccacttggtctatacacgcaaagcatgaatggatgacaacggaagatatgttagcagtatggaaccgggtatggatacaagaaaatccctggatggaggataagactccagttgaaagctgggaagaagtcccctatctcggcaaaagagaagatcagtggtgcggcagcttaatcggattaacaagtagagcaacatgggccaaaaacatacagacggcgatcaatcaggttcgaagccttattggtaacgaggaatatactgattatatgccgtcgatgaaaaggtttcgaagagaagaggaggaagcgggagttttatggtaa

SEQ ID NO: 22561 - RNA, 9876 nt, synthetic construct
  misc_feature 1..9876: note = derived and/or modified CDS sequence (opt6) from DENV-2__EU482589__SS-prME
  source 1..9876: mol_type = other RNA
acggcaggagtaataataatgctaataccaacagctatggcatttcacttaacaactcggaacggagaaccacacatgatagttgggcgacaagaaaaaggtaaatcactcctgtttaaaacagaagatggggttaacatgtgtactttaatggcgattgacctaggggaactctgtgaagatacaattacctataaatgcccactactacgtcaaaatgaaccagaagatattgattgttggtgtaattcaacaagtacgtgggttacttatggtacatgtacaacgacgggggaacaccgtagagaaaaacgatcggtagcacttgtccctcatgtcggtatgggattagaaaccagaaccgaaacgtggatgtcctcagagggtgcatggaaacacgtgcaacgaatagaaacctggatattacgacacccaggttttacgataatggctgctatcctcgcgtatactattggaacaacccacttccaacgagctttaatatttatactattaacagctgttgcaccaagtatgactatgcggtgcatcggtatctcaaacagagacttcgtggaaggggtgagcggaggatcgtgggttgacatagttctagaacacggcagttgtgtaacaactatggctaaaaacaaacccacgttagattttgaactcatcaaaacagaagcgaaacaaccagcgacgttacgtaaatattgtattgaagcaaaactgacaaacaccacgactgaatcgaggtgtccaacacaaggagaaccaagtttaaatgaagaacaagataaacgattcgtttgtaaacatagtatggtcgatcgggggtggggaaatggatgtggacttttcgggaaaggcgggatagtaacatgtgcaatgtttacctgcaagaaaaatatggaaggaaaagttgtactaccagaaaatctcgaatatacaatagtaattacaccacatagcggtgaggaacatgccgttggtaatgatacaggaaaacatggtaaagaaataaaaataacgcctcaatcctctattaccgaagcagagttgacgggctacggaactgtcactatggaatgttctccacgtatgggactagactttaacgaaatggtcttattacaaatggaagataaagcatggctggtgcataggcaatggtttttagatctacctttaccatggctcccgggggcagatacgcagggttcaaactggattcaaaaggagactctagtaacattcaaaaaccctcacgccaagaaacaggacgttgtagttcttggtagtcaggagggcgcaatgcataccgcattaaccggtgcaacggaaatccagatgtcctcagggaatctattattcacaggtcatttaaaatgtcgtctccgtatggataaactacagctaaaaggaatgtcatactcaatgtgtacgggaaaatttaagattgtaaaggaaatagcagaaacccaacatggaactattgtaatacgagtccaatatgagggagatggtagcccttgtaaaatacccttcgaaatcatggaccttgagaaacgacatgtattaggacgactgataacagtaaacccgatcgtcacagaaaaagacagtcctgtaaacattgaggcagagcctccgtttggggactcttatataataattggagtcgagccgggacagttgaaactcaattggttcaagaagggtagctctattggccagatgtttgagactactatgagaggggccaaaagaatggcaatactaggcgatactgcctgggactttggcagtttgggcggcgttttcacaagtatcggtaaagcactacatcaggtattcggagccatctatggggcagccttttcaggagttagctggactatgaaaattctaattggagtcataattacctggatcggaatgaacagccgaagtactagcttatctgtttcgttagtacttgtgggtgtagttactttatacctgggtgcaatggtccaggctgacagcggctgtgtagttagctggaaatcaaaagaattaaaatgtggcagcggaatattcattactgataatgtacatacgtggaccgaacaatacaagtttcagccggaaagcccatcaaagctagcttcggccatccaaaaagcgcatgaggaaggcatttgtggaatacgttcagtaacaagattggaaaacctaatgtggaagcaaattacacccgaattaaatcacatactctccgaaaacgaagtaaaattgacgattatgaccggagatatcaaagggatcatgcaagcagggaagcgcagcttaagacctcagccgaccgaattaaaatacagctggaagacctggggtaaagcaaaaatgttatcaacagagtcccataatcagactttcttaattgacgggcctgaaactgccgagtgtccaaatacaaacagggcatggaacagtctggaagtggaagactacggatttggagtatttacaactaacatttggttgaaattaagagaaaaacaggatgtattttgcgattcaaagctgatgtctgcggcaattaaggataatcgggctgtacacgcggatatgggttactggattgaatctgcacttaatgacacttggaaaatggaaaaagccagctttatagaggtcaaaagttgccattggccaaaatctcatactctatggtctaatggagtactggagtcggaaatgataattcctaaaaatttggcaggacctgtgagccaacacaactataggccaggatatcacacacaaacagcaggcccctggcatctgggtaaacttgaaatggatttcgacttttgtgagggaactacggttgtagtaacagaagattgtgggaatcgaggtccgagtttaagaactacaacagctagtggcaaattagtaactgaatggtgctgtagaagctgtacactaccaccgttaagatatcgtggtgaagacggttgctggtacggcatggagataagacctttaaaagaaaaggaagaaaatctagtaaatagtcttgtgaccgctggtcatgggcaaattgataacttctctctaggtgtattaggtatggcgctgtttttagaagagatgttgaggacacgtgttgggactaaacatgctattctattggtagctgtatcttttgttacacttatcactggtaacatgtccttcagggatttaggacgcgtaatggtgatggttggagcgacaatgacagatgatataggtatgggagtgacttacttagcactattggctgcgtttaaagtaagacccacatttgcagcaggcctactattaaggaagctcacatcgaaagagttaatgatggcaacaattggaattgctctactctctcagagcacaatacctgagaccatactagaattaactgatgcactagcattgggtatgatggttctaaagatagtgagaaacatggaaaagtaccagctagcagttaccatcatggccatctcatgtgttcccaatgctgtgatattacaaaacgcttggaaggtaagctgtacaatacttgcagcagtttcagtatctcccttgctactaacatcatcacaacaaaaagccgactggataccacttgcgcttacaataaaaggattaaacccgacagcaatattcttaacaaccttatcaaggactagcaagaaacgatcctggccgttaaatgaggcaataatggcagtaggtatggtctctatcctagcaagttcactactaaagaatgatatacccatgacgggccccctggttgcaggaggattgctgacggtctgctacgtgctaactggaagaagcgcagatctcgaactggaaagggctgctgatgtaaagtgggaggaccaggctgaaatatcagggtcatctccaatattatcaataacaatcagtgaagacggtagcatgtcaattaaaaatgaggaagaggagcaaaccttaactatattaataaggacaggattactggtgatatccggtgtctttccagtctcgattcccattacagcggcggcgtggtatctgtgggaagtaaagaaacaacgtgcaggcgtgttatgggatgttccaagcccaccaccggtcggtaaggccgagttggaggatggagcatacaggattaaacaaagggggatcctgggttatagtcagataggagctggtgtgtacaaagagggcacttttcatactatgtggcatgtaactagaggagccgttttaatgcatagaggaaaacgcattgaaccatcttgggcagacgtaaagaaagacttaatatcttatggaggtggctggaagctcgaaggtgaatggaaagagggagaagaggttcaagttcttgctctcgagccaggaaagaacccaagagctgtacaaactaaaccaggactcttcaagacaaacactgggactattggcgccgtcagtctggacttttccccaggaactagcggatcccctattgtagacagaaaggggaaggttgtgggattatacggtaatggtgtagtaaccagaagcggagcatacgtatcagcaatagctcaaacagagaaaagcattgaagataacccagaaatcgaagatgatatattcaggaagaaacgactaacgatcatggacctgcacccgggcgctggaaaaactaaaaggtatttacctgctattgtaagggaagcaataaaacgcggcttgcgaacattaattctggcaccaacaagagttgttgcagcagaaatggaagaagctctacgaggattaccaattcgttatcaaacccctgctatcagggcagagcataccggaagagaaattgtcgaccttatgtgtcatgccaccttcacaatgagattattaagccctgttcgtgtacctaactacaacttaataataatggacgaagcacactttaccgatccagcctccatcgcggcccgcggatatatcagtactcgagtagaaatgggtgaagcggcaggtatattcatgacagcaactccaccaggttcaagagatccttttcctcaatccaacgcaccaattatggacgaagagagagaaatacccgaacgcagttggaacagcggacacgaatgggtcacagacttcaagggaaaaactgtatggtttgtgccatcaattaaggcaggtaacgatatagctgcctgtctgcggaaaaacggaaagaaggtaatacagttatcaagaaaaacgtttgatagtgagtatgtaaaaacgcgagctaatgattgggactttgtagtcacaacggatatttctgaaatgggtgcgaattttaaagcagaacgagtaatcgatccacgtcgatgcatgaagcctgtgattctaacagatggagaagaaagggtaattttagcaggaccgatgcccgtaacccactcatcagcggcacaaaggagaggaaggatcggacgaaaccccaaaaacgaaaatgatcaatatatttatatgggagagcctctggagaatgacgaggattgtgcacactggaaggaagcaaagatgctattagacaacataaatacgcctgagggaataataccttcaatgttcgaacctgaaagagaaaaagttgatgcaatagatggagaatatagactacgaggagaggctaggaaaactttcgttgacttaatgaggagaggggacttaccagtatggctcgcataccgagtggctgcagagggtattaactatgctgataggcggtggtgttttgacggcatcaaaaataatcaaatattagaagagaatgtggaagttgagatatggacaaaagaaggagaacggaagaaattaaaaccaagatggttagacgcgcgaatatactcagatcctttagcattaaaagaatttaaagagtttgcagcaggccggaaaagtctaacattaaatctaataacagagatgggacgattaccaacttttatgacacaaaaggcaagaaacgcgttagacaatttggccgttctacacacggctgaggctggaggcagggcgtacaatcacgctttatcggaacttcctgaaacattagaaacacttctgctattaacccttctcgcaacagtcacaggagggatatttctattcttaatgtcgggaaaaggtatcgggaagatgaccttgggaatgtgctgcatcatcactgcgagcatattgttatggtacgcacaaatccaaccacattggatagcggcatctataatattggagtttttcctcattgttctattaataccagaaccagaaaagcaacgaacgccacaagataaccaactgacctatgttgtaatagccatattgactgtagttgccgcaacgatggcaaatgaaatgggatttctggagaaaacaaagaaagatctaggcttggggtcaatcactacacaggaaagtgagtccaatattcttgatatagacctgcggccggcctctgcttggacattatatgccgtcgcgactacctttgttacaccaatgcttaggcattcaattgaaaattcgtctgttaatgtaagtctcaccgcgatagcgaaccaagcaacagtgcttatgggcttaggaaaaggatggccattgagtaaaatggacataggggtaccacttcttgcaataggatgttattctcaagttaatccaattactctaacagctgcactcttactgctagttgctcattatgctataattggaccggggttacaggcgaaagctacacgagaggctcagaaaagagctgcggccggcatcatgaaaaacccaacagtcgatggcataacagtgattgacctagagccaataccatatgatcctaaatttgaaaaacaactaggacaggttatgttgttaattctttgtgtaacgcaagttcttatgatgcgaacaacatgggcattgtgtgaagccctaactttagcaacagggccaatatctaccctctgggaaggaaatccgggtagattttggaataccacaattgccgttagcatggccaatatcttccgtgggtcatacctagccggggcaggcctcttatttagcataatgaaaaatacaactaacactcgaagagggactggaaatataggagaaacattaggagaaaaatggaagtcacgtcttaacgctctaggtaaatcagaatttcaaatctacaaaaagagtggcatacaagaagtagatcgcaccctagctaaggaaggaatcaagagaggcgaaactgatcaccatgcagtctcgcgtggatccgccaaattaaggtggttcgtggaaaggaacatggttaccccggagggtaaagtagtagatctaggatgtggacgaggtggatggagttattattgcggcggtctaaagaacgtacgagaagtaaaaggactaacaaaaggaggtccaggtcatgaagaaccaattcccatgagcacctacggatggaatttagtaaggttacaaagcggagttgatgtattctttacaccccctgagaaatgcgatacgctactttgtgacataggtgagtcttccccgaatccaaccatcgaagccggaagaactttgcgggtactcaatctagtagaaaattggctaaacaataatacacagttctgtatcaaagttctaaacccatatatgccaagtgttattgagaaaatggaaacattgcagagaaaatatggaggggcattagttagaaacccgctctcgagaaattcgacccatgaaatgtattgggttagtaatgctactggtaacatcgtctcgtccgtaaatatgataagcagaatgttaattaataggtttacaatgaaacacaagaaagctacatatgaaccagatgttgacttaggtagcggaacgaggaatataggaatagaatccgagataccgaatttagacatcattggcaaaagaatagaaaagataaaacaggaacatgaaacgagctggcattatgaccaagatcatccatacaaaacttgggcttaccacggctcctatgaaaccaaacaaactggttcggcctccagtatggtcaacggggtcgttagactattaacgaaaccctgggacgtagtaccgatggttacacagatggcgatgactgatacaaccccgtttggtcaacaaagggtcttcaaagaaaaagttgatacacgaacacaagaacctaaggaaggtaccaagaaactaatgaagataactgccgaatggttgtggaaggaattgggaaaggagaaaacacctcgaatgtgcacaagagaagaatttacgagaaaagtgcgctcaaatgcagctctaggagccatatttaccgatgaaaacaaatggaaatctgctagagaagccgtagaagatagtagattttgggaactaatcgatcgcgaaagaaatttacacttagaaggaaaatgtgaaacttgcgtatataatatgatggggaaaagagagaagaaactaggtgaatttgggaaagcgaagggaagtcgggccatatggtatatgtggctaggagcacgatttttagagttcgaagctcttggctttttaaatgaagaccactggtttagtagggaaaatagtctatccggtgtagaaggtgaaggattacatagattaggctacatcttaagagatgtgtctaagaaagaaggaggagccatgtatgcggatgatactgcagggtgggacactaggataacattagaagacctgaaaaacgaagaaatggttacaaaccatatgaaaggtgaacataaaaagctagctgaagctatatttaaattaacgtaccagaataaagtcgtacgggtccaaaggcccacccctagagggacagtcatggatataatatctcgaagagatcaaagaggcagtggacaagttggaacttatggactgaatacgtttactaacatggaggcacaattgatcagacaaatggaaggcgagggaatattcaagtctatacagcacctcaccgcaacagaagaaatagcagtacaaaattggttggcaagagtgggcagagaacgcctcagcagaatggcaatatcgggagatgactgtgtagtaaagcctctagatgatagatttgcatcagctctaacggccttaaacgatatgggaaaagttagaaaagatatacaacagtgggagccttccaggggttggaacgattggacccaagtaccattttgttcccatcactttcacgagttagttatgaaagacggccgggtattagtagtcccttgccgaaatcaagatgaactaattggaagggcgcgaatctctcaaggggcgggttggtctctgaaagagacagcttgtttagggaaaagctacgcgcaaatgtggaccttaatgtatttccaccggcgcgacctcaggttagcagccaatgcaatatgctcagcggtacctagccactgggtaccgacttcccggaccacatggtcaatacatgcgaaacatgaatggatgacaacagaggatatgctagcagtatggaatagggtttggattcaagaaaatccatggatggaggataaaacaccggtcgaaagttgggaagaagtaccatacttgggcaaacgagaagatcaatggtgtggctctctaataggattaaccagcagggcaacttgggccaaaaacatccaaacagcgataaaccaggtacgctctcttatagggaacgaagagtatacagactacatgccgagcatgaaacgatttagacgcgaagaagaagaagcaggagtcctatggtga

SEQ ID NO: 22562 - RNA, 9876 nt, synthetic construct
  misc_feature 1..9876: note = derived and/or modified CDS sequence (opt6) from DENV-2__EU569706__SS-prME
  source 1..9876: mol_type = other RNA
acagcaggagtaataattatgttgattccaaccgcaatggcgtttcacttaacgacaaggaatggagaacctcatatgatagttggtcggcaagaaaaaggaaaatcactgctatttaaaacggaagatggtgtaaatatgtgtaccctaatggcaattgatcttggagaactatgtgaagatacaataacctacaaatgcccattgttacgacaaaatgaacctgaagatattgattgctggtgcaactctacaagcacatgggtcacatatggaacttgtaccacaactggggaacacagacgagagaaaagaagcgtagcgctagtacctcacgtgggtatgggtctagaaacgcggaccgaaacatggatgtctagcgaaggagcatggaaacatgttcagagaatagaaacatggatccttcgacacccaggatttaccatcatggctgcaattctggcatacaccatagggactacccacttccaaagagcgcttatatttatattgttgacggctgtggctccaagcatgacgatgaggtgtataggaatatcaaatagagacttcgtggaaggagtatcaggaggatcatgggttgacatagtacttgaacacggaagttgcgtgacgaccatggctaaaaataaacccactctagatttcgaactgataaaaactgaagcaaaacaacccgcaacgttaagaaaatattgcatagaagcaaaactaactaacacgacgaccgaatcaaggtgtcccacgcagggcgaaccttcattgaatgaagaacaggacaaaaggttcatttgtaaacatagtatggttgaccgaggctggggaaacgggtgtggacttttcggtaaaggcgggatagttacttgcgcaatgtttacatgtaaaaagaacatggaaggaaaagtagttctaccagaaaaccttgaatatacaatagtaatcacaccgcattccggggaagaacatgccgtagggaacgacactgggaaacatgggaaagaaataaaaataacaccacagagcagtataacagaagctgaactgactggatatggaacagttacaatggaatgtagcccaagaacaggcctagattttaatgaaatggttctattacaaatggaagacaaagcatggcttgttcatagacaatggttcttagatcttcccttaccttggttgcccggagctgacactcaaggatccaactggattcaaaaagagacacttgtcacatttaaaaatccacatgccaagaaacaggatgttgtagttttaggatcgcaagagggtgcaatgcacaccgctctaacaggagcgacggaaatccaaatgagttcgggtaatctattatttacgggacatttaaaatgtcgtttaagaatggataaattacaattaaagggcatgagttattcaatgtgtacaggaaaattcaaaatcgtgaaagaaattgcagaaacacaacacggtactatagtcatccgagtccaatatgagggtgatggaagcccgtgcaaaataccttttgaaatcatggatttagaaaaacggcacgtgctaggtagattaataacggtcaaccctatcgtggcagaaaaagatagtccggttaacatagaagcagaaccaccgttcggagacagttacattataataggggtcgaaccaggacagcttaaactaaactggttcaaaaaggggtcaagcatcggacaaatgttcgaaacgactatgcgaggagcaaagcgcatggccatattaggtgatactgcgtgggacttcggttcgctaggcggagtttttacaagtatcgggaaggcgctacatcaagtgtttggcgccatttatggggcagcatttagcggagtcagctggaccatgaaaatcttgatcggagtcattatcacgtggataggaatgaactctaggagcaccagcctatcagtttctttagtcctagttggagtcgtaacactttatctaggtgtgatggtacaagcagactccggctgtgtagtatcatggaaaaacaaagaactgaagtgcgggtcaggaatatttataacagacaatgtacatacttggacagaacaatacaagtttcagccagagtcaccgtcgaagctggcgagcgctatccagaaagcgcacgaggaaggaatatgcggtataagaagcgtaactagattggagaatttaatgtggaagcaaattacaccagagttgaatcatatattatcagaaaacgaggtgaaacttacgataatgactggcgatatcaaaggcataatgcaggcagggaaaaggagtcttagaccacaacctacagaattaaagtattcatggaagacatggggtaaagctaagatgctatcgaccgaaagccataaccaaacttttctaattgacgggccagagactgccgaatgtcctaacacaaatagagcctggaacagccttgaagttgaggactacggattcggagttttctctacaaacatatggctcaaattaagagaaaaacaagacgtattttgtgattctaaactgatgtcagctgcaatcaaggataaccgtgcagtacatgctgatatggggtattggatagaaagcgctttaaatgatacatggaaaatggaaaaagcatcttttattgaggtaaaatcctgtcattggcctaaatcacatacactttggagcaacggagtactagagagtgaaatgataatacccaagaattttgctgggcctgtatcacaacataattatcgaccaggataccatacgcagacagcaggaccctggcatttaggtaagttagagatggatttcgacttctgcgaagggactaccgtagtagtcacagaagattgtggcaatagggggccatcattgagaactaccactgcgtctggaaagttgataacagaatggtgctgcagatcgtgtaccctgccgccattacgctatcgtggggaggatggatgttggtacggtatggaaatccgcccgttaaaagaaaaagaagagaatctggtgaacagcttagttacagcaggtcatgggcaaatagataattttagtctcggagtactaggcatggcgcttttcttggaagagatgctcagaacgcgtgtcggaacaaaacatgcaatcttattagtagcagtgagttttgttacgctaataaccggaaatatgtccttccgggatttaggaagggtaatggtcatggtaggtgcaacaatgaccgacgacataggtatgggtgttacctacttagctttacttgcagcttttaaggtacggcctacctttgcagcaggccttctcctacgcaaattaacatcaaaagaactaatgatggctactattggaattgcattattaagtcaaagtactatcccagagacaatactagaactcacagacgcgctggccctaggtatgatggtactaaagatagtaaggaatcttgaaaaataccaactggcggtcacaataatggctatatcatgcgtcccaaatgcagtaatacttcaaaacgcttggaaagtgagttgcacgatcttggcagcagttagtgtatcgccactgttgttaacaagctcacaacaaaaagcagattggattccactagccttgaccataaagggtctcaaccccacagcaatatttctgacgactttgtcccgaacttcgaagaagagaagctggccattaaatgaagccgttatggccgtcggcatggtatctatactggctagtagcctattaaagaacgatattcctatgactggacctctggtagctggtgggctacttacagtgtgctacgtactcacaggacgaagcgccgatctagaactcgaaagagcagcagacgtgaagtgggaagatcaggctgaaatctcaggatcaagcccaattttaagcataaccataagtgaggatggttcgatgtccattaagaatgaggaagaagaacaaacgttgacgatattgatacggacaggtctattagtgatttctggtgtattccccgtatctataccaatcactgcagcagcctggtatctgtgggaggtaaagaaacaaagagcaggcgtcttatgggatgttccatcaccacctcccgtcggcaaagcggagttagaggacggagcttacaggattaaacaacgcggcattttcggatatagccagatcggtgcaggggtttacaaagagggaacattccatacaatgtggcatgtcacaagaggcgcggttttaatgcataggggtaagcgtatagaaccatcttgggcagacgttaaaaaggatctgataagttacggagggggatggaagttagaaggagaatggaaggagggcgaagaagttcaagttttggcattggaacccggcaaaaaccccagagcagtacaaacaaaacctggtctgttcaaaacaaacacgggtacaataggggcagtcagccttgatttctcaccagggacttctgggagtccaatagttgatcgcaaagggaaagttgtgggtttatacggaaacggagtagtcacgcgttcaggcgcatatgtgtcagctatagcacaaaccgaaaaatctatagaagataatccggaaattgaagatgacatattcaggaagaaaaggcttacgatcatggatttacacccgggcgctggaaagactaagcgatatctaccagcgatagtcagagaagcaatcaagagaggacttagaacattaatattagccccaacacgagtagtcgcagcagaaatggaagaggcattacggggactaccaataaggtaccagacgccggccatacgagcagaacatactggaagagagatagtagatctaatgtgtcatgcgacatttacaatgagacttttgtcgccagtaagagtgccaaattacaacctgataataatggatgaagcccacttcacagatccggccagtatagcagcgcgtggatatatatccaccagagtcgaaatgggagaagcggcaggaatctttatgaccgcaactccaccaggaagtcgcgacccttttcctcaaagcaacgcgccaattatggatgaagaaagggaaataccggaacgaagctggaactccggacacgagtgggtaacagacttcaaggggaaaacggtctggtttgttccatctataaaagcgggaaatgacattgctgcttgcttgaggaagaacggtaagaaagtaatccagctatcaagaaaaacttttgattcggaatatgtcaaaaccagggcgaatgattgggacttcgtcgttacaacagatataagtgaaatgggggcgaactttagggcggaacgcgtaatagacccgcgtcgttgcatgaaaccggttatacttacggacggagaagaacgagtaatacttgcaggtcccatgccagtgacacacagttctgcagcccaacgaagaggcaggattgggcgcaaccccaaaaatgaaaatgaccaatacatatatatgggagaacctttagaaaatgatgaagattgcgctcactggaaggaggccaaaatgttattagacaacatcaacacaccggaaggaataataccatccatgtttgaaccggagcgagagaaggttgatgcgatcgatggagagtaccgactccgcggggaagctagaaaaacatttgtagatttaatgcggcgtggcgacttaccggtatggctcgcataccgagtagcagccgagggaattaattacgcggatcgtaggtggtgctttgacggaatcaaaaacaatcaaatactagaagaaaatgttgaagtcgagatatggacaaaagaaggtgaaagaaagaaattaaagccccgatggcttgatgcacgaatatacagtgaccctctagcacttaaggagttcaaagaatttgcagcaggaaggaaaagtttgacgttaaatctcataactgaaatgggacgacttcctacattcatgacccaaaaggccagggatgcacttgataacctggctgttctacatacagcagaagtaggcggaagggcttacaaccatgcactctcagagctgccagaaacgcttgaaactttgttactactcactctcttagccactgttactggaggaatattcctctttctcatgagtggtaaaggtataggtaaaatgactttaggtatgtgctgcataatcacagcatcaatacttttgtggtatgctcagatacaaccccattggatagcagcttcaatcatattagagttctttctaatcgtccttcttatacctgaaccagagaagcaacgtactccgcaggataatcaactaacatatgtagtcatcgccatcctcacagttgtagcggctactatggctaatgagatgggcttcctagagaaaaccaagaaagatctcggattgggctctataactactcaagaatcagaatcaaatattttagacattgatttaagaccggcttcagcttggaccctatatgcagtagccacgaccttcgtaacaccgatgcttagacatagtatagaaaattctagcgtgaacgtatcactcacagctattgcaaatcaagctacggttctcatgggactgggaagggggtggccgctcagtaaaatggatattggcgtaccactattagctataggttgctatagtcaagtaaatccaataacattaacagccgcactcttgcttcttgtggcgcattacgcaattataggaccaggactgcaggcgaaagcaacaagagaggctcagaagagagccgcagcaggaattatgaaaaacccgacagttgatgggataacagtaattgatcttgaaccaataccatacgacccgaaatttgaaaaacaactaggacaggtaatgttattagtgttatgtgtaacacaggtgttaatgatgcgtacgacatgggcattatgtgaagccttaactttagcaaccggccctatcagcactttatgggaaggaaatcccggacgcttctggaacacaacgatagcggtttcaatggcaaatatcttccgtggatcgtatttagcaggagctggccttctattttccataatgaaaaatacaacaaatacacgtcgaggcacaggtaacataggggaaactttaggcgaaaaatggaaatctagactaaacgctttgggtaaaagcgagttccagatatacaaaaagagtggcattcaagaagtcgaccggacgttagccaaagaaggtataaaacgaggtgaaaccgatcatcatgcagtgagtcggggaagtgcgaaactaagatggtttgtggaacgtaatatggtaactcccgaaggaaaggtagttgacttaggttgtggtagagggggatggtcatattactgtggaggactcaaaaatgtgagagaagtgaaggggttgacaaagggagggcccggacacgaagaacctatacctatgtccacttatggatggaatttggtccgattacaatcaggagtggatgtattctttacaccgccagagaaatgtgacacattgctatgtgacattggcgaaagcagtccaaaccctacaatagaagctggcagaaccctcagagttctaaacttggtggaaaactggcttaacaacaatacccagttttgtattaaggtcttaaatccatacatgccaagcgtaatagaaaagatggagactctgcagcgtaaatatggaggggccctagtccgaaatccattgtctagaaattcaacgcacgagatgtattgggtttcaaatgcaactggcaatatagtgtcctcggtaaacatgatttcaagaatgttaataaatcggtttaccatgaagcataagaaagcgacttacgagccagatgtagacctcggttcggggacaagaaacataggtatcgaaaatgaaatacctaacttagacataataggcaaacgcattgagaaaataaaacaagaacacgaaacatcttggcattatgaccaagaccatccgtataaaacatgggcgtatcatggaagctacgaaactaaacaaactggctcggcatcatcgatggtcaatggagtcgtgagattactaactaaaccatgggacgttgttcctatggtaacgcagatggcaatgactgacaccactccctttgggcaacaacgggtatttaaggaaaaagtagatacgagaactcaagaacccaaagaaggaacaaagaaactcatgaggataacagcagaatggctatggaaagaattgggcaaaaagaaaactccacgtatgtgcacacgagaggaatttacacgtaaagtaaggtctaacgcagcactaggagctatatttacagatgaaaataaatggaagtcggcacgcgaggctgtcgaagattccagattttgggagctagtagacagggaaaggaacttgcatctagaggggaaatgtgaaacatgtgtttacaatatgatgggaaagagagagaagaaattgggtgagttcggtaaagcaaaagggagtagggcaatatggtatatgtggctaggagcacgattcctggagttcgaggcgttaggatttctaaacgaagatcattggttttctcgaggcaacagtttgtctggagtagaaggtgaagggctgcacaaactaggctatatcttgagagatgtcagcaagaaagaaggaggtgcaatgtatgcagacgacacagcgggatgggatacaagaattacactagaagacctcaaaaatgaagaaatggtgactaatcatatgaaaggtgaacacaagaaactggccgaagcgatatttaaacttacatatcaaaacaaggttgtgagggttcaacgaccaaccccaagaggaactgtaatggacataattagcagaaaagaccaaagaggtagtggacaagtgggaacatatggtttaaacacatttacaaacatggaggcacaactcattcgacagatggaaggtgaaggtatattcaaatctatccaacacctgacagtaaccgaagagattgctgtccaaaattggctggcacgagtaggccgtgaaaggttgagccgtatggcgatatcaggcgatgactgcgttgtaaaaccattggatgacagattcgcctctgctctaacagcattaaacgatatgggcaaagtcagaaaagatatacagcaatgggaaccctccaggggctggaacgattggacacaagtacctttttgcagtcatcattttcacgaacttgtcatgaaggacggtagagtattagtggtaccatgtcgtaaccaggacgaacttataggccgagcgaggatctctcaaggtgccggatggtcgctgaaagaaacagcctgtctaggtaaaagctatgcgcaaatgtggactctgatgtatttccacagaagagatcttaggttagcagctaatgcaatatgttcagcagtaccaagtcattgggtcccgacgtcgcggaccacatggagtatacatgctaaacatgaatggatgacaacagaagatatgttagccgtttggaacagagtatggatacaagaaaatccgtggatggaagacaaaacaccagtagaaagctgggaagaagtaccttatcttggcaagcgagaagatcaatggtgtggatcacttatagggctgacatcaagggcgacatgggctaaaaatattcaaacggcaattaatcaagtacgctcgctgattggaaatgaagaatatactgactacatgcctagtatgaagagatttcggaaagaagaggaggaagccggtgtactgtggtaa

SEQ ID NO: 22563 - RNA, 9876 nt, synthetic construct
  misc_feature 1..9876: note = derived and/or modified CDS sequence (opt6) from DENV-2__EU569707__SS-prME
  source 1..9876: mol_type = other RNA
actgcaggagtaataatcatgctaatccctactgcgatggcattccacctcacaaccagaaatggtgaacctcacatgatagtaggaagacaagaaaaaggaaaatcattactttttaaaactgaagatggagtgaatatgtgtactctgatggcaatcgacttaggggaactttgcgaagatacgataacgtataaatgtcctcttttgcgccagaatgaacccgaagacatcgattgttggtgtaactctacctctacatgggtaacctacggtacttgtacaaccacgggggaacaccgacgcgagaaaagatctgttgcgctggttccccatgtaggcatgggcttggaaacaagaacggaaacctggatgtctagcgaaggagcatggaaacatgtacagcgcattgaaacatggatcctaagacatccagggtttacgataatggcagcaatactcgcttatacaataggaacaacacattttcagagggcgcttatctttatcttactaacggctgtcgctcccagcatgacaatgcgatgcattgggatatctaatagagatttcgttgaaggagtttctggaggatcatgggtagacatagtcttggaacatggtagttgtgtgacaaccatggccaaaaataaacccaccttggacttcgagttgatcaaaaccgaggctaaacagccagccacccttaggaaatattgtgtagaggcaaaactgaccaacacaacaaccgaaagtcgttgccctacgcaaggtgagccgtcgttgaacgaagaacaagacaaaagatttgtgtgtaaacattctatggtggaccgaggatggggcaacggttgcggccttttcggaaaaggtggaattgttacatgtgcaatgtttacttgtaagaaaaatatggagggtaaagtcgtgcttccagagaatctagaatatactatagtaatcactccacactcaggagaagaacatgctgttggcaatgatacagggaaacacggaaaagaaattaaaatcacaccacaaagttctataaccgaggcagagttaacaggttacggaactgtcactatggaatgttcaccacgtacgggacttgactttaacgaaatggtgttgttaagaatggaagataaagcatggttagttcacagacagtggttccttgatttgcccttaccatggttgcccggcgcagacactcaaggtagcaattggattcagaaagaaacattagtaacttttaaaaatccacatgctaagaaacaagacgttgtagtactaggtagtcaggaaggagcaatgcacacagcacttaccggagctactgagatccaaatgagctcgggaaatctgctattcactggacatttgaaatgtagattaagaatggataaactccaactcaaaggaatgtcctattcgatgtgcactggaaaatttaagatcgtaaaggaaattgccgagactcagcacggtacaattgttatacgtgtgcaatatgaaggggacggtagcccttgcaagatacccttcgagataatggatctagaaaaacgtcacgtgttgggacgccttattacagtaaaccctatagttgcagaaaaagattcacctgtaaatatagaagcggagccacccttcggtgattcatatataattataggagtcgagcctgggcaattgaaattgaactggttcaagaagggatcctccatcggacaaatgtttgaaactacaatgagaggagcaaaaagaatggccatactaggtgatacagcgtgggattttggcagtctaggaggagtgtttactagcattggtaaggctctgcatcaagtatttggcgcaatttatggtgcagcattttcaggggtaagttggactatgaaaattctaatcggggtcattattacctggatcggcatgaacagcagaagtacgtcactaagcgtcagtctcgtcttagtaggagttgttacactataccttggagcaatggtacaggccgattcggggtgcgtcgtatcctggaaaagcaaagagcttaaatgcggttctggaatttttattacagataatgttcacacgtggaccgaacaatataagtttcaacctgaaagtccaagtaaactggcaagtgcgatacaaaaagcacacgaggaaggaatttgtgggataagatccgtaacacgattagaaaatttaatgtggaaacaaattactccagaattaaaccatatacttagcgaaaatgaagttaaattgaccattatgacgggggacataaaaggcataatgcaagcgggaaaaagatcattaaggccacaaccaaccgaactcaaatattcatggaaaacgtggggaaaagcaaaaatgctgtctacggaatcacacaatcagacattccttatagacggaccggagactgcagaatgtcccaacacaaatcgggcgtggaactctctcgaggtagaagattatgggttcggagtttttaccacgaatatatggcttaaactcagagaaaaacaagatgtattctgtgatagcaaactgatgagtgctgctataaaagataacagagcggtacatgccgacatgggatactggatagaaagcgctctgaatgatacttggaaaatggaaaaggcttcgttcatagaagtaaaatcgtgccactggcctaagagtcatacactttggagtaatggggtactcgagtccgaaatgatcatacctaaaaactttgcagggccagttagtcagcataactatagaccaggatatcatacgcaaactgcaggaccatggcatttaggaaaattagaaatggacttcgacttctgcgaagggactacagttgtagtcacggaagattgtgggaaccgtggccctagtctaagaactacaaccgcatcaggaaaattaataacggaatggtgttgtagaagctgtacactgccaccactacggtatcgaggagaagatggatgttggtatgggatggaaataagacccttgaaagagaaggaagaaaatttagtaaactctctagtaacagctggtcatggtcagattgataacttctcattgggggtactaggaatggctcttttcctagaagaaatgctaagaacaagggtaggtactaaacatgcaatgttgcttgtggccgtctctttcgttacattaattaccggtaacatgtcatttagggacctagggagagtaatggtaatggtaggtgccacaatgacagacgatataggaatgggaataacatacctagcactactagcagcatttaaagtaagaccaacattcgcagccgggctactgttacgaaaattaacaagcaaagaattgatgatggctacgataggaatagcactattaagccagtcaacaattccggaaacgattcttgaactcacagatgcattagcgctgggaatgatggtattaaaaatcgtgagaaatatggagaaatatcaattggccgttacaatcatggcgatatcctgtgtacctaatgccgtaatattacagaatgcgtggaaagtttcttgtaccatattagcagcagtcagcgtaagccctttactactgacgtcatctcaacagaaggcagattggatccccctagcattaactataaaaggattgaatccgacggcgatatttttgaccactttatctagaacaagtaagaaaaggtcgtggcccttaaatgaagcaataatggcagtagggatggttagcatactagctagctcgctcttaaagaatgatattcctatgacaggaccacttgtagctggaggtcttctgaccgtgtgctacgtacttactgggcgaagcgcagacctagaattagaaagggcagccgacgtaaaatgggaagaccaagcagagatttccggaagttcaccaattctatccataacgatctcggaagacgggagtatgtcaatcaaaaacgaggaagaagaacagacactaactattctaataagaacaggactacttgtcatatctggtgtatttccagtctcaataccaataacggcagcagcctggtacctgtgggaagtcaagaaacaacgagcgggcgttctttgggacgttccttcaccacctccagtaggcaaggctgaacttgaagatggagcatatcgcatcaagcaaagaggaatactaggttatagccagattggagcgggagtttacaaagaaggcacgtttcataccatgtggcacgtaacaagaggagctgtactcatgcatcgaggaaaaagaattgagccaagttgggctgatgtcaagaaagatctcatatcctacggaggagggtggaaactcgaaggtgaatggaaagaaggggaagaagtacaagtgctagctttggagcccggcaagaacccacgagcggtacagacgaaacccggtctatttaaaactaatacaggaacgatcggagcagtatcattagatttcagccccggcacctcagggtctccaatagtggataggaaagggaaagtggtagggctttacggaaacggagtcgtaactagaagtggagcatacgtgagcgctattgcacaaacggaaaagtctatagaggacaatccagaaattgaggacgacatattccgaaagaaaagattgacaataatggatctccatccaggtgctggtaaaacaaaaagatatcttccagcaatcgtgcgggaggcaatcaagcgaggactgagaacactaatacttgcaccaactagagtggtagctgcagaaatggaagaggcgttaagagggctaccaatacggtatcaaacgcccgcaatacgagctgaacataccggtcgggaaatagtcgatttaatgtgtcatgcgacattcacaatgagactactatcaccagtaagagtgccaaattacaacttgataataatggatgaagctcacttcacagaccctgcgtccatcgcggcgcgtggctatatcagcactagagttgaaatgggcgaagccgcaggcatatttatgacagccacaccacccggatctagagatccattcccacagagtaacgcgccaataatggatgaagaacgagaaattcctgagaggagctggaactcgggacacgaatgggtaacagactttaaaggaaagacagtatggttcgtcccttcaatcaaagccggtaacgacatcgcagcctgcctcaggaaaaatggcaagaaagtaatacaactgtcgcgaaaaacatttgattcagaatacgtaaaaactagagccaatgattgggactttgtagttaccactgacataagcgagatgggagctaatttcaaagctgaacgtgtcatcgatcctagacgatgcatgaaacccgtaatcctaacagacggcgaggaaagagttatactagccggacccatgccagtcactcatagcagtgctgcccagagaagaggacgaataggacgtaaccctaagaatgaaaatgatcagtacatctacatgggtgagcctctagaaaacgacgaagattgtgctcactggaaagaagccaaaatgttgcttgataatattaatactcctgaagggattataccaagtatgtttgagcctgaacgagagaaagtagacgcaattgacggagaatatcgacttcgtggagaagcacgaaagacatttgtagatctcatgaggcgaggtgaccttcccgtatggttagcgtacagagttgcagcagaagggatcaactacgccgatagaagatggtgttttgatggaattaaaaataaccaaatattagaagaaaacgttgaagttgagatctggactaaagaaggtgagcggaagaaactcaaaccacgatggcttgatgcacgaatctacagcgatcctttagcactaaaagaatttaaagaatttgcggccggtagaaaatcccttacactcaatttgatcacggaaatgggaagactccctacatttatgacgcagaaggcgagagatgcacttgacaatctagctgtcctacatacagcagaagccggaggtagagcgtataaccatgcattgtcagagttaccggaaacattggagacactcttgctactaacccttttggcaactgtaactggaggaatttttctctttctcatgtcaggtaaaggcataggaaaaatgacattaggtatgtgttgtataatcacagcaagcatacttttgtggtacgctcagatacaaccacattggatcgcggcttctataattttagagttctttttaattgtacttttgatacccgaacctgaaaagcaacgcactccgcaagacaatcaattaacctacgtagtaattgctatactaacagtcgttgcggccaccatggcaaacgaaatgggttttcttgagaaaacgaagaaagatttggggttgggttcaatagcgactcaagaatcggaaagcaatatcttggacattgacttaagacccgcatcggcatggactctctacgcagtagctacgacatttgtaacacctatgttaagacattcaatagaaaactcaagcgttaatgtgtcattgacggctatcgcgaatcaagctactgttcttatggggcttggaaaagggtggcctctttcaaaaatggatattggagtgcccctcctagcaatcggctgttacagtcaggtaaatcccataacgctaacagccgcattactcctcttagtagcacactacgccataataggacctggtttacaagctaaggcgactagagaagctcagaaacgggcagcagctggcatcatgaaaaatccaaccgtcgacggaattacagtgatcgatctagaacctatcccgtatgatcccaaattcgagaaacaattaggacaagtaatgttgttaatactatgcgttacccaagtcttaatgatgcgaacgacctgggcgctgtgtgaagcattaacactggcaacgggaccaatatcgactctttgggaaggtaatccgggtagattctggaacactacaattgcggtctcaatggcaaatatttttcgaggttcatacttagctggagcaggactgctatttagcatcatgaaaaacacaacaaatacccgacgaggaaccgggaatataggcgaaacattaggggaaaagtggaagagtcggttaaacgcattaggaaaatcagagtttcagatttacaagaaaagtggaatacaagaagtagaccgcacgttagcaaaagagggtataaaaagaggagaaacagaccatcacgcggtatcacgtggctctgcaaaattgcgatggtttgtggaacgcaacatggtaactccagaaggcaaagtagtggaccttggttgtggaaggggaggatggagttattattgcggtgggctcaagaacgtacgcgaagtaaaaggtttaacaaagggaggacccggccacgaggaacctattccaatgtcaacatatggatggaacctggtacgtcttcaaagcggcgtagatgtattctttaccccaccagaaaaatgcgatacattactatgcgatataggagaaagtagccccaacccgacgatcgaagctggcagaactcttcgtgttttgaacctggtagagaactggctcaacaacaatacccaattttgtatcaaggtcttaaacccttacatgcccagtgtaatagagaaaatggaaacactgcagcggaaatatggcggtgccctagtacgcaatcccctgtcaagaaattctacacatgaaatgtattgggtttcaaatgcaacaggaaacatcgtcagctcggtcaatatgatttcaagaatgttaatcaatcgcttcacaatgaagcataagaaagcgacctacgaaccagatgtcgacttaggaagcgggacaagaaatattgggatagaaagcgaaataccaaatctagacatcataggaaaaagaatagagaaaataaaacaagaacatgaaacaagctggcattatgaccaggatcatccgtacaaaacgtgggcgtaccatggttcctatgaaaccaaacagacaggatcagcgagttcgatggttaatggcgtagttcgacttctgacgaaaccatgggacgtcgtaccaatggtaacacaaatggcaatgacagatacaactcctttcggacagcaaagagtatttaaagaaaaagtagatacgcgaacacaagaacctaaagagggtactaagaaattaatgaagattactgcggaatggctatggaaagagttagggaaaaagaaaacgcctcgtatgtgcacaagagaagaatttacaagaaaagtacgaagtaacgcagcactaggtgctattttcaccgatgagaacaaatggaaatctgctagagaagctgttgaggattcgcgtttttgggaactcattgacagagaaagaaatttacatttagaaggaaaatgtgaaacatgcgtatataatatgatgggaaagagggaaaagaagctgggagaatttggaaaagcaaaagggagtcgcgcgatatggtatatgtggttaggagccaggtttttagagtttgaagcattaggcttcctcaatgaggatcactggttttcgcgcggtaatagcttatctggtgtcgaaggtgaagggttacaccgcctaggttatatattaagagacgtaagcaaaaaggaaggcggagctatgtatgctgatgatactgctggatgggacaccagaataacacttgaagatttaaagaatgaagaaatggtaactaatcacatgaagggagagcacaagaaattagcagaagcgatttttaagctaacgtaccaaaacaaggttgttcgagtgcaacgaccaacgccgagaggcactgtaatggatatcatatcgagaagggaccaaagaggaagtggccaagttggaacatacggcctaaatacttttactaatatggaagcccaattaatcaggcagatggagggagaagggattttcaaatcgattcaacatttaaccgtcacagaagagatagcagtgcaaaattggttagcacgcgtcgggcgagaaaggctttccaggatggcaatatctggggacgattgcgtagttaaaccactagatgatagattcgcaagtgcactaaccgccctcaacgacatgggaaaagtgaggaaggatatacaacagtgggaaccctcacgaggatggaacgattggacacaagttccattctgctctcatcattttcatgaactcgttatgaaagacggacgagtattagttgttccgtgtagaaatcaagacgagcttataggccgtgcaagaatttcccaaggagcaggatggtcgcttaaagaaacagcctgcctaggaaaaagttatgcacagatgtggacactcatgtatttccatcgtagagatcttcgactagccgctaatgcaatctgttctgctgttccttctcactgggtacctacaagccgtaccacatggagtattcatgcgaagcacgaatggatgaccacagaggatatgttagcagtttggaatagggtatggatacaggaaaatccatggatggaagataaaacgccagttgagagttgggaggaggtaccgtatctaggaaaacgcgaagaccaatggtgtggatcacttataggcttgacaagtcgcgcgacgtgggctaagaatatacaaactgcaataaaccaagttaggtcgctcatcgggaacgaggaatatacagattacatgccatctatgaagagattcagaagggaagaagaagaagcaggcgtgctttggtaa

SEQ ID NO: 22564 - RNA, 9876 nt, synthetic construct
  misc_feature 1..9876: note = derived and/or modified CDS sequence (opt6) from DENV-2__EU660399__SS-prME
  source 1..9876: mol_type = other RNA
acagctggagtaataataatgttaataccaacagcaatggcttttcatttaacaacaaggaatggagaaccacatatgatcgtaggaagacaagaaaaaggaaaaagtctactatttaaaacggaagatggtgttaatatgtgtactttgatggcaatagatttaggagaattatgcgaagatacaataacatataaatgccctctactacggcagaatgaaccagaagacatcgattgttggtgcaactccacgtcaacatgggtaacatacggtacatgtacaaccactggagaacacagaagagagaaaagatctgtagctctagtaccacacgtaggaatgggattagaaacacgaacagaaacatggatgtcgtctgaaggggcctggaaacacgttcaacgaattgaaacatggatactgagacatcctggattcactattatggcagcgatcttagcatacacaattggaacaacccattttcaaagagcattgatcttcatcttattaaccgctgtggctccatcgatgactatgagatgtattgggatatctaatcgcgacttcgttgagggtgtaagtggagggtcctgggtggatatagttctagaacacgggtcctgtgtaacaacaatggcgaaaaacaaaccaacactggatttcgagttaattaaaactgaagcaaaacaacctgcaacgttgagaaaatattgcatagaggccaaactaacgaacacaacaacagaaagtcgatgtccaacacaaggagagccaagtctgaacgaggaacaagataaaagattcgtatgtaaacacagtatggtagataggggatggggtaatggatgtggattatttggaaaaggtggaatagtaacgtgcgcaatgtttacatgcaaaaagaatatggaggggaaagttgtattaccagaaaatttagagtacacaatcgttataacacctcattcaggagaagaacatgctgttggaaacgacacagggaaacacggtaaagaaataaaaataacgccgcaaagcagtatcactgaggcagagctcactgggtacgggacagtcactatggaatgttctccaaggacggggttggattttaacgagatggtattattacaaatggaagacaaggcttggttagttcatagacagtggttcctagatcttcccctaccatggcttccgggtgcagatacgcaagggtccaattggattcaaaaagaaaccttggtcacatttaaaaacccacacgccaaaaagcaagatgtagttgtactaggatcccaagaaggagcaatgcacacagcgttaaccggcgccacagaaattcaaatgagttccggaaatctattattcaccgggcatttgaaatgtagactacgcatggataaacttcagctaaagggaatgagttactcaatgtgtaccggtaaattcaaaatcgtaaaagagatcgcagaaacgcaacatggtacgattgttataagggtccaatacgaaggagacggatccccgtgtaagatccctttcgagatcatggatctcgaaaagagacacgttctcggacgtcttataactgttaaccccattgtagcggaaaaggactcgccagttaatatagaggcggaaccaccgttcggggactcatacataattatcggcgtcgagcccggccaattaaagttgaattggtttaagaagggtagttctatagggcaaatgtttgagacgacaatgaggggcgcgaaacgaatggcaatcctaggtgacacagcatgggactttggtagcttaggcggagttttcacgtctataggcaaagcattgcatcaagtatttggagccatatatggagcagccttttcgggcgtcagttggaccatgaaaatattaataggtgtaataataacatggataggtatgaatagcaggtcaacgtccctcagcgtatctctagtgcttgtaggcgtagtaacattgtatctaggagcaatggtacaagcggattcaggatgcgtagtctcttggaaatctaaggaactaaagtgcggttctggaatatttataacagacaacgtccacacgtggacagaacaatacaaatttcaacccgaatcgccatcgaaattggctagcgcaatccaaaaagctcacgaagaaggaatttgtggtattcggtctgtcacaagactagagaacctaatgtggaaacaaataactcctgagttaaatcacatccttagcgaaaatgaagtaaagctaaccataatgactggggacataaaagggataatgcaagcaggaaagaggtctcttcggccacaacccactgaactcaaatattcgtggaaaacttggggaaaagctaaaatgctatccaccgaatcccataatcaaacgtttcttattgatggaccagaaactgcagaatgtcccaacactaatagagcgtggaactctctggaagtggaagattacgggtttggagttttcacgaccaacatatggttaaaactccgcgagaaacaggatgttttctgcgattcgaaactaatgtccgcagcaataaaagataatagagctgtgcacgctgatatgggttactggattgagtccgcgttaaatgatacgtggaagatggaaaaagcaagttttatagaggtaaagagttgtcattggcccaagagccacacactctggtcgaatggagtgctagaaagtgagatgattattccaaagaattttgcgggcccagtgagtcagcataactacagaccgggctatcatacacaaactgcaggtccgtggcatctagggaaactagaaatggatttcgatttctgtgaagggacaacggtagtagttacagaagattgcggtaatcgggggccgtctcttcgcacgaccactgcatccggcaaattaataacagagtggtgttgtagatcttgcactttaccaccactgcgctacagaggtgaggacggttgctggtatggtatggaaatccgcccgcttaaagaaaaggaggaaaatctagtgaatagtctcgtgacagcagggcatggacaaatagataatttctcgttaggagtcctaggaatggcattgttcttggaggaaatgctaagaacaagagttggtactaaacacgcgatgttgcttgtagctgtctccttcgtgaccctcataacaggtaatatgagttttagagacctcggccgtgttatggtgatggttggtgcaaccatgacggatgacatcgggatggggataacatacttagcactcctagcagcttttaaggtaagacccacttttgctgcggggttactgcttcgaaaattaacttcgaaagagctaatgatggcaacgattggaatagcactcctaagtcaatcgacaataccagaaacaattctcgaactcacagacgctctcgcattaggcatgatggttctaaaaatagtacgaaatatggaaaaatatcaactcgcagttaccataatggctatatcatgtgttccaaacgcggtaatacttcaaaacgcctggaaagttagttgcacaatacttgcagcagtgtcggtatctcctctgttactgactagctcacagcaaaaagcggactggatacctctagctctcaccataaaaggtttaaacccgacagcaatatttctaacaacattatcacgtacatccaagaaacgatcttggccattaaatgaagccgtcatggcagttggtatggtaagtatcctagcatctagtctcctcaaaaatgatatacctatgacggggccacttgtcgcgggtgggttattaacagtttgttatgtcctgacagggagaagtgccgacttagaattggagcgcgctgccgatgtaaaatgggaagatcaggcagaaatatcagggtcctctcctatattgtctataacgatatccgaggacgggtcaatgagcatcaaaaatgaagaagaagaacaaactcttacaatattgattagaactggtcttttggtcatctccggcgtatttccggtctctatacccattactgcggcagcctggtacctatgggaggttaaaaagcaacgggctggtgtcttatgggatgtgccctcccctccaccggtaggaaaggcagaactagaagacggagcatacagaataaaacaaaggggcattttgggatatagccaaattggtgccggcgtatacaaagaaggaacgttccacacgatgtggcacgtaactcgaggtgctgtattaatgcaccgtggtaaaaggatcgaaccaagttgggctgacgttaagaaggatctaatttcatacggtggaggttggaagctagaaggggaatggaaagagggtgaggaagtacaggtgttggctctagaaccgggcaaaaatccacgtgcggtacagacaaaaccagggttgtttaaaacaaatactggtacaatcggtgctgtaagtttagatttttcacccggcacaagtggctcaccaatcgtagatcgacaaggaaaagtcgttggactgtacggcaatggcgtagtgacacgaagcggcgcatatgtaagcgcaatagctcaaacagagaaaagtatcgaggataatcccgaaatagaagacgacatattcaggaagaaaaggttaactataatggacctacaccctggagcaggaaagactaaaaagtatttacccgctatagtcagagaagctattaaaagaggacttagaacactgatattagctcctacacgggtggtggccgcggaaatggaagaagctctgagaggactacctataaggtatcaaacaccagccataagagctgagcacactgggagagaaatagtagacttgatgtgccatgctacattcacaatgcgtttactttctcctgtccgtgttccaaattataatctgataatcatggacgaagctcattttacagatcctgcgagtatcgcagcaagaggatacatttctactcgagtagaaatgggggaggcagcgggtatatttatgacagctactcctccagggagcagggatccctttccccaatctaacgcgcccatcatggatgaggagagggagataccggaaagatcatggaactcaggtcacgagtgggttacggatttcaaagggaaaaccgtgtggtttgtcccgagtattaaagcaggaaatgacatagcagcatgcttacggaaaaacggcaagaaagttatacaactatcaagaaagacttttgatagtgagtacgtcaagacaagagcaaatgattgggatttcgtggtcacaacagatatatccgaaatgggcgccaatttcaaagcggagagagtgatagatccccggaggtgcatgaaacctgtaatattaacagacggcgaagaacgagtcatactcgcaggcccaatgcctgttactcacagttcagcagcgcaacgaagggggcgtataggaaggaaccccaaaaatgaaaatgatcaatacatatatatgggtgaacctttggaaaacgatgaagattgcgcgcattggaaagaagctaaaatgttacttgacaacataaatacacccgaaggaattattccttcaatgttcgaaccggagcgtgagaaggtggacgccattgatggtgaatacagattacgtggagaagcgcgcaaaacattcgtcgacttaatgcgtagaggtgacttacccgtttggttagcctacagggttgcagccgagggaatcaattatgcagatcgaaggtggtgctttgatggaattaaaaataatcaaatccttgaggaaaacgttgaagtcgagatctggacgaaggaaggcgaacggaagaaacttaagcccagatggttggatgccagaatatatagtgatccgctcgctctaaaagagtttaaggaatttgcagcaggtcgaaagagcctaaccttaaatttaatcacagaaatgggaagactacctacatttatgacccaaaaagcacgagatgcgctagataatttagcagtgttgcacactgcagaagcagggggaagggcgtataatcatgccttgtcggaattaccagaaactttagaaactttattactattaacgttgctcgctacagtaacaggtggaatcttcctattcttgatgagtggaaaaggtataggaaaaatgacactaggtatgtgttgtatcataaccgctagcattcttctttggtacgcacaaatacaacctcactggatcgcagcctctataatactagagttctttctcattgttttgttgataccggaaccagaaaagcagaggacaccacaggataatcaattgacttacgtggttatagcgattcttactgtagtagcagcgacgatggcaaatgaaatgggatttctagagaaaaccaagaaagaccttggtttaggatcaatagctacacaagaaagtgaatctaacatactagatatcgatttgcgtccagcatcggcatggaccttgtacgcagtcgcaactacatttgtcacacctatgttaagacacagcatagaaaatagctctgtaaatgttagtctaactgccatagcaaaccaagcaaccgttttaatggggttaggaaaaggatggccactaagtaagatggacattggtgttccacttttggcgataggatgttattcacaagtcaatccaatcacacttaccgcagcactattgttgttagttgcccactacgcaataataggacccggcctacaggccaaagcaactcgagaagctcaaaagagagctgcagctggtattatgaaaaaccctacagttgacggaatcaccgtaatagatctcgagccgataccgtacgatccgaaattcgaaaaacaactggggcaggtaatgcttctgatattgtgcgtaacacaagtacttatgatgagaacaacctgggccctgtgtgaggcactgactctcgctacaggaccgataagtaccttatgggaagggaatcctggaagattctggaacactacaattgcggtgagtatggcgaacatatttcgaggatcctacctagctggagctggattactattctctattatgaaaaacacgacaaacactagacgaggtacgggcaatataggagagacactgggtgaaaaatggaaaagccgattgaacgcgctaggcaagagcgagtttcaaatatataagaaatcagggatacaagaagttgacaggactctagctaaagaaggaattaaacgtggcgagactgatcaccatgcggtttcaagagggtcagcaaagttaaggtggttcgtagagagaaacatggtaacgccggagggaaaagtagtggacttaggttgcggaagagggggttggtcatactattgcgggggtctcaaaaatgtaagggaagtgaaaggactgaccaaaggaggacctggtcacgaagaaccgatacctatgagcacttatggctggaatttagtaagactacagtcaggagttgacgtgttctttacaccacctgaaaagtgcgatacactcctatgcgatattggtgagagtagtccgaatccaacaattgaagctggaaggacgctcagagttttaaatctagtagaaaactggcttaataacaacacccaattttgcattaaagtattaaacccctacatgccaagcgtaatagagaaaatggagacattacaaagaaaatacggaggggcattagtacgcaatccgttatcaagaaactcgactcatgaaatgtactgggtaagtaatgcaactggaaatatcgtaagctcagttaacatgatatcacgtatgttaataaacagatttaccatgaaacacaaaaaggcaacttacgaaccagacgtggatctcgggagtggaactagaaatataggtatagaatcagaaattccaaatttagatataattggtaaacgtatagaaaagatcaagcaagaacacgaaacgtcttggcattatgaccaagaccatccatataaaacctgggcataccatggaagttacgaaacgaagcaaacgggatcagcctcatctatggtgaatggagtcgtccgattattaacaaagccttgggacgttgtcccaatggtgacccaaatggcgatgacagataccactccttttgggcaacaaagggttttcaaggaaaaagtagacaccaggacacaagaaccgaaagaaggtaccaagaaactaatgaaaattacagctgaatggttatggaaagaattgggcaagaagaaaacaccaaggatgtgtacccgagaggaatttaccagaaaagtaagatcaaatgctgccctaggcgccatcttcacagatgaaaataaatggaaatcagcaagggaagcagttgaagactcaagattctgggaattaatagacagggagaggaatctccacttggaaggaaaatgtgagacatgcgtctacaacatgatgggtaagcgtgagaagaaattaggtgagttcggaaaagcgaaaggaagtagggctatttggtatatgtggctaggcgccagatttctagaatttgaagccttaggatttctaaatgaagaccattggttttccagaggaaattcactctcaggcgtagaaggtgaagggctgcaccgtttaggctatattttgcgtgatgttagtaagaaagagggaggagcaatgtacgcagatgataccgcaggctgggatactagaattacgctggaagaccttaaaaatgaagaaatggttactaatcatatgaaaggagaacacaaaaagttagccgaagcaatatttaaattaacctaccaaaataaagtagtacgagtacaacggccaacaccaagagggacagtaatggatataattagtagacgggaccaaaggggaagtggacaagttggtacgtacggtctaaacacattcacaaatatggaagcccaacttataagacaaatggaaggtgaaggaatattcaagtctattcaacatttaactgtgacagaggaaatcgcggtgcaaaattggctagcacgcgtagggcgagaaagattgtcacggatggcaatatctggtgatgattgtgtagtcaaacccttagatgatcgttttgcgtccgccctgactgccttgaatgatatgggaaaagttaggaaagatatccaacaatgggagccgtcgaggggctggaacgattggacacaggttccattctgtagtcatcatttccacgagctggttatgaaagatggtagagttctcgttgtcccttgtaggaaccaagacgaactgattggacgagcgcgaatatctcaaggagctggatggtcattaaaagaaacagcgtgtctgggaaaaagctatgcgcaaatgtggactttgatgtactttcatcggcgtgatttaagattagctgcaaacgctatatgctctgctgtcccctctcactgggtaccaacatcaaggacaacgtggtcaattcacgctaaacacgaatggatgaccacagaagatatgttagcagtgtggaaccgagtctggatacaagaaaacccatggatggaagacaagacaccagttgaatcatgggaggaggtaccatacctgggaaaacgggaggatcaatggtgtggaagtttaataggcttaacgtcccgtgcaacatgggccaaaaatatccagacagcaataaatcaagtacgttctttaataggaaacgaagaatacactgactatatgccctctatgaaacgatttagacgggaggaggaggaagccggtgttttgtggtga

SEQ ID NO: 22565 - RNA, 9876 nt, synthetic construct
  misc_feature 1..9876: note = derived and/or modified CDS sequence (opt6) from DENV-2__EU569708__SS-prME
  source 1..9876: mol_type = other RNA
actgcaggagtaataatcatgttaattccaactgctatggcgtttcatctaactacccgtaatggagaaccgcacatgatcgttggaagacaagaaaaagggaaaagtctactctttaaaacagaagatggggtgaatatgtgtacacttatggcaattgacttaggagaactatgtgaagatacaataacttataaatgtccattgttgcgacaaaatgaacccgaggatatcgactgctggtgtaatagtacttcgacatgggtaacttacggaacatgtactacaaccggtgaacatcgacgtgagaaaagaagcgtagcattagtgccacatgttggtatgggtctagaaacaagaaccgaaacatggatgtcaagtgaaggtgcctggaaacatgtacaacgtatagagacatggattctcaggcacccgggatttgcaataatggctgctattctagcttataccataggaaccactcattttcagagggcactaatattcatacttcttacggctgtagcaccctctatgactatgagatgtattggaatatccaatcgggattttgttgaaggagtaagcggcggaagttgggttgatatcgttctagaacacggcagttgcgtaactaccatggctaaaaacaaaccaacactggactttgaattaattaaaaccgaagccaaacaacctgctacgctgagaaaatattgtattgaggccaaacttacgaatacaacaaccgagtctagatgcccgacgcaaggtgaaccgtcactgaatgaagaacaggataaaaggttcatatgtaaacactcaatggttgataggggatggggtaacggatgtggtctcttcggaaaaggtggtattgtaacatgcgcgatgtttacctgcaagaaaaatatggaaggaaaagttgtacttccagagaatctggagtatacaattgttattaccccacattctggagaagaacatgcagtaggaaacgatacgggaaaacatggcaaagagataaaaataaccccacaatcctcgattacagaagctgagctcacaggatacggtaccgtaactatggaatgttcccccagaactggactagactttaacgaaatggtgttacttcagatggaggaaaaagcatggctggttcaccggcaatggttccttgatcttcctcttccatggctaccaggagcagatacgcaaggtagcaactggatacagaaagaaaccttggtaactttcaaaaatccccatgcgaagaaacaagatgtggttgtactgggatctcaagaaggcgccatgcatacagctctaacaggagcaactgaaatacaaatgagttcaggaaatctcctctttacaggccatctgaaatgcaggcttaggatggataagctgcaactaaaaggtatgtcctattcaatgtgtacaggcaaatttaaaatagttaaagaaatagcagaaacacaacatggaacaatcgttattagagtacaatacgaaggtgacgggagtccttgcaagattcctttcgagataatggatttagagaaacgccacgtactgggacgattaataacagtgaatcccatagtaactgagaaagacagtccagtgaacatagaagcagaacctccatttggcgatagttacattataataggcgtagagccgggacaattaaaattaaattggttcaagaaaggttctagcattggtcaaatgttcgagacgacaatgaggggagccaagagaatggcaatactgggcgatacagcatgggacttcggaagcctcggtggggtattcacatcaattggcaaagcactccaccaagtattcggtgcaatatatggagcagctttcagtggagtcagttggactatgaaaatacttataggggtgataatcacttggattggaatgaacagtcgttcaacaagtctcagcgtcagcttagttctggtgggtgtggttacattgtatctcggtgcaatggtacaagcagactcagggtgtgtagtgtcctggaagaacaaggaactgaaatgtggaagtggaatatttataacagataatgtacacacttggactgaacagtacaagttccaacccgagtcaccatccaaactagcttctgcaatccaaaaagcacacgaagagggaatatgcggaataagatctgtaactcgtctagaaaacttaatgtggaagcagataacacccgaattgaaccacattctctctgaaaatgaggtgaaattaacaataataacaggagacataaaaggcattatgcaagcaggaaagcgatccttaagacctcaaccaacagaactcaagtattcatggaaaacctgggggaaagccaaaatgttaagtaccgaatcacacaatcaaacatttctaattgacggccctgagacagctgagtgtccgaatacaaatagggcatggaactcactggaggtagaagactacggattcggtgtttttacaacgaatatttggttaaagctgcgcgagaaacaggatgttttctgtgactcaaagttgatgtctgcagcaatcaaagacaaccgagcagttcacgctgacatgggctattggatcgagtcggcacttaatgatacatggaaaatggagaaagcctcattcatcgaagtaaaaagctgtcattggcccaaaagtcacactttatggtctaacggcgttcttgagtcagaaatgatcattcccaaaaattttgcaggaccagttagccaacacaattacagaccggggtaccacacccagactgccgggccatggcaccttggcaaactagaaatggattttgatttctgcgaagggactacagttgtagttacggaagactgtggtaatcgaggaccgtcactaagaaccaccacggcgtccgggaaacttatcactgaatggtgttgccgtagttgtacgttaccgcctttgagataccgtggagaagacggctgctggtacggaatggaaattaggccacttaaagaaaaagaagaaaacctagttaacagtctggtcactgcgggacacggacagattgataatttctcattgggggtactaggcatggcattatttcttgaagaaatgttacgtactagagttggaactaaacatgctattttattggttgccgtttcttttgtcacgctaataacgggaaacatgagtttcagagatctaggcagggtgatggtcatggtgggcgccacaatgacggatgacattgggatgggcgttacgtatctagccctactcgctgcatttaaagtgcggcccacattcgcggctggcctactattaaggaaactgacgagtaaggaactaatgatggcaacaataggaattgcactgttatcgcagtccaccatacccgaaacgatattagaattaacagatgcattagcactcggcatgatggtacttaaaatcgtcagaaatatggaaaagtatcaactagccgtgacaatcatggctatatcatgtgtcccaaacgccgttattctattaaatgcatggaaagtaagttgcactatacttgcagccgtgtcggtttctcctttattattaacaagttctcagcagaaaactgattggatacctctagcattgacaatcaaaggtttaaacccaaccgcgatctttctaaccacgttatctagaacatcaaagaagagatcatggccactaaacgaggcggtgatggcagttggcatggtaagcattctggcatccagcttactaaagaacgacatcccaatgacaggtcccctagtggctgggggcctactgacagtatgttatgtcctgacaggacgtagtgctgaccttgagttagaaagagcagcagatgtaaaatgggaagatcaggctgaaataagtggttcaagtccaatactaagtgtcactatttcagaggatggttctatgtctatcaaaaatgaagaagaagaacaaacattaacaatactcatcagaacaggactcttagtaattagtggagttttcccagtaagcatccccataacagcagcagcatggtatctatgggaagtaaagaaacagagagccggagttttatgggatgtacctagtccaccgccagtaggcaaagccgaactagaggatggcgcgtaccgaataaaacaaagaggaatattagggtattcacaaatcggtgccggagtatataaagagggcacttttcataccatgtggcacgtgacgcggggcgctgtgctaatgcatagagggaagagaatagaacccagttgggctgatgtcaaaaaggatttaatatcttacggcggtggatggaaacttgagggtgaatggaaagaaggcgaggaggtacaagttctagcgctcgaaccaggcaaaaatccgagggcggtacaaacgaaaccaggattatttaaaacaaatacaggcacgataggcgcagttagcttagacttttctcctggaacaagtggtagtccaattgtagatcgtaaaggtaaagtggtcggattatatggtaatggagttgtcacaagatcaggtgcatatgtttcagcaatagcccaaactgagaaatcaattgaggacaatcccgaaattgaagacgacatatttaggaagaaaagattaactataatggatttacatccgggtgctggaaaaacaaaacgttatctccctgctatagtgcgcgaggcaataaaaagaggactaagaacattaattcttgctccaaccagggttgtcgctgcggagatggaggaggcattaaggggattaccaattagatatcaaacaccagccataagagctgaacatactggtagagagattgttgaccttatgtgccatgctacatttacgatgcggctcctttcaccagttagggtccccaactataacttaattataatggacgaagcccactttacagaccctgcaagtatagcagcacgcggatacatatctactcgggtcgaaatgggagaggcagcaggcatatttatgaccgcaacaccacccggcagccgagatcccttccctcagtccaatgcacctataatggacgaagagagagaaattcctgaacgtagttggaacagtggacacgaatgggtgacagatttcaaagggaaaacagtttggttcgttccaagtataaaagcagggaacgatatcgctgcatgtttacgcaaaaacggcaagaaagttatccaattatcgcgaaagaccttcgattcagaatatgtaaaaacccgagcaaacgactgggattttgtagttacaaccgatatatccgagatgggtgctaattttagagcggagcgtgtaatagaccccaggcgctgcatgaagccagtcattttaaccgatggcgaagaaagagtaattctagctgggcctatgccagttactcattctagtgcagctcaacgaagaggccggatcggtcgtaatccgaaaaatgagaatgatcagtatatttacatgggtgagcctttagaaaacgatgaagactgcgcgcattggaaagaagctaaaatgttgctggataacatcaatactccagaaggcataataccttcaatgtttgaaccggaaagggaaaaggtggacgctatagacggcgaatatcgtctacgaggagaggcacgaaaaacatttgttgatcttatgagacgaggagacctaccagtttggcttgcatatagggtagcagccgaaggtattaattatgcagatagacgatggtgttttgatggaattaaaaataaccaaatattagaggagaacgtagaagtagagatatggacgaaagagggcgagcggaagaaactaaaaccaagatggttagatgcgagaatatattcggatcctctcgctttaaaggagttcaaagaatttgctgctggaagaaagagtctaacacttaatttaatcactgaaatgggacgactcccaactttcatgacccagaaagcgcgcgatgctttagacaacttagctgtattacataccgcggaagccggtggcagagcttacaaccacgcattaagcgaactgcccgaaacactagaaacactactcttacttacactacttgcaaccgtgacagggggcatatttctcttcctaatgagtggtaaaggtataggtaaaatgacgctcggaatgtgttgcatcattacagcgtcgatcttattatggtacgctcaaatacaaccccattggatagctgcttcgatcattctagagttcttcttaatcgtactattaatccccgaacctgaaaagcaacggacaccacaagacaaccaattgacctatgtagtcatagctatattaacggtagtcgcagcgactatggcgaacgaaatggggtttcttgagaagacgaagaaggatctcggattgggaagtataaccacgcaagaatcagaaagcaatatactagacatcgacttaaggccagcttcagcatggactctttacgctgtagctacaacattcgtaactcccatgttaagacatagcattgaaaacagttcggtcaatgtgagcctgacagccatcgctaatcaggctactgttttaatgggccttggtaagggttggccattaagcaagatggatattggagtacccctgctggcaattggatgttatagtcaggtaaacccaattacattgaccgcagctctactgttattagttgctcattatgccatcatcggacctggattacaggcgaaggccacaagagaagcacaaaaacgagcagccgcaggtatcatgaaaaacccaacagtcgacggaattacagttatagacctcgaaccaatcccctatgaccccaaattcgaaaaacaactaggacaggttatgctactaatactttgtgtaacgcaagttttgatgatgagaacgacatgggcactatgtgaagcactaaccctcgcgacagggccgatcagcacattatgggaagggaaccctggtcgattctggaatactactatcgcagtaagtatggctaatattttccggggatcttatctagccggtgctggattattattttcaattatgaaaaacacaactaatacgagaagagggacgggcaacatcggagagacgctaggtgagaagtggaagtcacgccttaacgcccttggaaaatccgagttccagatttataaaaagagcggcattcaagaagtagatagaacgttagcaaaagaaggaattaaacgaggggaaaccgaccaccatgcggtatctagaggttctgcaaaactccgttggtttgtggaacggaatatggttactcctgagggtaaagtagttgaccttggctgcggacgaggtggatggtcatactattgtggtggccttaaaaatgttcgcgaagtaaagggattaacgaaaggaggcccaggacatgaagaacctatcccaatgagcacatatggatggaatttagttcgactgcaatccggagtcgatgtattctttacacctccggaaaaatgtgacactttactgtgcgacatcggcgaaagctcgccaaaccccacaatagaggcgggtagaacgttaagggtattaaatctagtagaaaactggttaaacaataatacacagttctgcattaaagtcctgaatccatacatgccatcagtaatcgagaaaatggaaactttacaacgcaaatacggaggagctctagtaagaaaccctttgagcagaaattccactcacgagatgtattgggtttctaatgcgactggtaacatagtaagctcagtgaatatgatctcgagaatgctgattaatagattcactatgaagcataaaaaggcaacatacgaaccagacgttgacctagggagtggcacacgtaacatcgggattgaaagcgaaattccaaaccttgacatcataggaaaaaggattgaacgaattaaacaagagcatgagaccagctggcattacgaccaagatcacccttacaagacatgggcataccacggtagttatgaaactaaacagacagggtctgcaagcagcatggttaacggagtagtaagattactaacaaaaccttgggatgtcgtaccaatggttacccagatggctatgaccgacacaactccattcgggcaacaacgtgtattcaaagagaaagttgatacgcgaacgcaggaaccaaaagaaggcacaaagaaactaatgaggataaccgctgagtggttatggaaagaattaggcaaaaagaaaactccacgaatgtgcactcgtgaagagttcactagaaaagtaagaagcaacgccgcacttggagcagtgttcaccgatgaaaacaagtggaaaagcgctcgtgaggctgtcgaagactctcgattctgggagctagtcgatagagaaaggaacctgcatttagagggtaaatgtgaaacatgcgtttacaacatgatgggaaaaagggagaagaaactaggagaatttggaaaagccaaaggatcacgtgccatatggtatatgtggttgggagctaggttcttagagttcgaagcacttggatttctaaatgaagatcactggttctcgagacggaatagtttgtctggagttgagggggaaggtttacatagattgggatacattcttagagatgtcagcaagaaagagggaggggcgatgtacgcggatgacaccgcgggatgggacactcgaataaccctcgaggatctcaagaatgaagaaatggttacaaaccatatgaagggcgaacataaaaagctcgcagaggccatattcaaactcacctaccagaacaaagtagtaagggtccaacgtcctacaccaagggggactgttatggatattatctctaggcgggaccaacgtggtagcggtcaagtgggtacttatggacttaatacattcacaaatatggaagctcaattaatacgccaaatggaaggtgaaggtatatttaaaagcatacaacacctaacggtcactgaagaaatcgccgtacagaactggctggccagagttggaagagaacgattgtcgaggatggctatctctggggatgactgtgtagtcaagccacttgatgacaggtttgcaagcgcactaacggctcttaacgacatgggcaaagtgagaaaagacattcaacaatgggaaccaagtagaggttggaatgactggacacaagtgccgttttgctcacaccacttccacgaactcgttatgaaagacggtagagttttagttgttccctgccgtaaccaagatgaattaattggccgtgccagaatatcccaaggagcagggtggtcactaaaagaaaccgcttgcctcgggaaatcttatgcacaaatgtggaccttgatgtattttcatcgtagagatttacggttagcggcgaatgccatatgttctgccgtaccctcccactgggtaccaacaagcaggaccacatggagtatacatgccaagcatgagtggatgactacggaggatatgctagcggtttggaatagggtctggatacaagaaaatccatggatggaagacaaaacacccgtagaatcttgggaggaggtcccatatcttggaaaacgagaggatcaatggtgtggtagcttgataggattaacgtccagagctacatgggcgaagaatatacaaaccgcgataaaccaagtaagatcattgattggaaatgaagaatatactgattatatgccctcaatgaaaagattcagacgagaggaagaagaagcgggtgtactctggtag

SEQ ID NO: 22566 - RNA, 9876 nt, synthetic construct
  misc_feature 1..9876: note = derived and/or modified CDS sequence (opt6) from DENV-2__EU569709__SS-prME
  source 1..9876: mol_type = other RNA
acggcaggggttattattatgttgattccaacagctatggcttttcacctaactacgagaaacggagaacctcatatgattgtaggaagacaagaaaaagggaaatcactattatttaaaaccgaagacggtgtaaatatgtgcacattgatggcgatagacctaggagaattatgcgaagatacaattacatataagtgtccgttgttgagacagaatgaacctgaagacattgactgttggtgcaattcgacatcaacctgggttacttacggaacttgtacaacaaccggagaacatagaagagagaaaaggtcagtagcgttagttcctcacgtcggaatgggattagaaacaaggacggaaacatggatgtcctcagaaggggcatggaagcatgtacagcgaatagaaacctggatccttcgacatccaggatttacaataatggctgcaatattagcgtatacaattggaaccacgcacttccaaagggctttaatattcatcctacttacagctgtggcaccttcaatgacgatgagatgtataggaatctctaatcgtgacttcgttgaaggagtttctggcggttcgtgggtagatatagtactggaacatggatcgtgcgtaacaacgatggccaaaaataaaccaacactggatttcgaattgataaaaacagaagctaaacaaccagctaccctacgaaaatattgtatagaagcaaaacttacgaacacaacgacagaatcaagatgccctacacaaggcgaaccgtccttaaacgaagaacaggacaaacgatttatatgtaaacattcaatggtagatcggggttggggtaacggatgtggtttatttggtaaagggggaatagtaacatgtgcaatgtttacttgtaagaaaaacatggaaggaaaagtagtcctcccagaaaacttagaatacacaattgtaataaccccacactcaggagaagaacatgccgtcggtaatgacacaggaaaacatggtaaagaaattaagataactcctcagtcatctattacagaggcggagctaaccggttatggaacagtaactatggaatgctcacctagaacaggcttggatttcaatgaaatggtattattacaaatggaggataaagcatggctagttcatcgccagtggtttttagatcttccattaccatggcttcctggtgcagatactcaaggttcaaactggatacagaaagaaacattagtaacatttaaaaacccccacgccaaaaagcaagatgttgtcgtccttggatcacaagaaggtgcaatgcatacagctttaaccggcgcaacggaaatccaaatgtcgtcgggcaatcttctatttacaggacacttaaagtgtagactacggatggacaagttacaattgaaaggaatgagctattcaatgtgcacaggtaagtttaaaatagttaaagaaatagcagaaacccaacatggaactatagtaataagggtacaatatgaaggagacggaagtccatgcaagatcccattcgaaataatggatttggagaaacggtacgttttagggcgattaattacagtaaaccctattgtcaccgaaaaagattctcctgttaatatagaggccgaacccccttttggagattcatatattattattggtgtcgaaccaggtcaactgaaacttaactggttcaaaaagggaagctcaatcggtcagatgttcgagacaacgatgagaggagcaaaaagaatggcaattttaggggatactgcatgggattttggaagtttaggaggtgtattcacgtcaataggtaaagcattgcatcaagttttcggtgcaatttatggtgcagctttctcaggtgttagttggacgatgaagatattaataggcgtaatcatcacctggataggtatgaatagtcgaagtacgtcattgtctgtatcgttagttcttgtcggcgtagtaactctatatctaggggtaatggtacaagcagatagcggatgtgtagtaagttggaaaaacaaagagctgaagtgcgggtctggtatctttattacggacaatgtacatacatggacagaacaatacaagtttcaaccagaatctcccagtaaattagcctcagcaatacagaaagcacacgaagaaggtatatgtggcatcagaagcgtaacacggcttgaaaacctaatgtggaagcaaataactcccgagcttaatcatattttatccgaaaacgaagtaaaattaaccatcatgactggcgacatcaagggaataatgcaagcaggaaaaagatcacttcgaccgcaacccacagaattaaaatactcatggaagacatggggaaaagcaaagatgttatccacagaaagtcacaatcaaacgtttctgatagatggaccagaaactgctgaatgcccaaacacaaacagggcttggaactctctagaagtcgaggactacggctttggagtcttttctacaaatatatggctaaaattaagagaaaagcaagacgtattctgcgactcaaaacttatgagtgccgcaattaaggacaatagagcagtacatgcggatatggggtattggattgagtctgctttaaacgatacatggaaaatggaaaaagccagctttatcgaggttaaatcatgccactggccaaagagtcacaccctttggagtaacggtgttctcgagtcggaaatgataatacccaaaaactttgcaggtccagtatcccaacacaactacaggccaggttaccacacccaaacagctggtccctggcatttggggaaattagaaatggactttgacttttgcgagggtacaaccgtagtcgtaactgaagactgtggaaaccgtggtccgagcttaagaacaactacagcttccggtaaactcataacagagtggtgttgtcgtagttgtactcttccgcctctacgctacagaggagaggatggctgttggtacggaatggaaattagaccgttaaaagaaaaagaagaaaatttagtaaattccttggtaacagctggccatggtcaaatagacaatttctcattgggcgtactagggatggcactgtttttagaagaaatgttaagaacaagagtgggaactaaacacgctatactactcgtagcagtttcgttcgtcacccttattacaggcaacatgtcgtttagggacctcggacgcgtcatggtgatggtgggtgctacaatgaccgacgatatcggcatgggcgtcacgtacctcgcactgcttgcagctttcaaagtccgacccacttttgcagctggtctcttgctccgcaaattaacttcaaaagaactcatgatggccacgatcggaatagcactactatctcagtcgaccatacctgagacaattctagaattaactgatgcactagcattggggatgatggtcctgaaaatagttcgaaacatggaaaaatatcagttggccgtgacgataatggcaatactctgtgttccaaacgcagttatcctgcaaaatgcatggaaggtaagttgtaccatcttagctgcggtatctgtaagtccactgctgctcacttcatcgcagcaaaaggcagattggatacccctagcgcttacaatcaaaggcctcaacccaactgccatatttttaacaacattatctcgaacatccaaaaagcggagctggccattgaatgaagcagttatggcagtcggtatggtttctatcttggcgagttcattgctcaaaaatgacattccaatgacaggaccattggtggctggtggattattaacagtatgttacgtattaacaggaagatcagcggatttggaactcgagcgagcggctgatgtaaagtgggaggatcaagctgaaatttcgggaagttctccgattcttagtataacaatatctgaggacggatctatgagtataaagaacgaagaagaggaacaaaccttaacaatactaattcgaacaggtctcttggtgatatcaggtgtattcccagtgtcgattcccattaccgccgctgcctggtacttgtgggaagttaagaaacaaagagccggtgtactatgggacgtcccctcaccgccacctgtaggaaaggctgaattagaagacggggcctataggattaaacaaagagggatttttgggtactcccaaattggtgctggcgtgtataaagaggggacgtttcataccatgtggcatgttactcggggtgcggtactgatgcacaggggaaaacgtattgagccatcatgggctgatgtcaagaaagatttgatttcatacgggggaggttggaaacttgaaggtgagtggaaagaaggggaagaggttcaagtactagcactagaacccggcaaaaatcccagagcggtccaaacaaaaccgggactgttcaaaaccaacacaggaacaataggagcagtatctttggacttttcaccaggaacaagtggcagtccgatagttgatcgaaagggtaaagtagtcggattatatggaaatggggtcgtcacaagaagtggagcctacgtttcagcaattgcccaaacagagaaaagcatagaagataacccagaaatcgaagatgatattttcaggaaaaagcggctaaccataatggatctgcaccccggggcagggaagacaaaacgttaccttccggctatagtacgggaagctatcaaaagagggctccgaacactaattttagccccgactagggtagtcgctgccgaaatggaagaagctctaagaggactaccgattcgataccaaacaccagctatacgagctgaacacactggcagggaaatagttgacttgatgtgtcacgctacatttactatgagattactctcacccgtaagagtacctaactataatcttatcataatggacgaagctcactttacagatccagcgtcaatcgccgctaggggatatataagtacaagggtagaaatgggagaagccgctggaatttttatgactgctacacccccaggcagtagagaccccttcccacaatcgaatgccccaataatggatgaggaaagagagataccggagagatcgtggaacagtggccacgaatgggttaccgattttaaaggaaaaacggtatggttcgttccttccataaaggccggcaacgatatcgctgcttgcttgcgcaaaaatggcaagaaagtaatacaactatcacgaaaaacctttgatagcgagtatgtaaaaacgagagcaaacgactgggatttcgtcgtgaccacggatatatccgaaatgggagctaacttcagagcggaacgagttatcgacccaagacgctgtatgaaaccagtaatattaactgatggagaggagcgagtaatcttagcaggccctatgccagttactcattcatcagcagcacaacggcgaggtagaattggacgcaatcccaaaaacgaaaatgaccaatatatctacatgggggaacctctagaaaatgacgaggattgcgcgcattggaaagaagctaaaatgttactagataacataaatactccagaaggaataattccaagtatgtttgaaccagaaagagaaaaagtggatgcaatcgacggagaatatagattacgaggtgaagcaagaaagacctttgtggatttaatgaggagaggggacctccccgtttggctagcctatcgagtcgccgccgaaggcattaattatgcagaccgacgatggtgcttcgacggaataaagaacaatcaaatactagaggagaacgtagaggtagaaatttggactaaagagggtgaaagaaagaaattaaagccaagatggctcgatgctcgcatatattctgatccgctagctctgaaagagttcaaagaatttgcagccggaaggaaatccctaacactaaacttaataacagaaatgggaagactaccaacttttatgacacaaaaggctcgggatgccctcgataacctagcagtattacacacagcggaggtcgggggacgggcatataatcatgcgctgtcagaattacccgaaaccttagagaccctattattgttgaccctactagcaactgttacaggaggaatcttcttatttcttatgtcggggaaaggaataggcaaaatgactctcggtatgtgctgcattattacagcgtcaattcttttatggtatgcacagattcagccgcattggattgcagcatcaataatcctagagttcttcctcatagtgttgctaataccagaaccggagaaacagaggacaccgcaagataaccaactaacgtatgtcgtgatagctatcctaacggtcgttgccgctactatggcaaatgaaatgggcttcctggagaaaactaagaaggaccttgggttaggaagcataattacacaagagagtgaatccaatatattggatatagatttgagaccagcatcggcatggactttatacgctgtcgcaacgacattcgtaaccccaatgttaagacatagtatagaaaattcaagtgtaaacgtaagtttaactgcaattgccaaccaggcaactgtactaatgggtctcggaagaggttggccgttaagtaaaatggacataggagtccctctgcttgcaataggctgctattcacaagtaaatccaataacgttaactgcagcattactactactggtagcacattacgcaataataggtccaggactgcaggcgaaagccactcgcgaagcgcagaaaagggccgccgcgggaattatgaaaaaccctactgtagatggtataaccgtgatcgacctagaacctataccctacgatccaaagttcgaaaaacaactaggccaggtcatgctattagtcttatgtgtaacgcaagtactgatgatgagaaccacatgggcgttatgtgaagcgttaacactagcgaccggtccgattagtaccctttgggagggtaaccctggcagattctggaacactacaatagctgtatcgatggcaaatatatttagagggagctatttagccggtgctggtctcctgttctcgataatgaaaaatactactaatacacgaagggggacaggtaacataggagaaacgttaggggaaaaatggaaaagtagattaaatgcattaggaaaatcggaatttcagatatacaagaaaagtgggatacaggaagtcgatagaaccctagctaaagagggtataaaacgcggtgaaaccgatcaccatgcggtatcaaggggaagtgcaaaattaaggtggttcgttgaaaggaatatggtcacacccgaagggaaagttgtagatttaggctgtggtagaggcggatggagctactattgtggaggcctcaaaaatgtaagggaggttaaagggttaaccaaaggaggccctggccatgaagaacctataccgatgtcaacatatggatggaatttagtgcgtttacaatcgggagtagacgtgttcttcactccgccagaaaaatgcgatacattattatgcgatatcggggaaagcagtcctaatccgacgattgaagcagggagaacattaagagtcctaaaccttgtggaaaactggttaaacaacaatacccaattttgtattaaagtattaaatccttatatgccttccgttattgagaaaatggaaactttacaaagaaaatatgggggagccttagtgcgaaatccactttccaggaactcaacacatgagatgtattgggtatcgaatgcaactggtaatattgtatcctcagtaaacatgatttcgagaatgctaataaacagatttaccatgaaacataagaaagcaacttatgaacccgacgtagatctaggttcgggtacaagaaacataggaatcgaaaacgaaattccaaatcttgacataataggtaaaagaatagagaaaattaagcaagaacacgaaacaagttggcattacgatcaagaccatccttacaaaacatgggcatatcatggctcatacgaaacgaaacaaactggctctgcatcaagtatggttaacggggtagtccgcctgctaacaaaaccatgggatgtagtaccaatggtcacccaaatggcaatgactgatacaaccccttttggacaacagcgcgtgtttaaggaaaaagtagatactaggacacaagaacccaaggaaggaacaaagaaactaatgagaattacagccgaatggttatggaaagaacttggcaagaagaaaactccgcgcatgtgtacgagagaagagttcactaggaaagtaaggtccaatgcggcgcttggagccatatttacagatgagaacaaatggaaaagcgcacgtgaagccgtagaagatagtcgattttgggagctagtagatcgagaacgcaacttacatttagaaggaaaatgcgaaacatgcgtatataacatgatgggtaaacgggagaagaaattaggagaatttggtaaggcaaagggaagtcgagcaatctggtatatgtggctaggagcaagatttttagaatttgaagctctcgggtttttaaatgaggatcattggttttctagggggaacagtctatcaggagttgaaggagaaggattacacaaattaggatatattctccgagatgtaagcaagaaagaagggggagcgatgtacgcagatgacactgctggatgggatacaagaatcaccctagaagatctcaaaaatgaggaaatggtgacgaatcatatgaagggcgaacacaaaaagttagcggaggcaatatttaaacttacgtaccagaataaagttgtcagggttcagagaccaacaccgcgaggtaccgttatggatataatatcacgcaaggaccaaagagggtccggccaagttggtacgtacggactaaatactttcacaaatatggaagctcagttgatacgtcagatggaaggtgaagggattttcaagtcaattcaacatctcactgttacagaagaaatagcagtccaaaattggcttgcacgagttggtcgagaaaggctctctcgcatggccataagtggagatgactgtgtagtgaaacctctcgatgatagatttgctagcgcactaacagcacttaatgacatgggaaaggtacgaaaagatatacaacaatgggaacctagtcgaggttggaatgattggacacaggtccctttttgttcgcatcattttcatgaattagtgatgaaagatggtagagtattggtagtcccttgcagaaaccaagatgagctcattggtagggcacgaatttctcaaggggcgggatggagtttaaaagaaactgcttgtttagggaaatcatacgcacaaatgtggaccctcatgtactttcataggagggatctacgattagccgctaacgcaatttgttccgccgtacccagccattgggttccgacaagccgtacaacctggagtatacatgctaaacatgaatggatgactacagaagatatgctagcagtatggaatagggtctggatccaagagaatccctggatggaagataaaacacctgtagaatcgtgggaggaggttccttacttaggtaaaagagaagatcaatggtgcgggtccctaattggccttacctcgcgcgcaacctgggcgaaaaacattcaaacggccatcaaccaagtaaggagcttgataggaaatgaagaatatactgattacatgccatccatgaaacgatttcgtaaagaggaagaggaagctggagtcttgtggtaa

SEQ ID NO: 22567 - RNA, 9876 nt, synthetic construct
  misc_feature 1..9876: note = derived and/or modified CDS sequence (opt6) from DENV-2__EU596485__SS-prME
  source 1..9876: mol_type = other RNA
acagcaggggttataattatgcttatcccaaccgcaatggcattccacctaacaacaaggaatggtgaacctcacatgatcgtagggcgacaagaaaaaggaaaatcacttttatttaaaactgaagatggagtcaatatgtgcacgcttatggcaattgatctaggagaactatgcgaagatacgatcacttataaatgccccttgctaagacaaaatgaaccagaagatatagattgctggtgtaattcgacctcgacctgggtcacttacggtacctgcacaacaacaggagaacatcgaagagagaaaagaagcgtcgccctagttcctcatgttgggatgggtcttgaaaccagaacagaaacgtggatgtcaagcgaaggggcttggaaacacgtccaacgcatagaaacatggatattaaggcacccaggattcactattatggcggcaatactggcatatacaataggcacgactcactttcaaagagctttaattttcatacttttaacagcagttgcaccctcgatgaccatgagatgtataggtatttcaaatcgcgattttgttgaaggagtaagcggagggagctgggttgatatagttctagaacatggttcatgcgtaacaactatggcgaaaaataaaccgaccctagacttcgaattaataaaaactgaggcaaaacaacctgcaaccctaaggaaatactgtatagaggcaaaactaactaacacaactacggaatctaggtgtccaactcaaggggaaccaagtttaaacgaagaacaagataaacgatttatatgcaaacattcaatggtggataggggatgggggaatggatgtggattgtttggtaaaggcggcatagtgacttgtgcaatgtttacatgtaagaaaaatatggaaggaaaagtggttctcccagaaaatttagaatatactatagttattacaccacactcgggagaagaacacgcggtgggcaatgatacaggaaaacatggaaaagaaattaaaataacgccacaatcgtctataactgaagctgaactaactggatatggaactgtaacgatggaatgttcaccaaggaccggacttgactttaacgaaatggttttattgcaaatggaagataaagcatggttagtgcataggcaatggttcctagacttaccacttccatggctccccggagctgatacacagggttcgaactggatacaaaaagaaacattagtaacttttaaaaacccacacgctaagaaacaagatgtggtagtacttgggtcgcaggaaggtgccatgcatacagccctcactggggccaccgagatccaaatgtccagtggtaatctattgttcacaggtcacctcaagtgtaggttaagaatggataagttgcaactgaaaggtatgagctattctatgtgcacgggtaaatttaaaatcgtaaaggagattgctgaaactcaacatggtactattgtaattcgcgttcaatatgagggagatggatcaccatgcaaaatcccatttgaaattatggacctcgagaaaaggcatgtgttgggaagacttataacggttaatccgatagttactgaaaaagatagtcctgtaaacatagaagcagagcctccatttggagacagttacataataataggagtagaacccgggcaattaaaactcaattggtttaagaaaggttctagtatcggtcaaatgttcgaaaccactatgagaggggcaaaacggatggctatcttaggcgatacggcctgggacttcggatcactagggggagtattcacgagcatcggtaaagccttacaccaagtttttggtgctatatacggggctgctttctcaggagtcagttggactatgaaaattttaattggtgtgatcataacctggatcgggatgaactcacgatcaacgtcactctctgtaagcctcgtattagtaggagtggtaaccctgtatttgggggtaatggttcaggcggactctggctgtgtagtatcctggaaaaataaggagcttaaatgcggctccggcatcttcatcacagacaacgtgcacacttggacggaacaatataaattccagccagaatcaccctcaaaattagcgagcgcaatccaaaaggcgcatgaagaagggatttgtggaataaggtctgttacgagactagaaaatctaatgtggaaacaaattactcctgaattaaatcatatcttaagtgaaaacgaagtcaaattgactataatgacaggagacatcaagggtataatgcaggccggcaaaagaagcctacgcccacagccaactgaattgaaatatagctggaaaacttggggaaaggcaaagatgctttcgactgattctcataaccaaacattcttaatagatggaccagaaaccgcagaatgccctaataccaacagggcctggaactctttagaagtagaggactacgggtttggtgtattctcaacgaatatttggttaaaactacgagaaaagcaagatgtattttgcgattcaaaacttatgagcgccgcgataaaagataatcgcgctgtacacgctgatatgggatattggattgaaagtgccctcaacgatacttggaaaatggaaaaagcatcattcattgaagtgaagtcttgccattggcctaaaagtcatacgctatggagtaatggagtactagagtcagagatgataattcccaaaaattttgctggtcccgtaagccaacataattatagaccaggatatcacacacaaacagccggtccttggcatttaggtaaactagaaatggattttgatttctgcgagggcaccaccgtagtagtaacagaggactgcgggaatagaggcccgagcctacgaacaacaacggctagtggaaagttaattacagagtggtgctgcagatcctgtacgttacccccattacgttatagaggagaagatggatgttggtacggaatggaaataagacctttaaaggagaaagaagaaaatttggttaacagtctagtgactgctggacacggacaaattgataacttctccttaggagtattaggcatggctttatttctagaggagatgctacgaacaagagttggcacaaaacacgctatcttgctcgttgcggtatcatttgttaccctaattacaggaaatatgagtttccgtgacctaggccgagtgatggttatggtgggggcgaccatgacagatgatattggaatgggtgtgacgtatctcgcccttttagcagcatttaaggttagaccgactttcgcagcaggactgttgctacgaaagttaacaagtaaggagctaatgatggccaccattggtatagccctattatcccaaagtacaatacctgaaaccatattagaacttacggatgcactagcactcgggatgatggtcttaaagattgttcgaaatatggaaaaataccaattggcagttacgataatggcaatctcatgcgtaccaaatgccgtgatcctacaaaacgcatggaaagtatcatgtacaattctagccgctgtctctgtatccccgttactccttacctcatcacaacagaaagctgattggatacctcttgcactaactattaagggtctaaatcccacagcgattttcttaacaactttaagcagaaccagcaagaaacggtcttggccgttaaatgaggcagtaatggcagttgggatggtaagcatccttgcatcatcacttctcaaaaatgacattccaatgacaggccctctcgtagcaggaggtttgctcacagtgtgttatgtcttgactggcagaagcgccgacttagaattggaaagagcagcggacgtaaaatgggaagaccaagcagagatatcaggcagttcacctatattgtccattacaataagcgaagatggttccatgagtatcaagaatgaagaagaagaacaaacattaacgatactaatacggacgggactactcgtgatttccggcgtgtttcccgtgtcaataccaattacggctgcagcttggtacctgtgggaggttaagaaacaacgagctggggtattgtgggatgttccgtcaccccctccagtggggaaagccgaattagaagatggagcatatcgcataaaacagagaggcatctttggttacagtcaaattggcgccggtgtttataaagagggtacttttcatactatgtggcatgttacaagaggtgccgtcttaatgcatagaggaaagaggatcgaaccatcctgggcagatgtcaagaaggacttaatttcatacgggggaggatggaaacttgaaggagaatggaaagaaggcgaggaagtacaagtcctagcccttgagccagggaagaatccgagagcggttcaaacgaagcccggtttatttaagacaaatacaggaacaattggagcagttagtctcgattttagcccaggtacttcaggttcaccaatcgtagacagaaaaggcaaagttgtcggtctatatgggaatggtgttgtgacgaggtcgggtgcgtacgtatcggctatagcacaaacagaaaagtccatagaagacaatccagaaatagaggatgacattttccggaagaaacgacttacgataatggatttgcacccaggagcaggaaaaacaaaacgatacttaccagctatagtccgtgaggccatcaaaagaggactgagaactctaatattagcaccaacacgcgtagtagcggccgaaatggaagaagccttaagaggtttgccgataagatatcaaacgccagctataagggcggagcacacggggagggaaattgtagacttgatgtgccacgctacttttacgatgcgattactttctccagttagagtaccaaactataaccttattataatggacgaggcccatttcactgaccccgcatcaattgccgcgaggggatatatctctacaagagtagaaatgggtgaagccgccggaattttcatgacagcgacaccacctggttcacgagacccatttccgcaatcaaacgcccccataatggacgaagagagagaaatacctgagcggagttggaactcaggccatgaatgggtaaccgacttcaaaggaaaaactgtatggtttgtaccaagcatcaaagcagggaatgacattgcagcttgcttaagaaagaacggtaaaaaggtaatccaattatcacgaaaaaccttcgactcggagtatgtaaaaacacgagcaaatgattgggactttgtagtaacaactgacattagtgagatgggagctaacttccgagccgaacgagttatcgacccacggcgctgcatgaagccagttatattaactgatggagaagaaagagttattctagcgggtccaatgccggtaacacattcgtcggcagcacaacgccgaggccgtataggacgaaatcctaaaaatgaaaatgaccaatacatatatatgggcgaaccactagaaaatgatgaagattgcgcacattggaaggaagccaaaatgttacttgataatataaatacaccggaagggattataccgagtatgtttgaaccagagagggaaaaagtggatgcaatagacggggaatatagattaagaggggaagcaagaaaaacttttgtagacttaatgcggcgaggtgatctcccagtctggctagcatacagagtagctgcagaagggattaactacgcagatagaagatggtgttttgatgggatcaaaaataatcaaattctcgaagaaaatgtggaagtagaaatatggacaaaagaaggggagcgcaagaaattaaagccccgttggctagatgcgagaatctattctgacccacttgcgctaaaagaatttaaggaatttgctgcaggcagaaaatcactcactttaaatttgataacggagatgggaaggctcccaacctttatgactcaaaaagcacgcgatgccctagacaacttagcggtacttcataccgccgaagtaggaggaagggcctataaccatgcactctcagaactcccagagacattagaaacactcttactactaactttgctagccgctgtcactggaggcatatttctttttctaatgtcaggcaaagggattggaaaaatgacactaggcatgtgctgcatcattacagcctccatattactatggtatgctcagatacaaccgcactggattgctgcgagcataattttggaatttttcttaatagttctgttaattcctgaacctgaaaaacaaagaactccacaggataaccaactgacttatgtggtaatagccatactaacggtagtcgcggccactatggctaatgagatgggattcctagagaaaacaaagaaagacttaggtttaggaagtataataacccaggagagcgaatcaaatattttagacatagatttaagacctgcatccgcctggactttatacgctgtcgcaacgactttcgtaacccccatgcttcgccattctatagaaaatagcagtgtaaacgtttcattaactgcaatagccaatcaagccaccgtacttatgggcctaggccgaggttggcccctatcaaaaatggatataggggtacccttgttggctataggatgttacagccaggttaatcctattactttaaccgcggctctattgttattagttgcacattatgcaataataggacccggattgcaggccaaagcaactcgcgaagctcagaaaagggcggcggcgggaattatgaaaaaccctacagttgacgggataacagtaatagatctcgagccgataccatacgaccctaaattcgagaagcaactaggacaagttatgctcctagtgttgtgtgtaacccaagtacttatgatgcgtaccacatgggcactctgtgaagcacttacattggctacaggtcccatatctacactttgggaagggaaccctggacgtttttggaataccacaatagcagtcagtatggcgaatatatttcggggaagctatctcgcgggagccggattattattttcaattatgaagaacactacaaacacaagaagaggcactggtaacattggagaaactttgggagaaaaatggaaatctagactgaacgcgctgggcaaaagtgagtttcaaatctacaagaaatctggtattcaagaggtggatagaacattggcaaaagaaggcattaagagaggggagactgatcaccatgcagtctcgagaggtagtgcaaaactgagatggtttgtggaaagaaatatggttactccggaagggaaggttgtagatcttggttgtggccgagggggatggagctactactgtgggggccttaagaatgtaagagaggtaaaaggtctaacaaaaggtgggccggggcatgaagaacctatacctatgtcgacctatggttggaaccttgttcgtctacaaagcggcgtagacgtattctttactcctcccgaaaagtgcgacacactactatgtgatataggagaaagttcgcctaatccgacgattgaagcaggacgtacattaagggtgctaaatctagtcgaaaattggttaaacaacaatactcagttttgtataaaagtattaaacccgtatatgcctagtgtcatagagaaaatggagactctgcaaagaaaatacggtggggcccttgttaggaaccctctatcccgaaattcaactcatgaaatgtattgggttagcaacgccacaggaaatatcgttagtagtgtaaatatgatttcacgaatgttgatcaataggttcactatgaaacataagaaagcaacttatgaacccgatgtggatttaggttccggaactcggaatattggtattgagaacgaaatcccaaatcttgatataataggcaaacgtatagaaaagataaaacaggaacacgagacaagctggcattacgatcaagaccacccatataagacatgggcgtatcatgggtcttatgaaacaaaacaaaccggctcagcgagttccatggttaatggtgtagtgcgtttactaacaaagccatgggatgttgtacccatggtaacacaaatggctatgactgataccacaccatttggacaacaacgggtgttcaaagagaaggttgacactagaacccaggagccaaaggaaggtaccaagaaacttatgcgtatcaccgccgaatggctatggaaagaactaggcaagaagaaaacccccagaatgtgtactcgggaggaatttgcgcgtaaagtgaggtctaatgcagcactaggggccatctttacggacgaaaataaatggaaatcagctagagaagcagttgaagacagtaggttctgggaattagtagatagagaaaggaatcttcacctagagggaaagtgcgaaacatgtgtttataatatgatgggtaaaagagagaagaaactcggggaatttgggaaagcaaaagggtcacgtgcaatatggtatatgtggttaggtgcaaggtttttagagttcgaagcacttgggttcctaaacgaggaccactggttctcaagaggaaactcactaagtggagttgaaggtgagggcttacataaactaggttacatactacgtgacgtaagtaagaaagaaggaggggccatgtatgccgacgatacggcgggctgggacacacgaataaccctagaagacctgaagaacgaagaaatggtaacaaatcacatgaaaggagaacataagaaactagccgaagcaatatttaaactaacataccagaacaaagtagtacgcgtgcaaagacccacaccaagggggacagttatggacatcattagtcgtaaagaccaacgaggatctggccaggtcggtacgtacgggttgaatacatttaccaacatggaagcccagttaataagacagatggaaggggaagggatttttaagtctatccaacatctgacagttacagaagagatcgcagtacaaaattggttagcaagagtcgggcgcgaaagactaagcagaatggcaatttcaggcgatgactgtgtggtcaaaccattagatgaccgttttgcatccgcacttacagccttaaacgatatgggcaaagtgagaaaagacatacaacaatgggaaccttctagagggtggaacgattggacacaggtccccttttgtagccatcatttccacgaattagttatgaaggatggacgggttctcgttgttccgtgccgaaatcaggatgagttaataggtagagcacgaatatcgcaaggtgctggctggtcactaaaagaaacagcgtgtttaggaaaaagttatgctcaaatgtggacgcttatgtatttccatagaagagacctaaggctagcggctaatgctatttgcagcgcagtgccatcgcactgggtacccacgagtaggactacttggtccatacatgcaaaacacgaatggatgaccaccgaagacatgttggccgtttggaaccgagtatggatccaagagaacccatggatggaggataaaacaccagtagaaagctgggaggaggtaccatatttggggaaacgtgaagatcaatggtgcggtagcctaataggcttaacaagtcgagcaacctgggcgaaaaacatccaaacagcaataaaccaagttcgatccttaattgggaatgaagaatacaccgactatatgcccagtatgaagcgctttcgaaaagaagaagaggaggccggcgtactatggtag

SEQ ID NO: 22568 - RNA, 9876 nt, synthetic construct
  misc_feature 1..9876: note = derived and/or modified CDS sequence (opt6) from DENV-2__EU569710__SS-prME
  source 1..9876: mol_type = other RNA
accgcaggagtaattattatgctgatccctactgcaatggcgtttcaccttacaacgcgtaatggagaaccccatatgattgtaggaagacaagaaaaaggaaaatctttattatttaaaactgaagacggagtaaatatgtgcacgcttatggcaatcgatttaggggaattatgcgaagatacaattacttacaaatgcccattattaagacaaaatgaacctgaagatatcgactgttggtgcaacagcacttcaacttgggtaacctatggaacatgcactactaccggagaacatcggagagagaaaagatcggttgcactggttccccatgtaggcatgggattagaaactcgaacagaaacatggatgtcttccgagggagcttggaaacatgtacaaagaatagaaacttggatactacgccatccgggctttacaattatggcagctatactagcttataccatcggcacaacgcatttccagcgagctttgacttttatacttttaaccgctgtggcaccaagtatgacaatgcgatgcataggcatttccaatcgggactttgtcgaaggcgttagtggcggctcatgggtggacatagttctagaacatggatcatgtgtgaccacaatggctaaaaataaaccaactctcgacttcgaattaattaaaacagaagcaaaacaaccagcgattctcagaaaatattgcatagaagcaaaattaaccaataccacaacggaatcgaggtgtccaacacaaggcgaacccagtttaaatgaagaacaagataaaagatttatatgtaaacattcgatggtcgatcgaggatggggcaatgggtgtggactttttggtaaaggagggatcgtaacgtgtgctatgtttacatgtaagaaaaatatggaaggcaaagttgtgttacctgaaaatctggaatatacaattgtgataactccccatagtggtgaggaacatgctgtaggaaatgacactggaaaacatggtaaagagatcaaaataacgcctcagtcaagtataacagaagctgagttaaccggttacggaacagtgactatggagtgttcgcctcgtacaggcttagactttaatgagatggtcttactacaaatggaagacaaagcatggttagttcacagacagtggttcttggaccttccgttaccatggcttcccggagctgatacacaaggcagcaattggatacaaaaagaaacattagtaactttcaaaaacccccatgccaagaaacaagacgttgtagttctaggctcccaggaaggagcgatgcacaccgcccttacaggggcaacggagatacagatgagctccggaaatcttctgttcactggacatcttaaatgtcgcttgaggatggataaattacaacttaaaggtatgagttattcaatgtgtacaggaaaatttaaaattgtaaaagagatagccgaaacacaacacggtaccatcgtaataagggtgcaatatgaaggtgacggtagtccatgtaaaatacctttcgagattatggatctagagaaaagatacgttcttggaagactaattacagtcaaccccatagttactgaaaaagacagtccagtgaatatagaagccgaaccaccctttggcgatagctatataataataggcgtagagccaggccaattaaaattaaattggtttaagaaaggtagtagtattggacaaatgtttgaaacgactatgcggggcgcaaagcgcatggctatccttggagacacggcttgggactttggctcattgggtggtgtatttacttctatagggaaggccttacaccaagtatttggtgctatttatggagctgccttcagtggggtatcgtggactatgaaaattctgataggggtaataataacgtggattggcatgaactctcgaagcacatccctcagtgtaagcctcgtcttagtgggagtagtaaccctatatcttggggttatggttcaagctgattccggttgcgtcgtgtcctggaaaaataaagaattaaaatgcggcagtggaatttttataaccgataatgtacacacctggactgaacaatataagttccagcctgaatcaccatcaaaactagcatcagcaatacaaaaggcccacgaagaaggtatatgcggcattcgatcagtaacaagactagaaaatctaatgtggaagcagatcactccggaattgaaccacatactcagcgaaaatgaggtaaaattaacgattatgacgggcgatataaagggcatcatgcaagccggtaagagaagtctacgtccacaacctaccgagctcaagtattcgtggaaaacctggggaaaagcgaagatgctttcaacagaatctcataatcaaacatttttaatagatggaccggaaacagccgaatgtccaaatacaaacagagcttggaactctctagaagtagaagattacggtttcggcgtatttagcacaaacatatggctaaaactcagagagaaacaagatgtgttttgtgattctaaactaatgtctgcggcaataaaagataatagagcggtacatgcagacatgggatactggatagagagtgcacttaatgatacgtggaagatggaaaaggctagttttatagaggttaaatcctgccactggccaaaatcacatacgctatggagtaacggcgtgctggagagtgagatgataataccaaagaatttcgccggacctgtgtctcagcataactacagaccagggtatcatactcaaacagcaggtccctggcatctgggtaaactagaaatggactttgacttttgcgagggtactactgtcgtggtgactgaggactgtggcaatagaggaccctctttgcgcactactactgcaagtggaaaactgataaccgaatggtgttgccgttcttgcactttaccccctctgcgatataggggagaagacggttgctggtatggtatggaaatacgcccacttaaagagaaagaggaaaacttagtaaacagcttagtaaccgcaggacatggacagatagataactttagtcttggagttttaggcatggctttatttttggaggaaatgctccgaaccagagtcggaacgaagcatgcgatccttctggttgctgtcagctttgtgacattaattacaggaaatatgtcctttcgggatttaggtagggtaatggtaatggtaggagccactatgacggatgatattggcatgggggttacttatctggcactactcgcggcgtttaaagtaagaccaacctttgccgcaggtctattactgaggaagttaaccagcaaagaattaatgatggcgacgatagggatcgcgctactatcacaaagcacaatccccgagacaatattagaattaactgacgcactagccttgggaatgatggttctaaaaattgtacgaaatatggagaagtaccagctcgctgttactatcatggcgattctttgtgtgcctaacgctgtaattcttcaaaacgcgtggaaagtcagttgtacgatattagcggctgtgagtgttagccccctactcttgacatcttcacaacaaaaggcagattggataccgctagccctaacgataaaaggtcttaatccaacagcaatctttttaaccaccttaagcagaaccagtaagaaaagatcctggccactaaatgaagctgtaatggctgtaggcatggtgtcaatactagcatcaagtctcctaaagaatgacattccaatgacaggaccattggtagcaggaggactcttaactgtatgttatgtgctcactggccgctcggcagatttggaattagaaagagcagcagacgttaaatgggaagatcaggcagaaattagcgggagcagccctatcttatcaataaccataagcgaagacggaagtatgagcattaagaacgaagaggaagaacaaacattaactattttaatacgtactgggctgttagtaatatcaggcgtttttcctgtttccatcccgattactgctgcagcctggtacttgtgggaggtaaagaaacaaagagcaggggtgttatgggatgttccgagtccgccaccagtcggaaaagcagaacttgaggatggggcctatcgaatcaaacaacgagggattttcggatactcacaaataggagccggagtatacaaagaaggtacattccacacaatgtggcacgttacgcgtggcgccgtgcttatgcacagaggaaaaagaatcgagcctagctgggcagatgtgaagaaagacttaatatcatatggaggaggttggaaactagagggagaatggaaagaaggtgaagaagtacaagttttagcgttggaaccaggaaagaatccacgggctgttcaaacaaaaccaggcttattcaaaacaaacacggggactataggtgcggtttcgcttgactttagccctggtacatctggatcaccaatagtggacagaaaaggcaaagtggtaggactttatggtaatggtgtagttacgagatcgggagcctatgtctctgccattgcacaaacagagaagtcaatagaggacaatccagaaattgaagatgatattttcaggaaaaagcgtctgacaataatggatttgcatcccggtgcaggaaaaacaaaacggtacctacctgcaatcgtaagagaggcaatcaagcgaggattacggactctaatacttgcaccgacacgggtcgtcgccgctgaaatggaagaagcattaagaggactacccataagatatcagacaccagccatacgagctgaacacactggtagagaaatagtagacctcatgtgtcacgcaacatttacgatgagactactttcgccagtccgtgttcctaattataacttgataatcatggatgaagcccacttcactgaccccgcatctatagcagctcgagggtatatatccactcgtgtagagatgggcgaagcagcaggtatttttatgactgcaacgccacctgggagcagagaccctttcccacagtcaaacgcacccataatggatgaagaaagagaaataccggaaagatcttggaacagtggccatgaatgggtaactgacttcaaaggaaaaactgtatggttcgtaccaagtatcaaagccggcaatgacatcgctgcctgccttaggaaaaatggcaagaaagtgattcagttgtcaaggaaaacgttcgactcagaatatgtgaaaacccgggctaacgactgggattttgtcgtcacaactgatatatcagagatgggtgctaacttcagagcggaaagagtgatagacccccgacggtgtatgaagcctgtcattcttacagatggggaggagcgggtcattttagcaggccctatgcctgtgacacattcctcagcggctcagaggagaggaagaattggacgtaacccgaaaaatgaaaacgaccaatacatatatatgggggaacccctcgagaacgatgaagactgcgctcattggaaggaagcaaaaatgttgcttgacaacattaacacaccagaaggcattataccctcaatgtttgaacctgagcgagaaaaagtagacgcgatagatggtgaatatagactaaggggtgaagcaagaaaaacatttgtagacttaatgcgtcgcggtgacctgccagtgtggttggcttatagagtagcagctgagggtataaactatgccgaccgtagatggtgttttgatgggatcaaaaacaatcaaatcttggaggaaaatgtagaagttgaaatatggacaaaagaaggggaaaggaagaaattaaaacctcgctggctcgacgcgaggatctattccgatcccctcgctttaaaagaatttaaagaatttgctgcggggcgaaaaagtttaactctaaatttaataacagaaatgggaaggctgcccacctttatgactcagaaagctcgagatgcattggataacctcgccgtattacacacggcagaagtagggggacgagcctataatcatgcccttagcgagctcccagaaacacttgaaactttattattactgactcttttagcgactgtaactgggggaatattcctatttctaatgtccggaaaaggaataggaaaaatgacactaggcatgtgttgtattataaccgcgagcatattgctatggtacgcacaaatccagccacactggattgcagctagtataatattagagtttttcttaatagttttattaataccagagccagagaaacagcgtaccccgcaagacaatcaattgacatatgttgttattgcgatattgactgttgtagcagctactatggcgaacgaaatggggtttttagagaaaactaagaaagatttaggactcggtagcatcataactcaagaaagtgagtcaaacatattggacattgaccttcgacctgcctctgcgtggacattgtatgcggtagctaccacctttgtaacaccaatgctacgacactctatagaaaacagctccgtcaacgtaagtttaactgctatagccaatcaagcaacggtactcatgggtttaggtagggggtggcctctcagtaaaatggacattggagtacctcttttagcgattggttgctattcacaagtgaacccgattacactaacagctgcccttttactactcgtcgcccactacgccataataggaccaggcttacaagcaaaggcaacgcgagaggcacagaaaagagcagccgcgggtattatgaagaatccaacggtagacgggataactgtgatagacttggagccgattccttacgacccaaaatttgaaaaacaattaggacaagtcatgttattggtactttgcgtaacacaagtgttaatgatgaggacgacgtgggccctttgtgaagcattaacattagcgacaggccccataagtacgctatgggaaggaaaccctggcagattctggaatacaacaatcgctgtatctatggcaaatatatttcgaggatcatacttagcaggagcgggtcttttattctccattatgaaaaatactacgaatactaggcgcggaaccgggaacattggggaaaccttaggagagaagtggaagtccagattaaacgcgctgggtaagtcagaatttcaaatttacaagaaaagtggaatacaagaggtagataggactctagctaaagaaggtatcaaacgaggcgaaacagaccatcacgctgttagtcgaggctcagcaaaattgaggtggtttgtagaaaggaatatggtcactccagaaggaaaagtagtcgacttaggctgcggtagaggagggtggtcgtattattgtggtggtctaaagaatgttagagaagtaaaaggattaacaaaaggcggaccaggacacgaggaaccaattcctatgagcacttatggatggaacctcgttcgattgcaatctggcgttgatgtcttctttacaccacccgagaaatgtgatactttgctgtgcgatataggagaaagcagccccaacccaacaatagaagcaggacggacattacgcgttctaaatttggtagaaaattggctaaataataacacacagttctgtataaaagtgctaaatccatatatgccatccgtaattgagaaaatggagacactacaaagaaaatatggaggtgctttagtccgaaacccattaagtcgtaatagtactcatgagatgtactgggtaagtaacgctacaggcaacatagtatcatcagtaaacatgatttctagaatgctaataaatagattcacaatgaaacataaaaaggctacttacgaaccggatgtcgatttaggaagcggaaccagaaatataggaattgaaaacgaaataccgaatttagacattatcggtaagagaattgagaaaataaaacaagagcacgagacatcctggcactatgaccaagatcatccgtacaaaacgtgggcatatcacgggtcctacgagacaaagcagacagggtctgcatcatcaatggtaaatggggtcgtacgactacttaccaaaccatgggacgtagtaccgatggtcacacaaatggcaatgactgacaccacaccattcggccaacaaagggtcttcaaggaaaaagtggacacaagaacacaagaacctaaagaaggtaccaagaaactaatgagaataaccgcagaatggctctggaaggaacttggcaagaagaaaactcccagaatgtgtactagggaggaatttacaagaaaagttcgtagtaatgcggccttaggtgcgatctttacagatgaaaataagtggaagagtgcgcgagaagcagtagaggacagccgcttttgggaactcgtagaccgcgaaagaaacctacatttagaaggtaagtgtgaaacatgcgtatataatatgatgggtaagcgcgagaaaaagttaggtgaatttggtaaggctaaggggtctagagctatatggtacatgtggctaggagcaaggtttttggaatttgaagcactcggattcttaaacgaggatcactggttctcaagaggaaatagcctttcaggcgttgaaggagaaggtttgcataagttaggatatattttgagagacgtgagtaagaaggagggaggcgctatgtacgccgatgacacagcaggttgggacacaagaataactctggaggacctcaaaaacgaggaaatggtaactaaccatatgaaaggggagcataagaaacttgcagaagctattttcaaattaacttaccagaataaagttgtacgtgtccaacgtcctacaccccgaggaacagttatggatataattagtaggaaggatcaaagaggtagcgggcaagtaggtacatatgggctgaatacttttactaacatggaagcacaattaatccggcaaatggaaggggagggaatttttaaatcaatccagcacctcactgtaacggaggaaattgctgtacaaaattggttagccagagtggggcgtgaacgtttatcgagaatggcaatatcgggggacgattgcgtagtgaagcctttagatgatcgatttgcatcagcacttactgcattaaatgacatgggaaaagtgagaaaagatatacagcagtgggaaccttcaagaggatggaatgattggacgcaagtaccattctgctctcatcactttcatgagcttgtaatgaaagacgggagagtcttggttgtaccctgtagaaatcaagatgaattgatcggacgagctagaattagtcaaggagcgggttggagtctaaaagaaactgcgtgcttgggtaaatcgtacgcacaaatgtggaccttaatgtacttccatcgtagagatctaaggttagccgcaaatgctatatgcagcgctgtacctagtcactgggtacctacttcaagaactacttggtctatacatgcaaaacatgagtggatgactactgaagacatgttagcggtttggaatcgagtttggatacaagaaaacccatggatggaggataaaacgccggtggagagctgggaagaagttccttatttaggtaaaagagaggatcaatggtgtggaagtttaattggtcttacttcaagagcaacatgggccaaaaacatacaaacggcaataaatcaagttaggtcactaatcgggaacgaggaatataccgattatatgccttccatgaagcgattcagaaaagaagaagaagaagcaggagtattatggtaa

SEQ ID NO: 22569 - RNA, 9876 nt, synthetic construct
  misc_feature 1..9876: note = derived and/or modified CDS sequence (opt6) from DENV-2__EU596486__SS-prME
  source 1..9876: mol_type = other RNA
acagctggtgtaataataatgctcattcccactgctatggcatttcacctgactacaagaaacggagaacctcatatgattgtcggcagacaagaaaaaggaaaaagtctattgttcaaaacagaagatggagttaatatgtgcactctgatggccatcgaccttggagaattatgtgaagatacaataacgtataaatgccctctgctacgacaaaatgaaccggaagacatagactgctggtgtaactcaacctcaacgtgggtcacatacggaacgtgcacaacaaccggagaacacagacgggaaaaacgctctgttgctctagtcccccatgttggaatggggttggaaacaaggacagaaacgtggatgtcatccgaaggggcatggaaacatgtgcagcgaatcgaaacatggatcctcaggcatcctggattcacaatcatggccgctatcttagcttatacgatagggactacgcacttccaaagggcgctaatattcatacttctcacagcagttgcaccaagcatgactatgcgctgcataggcatatccaaccgggatttcgtagaaggagtaagcggaggttcatgggtagatatcgttttagaacatggatcgtgtgtaacgacgatggctaaaaataaacctactctggactttgaactaatcaaaactgaagcaaaacaaccggcaaccttgagaaaatactgtattgaagcaaaacttacaaacacaactacggaatcaagatgtcctacccaaggtgaaccatcactcaacgaggaacaagataaacgcttcatatgtaaacattccatggttgacagaggctggggaaacgggtgtgggcttttcggaaaaggtggaattgtaacgtgcgcaatgttcacttgtaagaaaaatatggagggcaaagttgtacttcctgaaaatcttgaatatactatagttattaccccacatagcggtgaagaacatgctgttggtaatgataccggaaaacacggcaaagagatcaaaataaccccacaatcaagtataacggaagctgagctaaccggttacgggacagtaactatggaatgttctccgaggactgggcttgatttcaacgaaatggtactcttacaaatggaagacaaagcatggttagtccatcgtcagtggtttttggatttaccgctaccctggcttcctggagcagatacccaaggcagtaattggattcaaaaagaaacattggttacttttaaaaaccctcatgcaaagaaacaagacgtagtagtgctcggatctcaagaaggtgctatgcatacggcattaaccggagccaccgagatacagatgagttcaggaaatctgctctttacaggacatctcaaatgcaggctcagaatggacaaactccaattaaaaggtatgagctatagcatgtgtacgggcaaatttaaaatagtgaaagaaattgccgagacgcaacacggaaccatagtcatacgcgttcaatatgaaggtgatggatcaccttgtaaaataccatttgaaattatggacctagagaaacgttatgtattaggaagacttattactgtgaaccctatcgtgactgagaaggattcccccgtaaatatagaggccgaaccgccctttggagattcttacataatcataggtgttgaaccaggacaactaaagctaaattggtttaagaaaggctcaagtattggacaaatgttcgaaacaacgatgagaggcgcaaagcggatggccatactcggagatacagcatgggatttcggatcgttaggcggagtgtttacgagcattggcaaagcgttgcatcaagtatttggagctatctacggggcggcattctctggcgtatcatggactatgaagattttaataggagtaataattacctggatagggatgaatagcaggagtacgtctctaagcgtatcgttagtactcgttggggtagttacactttatttaggcgtcatggtacaagcagactccggatgtgttgtatcttggaaaaataaagagctaaaatgtggtagcggaatatttataaccgacaacgtacacacatggacagaacaatataaattccaacctgagtcaccttctaagttagcgtcggcaatacaaaaggcacatgaggagggcatatgtggaatcagatccgtaaccaggttggaaaatttaatgtggaaacagataacacctgaattgaatcatatcctatcagaaaatgaagtaaaacttacaatcatgaccggtgacataaaaggaatcatgcaagctggaaaaaggtcgctaagaccacaaccaacggaactaaagtattcttggaagacctggggaaaagcgaaaatgttgtctacagaatcacacaaccaaactttcctcatagacggacctgaaacggccgaatgcccaaacactaacagagcctggaactcacttgaagtcgaggactacggcttcggagtattctctacaaacatttggttgaaactaagagagaaacaggatgtattttgtgatagtaagttaatgagtgctgcaattaaagataacagagccgtacatgccgatatgggctattggattgaatcagcactgaatgatacatggaaaatggagaaagctagctttatagaagtaaagtcctgtcactggccgaaatctcatacactgtggagtaacggggtcttagaatccgaaatgattatccccaaaaatttcgcaggacctgtatcacaacataactatagaccaggctatcacactcaaaccgctggtccatggcatctaggaaaactagaaatggacttcgatttttgtgaaggaaccacggtagtagttactgaagactgcggtaatagaggtccaagtctccgaacaactacagcgtcgggcaaactaattacagaatggtgctgtcgtagttgtactctgccacccctacgatatagaggagaagacggatgctggtacggtatggaaatacgcccattaaaagaaaaagaagaaaacttagtaaattcattagttaccgcaggtcatggtcaaatagataattttagcctgggcgtacttggtatggccttatttctagaagaaatgttaaggacgagggtaggaacgaaacacgcaatcctcctagtggcagtcagcttcgtaacactaatcacgggaaatatgtcatttcgggacttgggcagagtaatggtcatggttggtgcaaccatgactgacgatataggaatgggtgtcacatacttagcactattagcagcattcaaggttcggccaacattcgcggcaggacttctgttaaggaaactaacctcaaaggaactaatgatggcgaccataggtatagccctattgtcccaatccacaattcctgaaactatacttgaattaaccgacgcactggcgctcgggatgatggtgctcaaaatagtgagaaacatggagaaatatcaacttgctgttaccatcatggcaattttatgcgtacctaacgcagtaatactacagaatgcatggaaagtaagttgcacaattctggcggcagttagcgtaagtcccctattactaacaagttctcagcagaaagcagactggataccgttagccctgacaatcaagggactaaaccccacggcaatcttcctaactactctctcccgcactagcaagaaaagatcatggccattaaatgaagcagtaatggcagttgggatggtctcgatccttgcctcaagtttattgaaaaacgacatccccatgacaggacccctagttgcaggcggactcttaacagtatgctacgtcttaacggggcgaagcgcggacctagaattagaaagagcggcagatgtgaaatgggaagatcaagctgaaatatccggatcatcacccattctttcaattacaataagtgaagacggaagcatgtctatcaaaaatgaagaggaagaacaaactttaactatattaatacggacaggactattggtaattagcggcgtgtttccagtttcgatacctattactgcggccgcctggtacctatgggaggtcaagaaacaaagagctggagtactatgggatgtacctagtcctccacccgttggcaaggccgaacttgaagatggagcttatcgtataaaacaaaggggaattttcggttatagccaaatcggagctggcgtgtataaagaaggtacatttcatactatgtggcatgttactcgaggtgcagtgcttatgcatcgaggaaaacgtattgaaccaagttgggcagatgtcaagaaagatttgattagttatgggggcgggtggaaattggaaggagaatggaaggaaggtgaagaagtgcaagtactggcactagagccagggaaaaacccacgcgccgtacaaactaagccaggcttattcaaaactaatactggtactatcggtgcagtatcactggacttttcacctggaacttcagggtcgccaatagttgacagaaaaggaaaagtagtaggactatatggcaacggggtggttacgagaagtggcgcctacgtttcagctatagcacaaacagagaaaagcatagaagataatccggagatcgaggatgacattttcaggaagaaaagattaaccatcatggatttacatccaggtgctggtaaaaccaaacgatacttacccgctatagttagggaagcaattaaacgaggcctaagaacattaatcttagcccccaccagagttgtcgcagctgagatggaagaagcactgcgtggcctgcctataaggtatcaaaccccggctatacgagctgaacacaccggccgagaaatagttgatctcatgtgtcatgcaacatttacgatgaggctactatctcctgtacgagttcccaactataaccttataataatggacgaggctcatttcacggacccggcgagtatagcagcacgtggctatatatcaacacgagtagaaatgggggaagcagctgggatctttatgactgcaacaccaccaggcagcagagacccatttccgcagtctaatgctcctattatggacgaagaacgtgaaatacctgaaaggtcctggaacagtgggcacgagtgggtgaccgatttcaaaggcaagacagtatggtttgtaccctcaatcaaagccggcaacgacattgccgcatgcctcaggaaaaatggaaagaaagtaatacaactcagtcgcaaaacatttgattcagagtacgtcaaaacacgggcaaatgattgggacttcgtggtaacgacagatatctccgaaatgggtgctaattttcgagccgaacgggtaatagacccgaggcgatgcatgaaaccagttatcttaacagacggtgaagaacgtgttatcctagcaggtcctatgccagtaactcatagttccgcagctcagaggcgaggtagaattggaaggaaccctaagaatgaaaacgaccaatacatatatatgggagagcctcttgaaaacgacgaagactgtgcgcactggaaggaagcaaaaatgttactggacaacatcaatacacccgaaggaatcataccatcaatgttcgagcctgaaagggaaaaagtagatgctatcgacggtgaatatcggttgagaggagaggcgagaaaaacattcgtagatttaatgaggaggggagatttgccagtatggctagcttatagggtcgcagcggaaggtataaattacgcagatagacgctggtgttttgatgggatcaaaaacaatcaaatactagaggaaaatgttgaggttgaaatttggactaaggaaggcgaaaggaagaaattaaaaccacggtggttagatgcaagaatttatagtgatccactagcattaaaagaatttaaagagttcgcggcaggacgaaaaagccttaccttaaacctcataaccgaaatgggacgcttgccaacatttatgactcaaaaagctagggacgcgctggataacctcgcagtattacacactgccgaagtcggcggacgagcctacaaccatgcactatctgagctgccagaaacactagaaactctattacttttaacactactagccacagtcacaggtggaattttccttttccttatgtcaggtaaaggcataggaaaaatgaccttaggaatgtgttgtataattaccgcatcaattctgttatggtatgcacaaattcaaccgcattggattgcggcatccataatactcgagtttttcttaattgtactactaataccagaaccggaaaaacaaaggacaccgcaagacaaccaattaacttatgtggttattgcgatactcaccgtggttgcagcaacaatggctaatgaaatgggatttttagagaaaactaagaaggatttaggtctaggttcgatcatcacacaagaatcagaaagtaacatactagatatagatcttaggccggcttccgcttggacattatacgctgtagctacaacatttgttactccgatgctaaggcattcgatagaaaattcatcagtcaacgtatctttgacagctatagcgaaccaggcgacagtccttatgggattaggacgaggatggccattgtccaagatggacataggtgtcccactgcttgcaattggttgttattctcaggtcaatcctattaccttgacagctgctttactgctccttgttgctcactatgctattattgggccggggttacaagccaaagctacacgagaagcgcagaaacgagcagcagctggcattatgaaaaatccaacagtagatggaataacagtgattgaccttgaaccaattccttacgatcctaaatttgaaaaacagttgggacaagtaatgcttttagttttatgtgttacacaggtgcttatgatgcgaacaacgtgggccctttgcgaggcattaactttggctacaggcccaatcagtactctctgggaaggtaacccagggagattctggaatacaaccatagcggtaagcatggcaaacatattcagaggctcgtatctagctggagcaggcctcctattcagtataatgaaaaatacaacaaacacaaggcgaggtacaggtaatattggagagacacttggcgaaaaatggaagtcccgactcaatgccttaggtaaatcagaatttcaaatatacaagaaaagtggaatacaggaagtagatcgaacactcgcaaaagaaggtataaaaagaggagaaactgaccaccatgctgtaagtagaggatctgctaaattaagatggttcgtcgaaagaaacatggtaactcccgaaggtaaggttgttgatctcggatgtggcagagggggatggagttattattgcgggggcctaaagaacgtgcgggaagtgaaagggctgacgaaaggaggtcccggacatgaagaacccatccccatgtcaacatatggatggaatttggtcagactacaatcaggcgtggatgtcttctttacaccgcccgagaaatgcgatacgttattatgtgatataggtgaaagcagtccaaatcctacaatcgaagccgggagaacattgagggtactaaatttagtcgaaaattggttaaataacaatacacaattctgcataaaggtgttaaacccatacatgccgtcagtaattgaaaagatggaaaccttgcagcgaaaatacggaggtgctttggttaggaaccccttatcaagaaattctacccatgaaatgtactgggttagcaacgctacaggtaatattgtatcatcagtcaacatgatatcacggatgcttattaacagatttacaatgaaacacaagaaagctacttacgaacccgacgtagatctaggatctgggacaagaaacatagggatagaaaatgaaatacctaatctagatatcatagggaaaagaattgagaaaataaaacaagaacacgaaacttcttggcattacgaccaagatcacccatacaaaacttgggcttaccacggttcatatgagacaaaacaaactggttcagcaagttcaatggttaacggcgttgttcggctgctgactaagccctgggatgtcatacccatggtaacgcaaatggcaatgaccgatacgacgccatttggccagcaacgagtctttaaggaaaaggtagatactagaactcaagaaccaaaagaaggaacaaagaaattaatgagaattacggcggagtggctatggaaagagctagggaaaaagaaaaccccgagaatgtgtaccagagaagagttcacaaggaaagttcggtcaaatgctgcactaggagctatattcacggatgagaataaatggaaaagtgctcgggaagcagtagaagattcacgattttgggaattagtcgaccgggagcgaaatcttcatctagaaggaaaatgtgaaacgtgcgtgtataacatgatgggaaaaagagagaagaaactaggagaatttggtaaggcaaaaggatctagagctatatggtatatgtggctaggtgcacgttttctcgagttcgaagcgttagggttcctgaacgaagatcactggttcagtagaggcaactcattaagtggagtagaaggagaagggctccacaaattaggctacattctaagggatgtatctaagaaagagggtggtgcaatgtatgctgatgacacagctgggtgggatacgagaataactctagaagatctgaaaaatgaagagatggttactaaccatatgaaaggtgaacataagaaattagccgaagcgatattcaaattaacataccagaacaaggtagtacgtgtacaaaggcctactcctcgaggcacagtgatggatataataagtaggaaggatcaacgtggcagtggtcaagttggaacttacggacttaatacatttacaaacatggaagcacaactgatacgacaaatggaaggtgaaggtatatttaaatcgatccagcatttaacggtaactgaagaaattgcagttcagaattggctagcgcgtgtaggcagagaaagattatcgagaatggcgattagtggagatgattgcgtagtaaagccattagatgaccgttttgcttctgcactaactgctttaaacgatatggggaaggtaaggaaagatattcaacaatgggaaccgtcacgcggctggaacgactggactcaagtaccgttctgttcacatcactttcatgagcttgtgatgaaagatggaagggtcttagttgtcccctgtagatcgcaagacgagttaataggcagagcaaggatctcccagggtgcggggtggtcattaaaagaaaccgcctgtttgggaaaatcttatgctcagatgtggactcttatgtatttccatcgccgagacctcagattagctgcaaacgcaatttgtagcgcggtaccttcgcattgggttccgacctcgagaactacatggagtatccatgccaaacacgaatggatgacaacagaggatatgctagctgtttggaatagagtttggatccaagaaaatccatggatggaagataaaacacccgtcgaatcatgggaagaggttccttacctcggaaaaagagaggaccagtggtgtggatcgctaattggcctaacatctagggcaacctgggccaaaaatatacagactgcaataaatcaggtacgctccttgataggtaacgaagaatatatagattatatgccttcaatgaagcgctttcgcaaagaggaagaagaagccggcgtactgtggtaa

SEQ ID NO: 22570 - RNA, 9876 nt, synthetic construct
  misc_feature 1..9876: note = derived and/or modified CDS sequence (opt6) from DENV-2__EU687212__SS-prME
  source 1..9876: mol_type = other RNA
actgctggagtaattgtaatgttaatccctacagcgatggcttttcatttaacaacaaggaacggcgaaccacatatgatagtaggcagacaagaaaaagggaaaagtctattgtttaaaacagaagatggggtaaatatgtgtacgcttatggcaatagacctaggagaactatgtgaagacacgataacatataaatgcccattgttacgacaaaatgaacctgaagatatagactgttggtgtaatagcacaagcacatgggtaacctacggaacgtgcacaacgaccggagagcacagaagggagaaacggagcgttgcgttggttcctcacgttggtatgggtctagaaacaagaacagagacatggatgtcttctgaaggcgcatggaaacacgtccaaagaatagaaacatggatactcagacaccctggttttactattatggcagcaatcctagcctacacaatcggaacaactcattttcagcgtgcactaatttttatattactgacagcagttgccccaagtatgacaatgcgatgtatagggataagtaatcgagattttgttgaaggagtatcagggggaagttgggtagacatagtcttagaacacggctcatgcgtcactaccatggcaaaaaataaacccacactagatttcgaactcatcaagacagaagctaagcaacccgccacactcagaaagtattgcatagaagcaaaacttacaaacaccacgacagaaagtaggtgcccaacacagggcgaaccaagcctcaatgaggagcaagacaaacggtttatatgcaagcattcaatggtggaccgcggatggggcaatggatgcggtctgttcggaaaaggtggaatagttacgtgcgctatgttcacttgcaaaaaaaacatggaagggaaagtagtccagcctgaaaatctagaatatacaattgtgattactccacattctggcgaagaacatgcagtaggcaatgacacaggcaaacatggcaaagaaatcaaaatcaccccacagtcaagcataacggaagcggaacttactggttatggaaccgtgacaatggagtgtagtccacgtacaggactagattttaatgagatggttctattgcaaatggaagataaagcatggttggtgcatagacaatggtttcttgatttaccgttaccttggcttccaggagctgatacacaaggaagcaactggattcaaaaagagacacttgtcaccttcaaaaatccgcatgcgaaaaaacaagatgtagttgtactcggaagccaagagggagctatgcatacggcactgaccggagcaacagaaatacaaatgagttctggaaatttactatttacaggccacctgaagtgtcgtctaagaatggacaagttacaattaaagggtatgagctacagcatgtgcactgggaagtttaaaatagtaaaagaaattgcagagactcaacacggcacaattgtaatacgcgtacagtatgaaggagacggatctccgtgcaaaataccgttcgaaataacagatctagaaaaacgtcacgtattgggacggcttattacagtaaacccaattatcactgaaaaagattcaccggtgaatattgaagctgagccaccgtttggcgacagctatataattataggcgtcgaaccaggacaactaaaactcaattggttcaaaaaaggttcaagtataggccaaatgtttgaaacaacaatgaggggcgccaagagaatggccattctgggagatacagcatgggatttcggatccctaggcggagtgttcacttcgattggaaaagctctgcatcaagtgtttggagccatatatggagctgccttctccggcgtgtcgtggactatgaagatacttataggggtcatcattacatggataggaatgaactcaagaagcacatctctaagtgtgagtctagtattggtaggcgtagtcacattatatctaggtgccatggtgcaagcagattcgggatgtgtagtatcttggaagaacaaagaattgaagtgtggatctggcattttcattaccgacaatgtacatacgtggacggagcaatataaatttcaacctgaatcaccatccaagctggcgtctgcgatacaaaaggctcacgaagaaggcatttgcggaatcaggtctgtaacaaggttagaaaatctaatgtggaaacagataacacccgaattaaaccatatattgtcagaaaacgaagttaaattaaccattatgactggggatattaagggtattatgcaagcgggaaaacgtagcttaagaccacaaccgacagaattgaaatattcgtggaaaacttggggtaaagcaaaaatgctgtcgacagaatcccataaccaaacatttttaatcgatgggcccgaaacggctgaatgtccaaacacaaatcgtgcgtggaatagtttagaggtagaggactatggatttggcgtatttacaaccaatatatggctgaaattgagagaaaaacaggatgtattctgtgattcaaaattaatgagtgccgcaattaaagataatagagctgtgcatgcggatatgggatattggatagagagcgcacttaacgacacttggaaaatggaaaaagcttcgttcatagaagtgaaatcatgtcattggcccaaatcgcatacgctctggagtaacggagtactagaaagtgaaatgattatccccaaatcattcgcaggaccagtaagccaacacaattacagaccaggataccatacccaaacagcgggaccatggcatttaggaaagctggaaatggatttcgatttctgcgagggtacaacagtagtagtaacagaagattgtggaaaccgtggcccctcgcttaggaccaccactgctagtggtaaattaataacggaatggtgttgcagatcctgtacacttccaccattaagatacagaggagaggatggatgttggtatggcatggaaatcaggccattgaaagagaaagaggaaaatctagtaaatagtttagtcactgctggacatggacaaattgacaacttttcgcttggggtcttaggcatggcgctatttctagaagagatgttgaggacacgagttggaacaaaacacgctatattgctagtggcagtatcattcgtaacattaatcacaggtaacatgtcatttcgcgatttaggtcgtgtaatggttatggtgggagctaccatgactgacgacattggaatgggggtcacttatttagcacttcttgcagcgtttaaagtacgtcccaccttcgctgccggattattattaaggaagctaacttccaaagagcttatgatggcaacaattggtatagcactactatcacaatcaactatgccggagacaatattagaattaactgacgcacttgccttagggatgatggtccttaagatcgttagaaacatggagaaataccagctggccgtaacaatcatggccataagctgcgtacctaatgcggtaatcttacagaatgcctggaaagtgagttgcacaatactagcaacggttagcgtgagccctctgttattgacatctagccaacagaaagctgattggatccctctagcactaacgattaaaggtttaaacccgactgcaatctttctgacaaccctgtctaggactagtaaaaaaagatcttggccgttaaatgaggccattatggctgtaggaatggtatcgatactggcttcgtcactattaaaaaacgacatcccaatgacagggcccctagtggccggtgggttactaacagtatgctatgttctaacaggaagatcagctgatctagaattagaacgagctgcggacgtgaaatgggaagaccaagccgagattagtggcagtagcccgattttgtccattacgatatctgaagatggatcgatgagtataaaaaatgaagaagaagaacaaaccttaacaatattaatacgaacaggactattagtaatcagtggtgtgtttcctgttagcattcccataaccgcagcagcttggtacctatgggaggtgaaaaaacaaagagccggagttttgtgggatgttccttccccacctcctgtagaaaaagctgaactagaagacggagcttatcgaataaaacaaagaggtatcctaggctattcgcaaataggagcaggggtatacaaagaaggtacttttcatacaatgtggcatgtaacacgaggtgctgtactcatgcatagaggtaaaagaattgaaccttcatgggccgatgttaaaaaagatttaataagttatgggggtggctggaaattagaaggggaatggaaagaaggagaagaagtacaggttctagcgctcgagccgggaaaaaatccaagggcagtacagaccaaaccagggatattcaagacaaatacaggaacaatcggagctgtaagtctagatttctcccctggtacgtcaggaagtcctatagtagatagaaagggtaaagtggtaggactgtatggaaacggggtagtgactcgatcaggagcttacgtatctgcaattgcccaaacagaaaaatcaatcgaagataatcccgaaatcgaggatgatatattcagaaaaaaaagacttactataatggatttgcaccctggagcaggaaagacaaaacgatatctacctgcgatcgtaagagaagccataaagagagggctcagaacattgatactagcgcccacaagagttgtggctgcagaaatggaggaagcgctcagaggacttccgattcgataccaaacccctgctattcgagctgaacatacaggcagagaaattgtagatttaatgtgtcatgcgacgtttacaatgcggcttctcagtccagtaagagtacctaattacaatcttataattatggatgaagcacatttcacagacccagcatccatcgccgcacgtggatatatatcaacaagagttgaaatgggcgaagcagcggggatatttatgacagcaacccctccaggaagccgcgacccttttccacaatcaaacgctccaataatggatgaggagagagagataccagaacggagctggaacagcggacatgagtgggtgacggactttaagggaaaaacagtgtggtttgtcccatcaataaaagcaggaaatgacattgctgcctgtctaagaaaaaacggaaaaaaagttatccaactttcgagaaaaacgtttgatagcgagtacgtaaaaactcgtgcaaatgattgggacttcgtagttactacagacattagtgaaatgggtgcaaactttaaagcggaacgtgttatagatccaagaaggtgcatgaaaccagttatccttaccgatggggaagaacgagtaatattggccggaccaatgccggtgacacacagtagtgccgcacaacgtagggggagaatagggagaaatccaaaaaacgaaaatgatcaatatatatacatgggtgaacctcttgagaatgatgaagattgtgcgcactggaaagaagcgaaaatgttattagataacatcaacaccccagagggcataattcccagtatgttcgagcccgaacgtgaaaaagtagatgctattgacggcgaataccggctcaggggtgaggcccgaaaaacatttgttgatctaatgagaagaggcgacttaccagtctggctagcatataaagtagcggctgaaggcatcaactacgctgataggaaatggtgcttcgacggaataaagaacaatcaaatattagaagaaaatgttgaagtcgaaatctggaccaaagaaggagagaggaaaaaacttaagccgagatggctagatgccagaatctatagtgacccgttggccctaaaagaatttaaagaatttgcggcggggagaaagagcttaacgctaaacttaataactgaaatgggtcgactaccaacgtttatgactcagaaagctcgaaacgcacttgataacttagcagttcttcatacagcagaggctggtgggcgagcatataaccatgctttaagcgaacttccagaaactttagaaactctattgcttttaacattactggctactgtcaccgggggaatctttcttttccttatgagcggcaaaggtatcggaaagatgacattaggtatgtgttgcataataacagcttctatcctcctatggtacgcacagatccaaccacactggattgcagcctcaataatcctagaattctttcttatagttctgctaataccagaaccggagaagcaacgaacaccgcaggataatcagttgacatatgttgttatagctatcttaaccgtagtcgccgcaaccatggccaatgaaatgggattcttagaaaaaacaaaaaaagacctagggctaggatccataactacgcaagagtcggaatcaaacattttggatattgatctccgccctgcgagcgcgtggacattatatgcagtagccaccaccttcgtaacaccaatgttgcgacattcaatagaaaactcttcggttaatgttagtctgacagctatcgcgaatcaagctacagtcctgatgggactaggaaaaggctggcctctctcaaaaatggatattggggtcccattattagctatagggtgttacagtcaggttaacccaattactctaaccgctgccctcttattactcgtggcccattacgccatcataggccccggattacaagcaaaggctacaagggaggctcagaaacgtgctgctgctgggatcatgaaaaacccaaccgttgatggaatcacagtcatagacctcgaaccaattccgtatgatcctaaattcgagaagcaattaggacaggtaatgctgttaatactatgcgtgacacaagttctaatgatgaggacaacttgggcgctctgcgaggcactaacattggccaccgggccgatatctacactttgggaagggaaccccggaagattttggaacacaacaatagcagtatctatggcaaatatattccgtggttcatatctagcaggagctgggctattgttcagtataatgaaaaacacgacgaacactagacggggcaccggaaatatcggagaaaccttaggagagaaatggaagagtcgtttgaacgcgctaggcaaaagtgagttccaaatatacaaaaaatcaggaatccaagaagttgacaggacgttagcaaaggaaggaattaaacgaggcgaaactgaccatcatgcagtttcacgcgggagtgcgaaattaagatggtttgtagaacgaaacatggtaaccccagagggaaaagtagtagatcttggatgtggacgaggggggtggtcatattactgtggaggtctgaagaacgtaagagaagtcaagggtttaacaaagggaggaccgggacatgaggaacctgtacctatgtctacttacggctggaatctagtacgactacagtcgggagttgatgtattctttacacccccggaaaagtgtgatacattgctgtgtgatatcggagagagttcacctaaccctaccattgaagcaggacgaaccctccgcgtgttgaatctagttgaaaattggctcaataacaacacacaattctgcataaaagtactaaatccatacatgccatcagtaattgagaagatggaaacccttcaaaggaaatacggtggagccctggttcgtaacccattatcaaggaactccactcatgaaatgtattgggtaagcaatgcaaccggaaacatagtatcatcggtaaacatgataagcagaatgttaattaatcgattcactatgaaacataaaaaagcaacatatgagccagatgtggatttaggttcaggaacgagaaatattgggatagaatcagaaataccaaacttagatataatcggtaaacgtatagagaaaataaagcaagagcacgagacttcatggcattatgatcaggatcatccatataagacctgggcataccatggctcatatgagactaaacaaactggtagtgcatcgtcaatggtgaatggggtagtccgattattaactaagccatgggacgttgtccctatggtgacccagatggcaatgactgatacgacaccctttggtcaacagcgagtattcaaagaaaaagtagacacaaggacacaagaacctaaagaagggacaaaaaagctaatgaaaatcacagcggaatggttatggaaagaactaggtaaaaaaaaaacgccgagaatgtgcacacgggaagaattcacaaaaaaagtaaggtcaaatgccgctcttggggcaatatttactgatgaaaataagtggaaaagtgcccgtgaagcagtagaagacggtaggttttgggaactagtagatcgtgaacgtaacttacatctcgaaggtaagtgtgaaacttgcgtatataacatgatggggaaaagggaaaaaaaactgggtgaattcggaaaagcgaaaggaagtagggctatttggtatatgtggcttggtgcacgctttctagaatttgaagcgttaggatttctgaacgaggatcattggttttcacgtggtaattccttaagtggtgtagaaggagaaggattgcatagattagggtatatattacgcgaagtcggaaaaaaagaggggggtgccatgtacgccgacgatacagcaggatgggacacaagaattactttggaagatttgaagaatgaggaaatggtaactaatcatatgaaaggagaacacaaaaaactagctgaggcgattttcaaacttacttatcaaaataaggtcgtacgagttcaacgaccaacgccaagaggcacagtgatggacataatttcccgcagggaccaaagagggtctgggcaagtaggtacttacggcttaaatacattcacaaacatggaagcacaattgattcgtcaaatggaaggagaaggaatattcaaatcaatccaacatctaaccgctacggaagaaattgcagtacaaaattggcttgcaagggtgggacgagaaagattatcaaggatggccatatccggagatgattgtgttgtaaaacctatagatgacagatttgcgtctgcacttactgccttaaacgacatggggaaagtccgtaaggatatccagcaatgggaacctagtcggggatggaatgactggacacaagtaccgttctgcagtcatcattttcatgagctagtgatgaaggatggtagagttttggtcgttccctgtagaaatcaagacgaattaatagggagagctaggataagtcaaggagctgggtggtcgttaaaggagactgcctgcctagggaaaagttatgctcaaatgtggactctcatgtatttccatcgcagggatcttagattagccgcaaacgcaatttgtagtgctgtgcccagtcactgggtaccaacatcaagaacaacatggtctattcatgccaaacatgaatggatgactacagaagacatgttagccgtatggaacagggtctggattcaagaaaacccatggatggaagacaagacgcctgtagaaagttgggaggaggtcccgtatctaggaaagagagaggatcaatggtgcggatccttaattgggctaacaagcagggcaacatgggccaaaaatatacaaaccgcaattaaccaagtgaggagcctgattgggaacgaagaatatacagactacatgccatccatgaaacgatttaggcgtgaagaagaagaagcgggagtcctatggtga

SEQ ID NO: 22571 - RNA, 9876 nt, synthetic construct
  misc_feature 1..9876: note = derived and/or modified CDS sequence (opt6) from DENV-2__EU660400__SS-prME
  source 1..9876: mol_type = other RNA
acagcaggtgtaattataatgttgataccaacagcaatggccttccatctaactacaagaaatggtgaaccacatatgatagtaggtcgacaggaaaaagggaaatcattattgttcaaaaccgaagacggtgtgaacatgtgtactttaatggccatagacctcggagaattgtgtgaagacacaataacatacaaatgccctcttctaagacagaacgaaccagaggacatagactgctggtgtaactcgacgtctacgtgggttacatatgggacatgtaccaccacaggcgaacatagacgagagaaaagatccgtagcattagtcccacatgtaggaatgggattagaaactcgaactgaaacgtggatgtctagcgaaggagcgtggaaacatgtgcaaagaatagaaacttggatcttaagacacccaggttttacgattatggccgcgatattagcttatacaataggtacaacgcatttccagagagctctgatattcatattattaactaccgtagcaccctccatgaccatgagatgcataggaattagcaatagagactttgtagaaggtgtttctggtggaagctgggttgacatagttctcgaacatggcagctgtgtaaccacaatggcaaaaaacaaaccaactctggacttcgaattgattaaaactgaagcaaaacaaccggctactctacgaaaatactgtatagaggcaaaattaaccaacacaacaaccgagtcacggtgtcccactcaaggagaaccctcgttgaatgaagaacaagataagcgattcatatgtaagcattcaatggtagatagagggtggggaaatggctgcgggttgtttggtaaaggcggaatagtgacttgtgcaatgttcacatgcaagaagaacatggaaggaaaagtggtactgccggaaaatctagaatacactatagtaatcaccccgcacagcggagaagaacacgcagttggtaacgatacgggaaaacacgggaaagaaataaaaataacaccccagtcgtcgattacagaagcagagcttacaggatacggcacagttaccatggagtgctcaccgagaacgggcctcgatttcaacgaaatggtcttgttacaaatggaagacaaagcctggttggtgcaccgacagtggttcttggatctaccattaccatggctgcctggggctgatactcagggctctaactggattcaaaaagaaacactagtgactttcaaaaatccccatgccaaaaagcaagacgtagtcgtcctagggtcgcaggaaggagcaatgcatacagcgctcactggagcaactgaaatacaaatgtcctctggcaatctcctcttcacaggccatctgaaatgccgtttgcgtatggataaattacagttaaaaggaatgtcttacagcatgtgtactggaaaatttaaaatagtaaaagaaatagcagaaacccaacatggaaccatagtaatacgagtacaatatgagggagacggcagtccatgcaaaatcccattcgaaatcatggatctagaaaagagacatgtcctaggtaggctaataacggtcaatcctatagttacagagaaagacagtcccgttaatatagaagcagaaccaccttttggggacagctatataattatcggtgtagaaccaggacaattaaaactcaactggttcaaaaaaggaagttcaattggacaaatgtttgagacaacaatgagaggtgcaaaaagaatggcaatactcggagacactgcgtgggattttggatctctcggcggggtgtttacatcgataggtaaagcgctgcaccaagtctttggagcaatctatggtgctgcattcagcggcgtatcttggacaatgaagatacttatcggagttattatcacatggattggaatgaatagtaggtccacatctttatcagtctcacttgttctagtaggtgtagtgacattatacttgggtgtcatggtacaagccgatagtggttgtgtcgtatcttggaaaaataaagagttgaagtgcggaagtggaatattcataacggataacgtccatacatggactgaacaatataagttccaaccagaatccccttccaaattagcaagtgctattcagaaagcgcatgaagagggaatatgtgggatccgctcagtcacaagattagaaaatctaatgtggaaacaaataacaccagaactaaatcacatactatcagaaaacgaagtcaagctgacaataatgacaggcgacataaaagggataatgcaagcaggaaaaagaagcctacgtccacagccaacagaattaaagtactcttggaaaacctggggtaaagcgaaaatgctctcaactgaatcacataatcagacattcctaatagatggcccagaaaccgcagaatgtccaaacactaatcgggcctggaattcactagaagttgaggattacggttttggcgtattttcaacaaacatttggcttaaacttagagagaaacaagacgtgttttgtgatagtaaattgatgagcgctgcaatcaaagacaacagggctgtacatgcagatatgggctactggattgaatctgcactaaacgatacatggaaaatggagaaggcttcatttattgaagttaaatcatgtcattggcctaagtcacatactttatggtctaatggggttctagaaagcgaaatgataattcccaagaacttcgctggaccagtgagtcaacataattaccgaccaggctatcacacacagacagcaggaccatggcatcttggaaagctagaaatggacttcgacttttgtgaaggtacgacagtggttgtaacagaggattgtggtaatcgaggacctagccttcgtactaccactgcatcgggaaaattaattacagaatggtgttgtagaagttgcactctgcccccgttgcgatatagaggagaagatggttgttggtatggaatggagattcgaccactaaaagaaaaagaagaaaatctcgtaaactcgttagtcacggccggccatggacaaatagataactttagccttggagtcttaggtatggcattattcttagaagagatgctgcgaactagggtaggaactaaacatgcaattctacttgtagcagttagttttgttacgctaataacgggcaatatgagctttagagatctgggacgcgtgatggttatggtcggagcaacaatgaccgatgacatagggatgggcgttacatatctcgcattactcgctgccttcaaagttcgacccacattcgctgcaggactgctcttacgaaaactaacctctaaggagttaatgatggccacgattggaattgcactactgtcacagagtaccataccggaaacaattttagagctaaccgatgctttagcgctgggtatgatggttttgaaaatcgtacggaacatggagaaataccagctcgcagtaactataatggctataagctgcgttccaaatgcagttattctgcagaatgcttggaaagtttcttgcacaatacttgccgcggtttccgtaagtcctctgcttttgacgagctcgaggcaaaaggccgattggataccactagcacttacgataaagggcctaaatccgacagcaatattcctcactacactaagtaggacttcgaaaaaaagaagctggccattaaatgaagcagtaatggctgtgggcatggtaagtattctagcgagttcattattaaaaaacgacatacctatgacaggccccctagtcgcaggaggactactaacagtatgttatgtcctaactggcagatcagctgacttagaattggaaagggccgctgatgtcaagtgggaagatcaagcagaaatctcaggttctagtccaatcctatcgatcacaataagtgaggatgggtcaatgtccataaaaaatgaagaagaagagcacaccttaaccatattaatacgtactggactcttagtaatttcgggggtatttccagtaagcataccaataacagcagctgcatggtatttgtgggaagtgaagaaacagcgcgcaggggtattatgggatgttccaagtccccctcccgtaggaaaggcggaactggaagatggtgcctaccgaataaaacagcgagggatctttggatatagtcaaataggagcaggcgtttataaagaaggaacatttcacactatgtggcatgtcacgcgaggggctgtattaatgcatcgagggaagcgtattgaaccctcgtgggcagacgttaaaaaagacctcattagctatggtggcggatggaaacttgaaggcgagtggaaagagggagaagaggtccaagttctagcactcgaacctggcaaaaacccccgagcagtgcaaacaaaaccgggattatttaaaactaacacaggaactattggagcagtcagtctcgatttcagcccgggaacatctggaagcccaatagttgatagaaaaggcaaagtggtggggctctatgggaatggggtagtaactcgttctggagcttatgtttccgccattgcacaaacggaaaaatcgatagaggacaatccagaaatagaagacgatatttttcgcaaaaaaagacttacaatcatggatctccatcccggtgccgggaaaacaaagaggtatcttccagcgatagttagagaggcaattaagcgcggattaagaaccttaatacttgcaccgacaagagtagtagctgctgaaatggaggaggcactaagaggactacctataagatatcaaaccccagcaattagagctgagcacaccgggagagaaattgtcgatttaatgtgccacgccacattcacgatgagactacttagtcccgttagagtacccaattataacctaattatcatggatgaagcccattttacagaccccgcttcaattgcagctagagggtatatatcaacgagagtagagatgggcgaagctgctggcatatttatgacggcaacacctccagggtcaagagacccttttccccagagtaacgccccaataatggatgaagaacgcgaaattccagagagatcttggaacagtggacatgaatgggtcactgatttcaaaggtaagacagtatggtttgttccttccattaaagcgggaaacgacattgcggcttgccttagaaagaacggaaagaaggtaattcagttatcaagaaaaacatttgattctgaatatgtaaagacaagggctaacgactgggactttgttgtcacaaccgatataagcgagatgggtgccaacttcagagcggaacgggttattgatcctagacgatgcatgaaacctgtgatattaacagacggtgaggaaagggtaatactagctggaccaatgcccgttacacattcatcagcagctcaacgaagaggaagaattggaagaaaccccaaaaatgagaatgaccagtacatatatatgggggagccactcgaaaacgacgaagattgcgcgcattggaaagaagctaaaatgttattagacaacataaataccccagaaggaataataccaagtatgtttgaacccgaacgtgaaaaagtggatgcgattgatggcgagtaccgtctaagaggtgaagctaggaagaccttcgtcgacttaatgcgccggggagatttgccagtttggttagcatatcgggtagcggcagaagggataaattatgcagatcgcagatggtgcttcgacgggattaaaaataaccaaatactagaagaaaacgtggaagtagagatttggactaaagaaggtgaacgaaaaaaactaaaacctcgctggttagatgcacggatctactctgatcctttagcactcaaagagttcaaggaatttgctgcaggaagaaaatcattgacgcttaatcttattacggaaatggggcgacttccaactttcatgactcagaaggctcgggatgctctagacaatctagcggttctacatactgcggaagtcggagggagagcctacaaccatgcactgagcgaactcccggagaccttggagaccctactattattaacattgctagcgactgtgacgggtggaattttcctgtttttgatgagtgggaaaggtataggaaaaatgactttaggaatgtgctgcatcataacggcctcaatactgctttggtatgcccaaattcaaccacactggattgcagcatctattatactagaattttttctcattgttctcctaataccagaaccagaaaaacagaggactccacaagataaccaactaacctatgtagttattgcaatcctaacggtggttgcggcgaccatggctaacgaaatgggcttcttggagaaaactaaaaaggacttgggactcggcagtataactactcaagagtctgagagtaatattctagacatcgatcttagacctgcgagcgcatggactctgtacgcagtcgcaactacgtttgtcaccccaatgttaaggcatagtatagagaactcttcagttaatgtcagcctgaccgcaatagccaatcaagccacggtattaatgggtctcggtcgtggttggcccctgtccaaaatggacattggggtgccactccttgccataggatgctacagtcaagttaatccaataacattaacggctgcacttctgctattagttgcccattatgccataattggacctggtctacaagctaaagctacaagagaagcacagaagagagccgccgcaggaataatgaaaaaccctacagtcgatggtataacagtaatagatctagaacccatcccttatgatcctaaattcgagaaacagttagggcaagttatgctattagtactctgcgtaactcaagtattaatgatgagaactacatgggcgctttgtgaagcactgacattagccacaggtccgataagtactttatgggaaggaaatccaggtcgtttctggaacacgacgatcgcagtctctatggcgaatattttcagagggagctatttagcaggtgctggattattattctcaataatgaaaaatacaacaaatacacgaaggggaactggcaacataggagaaactctcggggagaagtggaaatccagactaaatgctctcggaaaaagtgaatttcaaatttacaagaaaagtggcatacaagaagtggatcgaactttagctaaagaaggcataaaaaggggagagactgatcaccatgccgtaagtagaggatccgctaaattacgatggttcgtagaaagaaatatggtaaccccagagggaaaagttgtagatcttggatgtggcaggggagggtggtcctactactgcggagggctaaaaaatgtgagggaggtgaaagggctaacaaagggtggtccaggacatgaagagccaattcctatgtcaacatacggttggaatcttgtgaggttgcaaagtggtgtagatgtcttctttactccacccgaaaaatgtgacacattattgtgcgatataggggagtcttctccaaatcctacaatagaggcagggcgtaccctaagagtcctgaatttagtagaaaactggttaaacaataatacccaattttgcataaaagtgctgaatccatatatgccctcggtgatagaaaaaatggaaacacttcagcgcaagtatggaggtgcgcttgtacggaacccactgtcgaggaatagcacacacgagatgtactgggtcagcaatgcaactgggaatattgtctctagcgtaaatatgataagcagaatgttgatcaatcgattcacgatgaagcataaaaaagccacttatgaaccagatgtagacttaggttctggaacccgaaatattggtattgaaaatgagatacccaatttagacatcataggaaagagaatagagaagataaaacaagagcatgaaacatcctggcattatgatcaagatcatccctacaaaacctgggcttatcacggatcatacgaaactaaacaaacaggctccgctagttcgatggtaaacggagttgttaaattactcacgaaaccatgggatgttgttcccatggttactcaaatggctatgactgacaccactcccttcggtcagcaaagagtatttaaagaaaaagtcgatacaagaacacaagagcccaaggaaggtacgaaaaaacttatgcgcattacggcagagtggttatggaaagaattgggcaagaagaaaacacctcgaatgtgtacgagagaagaattcacgagaaaagttagaagcaacgcggcactgggggcgatttttaccgacgaaaataaatggaaatcagcccgcgaagcagtcgaagactcaagattctgggagttggtagaccgagaaagaaacctgcatctagaaggaaaatgcgagacgtgtgtctataatatgatggggaaaagagaaaaaaaattgggggaatttgggaaggctaaaggaagtagagcaatatggtatatgtggttgggtgcaagatttctcgaattcgaggctttgggattcttgaacgaagatcattggtttagtcgtggcaattctttaagcggagtcgagggagaggggctccataagttgggatatattttaagagacgtaagcaaaaaagaggggggagcaatgtatgccgatgataccgctggctgggacactagaattacgttagaagacctcaaaaatgaggagatggtgaccaatcacatgaagggtgagcataaaaagctagctgaagctatattcaagttaacatatcaaaataaggtggtaagagtacaacgaccgacaccgcgtggtacagtgatggacataattagccggaaagaccagagaggcagtgggcaggtcggaacgtatggactaaacacctttacaaatatggaagcacaactaattcgtcaaatggaaggagaagggatattcaagtcaatacaaagactcacagttacagaagaaatagcagttcaaaactggctagctcgagttggtcgcgaaagattatcaagaatggcgatatcgggagacgattgtgtagtgaagccattagatgacagatttgcttccgcgttaacagcacttaatgatatgggcaaagtaagaaaagatatccagcaatgggaaccgtcaagaggatggaacgactggacacaggttccattttgttctcaccattttcatgaattggttatgaaagatggaagagtcctagtagtcccatgccgtaatcaggacgaattaatcggaagagctcgaatatcacagggagctggatggtctttaaaagaaacagcatgtctcggtaaaagctacgctcaaatgtggacactgatgtacttccatagacgagacttaagattagcagccaatgccatatgcagtgctgtgccgtcacactgggtacctacatcacgtaccacatggagtatacatgctaaacacgaatggatgacaacggaagacatgttagccgtctggaaccgagtatggatccaagaaaacccatggatggaagataaaaccccagtagaaagctgggaagaagtaccatatcttggtaaacgcgaagatcaatggtgcggttccctaataggactcacaagtagagctacatgggcaaaaaatatacagacagctatcaaccaagtacgctccctaattggtaatgaagaatatacggattacatgccaagcatgaaacgttttcgtaaagaagaagaagaagcaggagttctatggtaa

SEQ ID NO: 22572 - RNA, 9876 nt, synthetic construct
  misc_feature 1..9876: note = derived and/or modified CDS sequence (opt6) from DENV-2__EU569711__SS-prME
  source 1..9876: mol_type = other RNA
acagcaggagtaataattatgttaatacctacagcaatggcatttcatttgacaactaggaacggagaaccccacatgattgtaggtagacaagaaaaaggcaaatctcttttatttaaaacagaagatggggttaatatgtgcacactgatggcaattgatttaggagaactatgcgaagataccattacatacaaatgtcctttgctgcgtcaaaatgaacctgaagacatagactgctggtgtaactcgacatcaacatgggtaacttacggtacctgtactactacaggagaacatcgtcgagaaaaacgcagcgtagcattggtgccacacgtaggaatggggctagaaaccagaacagaaacgtggatgtcatcagaaggcgcatggaaacacgtgcaaagaatagaaacttggatactgcgacacccgggtttcacaataatggctgctattctagcttacacaatcggaacaactcactttcaacgagcactgatattcatcttgttaacggcggtagctccttcgatgacgatgaggtgtattggcattagcaatcgggacttcgtggaaggggtctcaggcggatcttgggttgacatagttctagaacatggatcatgcgttacaacgatggctaaaaataaaccaactttggactttgaattaattaaaaccgaagcaaaacaaccggccacattacgcaaatattgcatagaagcaaaactgaccaataccacgactgaatcgagatgcccgacacagggagaaccgtcattaaatgaagaacaggacaaacgcttcatttgcaaacatagtatggtggatcgaggctggggtaacggatgtggactatttggtaaaggaggaatcgtcacttgcgcaatgtttacgtgcaagaaaaatatggagggtaaagtagtactgccagaaaatcttgaatatactattgtgataacgcctcactcaggtgaagaacatgcagtcggaaacgatacgggcaaacacgggaaagaaataaaaataacacctcaatccagcataacagaagcagaacttactggttacggcactgtaacgatggaatgttcacctcgcactggattagactttaatgaaatggtgctcctacaaatggaagataaggcttggttagttcatagacaatggtttttagatttacctctaccgtggttgcctggagcagatacacaggggtctaattggatacaaaaagaaaccttagttacatttaaaaatccacatgccaagaaacaagacgtggtagtactaggtagccaagaaggagccatgcacacagcactgacaggagcgaccgaaattcagatgagtagcggaaatttactattcactggtcatctcaaatgtcgactaaggatggataaattacagttgaaaggcatgagctacagtatgtgcacgggaaaattcaaaatagtcaaagaaattgcagaaacccaacatgggacaattgttattagggtacagtacgaaggcgatgggtcaccgtgtaaaataccattcgagataatggacctggaaaaacgtcacattctaggtcgcttaattaccgtaaacccgatagttacagagaaagatagtccggtaaatatcgaagcagaaccgccatttggagatagttatataattatcggggtagaaccagggcagctaaaattgaactggtttaaaaaggggtcctcgattggacagatgtttgaaactactatgcgaggggccaaacggatggctattttaggcgatacagcatgggattttggatccttaggtggtgtctttacttcaataggaaaagccctccatcaagtatttggggctatatacggagccgctttttcaggagtgtcttggacaatgaaaatactaataggagttataattacctggattggaatgaactcaagatcaacaagtctttcggtatcattggtgttagtaggggtagtgacattgtatctgggggtcatggttcaagcggatagcggctgtgtcgtttcctggaaaaacaaagaattaaagtgcggttcgggaatattcattactgataatgtacatacatggacagagcaatataaatttcaacctgaaagtccgagcaaactagcctcggcgatacagaaagcccatgaagagggcatttgtggtataagatcagttacccgactagagaacttgatgtggaagcaaatcactcccgaattgaatcacattctttcagaaaatgaagtaaaattgactatcatgacaggagacattaaaggtataatgcaggctgggaaaagatccctacgaccgcagcctaccgaattaaagtatagctggaagacatggggaaaggccaaaatgttgtcaactgaatcacataatcaaacattcttaattgacggacctgaaactgcagagtgtccaaacactaacagagcttggaactctctggaagttgaagactatggatttggagttttcagtaccaatatttggctcaaactaagagaaaaacaggatgtattttgcgattctaaattaatgagcgcggcaataaaagataaccgtgcggtacatgcagatatgggttattggatagagagtgctcttaatgacacgtggaagatggaaaaggcttcttttattgaagttaagagttgtcactggccaaaatcacatacgttatggtcgaacggtgtgctcgaatccgagatgataatccctaaaaactttgctgggccggtttcgcaacataactataggcccggctaccacacacaaacagcgggaccatggcatttgggcaaacttgagatggattttgatttttgtgaagggaccaccgtcgtagtaacagaagattgcggtaataggggaccatcgcttcggaccacgaccgctagtggcaaattaataacagagtggtgttgccgcagttgtactttaccgccattgaggtatcgaggtgaagacggttgctggtacggaatggagatcagaccactaaaagagaaggaagaaaatcttgtaaacagccttgttactgcaggacacggtcaaatagataatttttcactaggagtgcttggtatggctctattcttagaagagatgctacgaacgagggtaggtacaaagcatgctatcttacttgtcgcagtatcttttgtaacccttattacgggaaatatgtcattcagagaccttggaagagtaatggtaatggtcggcgcgacaatgaccgacgatataggaatgggagtaacttacttggcgttattagctgcgttcaaagttagaccgacatttgcagcaggattattactgagaaaacttacctctaaagagttaatgatggctacaattggaattgcgctgctgtcacaaagtacaatacctgagacaatattagagctaacagacgcgctagctttgggtatgatggtgttaaaaatagttcgtaacatggaaaaatatcaattagctgtaacaatcatggctataagttgtgtaccaaacgcagttatcctgcaaaacgcttggaaagtctcgtgtacgatcctagctgcagtaagtgtcagtcctttgcttctcacaagtagtcaacaaaaagcggactggatcccgttagctttaacaattaaaggactaaatcccacagcaatatttctaacaacattaagtcggacaagtaagaagcgtagttggccgctgaacgaggcggtaatggcagttggtatggtctcaatactagctagcagtttgctgaaaaacgatattccgatgacaggacccctcgtagcaggcggactacttaccgtatgttatgtattaactggccgtagtgcggacctggaattagagcgtgcggcagatgttaaatgggaagaccaggccgagatttctggatcttctccaatcttaagtattacaatctctgaagatggatcaatgagcatcaaaaatgaagaagaagaacatactttaactattctgataagaaccggtctcctagtaatctcgggcgtgttccctgtatcaatccctataacagcggccgcgtggtatctatgggaagtcaaaaagcagagggctggagttttatgggacgtgccctcaccaccacctgttggaaaagctgaactcgaggacggtgcatacagaattaaacagagaggaattttcggatattcccagataggtgctggggtatataaagaaggcacattccatacgatgtggcacgttacaagaggggcggtattaatgcatcgcgggaagcggatagaacctagttgggcagacgtcaagaaagacttaatctcttatggaggaggatggaaacttgaaggggaatggaaggaaggagaagaagttcaagtactagccctagagccgggcaaaaatccacgagcagtacaaactaagccaggtttgtttaaaacaaacacggggacgataggggcggttagtcttgacttttctcctggtacaagtggcagcccgatagtcgatagaaagggtaaggtagtaggactgtacggtaacggagttgttactagatcaggtgcatatgtttcggcaatagcccaaacggaaaaatcgatagaagataatcctgaaatagaagatgacatatttcgaaagaagcgcctaactattatggatttacacccaggggctggtaaaaccaagagatacctccctgcgattgtacgagaggctataaaacgaggattgcgcacactgattttagccccaactcgcgtagtagcagcagaaatggaagaagcattaaggggcttaccaattagatatcaaactccggcgattcgagcagaacatacaggaagagaaatagtagacctaatgtgtcatgcaacgttcacaatgcgtttattgagcccagtacgtgttccaaactataacctgatcataatggatgaggctcactttacagatcctgcatctatagccgcacgaggctatatatcgactagagtggaaatgggagaggcagccggaatttttatgacagcaacaccgccggggtcaagagacccctttccgcagtcaaatgctcctatcatggacgaggagcgtgaaatacccgagagaagttggaacagcggacacgaatgggtaaccgactttaagggaaagaccgtatggtttgttccatccattaaagctgggaatgacatagcagcgtgccttcgtaaaaatggtaagaaagtcatacaactgagcaggaaaaccttcgacagtgaatatgtaaaaacaagagctaacgattgggactttgttgttacaacggatatcagcgaaatgggcgcaaacttcagagctgaaagggtcattgaccctaggagatgtatgaaacctgtaattttaacagacggcgaggaacgtgtaattttagctggaccaatgccagtcacacacagtagcgcggcacagagaagaggaagaataggaagaaaccctaagaacgagaatgatcagtacatttacatgggagaacctctagaaaatgacgaagactgtgcacattggaaagaagctaaaatgttattagataatatcaatactcccgaaggtattataccatctatgtttgaacccgaaagagaaaaggtagacgcaatagatggcgaatatcgactcagaggagaggctcgaaaaacttttgttgacctaatgcgaaggggcgacctacctgtgtggcttgcgtatagggtggcagctgaagggataaattacgcggaccgccgatggtgttttgacggaatcaaaaacaatcaaatattagaggaaaatgtagaagtggaaatatggacaaaagaaggagaaaggaaaaagttgaagcctagatggttagatgcacgaatatattctgacccactagcactcaaagaatttaaggagttcgcagccggtagaaaatctctaacacttaatttaattacggaaatgggaagattaccgacgtttatgacacaaaaggcccgagacgccttagacaatttagcggtacttcatacggcagaagtgggaggcagagcgtataaccacgcacttagtgaattgccagaaacccttgagactcttttgttacttacactattggcgaccgtaactggtggcatcttcttatttttgatgagtggcaaaggaataggaaaaatgactctcggtatgtgctgcatcataacggcatcaatattactttggtacgcacaaatacaaccacattggatcgcggcctccatcatacttgagttctttctcattgttttattaataccagaacctgaaaagcaaagaaccccacaggataatcaacttacatatgtagttatagcaattctaacagtggtggcggcaactatggcaaatgaaatgggattcttagaaaagactaagaaagacctgggtttaggatcgattacaacacaagagagcgagtctaatatattagatatagatctgcgaccggcatcggcatggactttatatgcagttgccactaccttcgtaacaccgatgttgaggcacagcattgaaaacagttctgtgaacgtctctctcactgcgatcgccaatcaagcaacagtcttaatgggactaggtagaggttggccactaagcaaaatggacataggagtaccactattagctattggttgctatagtcaggttaacccaataacactcaccgcagcattattactcttagtagcacactacgctataataggaccgggtttgcaagcaaaagcgacaagagaagcacagaaaagagcggcggcaggtataatgaagaacccaacggtagatggaataacagtgattgacctcgagccaataccatatgaccctaagtttgaaaagcaactcgggcaagttatgcttttagttttatgcgttactcaagtcctgatgatgagaacaacgtgggctttatgtgaagcgttaacactcgcaacaggacccatttcaactttatgggaaggcaatccaggacgattctggaatacaacaatagcggtaagtatggcaaacattttccgagggagctacctagcgggagcaggcctcctattttctataatgaaaaatacgacaaataccagaaggggaactggaaacattggtgagacattaggggagaaatggaaaagccgactgaatgctctaggcaaaagtgagtttcaaatttacaagaaatctgggattcaggaagtagatagaacacttgccaaggaaggcattaagcgaggagaaactgatcatcatgccgtctcaaggggaagtgcaaaactaaggtggttcgtagagcgtaatatggtgaccccagaaggaaaggtggttgatctgggatgtggaaggggagggtggtcctactactgcggtggactaaagaacgttagggaagtaaaaggattaacaaaaggcgggccaggacacgaagaaccaataccgatgtccacatacggatggaatcttgtgagactacaaagtggcgtagatgtgttctttacaccgccagagaagtgtgatacgctcctctgtgacataggagagagcagcccaaatcctaccatagaggccggtagaaccctgagggttctcaatctagtagaaaactggttaaataacaacacacagttctgcatcaaagtccttaatccatatatgccctccgtaattgagaaaatggaaacactccaaaggaaatatggtggagccctagtaagaaatcctttatcacggaactcgacacatgaaatgtattgggtgagcaatgctacaggtaacatagtatccagtgtcaacatgataagcaggatgcttataaatagattcactatgaaacacaagaaagcaacttatgaaccggatgtcgacttgggatcgggtactcgtaatataggtattgagaatgaaatacccaacttagatataattgggaagcgcatagagaaaataaaacaggaacacgaaacgtcttggcattatgatcaagatcacccctataagacatgggcgtatcacggatcatatgagacaaaacaaactggtagtgcatcaagtatggttaatggggttgtacgactattgactaagccttgggacgtggttccaatggtgacacaaatggccatgaccgacacaactccatttggacaacagagagtatttaaggaaaaggtcgacacacgaacccaagagcccaaagaaggaaccaagaaacttatgagaataaccgcggaatggttgtggaaagaacttggtaagaagaaaacaccacggatgtgcactagagaagagttcacaagaaaagttagaagtaatgcagcactgggagcaatatttaccgatgaaaataaatggaagtccgcccgagaagcagttgaagattcacgattttgggagctagttgatcgagagcgcaatctacatctcgaggggaaatgtgaaacttgcgtatataatatgatgggtaaaagggagaagaaactaggagaatttggtaaagcgaaaggatcacgagctatatggtacatgtggttaggtgcacggtttttagagttcgaagctctgggcttcttaaatgaagatcactggtttagtagaggcaacagcctttcaggggtcgaaggtgaaggacttcacaaattaggttacatcttaagagacgtctccaagaaagaaggtggtgctatgtatgccgatgatactgcagggtgggataccagaataacacttgaagacttaaagaatgaagaaatggtaacgaatcatatgaagggggaacataagaaattagctgaagcaatcttcaaacttacataccagaataaggtagtcagagttcaacgaccgacaccacgaggcacagtcatggacataataagtcgtaaagaccagcgaggaagtggacaagttggaacttatggactcaataccttcacgaatatggaagcacagttaattagacaaatggaaggcgagggcatcttcaagagcatacaaaggctaacagtaaccgaagaaatagccgttcaaaattggctagcacgagtaggaagggaacgattatcacgaatggctatatcgggtgacgattgtgtagtaaaacccctcgatgatagatttgcatcagcactaactgccttaaatgacatgggaaaagtgagaaaggacatacaacaatgggaaccatctagaggttggaatgattggacacaggttcctttttgctcacaccattttcatgaattggtaatgaaagatggcagagtcctcgtcgtcccttgtagaaaccaggacgaacttataggtagggcacgtatatcgcaaggagctgggtggagtctgaaagaaacagcttgcctgggcaagtcgtacgcccagatgtggacattaatgtattttcaccggcgagacttaaggttagcagctaacgctatatgttccgcggtccctagtcactgggtacccacgtcccgcacaacatggtcgattcatgcaaaacacgaatggatgacaaccgaggacatgttggcagtatggaatagagtgtggatacaagaaaatccgtggatggaagataaaacccccgtagaatcgtgggaagaagtgccttatctagggaaaagagaagatcaatggtgcgggtcgctaatcggactaacgagccgcgccacatgggccaaaaacattcagacagcgatcaatcaagtccggtctttaattggtaacgaagaatatactgattatatgccaagtatgaagaggtttagaaaggaagaagaagaggctggagttctatggtga

SEQ ID NO: 22573 - RNA, 9876 nt, synthetic construct
  misc_feature 1..9876: note = derived and/or modified CDS sequence (opt6) from DENV-2__EU569712__SS-prME
  source 1..9876: mol_type = other RNA
accgccggaatgataatcatgttaattccaacagcgatggcgtttcatttgaccactaggaacggtgaaccacatatgattgtaggaagacaagaaaaaggaaaatcactactctttaaaactgaagacggagtgaatatgtgcactctcatggctatcgatctaggcgaattatgtgaagacacaataacgtacaaatgtcctttacttcgccaaaatgaaccagaagatatcgattgttggtgcaattcaacatcaacttgggttacgtatgggacatgcacgactacaggagaacatagaagggaaaaacggtcagtggcgttagtaccacatgttggtatgggtttagaaacaagaacagaaacctggatgtcttcagaaggagcatggaaacacgtgcaaagaatagaaacctggattttaagacacccaggtttcacaattatggccgccatacttgcttataccatcgggactacccatttccaaagagctcttatattcatcctcttgacggcagtagctcccagcatgaccatgcgatgtatagggatatcgaatagagattttgtcgagggggttagtggcggttcatgggtcgacattgtattggagcacggaagctgcgtaacgacgatggccaaaaataaaccgacactagatttcgaactcattaaaactgaagcgaaacaacctgctacactacgaaaatattgtatagaagctaaattaacaaacacaacaactgaatcaagatgcccaacacaaggagaaccaagcctaaacgaagaacaggacaaacggttcatatgcaaacattccatggtagatagaggatggggaaacggctgcggcttatttggcaaaggagggatagtaacctgtgctatgtttacctgcaagaaaaacatggaaggtaaagtagtcctacctgaaaatttggaatacacaattgtaattacgccacattccggtgaggagcatgcagtaggtaatgatactggcaaacatgggaaagaaattaaaataactccacaaagttcaataacagaagctgaactgacaggatacggcactgttacaatggagtgcagtccgagaacagggctagatttcaacgaaatggtcttattacagatggaagacaaagcatggctcgtacatagacaatggtttctagacttacctttaccttggttaccaggggctgacacacaaggcagtaattggattcaaaaagaaaccttagttacttttaaaaacccgcacgctaagaaacaggatgtagtcgtactgggtagccaagagggagcgatgcacacagcattgacaggcgcgacagagatacaaatgtcaagtggaaatctactctttacaggtcacctgaaatgtcgactcagaatggataaactacaacttaaaggaatgagttatagtatgtgtacaggaaaatttaaaatagttaaagagatagcagagacacaacacggcacaattgtgataagagtacagtacgaaggcgatgggagtccatgtaaaataccatttgaaataatggatctagaaaaacgatatgtattaggacgattgataacggtaaatcctattgtgactgagaaagattcaccagttaatatagaagcagaaccaccattcggagacagctacatcattatcggtgttgaaccaggccaacttaaattaaactggttcaagaaaggttcgagtataggacaaatgtttgaaacgacgatgcgtggagccaaacgcatggcgatattgggtgacaccgcgtgggatttcggatcactagggggagtatttaccagtatagggaaagcacttcaccaagtcttcggtgccatatatggtgcagccttctcgggtgtatcatggactatgaaaattctgataggggttatcataacatggataggtatgaacagtcgaagcacatcactatcagtgtctctggtattggttggagtagtgactttatacctaggagttatggtacaagcggattcagggtgtgtagtctcttggaaaaataaagagctcaaatgtggttcagggatatttataacggataatgtacatacctggactgagcaatataaattccaaccagaatcacccagtaaattagcttcagcaatccaaaaagctcacgaagagggaatatgcggtataagatccgtaactaggttagaaaatctaatgtggaaacaaataacccctgaattaaatcacatattatccgaaaacgaggtaaaattaacgataatgacaggcgatataaaagggataatgcaggcaggtaaaagatcactacgccctcagccgaccgaactgaaatattcgtggaaaacttggggaaaggcaaagatgcttagtacagaatcacataaccaaacatttcttatagacggaccagagactgcggaatgtccgaacacgaacagggcttggaactcgttggaagtggaagactatggatttggagtgttttcaacaaacatctggctaaaactgagggaaaaacaagatgtattctgtgattccaagctcatgtcggcagccattaaagataacagggctgttcatgctgacatgggttactggatcgaatcagcactaaatgatacttggaaaatggaaaaagcgagtttcatcgaggttaaaagctgtcattggccgaaatctcatacgttgtggtcaaacggcgtattagagtcagagatgattatccccaaaaattttgcaggtccagtttctcaacataactaccggccgggatatcatacacaaaccgcgggtccgtggcacctggggaaattagagatggactttgatttttgcgaaggaaccacagttgtcgtgacagaagactgtggtaacagaggaccaagtttaagaaccacaacagcatccggtaaattaataacagaatggtgttgccgcagctgtactctgcccccattaaggtacagaggagaagatggatgttggtatggtatggaaataaggcctctcaaagaaaaagaggaaaatttggttaacagcttagttaccgctggacacggacaaatagataatttttcattgggagtattaggcatggcactctttttggaggaaatgctgaggactagagtaggtaccaagcatgcgatcttactggttgcagttagttttgtaactcttattacaggaaacatgtcgttcagagacctcggcagggttatggtcatggtgggcgccactatgacagatgacatagggatgggagtaacatatcttgctctattagctgcatttaaggttaggccaacattcgccgcagggttactactaagaaaattaacaagcaaagagcttatgatggctactatcggtattgctctactaagccaatcgactataccagagacgatcctagaattgacagatgcgctggcactcgggatgatggtgttaaaaattgtgagaaacatggaaaaatatcagttagcagttaccatcatggcgattctctgtgtgcccaatgctgttatcttacaaaatgcgtggaaagtgtcatgtacgatcctcgcagctgtcagtgtaagtccattgcttttaacctcatcacaacaaaaagcagattggattccacttgcactaactataaaaggtcttaacccgacagcaattttcctcacaacactttctagaacctctaaaaagagaagctggccactgaatgaagcggttatggcggtaggaatggtgtcaattttagctagcagcttactgaaaaatgatatcccaatgaccggtccattagtagctggcgggttattaaccgtttgttatgtattaactggaaggagtgccgatctggaattagagcgggcggctgatgtcaaatgggaagatcaagcagagatcagcggctcaagtccaatcttatcaataactatatcagaggacggctctatgtcgatcaaaaacgaagaagaggaacaaaccctaacaattctcatccgaacgggcttattggtcatatccggggtatttcccgtaagcataccaattacggcggctgcgtggtatctgtgggaggtaaagaaacagagggctggagtcttatgggacgtaccatccccacctccagttgaaaaagctgaacttgaggacggagcctaccgcattaaacaaagaggaattttcggatatagtcaaatcggcgcaggagtttataaggagggcactttccatactatgtggcacgtaactcgtggagcagttctaatgcacagaggcaagaggatcgaaccctcatgggcagacgtcaagaaagatcttatatcatatgggggcgggtggaaactcgaaggagagtggaaagaaggggaagaggttcaagttctcgctttggaacccggcaaaaatcccagagcagtacaaaccaagccaggactatttaaaactaataccggcacaataggagctgttagtctggatttcagccctggaacttcaggatctccaatagtagaccgaaaagggaaagtcgttggattatatggtaatggggtggtcacacggtcaggagcatatgtatccgctatagcgcaaacagagaaaagcatagaggataacccggaaatagaagacgacattttcaggaaaaagcgactgacgataatggatctccaccctggtgcaggaaagacaaaaagatacttacctgcaatcgttcgagaggcaattaaacgagggctcaggacgctaatattagccccgaccagggtagtcgcagcagaaatggaggaagctctgcggggtctacctattcgataccaaactcctgcaataagagccgaacacactggcagagaaatcgtagatctgatgtgtcatgctacattcaccatgcgattactatcacctgttcgtgtcccgaattataatctcattataatggacgaagcccatttcacagatcccgcgagtattgcggctagaggctacatttctacaagggtcgagatgggtgaagcggccggaattttcatgactgccactcccccaggtagtcgagacccattccctcaatcaaatgcaccaataatggacgaagaaagggaaattcctgagaggagttggaactcaggccatgaatgggtaacagatttcaaaggaaaaactgtctggtttgtcccatcgattaaagctggaaatgatattgctgcctgtctaaggaaaaatggaaagaaagtgattcaactctcaaggaagacattcgatagtgaatacgtaaaaacgcgagcgaacgactgggatttcgtcgttactacagatatatcagaaatgggcgctaactttcgggcggaaagggttatcgatccccgccgatgtatgaaacctgttattttaaccgacggagaggaaagagtaattctggcgggtccaatgcctgtaacacatagcagtgctgcgcaaagaagaggcaggataggaagaaatcccaaaaatgaaaatgaccaatacatatacatgggcgaacctctagaaaatgatgaggattgcgcgcactggaaggaagctaaaatgttattggataacataaatacacccgaaggtattattccgagtatgtttgaacctgaacgtgaaaaagtcgatgcaatagacggcgaataccggttacggggagaagcccggaaaactttcgtagatcttatgagaagaggcgatctccccgtgtggctagcatacagggtggcggccgaaggtataaattatgcagatagacggtggtgttttgacggaattaaaaacaatcagatactggaagaaaacgtagaagtagaaatatggaccaaagagggggaaaggaagaaattaaaaccgcgatggttagatgctcgaatatactctgatccgctagcattaaaggagtttaaggagttcgcagcaggtagaaaaagccttacattaaacctaataacggagatgggacgattaccaacatttatgacacaaaaagctagggacgccttggataacttagccgtgttacataccgccgaggttggtggacgggcctataatcatgccctatcagaattaccagagaccttggaaactctattgttgttgacacttctcgcaacagtaacaggaggaatatttctatttcttatgagtggtaaggggataggcaaaatgacactaggtatgtgctgcataatcaccgcctctatacttctatggtatgctcagatacaacctcactggatcgctgcgagcattatcctagagttctttttaatagttcttttaatcccagaacctgaaaaacaaaggactccacaagataatcagcttacctatgtcgttatagcgatcctaacagtcgtagctgcaacaatggcgaatgagatgggttttcttgaaaagaccaagaaagacctagggttaggaagtataataactcaggaatctgagtccaatattcttgatatagatttaagaccggcatcagcatggacgttgtatgctgttgccaccacttttgtaacaccaatgcttagacactctatagaaaattcatctgttaatgtttcattaaccgcaatagctaatcaagcgactgtactaatgggactcgggcgaggatggcctctaagtaaaatggatataggtgtacccttattagcgataggatgttattctcaagttaaccccatcactttgacagccgctctattgcttttagtcgctcactatgctataataggacccggtctgcaagcaaaggcaacacgagaagcgcagaaaagggccgctgcaggtataatgaagaacccaacagttgacggtatcacggttattgatctggaaccaataccctacgatcctaaatttgaaaaacaactcggtcaagtgatgctccttgtattgtgtgtaacgcaagttttaatgatgcgcaccacgtgggcactctgtgaagcattaaccctagctactggtccaatttctacgttatgggaaggcaaccccgggcgattctggaatacgaccatcgcagtaagcatggcaaatatctttcgaggatcatatctggcaggcgcaggtcttctctttagtataatgaaaaatacaacgaacacacgaagagggactggcaacataggggagacattgggagaaaagtggaagagtaggttaaatgcacttgggaaaagcgagttccaaatctataagaaatcggggattcaagaagtagatcgaactttagcgaaggaaggaattaaaagaggtgaaacagaccatcacgccgtgtcgcgaggttcagctaaactacgctggtttgttgaaagaaatatggtaacgcctgaaggcaaagtagtcgacttgggttgtggacgtggtggatggtcatattattgtggtggactgaaaaatgtgagagaagttaaagggctaactaagggagggcccggccatgaggagccaattcctatgtcaacctacgggtggaatttagtccgtttacagagcggtgtagatgtctttttcactcctcctgagaaatgtgatacactactatgtgatattggcgagtcatcaccgaatcctacaatagaagcaggccgaactctacgagtactaaatctagtggaaaattggttaaacaacaatacgcaattttgtattaaagttttaaacccttatatgccatctgttatagagaaaatggagactctacaaagaaagtatggtggtgcattagttaggaacccactttctaggaactctacacatgagatgtattgggtaagcaatgcaacaggaaacattgtttccagcgtgaatatgatctcacgaatgctgatcaacagatttaccatgaaacataaaaaggccacgtacgaaccagatgtagacttaggaagtgggactagaaatattggaattgaaaatgaaattccgaatctcgacataatcggaaaaaggatagaaaagattaagcaagaacacgaaacatcatggcattatgatcaagatcatccatataagacctgggcataccacggctcctacgaaactaaacaaactggaagtgcatcttctatggtgaacggcgttgtaagactcctaactaagccgtgggacgtagtaccaatggtcacccaaatggccatgacggataccacaccgttcggccaacaaagagtatttaaggaaaaagttgatacacgtacccaggagccaaaggaaggaacaaagaaactgatgagaataactgcggaatggttgtggaaagaactaggcaaaaagaaaactccccgaatgtgtactagggaagagtttacgcgaaaagtaaggtctaacgcggccctcggggcgatttttaccgatgagaataagtggaaatcagctagggaagcagtggaagactcccgattctgggagctagtagatagggaacgaaacctccacttagaaggaaaatgtgaaacctgtgtatacaatatgatgggtaagagagagaagaaattaggggagtttggtaaagcgaagggatcacgcgccatctggtatatgtggttaggtgcaagattcctggaatttgaggcactcgggtttctaaacgaagaccactggttttcccgtggtaactctttatctggagtagaaggagaaggattacataaattaggatatatcctacgggacgtatctaagaaggaaggcggcgcaatgtacgccgatgacacagcgggttgggatacacgaatcactctggaggatttgaaaaatgaggaaatggtcacaaatcacatgaaaggcgaacataagaaactagctgaagctatttttaaactaacttatcagaataaagtcgtgagggtacagcgcccaactccgcgtggcacggtaatggatattataagtcgaaaagaccaaagaggtagcggccaggtcgggacatacggattgaacacattcactaacatggaagcccaattaataagacagatggaaggcgaaggcattttcaaatccattcaacatctgacggtaacggaagagatagcagttagaaactggttggctagggtaggcagagaaagactaagtagaatggctattagtggcgatgattgtgtagttaagcctttagatgacaggtttgctagtgctcttactgcactaaatgatatgggtaaagtccggaaggatattcaacagtgggaaccttcgcgaggctggaatgattggacccaagtccccttttgcagtcaccatttccatgaattggttatgaaagacggtagagtgttagtagttccatgtcgcaatcaggatgagttgataggccgggcaaggatttcccaaggggcagggtggagccttaaagaaacggcctgtttaggtaaatcatacgcacaaatgtggactttaatgtattttcacaggcgagacctcagactagcagctaacgcaatatgtagcgccgttccatcacattgggtaccaacttcgcgaacaacatggagcatacatgccaaacatgagtggatgacaaccgaagatatgctagcagtttggaacagggtttggatacaggaaaatccctggatggaagataaaactcctgtcgagagttgggaagaagttccgtatttgggtaagcgagaagatcagtggtgtggttcgctaatcggcctaactagcagggccacctgggccaaaaatatacagacagcaataaaccaggtaagatcgttgataggtaatgaggaatatacagattacatgccaagtatgaaacggtttcggaaagaggaagaggaagcgggagtactatggtaa

SEQ ID NO: 22574 - RNA, 9876 nt, synthetic construct
  misc_feature 1..9876: note = derived and/or modified CDS sequence (opt6) from DENV-2__EU596487__SS-prME
  source 1..9876: mol_type = other RNA
acggcaggcgtgataatcatgttaatacccacggcaatggcgtttcacttaacgacacgaaatggagaaccccacatgattgttggacgacaagaaaaaggaaaatcattactatttaaaacagaagatggagtaaatatgtgcacgcttatggctatagacctaggagaattatgcgaagacactattacatacaaatgtccgctattacggcagaatgaaccagaagatatagactgctggtgcaattcgacgagcacatgggtaacgtatggaacttgcaccaccacgggggaacatagaagagaaaaacggtctgtggctttagtcccccacgttggaatgggactagaaacgcgaacagagacctggatgtcttcagaaggggcctggaaacacgttcagagaattgaaacttggatactaaggcacccgggctttactataatggcggccatattggcttacacgatcggaaccacacactttcaaagagctcttatatttatactactaaccgctgtggccccttcaatgacaatgaggtgtataggtatatccaatagggatttcgtagaaggcgtaagcggcggatcctgggtagacatagtcttagaacacgggagttgcgtcacaacaatggcgaaaaataaacctactctagactttgaactaataaaaacagaggcgaaacaacccgctactttaaggaaatattgcatcgaagcgaaattgacaaatacaaccacagaatcacgttgcccgactcagggggagccatctttgaatgaagaacaagataagcgtttcatatgtaaacacagcatggttgatcgaggatggggcaatggatgcggactattcggaaaaggaggaatcgtaacctgcgctatgtttacatgcaagaaaaatatggaaggaaaagttgttctaccagaaaaccttgagtatacaatagttataacgccccatagtggagaagaacacgctgtcggcaacgacactggaaaacatggaaaagaaatcaaaataacacctcaaagcagtattacagaagcagaactaactggctatggaaccgtaaccatggaatgctctccgcgtactggattggactttaacgagatggtattgcttcagatggaagacaaagcatggctagtgcacaggcaatggttcctagacctacccctaccttggttaccaggagcagacacccaaggtagcaattggattcaaaaagaaacgttggtaacattcaaaaatccccatgctaagaaacaagatgtagtcgtcctagggtcacaagagggcgcaatgcacacagcacttactggagcaacagagatccaaatgtcctccgggaaccttctcttcaccggtcatctaaagtgtcgtttaagaatggataaattgcagttaaaaggaatgagttattctatgtgtacaggcaaattcaaaatcgtaaaagaaatagccgaaacacaacacgggactatagtgatccgtgtacagtacgaaggtgatggatccccctgcaaaataccattcgaaataatggatttagagaaaagacacgttcttggacgattaattactgtcaacccgatagtcaccgaaaaagactcccctgtaaacattgaggccgagccacccttcggagatagctatataataataggtgttgaacctgggcaactgaaactcaactggtttaagaagggctcaagcattggtcagatgtttgaaactactatgcgtggtgcgaagagaatggccatcttgggagataccgcctgggattttggaagtctaggtggtgtattcactagcatcggcaaagcactgcatcaggttttcggagccatctacggggcagcatttagtggcgtctcctggactatgaagatactaataggtgtgatcatcacttggataggaatgaactcccggtcgacctcactatcagtttcgttagtgttagtaggcgtagtaacattatatttaggggttatggtacaagcggatagtggttgcgttgtttcatggaagaataaagagctaaaatgcgggtcaggaatattcattacagacaatgtacatacatggacagaacagtataagtttcaaccagaatcaccatcaaaattggcaagtgcaatccaaaaggcacatgaagaaggaatatgcggcatcaggtctgttacgagactagaaaatttaatgtggaagcagattacaccagagttaaatcatattttaagtgaaaacgaagtaaagttgaccataatgaccggagatattaaaggaataatgcaagcgggaaagagatctctacggccacaacctactgaactcaagtattcgtggaaaacatggggaaaagccaaaatgttgtcaactgaaagtcataatcaaacattccttatagacggtccagaaactgctgagtgcccaaatactaatcgagcatggaactccttagaagtagaagattatggattcggggtgttcagtacgaacatctggctgaaattacgagagaaacaagacgtattttgcgactcaaaattaatgtcagctgctataaaggataatagggccgttcatgctgatatggggtattggatagaaagtgcattaaacgacacatggaagatggaaaaggcctcatttattgaagtaaagtcgtgtcattggcccaaatcgcatacgctatggagcaatggagtgttagagagtgaaatgattatacctaaaaatttcgctggtcctgtaagtcagcataattacagaccgggatatcacacacaaaccgcaggaccatggcatttaggaaaattggaaatggattttgatttttgcgaaggtacaacagttgtagtaaccgaagactgcggaaatagaggtccaagtctgagaacaactacagctagtggtaaattaataaccgagtggtgctgcaggagctgcacacttcctcccctacggtatcgaggtgaagatggttgttggtacggcatggaaattcgacccttaaaagaaaaagaagaaaatctcgtaaattccctggttactgctggccacggtcaaatcgacaattttagtctaggagtacttggaatggctttatttttagaggaaatgttaagaacgagagtcggtacaaaacacgctattctattagttgcagtatcatttgtcacattaataacgggtaatatgagtttccgagatctaggaagggtaatggttatggttggagctacaatgactgatgatattggaatgggcgttacttaccttgccttgttggctgcgtttaaagtacgcccaacattcgctgcggggctattgcttagaaaattaacatcaaaagaattaatgatggcaactataggcatcgcccttttaagtcagtctactatacccgagacaatcctagagttaactgatgctcttgccctagggatgatggttttaaaaatcgttcgaaatatggaaaaataccagttggcagtcacaattatggccataagttgtgtacctaatgctgtaattctccagaacgcgtggaaagtgtcttgtacaatcttagctgcggttagcgtatcacccttattgttaaccagttctcagcagaaagctgactggatccctttagcattgactattaaaggactaaacccgacggccattttccttaccactctgtctcgaacatctaagaaacgaagctggccactcaatgaagcagttatggctgtcggtatggttagcatactcgcttcttcactgctcaaaaatgacatccccatgaccggtcctctcgttgcgggaggcttactaacagtatgctacgtgttgacaggaaggtccgcagatcttgagttggagcgtgcagctgacgttaaatgggaagaccaagcagaaataagcgggtctagcccaatactaagcattacaatcagtgaagatggttcaatgtccatcaaaaatgaggaggaagaacatactctaacaattctaatacgcacaggactcttagtgattagcggagtattccctgtgtcgataccgattacagcagctgcatggtacctttgggaggtcaagaaacaacgtgcaggagtgttatgggatgtaccatcacccccgccagtcggaaaggcagaactagaagatggtgcctataggataaagcagcgaggaatatttggatactcccagattggagcgggtgtttataaagagggtaccttccatactatgtggcatgtaacgaggggtgcggtactaatgcatcgaggtaaaagaatagaaccttcctgggcagatgtcaagaaagatctaatatcatacgggggtggatggaaactagagggtgaatggaaagaaggagaagaagtacaagtactagcgctagagcctggaaagaatccgagagctgtacaaaccaagccaggtctttttaaaacgaataccggaacaatcggggctgtctcactagatttttcacctggaacatcaggatccccaatagtagatagaaaaggtaaagtggttggtctttatggtaatggcgtggttacgcgttcaggagcgtatgtgagtgccatcgcacaaacagagaaaagtatagaagacaaccctgaaattgaagatgatatcttcagaaagaaaaggctcactattatggatctacatccaggagcagggaagacaaaaagatatcttcctgcaatcgttcgagaggcaatcaaaagaggactacgaacattgattttagcaccaactagagttgtagcggccgaaatggaagaagccttgaggggacttccaattcgctaccaaacaccggcaatcagagcagagcacacaggaagggaaatagtggatttgatgtgccacgctactttcacgatgcgtctgctctctcctgttagagtaccgaactacaatctaattataatggatgaagcacacttcacagatccagcaagtatcgcagcgcgtggatacatatcaactcgggtagaaatgggcgaagccgcgggtatatttatgacggcaacaccgccgggaagtcgtgacccatttccacaatctaatgcgccaataatggatgaggaacgcgaaatacccgaaagaagctggaatagcggacacgagtgggttactgactttaagggaaaaaccgtatggtttgtaccgagtattaaggcagggaatgatattgctgcctgcctaaggaaaaatggtaaaaaggtcatacaactgagcagaaaaacttttgattccgagtatgtaaaaactagggctaatgattgggatttcgtagtaactaccgacatatcagaaatgggcgccaatttcagagctgaacgcgttatagatccgcggagatgcatgaaacctgtaatactaacagatggagaagaacgagtcatattagcgggtccaatgccagttacacactcttctgcggcccaaaggagaggcaggataggcagaaatccaaagaatgagaacgatcaatatatatatatgggagaaccgttggaaaatgatgaagattgtgcccattggaaagaagcgaaaatgctgttagacaatattaatacaccagaaggaataattcctagtatgttcgaacctgaacgagaaaaagtggacgcgattgatggagaatacagattaagaggcgaagcgagaaaaacatttgttgacttgatgagaagaggggatttacctgtttggctagcttatagggtggcagcagaaggaataaactacgcggatagacgatggtgttttgacggaatcaaaaataaccagatactcgaagaaaatgtagaagtagaaatatggacaaaagaaggtgagagaaagaaactaaaacccagatggttagacgctcgtatatatagtgatccgttagctttaaaagaatttaaagagttcgcggcggggcgtaagagcctcacgctgaatctcataacagaaatgggccgtctaccgacatttatgacccagaaggcccgggacgcattagataatttagctgtcctacacacagccgaagtaggcggcagagcgtataatcatgcattaagtgaactccctgaaactttggaaactttgctattattaactttgctggcaactgtcacaggaggtatatttttgttcttaatgagtgggaagggtataggtaaaatgactttagggatgtgctgtataattactgcgagcattttactatggtacgctcaaattcagccgcattggatcgctgcaagcatcatattagaatttttcctgatcgtgttattaatacccgaaccagagaagcagaggacacctcaagacaatcaactgacttatgttgtcatagcgatcttaacagtagtagccgcaaccatggctaacgagatgggattcttagagaaaaccaagaaggatttaggactaggcagcataactacacaagaaagtgagtcaaacatactcgacatagatctaagaccggcctcggcatggacactatacgcagtcgcgaccacattcgtaacaccaatgctacgacactctatcgagaatagttctgttaatgtctccctaacggctatagcgaaccaggctacagtacttatgggcctaggacgcggatggcctcttagtaaaatggacattggtgtaccattgctcgcaattggttgttattcgcaagtcaatccgattacgctaacagccgcgttgctactattggtcgcacactatgcgattattgggcctggacttcaggcaaaagcaacacgcgaggcacaaaaacgagcagccgcaggtataatgaaaaaccctaccgttgacggtatcacagtaatagatttagaacctataccctatgatccaaaattcgaaaaacaacttggacaagttatgctattagtactatgcgtgacgcaggtacttatgatgcgtacaacatgggcactatgtgaagcattaacattggcaaccggtccaatctcaaccttatgggagggaaatccaggtcgattctggaatacgacgatcgcagtaagtatggcaaatatcttcagaggctcgtacttagcaggcgcaggattactttttagcataatgaaaaataccaccaatactagacgaggcacagggaacatcggtgaaacgcttggagagaaatggaaatctaggttaaacgcattaggtaagtcagaatttcaaatatataagaagtcaggcatacaggaagtggatagaaccctcgcgaaagaagggataaagcgtggcgaaacagaccaccatgcagtgagtcgtggatcggctaaattgcgatggtttgttgagcgcaatatggtgactccggaaggtaaagtggtagacttaggctgtggaagaggaggttggagctactattgcggcggcctcaaaaatgttagggaagtcaaaggtttaactaaagggggtcccggacatgaggagccaataccaatgagcacatatgggtggaatctagttcgattacaatctggtgtcgacgtatttttcacacccccagaaaagtgcgataccctactatgtgatattggcgaaagcagcccaaatccgaccattgaggccggacgtactctaagggtgctcaacttagttgagaactggctaaacaacaacacacagttctgtataaaggtattaaatccttacatgccaagtgtcattgaaaagatggaaacgctccaaagaaaatatggtggagcattagtacgcaatccactctcaagaaattcaactcacgagatgtattgggtgtccaatgcgaccggaaacatagtatcatcagttaatatgatttcccgcatgctcataaaccgtttcacaatgaagcataagaaagctacctatgagccggatgtggacctcggtagtggaacaaggaatataggaattgaaaacgaaattcctaacctcgacatcatagggaaaagaatagagaaaattaaacaggaacatgaaactagctggcattatgaccaagaccatccttacaaaacatgggcatatcacggtagttatgagaccaagcaaactgggagcgcctcgagcatggtaaatggcgttgtgaaacttctcacgaaaccttgggacgtagtcccgatggtgactcagatggcaatgacagacacaacaccatttggacaacaaagagtatttaaagaaaaagtcgatacgagaactcaggagccaaaagaaggtacaaagaaactcatgcgaattacggcggaatggttatggaaagagttaggtaaaaagaaaactccccgaatgtgtacccgcgaggagttcactcgtaaggtccgtagtaatgcagctctaggcgcaatttttacagatgaaaataaatggaaaagcgcgcgagaagctgtagaagattcaaggttttgggagctagtggatcgagagagaaaccttcatctagaaggaaaatgtgaaacttgcgtatataacatgatgggtaaaagggagaaaaagttaggagaatttggtaaagcaaagggtagccgcgccatatggtacatgtggcttggagccaggtttttagagttcgaagcattaggatttttaaatgaagatcattggttttcaaggggtaattcattaagcggagtcgagggggaaggcttacataaacttggatacattctaagagatgtttcaaagaaagaaggaggtgcaatgtatgccgatgacacagcggggtgggacacgagaataacattagaagaccttaaaaacgaggagatggttacgaatcatatgaaaggcgaacacaagaagttagcggaagctatcttcaaacttacataccaaaacaaggtcgtacgtgtacagagacctacaccaagaggcactgttatggacattatatctagaaaagatcaacgaggttcaggacaggtcggaacctatggactaaacacgtttacaaatatggaggctcaattgatacgccaaatggaaggagaaggtatattcaaatctatccagagattgacagtaactgaagaaatagcagtacagaactggttagcgcgggtaggccgagaacgcttaagtcgaatggctattagtggagacgactgcgttgtaaaaccattagatgatagatttgcttcggctttaacagctctaaatgatatgggaaaagtccggaaagacatacagcaatgggagccttctagaggttggaatgattggacccaggtacctttctgttcacatcactttcacgagctagttatgaaggatggaagggtcttagttgtcccgtgcagaaaccaagacgaacttattggccgagcaagaatatcacaaggggcagggtggtctctgaaggaaacagcttgcttaggtaaaagctatgcccaaatgtggacattaatgtatttccaccgccgtgacttgagattagcagcgaacgcgatatgcagtgcagtaccgtcgcattgggtacccacatcgagaacaacgtggagcattcatgcaaaacatgaatggatgaccacagaggatatgctcgcagtatggaacagagtatggattcaagagaatccatggatggaagacaagacacctgtagaatcatgggaagaagtaccttatctcggcaagcgagaagatcaatggtgtggctcacttattggtttgacatcgagagccacttgggcaaagaacatacaaacggcgattaatcaagtgcgatccctaataggcaacgaggaatatacagactacatgccatcaatgaaaagattcagaaaagaggaagaagaggcgggtgttttgtggtaa

SEQ ID NO: 22575 - RNA, 9876 nt, synthetic construct
  misc_feature 1..9876: note = derived and/or modified CDS sequence (opt6) from DENV-2__EU569713__SS-prME
  source 1..9876: mol_type = other RNA
acagcgggtgtaataataatgctaattccgacagctatggcatttcatctaacgactagaaacggagaaccacacatgatagtgggtaggcaagaaaaagggaaatctctgttatttaaaaccgaagacggggtaaatatgtgtacactgatggcaattgatttaggtgaactctgtgaagataccataacttacaaatgcccgctacttagacagaatgaacctgaggatattgattgttggtgtaattctacatcaacgtgggtaacctatggaacgtgcacgacaacgggggaacatagaagggagaaaagaagtgtcgctctagtaccacatgtaggaatgggtttagaaacccgaaccgaaacttggatgtcctctgaaggtgcatggaaacacgtacaacgtatagagacttggattctacgtcatccaggctttaccatcatggcagcaattctcgcatataccatcggaaccacgcattttcaaagagcactaatattcatattgctaacagcagtcgctccgagtatgacaatgcgatgcataggaatcagtaaccgggacttcgtagagggagtatccggagggtcctgggtggatattgtattagaacatggttcatgtgtcactaccatggccaaaaacaaaccgactcttgattttgaactcattaaaacggaagcgaaacagccagcaactctacgaaaatattgtatagaagccaaactaactaatacgactacagaatcacgatgtcctacacagggagaacctagtctaaacgaagaacaagataaaaggtttatctgtaaacattcaatggtcgatagaggctgggggaatggttgcggattgtttggaaaaggcggcatagtgacatgtgcaatgtttacatgcaagaaaaacatggaaggaaaagtggtcttgccagaaaatctggaatacacaattgtaataacccctcacagtggagaggaacacgcagttggctcagacacaggtaaacatggcaaagaaattaaaataactccacagtcatcaattacagaggccgaattgaccggatatggaacggtaaccatggaatgtagcccgagaactggattggattttaacgaaatggttttactgcaaatggaggataaagcatggctcgttcacagacaatggttcctcgacttgccgttgccgtggctacccggagctgatacacagggaagtaactggattcagaaagagaccttagtaacatttaaaaatcctcacgccaagaaacaagacgtagtcgtactaggttctcaagaaggggcaatgcacacagctcttactggcgcaacggaaatacaaatgtcgagcggaaatctattgtttacgggccacctaaaatgcagactacgaatggataaattacaactgaaaggtatgagctacagtatgtgcacgggaaaatttaaaatcgtaaaggaaatagctgaaacacagcatggcacgatagtgattcgcgtacaatacgaaggagacggatccccttgtaaaatcccctttgagataatggatttagaaaagcgatatgtattgggaagactaataactgttaatccaatagtaactgaaaaagacagtccagttaatatcgaagcagaaccgccattcggcgactcgtatatcatcattggcgtagaacctggccagctgaaattaaattggttcaagaaagggtcatcaattggacagatgttcgaaacgacaatgcgaggtgcaaaacggatggcaatattaggggatactgcgtgggacttcggctctctaggaggagtattcacctcaattggcaaggctctacatcaagtttttggcgcaatatatggtgcagcttttagtggtgtgtcatggactatgaagatattgataggtgttataataacttggataggaatgaatagcaggtcgacatctttatcagtcagcttagttttggtgggagtggtgacactgtatttaggtgtcatggtccaggcagatagtggatgcgtcgtatcttggaaaaacaaagagttaaaatgtggctcggggatatttattacagataacgtccatacatggaccgagcaatataaattccaaccagagtcgccatcgaaattagcaagcgccatacaaaaagcacatgaagagggtatttgtggtattaggtcagttactcgacttgaaaacctaatgtggaagcagatcacaccagagctaaatcatatattatctgaaaatgaagccaaactgacaataatgaccggagatattaaaggtatcatgcaagcagggaaaagatcactcagacctcaaccaacagaacttaaatactcatggaaaacctggggcaaagcaaagatgttgagtacagaaagtcacaatcagacatttctaatagatggtcccgaaaccgcagaatgtcccaatactaatagggcatggaatagcttggaagtggaggactatggattcggagtattcagcactaacatatggctaaaattgcgagaaaagcaggatgtattctgcgatagtaaattaatgtcagcagcaataaaagataaccgtgcagtccatgcagatatgggatattggatagaaagcgctttgaacgatacatggaagatggaaaaagcatcgttcatagaagttaagtcctgtcactggcctaaatcacatacgttatggtcaaacggagtactcgaatcagaaatgattatccccaaaaatttcgcgggtcccgtaagccaacacaattataggcccggatatcacacccagaccgcagggccctggcacttaggaaaattagaaatggatttcgacttttgcgaagggacgacagttgtagtaacagaagattgtggtaatagaggcccatccctgaggaccacgacggcaagcggaaaattaatcaccgaatggtgctgtagatcgtgtacattacctccacttaggtatcggggtgaagatggatgttggtacggaatggaaatacgtccattaaaagaaaaggaggaaaacctggtaaacagcctcgtaactgccggtcatggacagatagataattttagtttaggagttctaggaatggccctatttctagaggagatgcttaggactcgggtgggtacaaaacatgccatcctcttagtagctgtaagtttcgtaacattaataacaggcaacatgtcatttagggatttaggaagagttatggttatggtaggagcgacaatgacagacgatataggaatgggtgtaacttatctagcactattggcagcctttaaagtaagacctacatttgccgccggtctgctattaagaaaactcaccagtaaagaactaatgatggcaacgataggaatagctttgctctcacagtcgaccatccctgaaaccatactcgaacttactgacgcattagctcttggcatgatggtactcaagatagtacgaaatatggaaaaatatcagttagcagtaacaataatggctattctctgtgtccccaatgcggtaatacttcaaaatgcatggaaagtatcctgtacaatattggccgcagtatcagtgagtccgctactgctcacatcatctcagcagaaagcagattggatacctttagctttgacaataaaaggtctgaatccaacagcgatattcttgaccactctatcccgaacatcgaaaaagcgttcttggcccctaaatgaagccgttatggctgtaggaatggtaagcatcctcgcaagcagtttactgaagaatgatatcccaatgacgggtccgttagttgcaggcggcttattgaccgtctgctatgtcttaacgggcagatccgcagatctcgagttagaaagagcagcagatgttaaatgggaagatcaggcagaaatctcgggaagtagtcctatactgtcaataaccatcagcgaagatggtagcatgtcgattaaaaatgaagaggaagaacagacattaacaattcttataaggaccgggttattagtaatatcaggagtattcccggttagtataccgataactgctgcagcatggtacctttgggaagtgaagaaacaaagggctggtgtactgtgggatgtgccttctcctcctcccgtaggtaaagccgagttggaggatggcgcatacagaattaagcaacgaggaattttcggatattctcaaattggagcaggagtctacaaggaaggaactttccatactatgtggcatgtaacccgaggtgcagtccttatgcacagaggaaaaaggatagaaccttcatgggccgatgttaaaaaggatcttatttcgtacgggggtggttggaaattagagggagagtggaaagaaggtgaagaagtccaagtattagctttggaaccaggaaagaaccctcgggctgttcaaacaaaacctggcctattcaaaacgaatactggtacaataggtgctgtgtcattagacttctcacctggcactagcggtagtccgatagtagatagaaaagggaaagttgtaggattatacgggaatggcgtggtgacaagatccggagcgtatgtctcagcaatagcacaaacagagaagtcaatagaggataatccggaaatagaagatgatatatttaggaaaaagcgacttacaatcatggatcttcacccaggtgccggtaagactaaaagatacctcccagccattgtacgagaagccataaaacgagggttgcgaacattaattttagcccccacacgtgttgtcgccgcggagatggaagaagcgctgcgcggcctacccattagataccaaacgccagcgattcgtgcagaacacaccggtagagaaatagtagacttgatgtgccacgcaacgttcacaatgcgcctcttaagtccagtcagagtgccaaattataatctaataataatggacgaagcccacttcactgatcccgccagtattgcagcaagaggatatataagtacacgggtcgaaatgggagaagcggccggaatctttatgacagcaacacccccgggttcccgcgatccgtttccccaatctaacgctccaatcatggatgaagaacgagaaatacctgaaaggtcgtggaacagcggccacgaatgggtaacggacttcaaaggtaagacagtatggtttgtccctagtattaaagccggaaatgacatagcagcatgtttgcgtaagaacggaaagaaagtaatacagttatctcgaaaaacctttgacagcgaatatgtcaaaactagagccaacgattgggattttgtagttacaacagatatatcggaaatgggcgccaattttcgagccgaacgagtgatcgacccgagacgatgcatgaaaccagtaatattgacggatggagaagaacgggttatattagcaggaccaatgccagtcacgcatagtagcgctgctcaaaggagaggtagaataggcagaaatcctaaaaatgaaaatgatcaatatatatatatgggggaacccttagagaatgatgaagattgcgctcattggaaagaagcgaagatgttgctagataatataaatacacccgaagggattattccatcaatgtttgaaccagagcgggaaaaagttgatgcgattgatggtgaatacagattaagaggagaggcaagaaagacatttgtagatttaatgcggagaggtgacctaccagtctggctagcgtatagggtggctgcggaaggaatcaattatgctgacaggcggtggtgttttgacggcatcaaaaacaaccagattcttgaagaaaatgttgaagtagaaatatggacaaaagaaggggaacgaaagaaattaaaaccaaggtggctcgacgctcgaatctactccgatccgttagcgttaaaagagtttaaggaatttgccgccgggcgtaagtcattaactctgaatttaataacggaaatgggcagattgccgacatttatgactcagaaagcaagagatgcgctagataatctagccgtattacacaccgccgaggtaggaggtcgggcatataaccacgcactctcagaacttccagaaacactggaaacgctgctacttttgacattattagcgactgttacaggaggtatatttctctttttaatgagtggaaaaggtataggcaaaatgacactaggaatgtgttgtattataacagcgagtattttattatggtatgcgcaaattcaaccgcattggattgcagcttcgattattttagagttctttctaatagtcttgctaattcccgaacctgaaaagcagaggactcctcaagacaatcaattaacgtatgttgtaatagctatactcacagtagtagcagcaactatggccaatgagatggggttcctagagaagaccaagaaagatcttggcctgggaagcataataacacaggaatcagaatctaacatattggatatagatttacgacccgcctccgcttggacactttatgctgttgccacgacattcgttacgcctatgttgcggcactccatagagaactcgtcagtcaatgttagtcttactgcgattgccaaccaagctactgtattaatgggacttggaagaggatggcctttatccaaaatggatataggtgtaccgcttctcgccattggatgttacagccaagtgaatccgattacacttacagcggcattacttctcttagtggctcattacgcaattataggaccaggattgcaggctaaagcaaccagagaagcacaaaagagggctgctgccggtattatgaaaaatccgacagtagatggaataactgttatcgacttagaacctattccgtatgacccaaaatttgaaaagcaacttggtcaagtaatgctcctagtattgtgcgtgacacaggttctaatgatgcgcactacatgggctttatgtgaggcactaaccctagccaccggtccaataagtacgttatgggaaggaaacccagggcgattttggaatacaacaatagcggtatctatggccaatatttttcgaggatcctatttggcaggggcaggactgttattctctataatgaagaacacaacaaacacgcgaaggggcacgggaaacataggagagacactgggtgaaaaatggaaaagtcgacttaatgccctgggcaagagcgagttccaaatctacaaaaagagcgggatccaagaagtggatagaacattggcaaaggaaggaataaaaagaggagaaacggaccaccacgcagtgtccagaggatcggctaagttacgctggttcgtagaacgaaatatggtaacaccagaaggtaaagtcgtagacttgggatgtggcaggggaggttggtcctattactgtgggggcttgaaaaacgtaagggaagtgaaaggattaacaaagggaggacctggtcatgaagaacctataccaatgagtacttatggatggaatttagtgcgcttgcaaagtggggtagatgtattttataccccaccagaaaagtgtgacaccctattatgcgacatcggcgagagttccccaaatccaacaattgaagctggaagaacattgagggtgctaaacctagtagagaattggctcaacaataacactcagttttgcataaaggtcttgaacccctacatgccctcagtaattgagaaaatggagaccctacagcgcaaatatggaggcgcgcttgtaaggaatccacttagcagaaactcgacacatgagatgtactgggtctctaacgctacagggaatatagtgtcatccgtaaatatgatatcgagaatgcttattaataggttcaccatgaaacacaagaaagctacttatgagccggatgtagatctcggatcaggtactaggaatattggtatcgaaaacgaaataccaaacttggatataataggtaaacgtatcgagaagataaagcaagaacatgaaacctcatggcattatgaccaagaccatccatataaaacatgggcgtatcacggtagctacgagacaaaacaaacgggttctgcgagttcaatggtaaatggtgtagttagactcctcacgaagccttgggatgtagttccaatggtcacccaaatggccatgaccgatactacaccctttggacaacaacgtgtttttaaagagaaagtagatacccgtacacaagaaccaaaagaaggtacaaagaagttaatgcgaataactgctgagtggttatggaaagaattagggaagaagaaaacaccacggatgtgcacacgagaagagttcacccgaaaagtaagatcgaatgcggctctaggagctatcttcacagatgaaaataagtggaaatcagccagagaagcagttgaagattcgagattttgggagctagttgaccgagaaagaaatctacacctagaaggaaaatgtgaaacatgcgtatataacatgatgggtaaaagagagaagaaattaggggagttcgggaaggccaaaggctctagagccatttggtatatgtggttgggagccagatttttagagttcgaagccctgggatttctaaatgaagatcattggtttagtagaggaaatagtctaagtggcgtggaaggcgaggggcttcataaactaggttacattttgagggacgtgtctaagaaagaaggaggtgcaatgtacgctgatgatacggcaggctgggataccagaattacattagaagaccttaaaaatgaagagatggtaactaaccatatgaaaggggaacataagaaactagccgaagcaatcttcaaactaacatatcaaaataaagtcgtaagagtacaacgtccaacacctaggggaacagtaatggatataataagtagaaaagatcaaaggggatcaggtcaagtaggaacgtatggattgaacactttcaccaatatggaggcacaacttatcaggcagatggaaggcgaaggtatattcaagtctattcagcatttaaccgttactgaagagatcgcagttcaaaattggttagctcgagtaggaagggagaggttaagcagaatggcaatatccggcgatgattgtgtagtaaaaccccttgacgatcgttttgcatctgccttaaccgcattaaacgacatgggaaaagttcgaaaagatattcaacaatgggaaccttcgagagggtggaacgactggacgcaagttccattttgttcacaccactttcacgagttagtaatgaaagacggaagggtattagtcgtaccctgccggaaccaagatgaactaatcggtagggccaggatttcacaaggagcggggtggtcattaaaagaaacagcatgcttaggcaaaagctatgctcagatgtggaccttgatgtactttcacagacgggacttacgtctagcggctaacgccatctgttcagcagtaccaagccattgggtaccaacgtcgaggacgacatggtcaatacatgcgaagcatgaatggatgacgaccgaagacatgcttgctgtatggaatcgtgtttggatccaggaaaatccctggatggaagacaaaacgccggtcgagagttgggaagaagtaccttatctaggaaagagagaggatcaatggtgcggcagcctaattggacttacaagccgggcaacgtgggccaaaaatattcaaactgctataaatcaggttagatcactgatcggaaacgaggaatatactgattatatgccaagtatgaaaagatttaggaaagaggaagaaaaagcgggagtactctggtag

SEQ ID NO: 22576 - RNA, 9876 nt, synthetic construct
  misc_feature 1..9876: note = derived and/or modified CDS sequence (opt6) from DENV-2__EU569714__SS-prME
  source 1..9876: mol_type = other RNA
actgcgggagtgataataatgttaatacctactgctatggctttccaccttaccacacgtaacggtgaaccgcatatgattgtaggacgacaagaaaaagggaagtcattgctctttaaaaccgaagacggtgtgaatatgtgcactttaatggcaatagatttgggcgaactctgtgaagacacaattacatacaaatgcccacttttaagacagaatgaaccagaagatattgattgctggtgcaatagcacttctacatgggtaacatatggaacttgcacaacgaccggagaacatcgacgtgagaagcgtagcgtggcgttagtaccacacgtagggatgggactagaaacaaggacagaaacatggatgtcaagtgaaggagcatggaaacatgtccaacgcatagaaacttggatactgcgtcatccaggttttacaataatggcagcaatcctcgcctatacgataggcacgactcatttccaacgtgccctgatttttatactattaacagcagtggccccatcaatgacaatgagatgtatcggaataagcaatagagatttcgttgaaggggtatctggaggaagttgggtcgatatagtactagaacatggctcttgtgtcaccactatggccaaaaataaacctacattggacttcgaactcatcaaaacagaagctaaacaacctgcgacactcagaaaatattgtattgaagcaaaactaacgaataccaccaccgaaagcagatgtcctacacagggagaaccaagcctcaacgaagaacaagataaaagatttatatgcaaacattcaatggtggacagaggctgggggaatggatgcggactttttggaaaaggcggcatagttacttgtgccatgttcacctgtaagaaaaatatggaaggaaaagtcgtcttgccagaaaatttagaatacacgatcgtcataactccgcattcaggcgaagaacatgcggttgggaatgataccggaaaacatggtaaagaaataaaaataacgccacaaagctcaataacagaagcagaattgacaggatacggcacagttacgatggagtgcagccccagaacaggactcgacttcaatgaaatggtactcctgcagatggaagacaaagcatggcttgttcatagacaatggtttctagaccttccacttccatggcttcccggtgcggatacacaggggagcaactggatacagaaagaaaccctcgtaacattcaaaaatccacatgccaaaaagcaagatgtagttgtactcggaagccaagagggtgcaatgcatactgcattaacaggagccactgaaatccaaatgagctcaggaaacttgttgtttaccggtcacctcaagtgcaggttacgtatggataagctacaactaaaaggcatgagttatagcatgtgcacaggaaagttcaaaattgtgaaggagatagctgagacacaacatggcacaattgtaatcagagttcaatatgaaggagatggcagtccctgtaaaataccttttgaaataatggaccttgaaaagcgacatgtgttagggcgactaattacagtaaatccaatagtcacggagaaagactctccagtcaacattgaagccgaaccgccttttggagatagctatataattataggagtcgaaccaggacagttgaaactaaattggtttaagaaaggaagttctatagggcaaatgttcgaaactacgatgaggggcgctaagagaatggcaattctcggagacaccgcttgggactttggctcacttggaggagtttttacatcgatagggaaagcgctacaccaagtgtttggagcgatatatggagccgctttttcaggagttagttggacgatgaaaatattaatcggggtcataataacatggattggtatgaatagcagaagcacgagtctttctgtctcattagtattagtaggtgtagttactctatatttgggagttatggttcaggcagactcagggtgtgttgtgtcgtggaagaacaaagaattaaaatgcggaagtgggatatttataactgataatgtacacacatggactgaacaatacaagttccaacccgaatcaccatcaaagttagcaagtgctattcaaaaggctcatgaagagggtatctgtgggattcgcagcgtaacgagactagaaaatttaatgtggaaacaaataacacctgaacttaatcacatattgtcagaaaatgaggtcaaactaactataatgactggtgatattaaaggtataatgcaagcaggcaaaaggtctctaaggccacaaccgaccgagcttaaatactcatggaaaacctggggaaaagccaaaatgttgtcaacagaaagccataaccaaacgtttttaatcgatgggccagagacagcggaatgccccaatacaaatcgggcatggaactcgctagaggtagaggattacggatttggagtattctcaacgaacatatggcttaaacttcgagaaaagcaagatgtgttttgtgacagcaagctaatgtcagcggccataaaagacaatagagctgtgcatgccgatatggggtactggattgaatcggctttaaacgatacctggaaaatggagaaggcctccttcattgaagtcaaatcctgccactggccgaaatcacacaccctctggtcaaatggagtcctcgaatccgaaatgataatcccgaaaaattttgctggaccagtttctcaacataactaccgtccaggatatcacactcaaactgcggggccctggcatctgggaaagctcgaaatggattttgacttttgtgaaggtacaactgtcgttgtaacagaagactgtgggaacaggggacccagcttacgtacaacgactgcttccggaaaacttataacagaatggtgttgtcgatcttgcaccttgccaccattgagatatcgtggagaggatggatgctggtacggtatggagatacgaccgttaaaggagaaagaagaaaacttagtcaatagtctcgtgacagcgggccacggacagatcgataacttttccctgggtgtccttggaatggcattattcctagaagaaatgctacggacgcgagttgggacaaaacatgtcattcttcttgtagctgttagttttgtgactctaataacgggtaacatgtctttcagggacctcggtagggtgatggtaatggttggcgctacaatgacagacgatataggaatgggcgttacttacctagctttattggctgcgtttaaggtaagaccaacatttgcggctgggttactattaaggaagctaaccagcaaagaacttatgatggcaaccattggcatagctctattgtcacaatcgacgattcctgagaccattttagagctaacagacgcacttgctttgggcatgatggtattaaaaatcgtaaggaatatggaaaaataccagctcgcggttacaattatggcaataagctgcgttcctaatgcagtcatcctgcaaaacgcatggaaagtttcttgtactatacttgcagtagtttccgttagtcctttattactaacaagtagtcaacaaaaagcggattggatacctttagctctaactatcaagggcttaaatcctaccgcaatatttttgaccaccctaagtcgaacgagtaagaaaaggagttggcccttaaatgaggcagtcatggcagtcgggatggtcagtatattagctagttctctactaaagaacgacattccaatgacaggacccttagtagcaggcggattgctcacagtatgttacgtattaaccggtcgttccgcggacctcgagttggaaagggctgctgatgtgaaatgggaagatcaagcagaaatctcgggtagtagtccaatactatctatcacaattagtgaagatggtagtatgagtatcaaaaacgaagaagaagaacaaacactcacaatattaatacgaacaggcttattggtcatttcgggtgtatttcccgtttcaatacccataacggcagctgcatggtacttgtgggaagtaaagaaacagagggcaggcgttctatgggacgttccttcgcctccgcccgtaggtaaagcagaactagaagacggcgcttatagaataaaacaacgtggtatctttggatattcccagataggagccggtgtatataaagagggtacctttcatacaatgtggcatgttacaagaggggcggtactaatgcatcgggggaaacgaatcgaaccctcttgggcagatgttaagaaagatctcatttcgtatggaggaggttggaaactagaaggagaatggaaagaaggcgaagaagtccaagtactggcgctcgagccaggtaaaaatcctcgcgcggttcagacgaaacctggtctattcaagacaaatacaggaacgataggagccgtgagcttggacttttccccaggtacaagtggaagcccaatagtagaccggaaaggcaaagtagtcggactatatgggaacggtgttgtaacaaggtccggtgcgtacgtctcagcaatagctcaaacagaaaagtcaatagaagacaatccggagattgaagacgacatctttcgaaagaaacgtctaacgattatggacctccacccaggcgcaggaaaaacaaaaagatacctcccggccattgtacgagaggctataaaaagaggactccgtactttaatattagcgccgactagagtagtagcagcagaaatggaagaggccctaagaggactaccaatcaggtatcaaacgccagcaataagagcggagcataccggacgggaaatagttgacctgatgtgccatgctacatttacaatgcgactactgtcacctgtaagggtcccaaactataatttgatcataatggacgaggcccattttacagacccagcatcaattgcggcgcgtggatatatatctacccgggttgaaatgggggaggcagctggaattttcatgacggctactccgccaggctccagggatccattcccacaatcaaatgcgccaataatggatgaggagcgggagattccggagcggtcttggaacagcggtcatgaatgggtaacagactttaaaggaaaaacagtatggttcgtaccatcaattaaggctggcaatgatatagcggcatgtttacgtaaaaacggtaaaaaggtcattcagttaagccgtaagacatttgactctgagtatgtaaaaacacgagcaaatgactgggattttgtcgtaacaaccgatattagcgaaatgggagcaaattttagggcagaaagagtgatagacccacgacgatgtatgaaacccgtgatccttacggatggcgaagaaagagtaatacttgcggggcccatgccagtaacacatagcagtgcagcgcaaagaagagggcgcattggccgaaatcccaaaaatgaaaacgatcagtacatttacatgggtgaaccactagagaacgatgaagactgcgcccattggaaggaagcaaaaatgctattagataatattaacacgccagaaggaataatcccaagcatgttcgaacccgagcgcgagaaagttgacgcaatagacggagaatatagactacgcggagaagcaaggaaaacatttgtggacttgatgcgccgaggtgacttgcctgtgtggctggcctatcgcgttgcagcagaaggtataaactacgcagacagaagatggtgctttgatgggataaagaacaatcaaattttggaagaaaatgtagaggtagaaatctggacaaaggaaggagaacggaagaaattaaagcctcgctggttagatgcgcgtatttatagcgatccattagctctaaaagaatttaaagaatttgcggcaggacgaaaaagtttaacattgaatttaataacagaaatggggagattgccaacttttatgacccagaaggcgagagacgctcttgataatcttgcggtcctacacacagcagaagttggtggtagagcatacaaccacgcgttaagtgagctacccgagacgttggaaacactccttctcctaactctgctagcagctgtaacaggagggatatttcttttcctcatgagtggcaaaggtattggaaaaatgacgttaggaatgtgttgcataattacggctagcattcttctgtggtatgcccagatacaaccacattggatcgcagcatcaatcattctagagttctttttaatagtcctattaataccagaacctgaaaaacagcgaactccacaggataatcaattaacctatgtagttatagctatattgactgtagtagctgcaactatggccaatgaaatgggctttctagagaaaactaagaaagatctagggcttggtagtattattacccaggagagtgagtccaatatactagatattgacttaagacctgcgtcagcctggacattatacgccgtcgccaccacgttcgtaacgcctatgcttcgtcactcaatagaaaattcttcagtgaacgtttcattaactgcaatagcgaaccaagcgacagtattgatgggactgggaagggggtggcctctgtcaaaaatggatataggagttccattattggctatagggtgttactcccaggttaatcctataacccttactgcagctcttttacttttggtggcccactatgcaatcatcggacctggattacaagctaaagcaactcgtgaggcacagaagagagcagctgcagggataatgaaaaaccctactgtagacggaatcacagtaatcgacttagaaccaataccttacgatcctaaattcgaaaaacaacttggccaagttatgctgctagtactttgtgttacccaagtactaatgatgcgaacgacttgggcgttgtgtgaggcactaacgctggcaacaggaccaatatcaactttgtgggagggaaatccggggcgattctggaacactacaatagccgtcagcatggcgaacatatttcggggctcataccttgcgggtgctggcctattattttcgatcatgaaaaatactacaaatacaagacggggtaccggcaacataggtgaaaccctcggtgagaagtggaaaagtcgattaaatgccttggggaaatccgagttccaaatatataagaaatccgggatccaagaagtagacagaactctagccaaagaagggatcaagagaggagaaaccgatcatcacgcagtgagtagaggttccgccaaactaaggtggtttgtcgaaaggaatatggtgaccccggaaggaaaggtcgtagatcttggctgtgggagaggtggctggtcatattattgcggaggacttaaaaatgtacgagaagttaaaggacttacaaaaggtggaccaggtcacgaggagcccattcccatgtctacttacgggtggaacttagtccgtttacaatctggagtagatgtattctttacgccgccagaaaaatgcgatacgctcttgtgtgatattggcgaatcgtcccccaatcctacaattgaggcaggtcggactcttcgtgtactaaatctagtagaaaattggctaaataacaatacacaattttgcatcaaagttttgaacccatatatgccatcagtaatagagaaaatggagacattacaaagaaaatacggtggggcgttggttcgaaaccctctgtctagaaactctacgcatgaaatgtactgggtaagtaacgccacaggaaacattgtatcttcggtaaatatgatatctcgcatgctgataaatagattcaccatgaaacacaaaaaggcaacgtatgaaccggacgttgatttaggctcagggacaagaaatataggtattgaaaacgaaatacctaacctagacatcataggaaagcgaatagagaaaattaagcaggaacatgaaacatcatggcactacgaccaagatcatccatacaagacatgggcgtatcacggatcatacgaaacaaaacaaacgggatccgcatctagcatggtaaatggagtagtccgcttgttaacgaaaccatgggatgtggtgccgatggttacccaaatggcgatgacagatacgaccccatttggtcaacaaagagtttttaaagaaaaggtagacacacgaactcaggaacccaaagagggaacaaagaaattaatgagaataactgcggaatggttatggaaagaattaggtaagaagaaaacgccgagaatgtgtacacgggaagagttcactcggaaagtacggtcaaacgcagcacttggggcaatttttacagacgagaacaaatggaaaagcgcgagagaagcggtagaagatagcagattctgggaattagttgaccgcgaacgaaacctacatcttgaaggaaaatgtgaaacctgtgtttacaacatgatgggtaaacgagagaagaaattaggagagttcggaaaagcaaagggttcaagagcaatatggtacatgtggctaggtgcaagatttttagaatttgaggctttaggcttcctcaatgaggatcattggttcagcaggggaaacagcttatcaggggttgaaggtgaaggattgcataagttggggtacatattgcgcgacgttagtaagaaagaaggaggagcaatgtatgcagatgatacagcaggttgggacacaagaataacactagaggatttgaaaaacgaggaaatggtaacaaatcacatgaaaggagaacacaaaaagttagcggaggccatcttcaaactcacatatcagaataaggtagtaagagtacaaagacccaccccaagaggcacagtaatggatataatatcaaggaaggatcagagagggagcggccaagtaggaacatacgggctaaatacgtttactaatatggaagcacaattaattaggcaaatggaaggagaaggaatcttcaaatcaattcaacacttaaccgttaccgaggaaattgcggttcagaattggcttgcgagggtaggacgagagaggctttcacgcatggccatctcaggtgatgattgcgtggtgaaaccactcgacgatcgctttgcctcagctctcacagccctaaacgatatgggcaaagtgagaaaagatatccaacaatgggagccatcacgaggttggaacgactggacgcaagtgccattttgtagtcatcacttccatgaattagtgatgaaagatggtagagtgctagtagtaccctgcagaaatcaagacgagctaattggacgagcaagaattagccagggagctggttggtcgctaaaagaaacagcctgcctaggcaagagttatgcacaaatgtggacgctaatgtattttcaccggcgagatttaagactcgcagcaaacgcaatctgcagtgcagtgccaagtcactgggtaccgacgtccaggacaacatggagtatacatgctaaacatgaatggatgactacggaagacatgttagcggtatggaatcgagtatggatacaagaaaacccatggatggaagacaaaacaccagtagaatcctgggaggaagttccatacctgggcaagagagaagaccaatggtgtggctccctaataggccttacaagtagagctacctgggcaaagaatattcaaactgcaataaatcaagtccgctcattaattggaaatgaagagtataccgattatatgccaagtatgaaaaggttcagaaaagaagaggaagaagcaggggttttgtggtaa

SEQ ID NO: 22577 - RNA, 9876 nt, synthetic construct
  misc_feature 1..9876: note = derived and/or modified CDS sequence (opt6) from DENV-2__EU569715__SS-prME
  source 1..9876: mol_type = other RNA
actgctggagtaatcataatgctcattccaacagcaatggctttccatcttacaactagaaatggagaaccccacatgatagtaggaagacaagaaaaaggtaaatctctcttattcaaaacagaagatggtgttaatatgtgtacactgatggcaattgatctaggtgagttatgcgaagacaccataacatataaatgtccgctactacggcaaaatgaaccagaagatattgactgttggtgtaattcaaccagcacttgggtaacttatggcacgtgtacaactacaggcgaacacagaagagagaaaagatcagttgcacttgtaccgcatgtaggaatggggttagaaacgcgaacagaaacttggatgtcctccgaaggcgcgtggaaacatgtacagaggatagaaacatggatattacgacacccaggatttacaatcatggcggcaatacttgcatatacaatcggtactacccatttccaaagagcgttaatattcattcttttgactgcagttgcaccaagcatgactatgcgctgcataggaatatcaaatcgcgacttcgtagaaggcgtatctggtggaagctgggtagatattgtgctcgaacatggatcctgcgtgacgactatggccaaaaataaaccaacattggacttcgaactcattaaaacagaagctaaacaacctgcaacacttagaaaatattgcattgaagcaaaactgactaatacaactacagaatctcgctgtccaacgcagggtgaaccttcactaaatgaagaacaagacaaacgttttatatgtaaacattctatggtggatcgaggatggggaaatggttgcggtttatttgggaaaggaggtatcgtcacatgcgcaatgtttacgtgcaagaaaaatatggaagggaaagttgttctccccgagaatctggaatacactatcgtaataacgccacactccggtgaagaacatgctgttggcaatgatactgggaaacacgggaaagagattaaaattaccccacaatccagcatcacggaagcagaactaactggttacggaactgtcaccatggagtgttcacccaggacaggactggactttaacgaaatggttctacttcaaatggaagacaaagcatggctcgtgcatagacaatggttccttgatctcccattgccatggcttccaggagcggatacacaaggctcaaattggattcagaaagaaacgctagttacctttaaaaatcctcatgcaaagaaacaagatgtagttgtattggggtcacaagaaggtgcaatgcatacggcgttaacaggagctacagaaatacagatgtcttcgggaaatttattgttcactggccacctaaaatgtagactacgaatggataaacttcaactcaaaggaatgagttattcaatgtgtaccggaaaattcaaaattgtaaaagaaattgcagagactcaacacggcaccattgtgattcgagtacaatatgaaggtgatggttcaccttgcaaaatccctttcgagattatggaccttgaaaaacgccatgtgttaggtagattgataacagtgaaccctatcgttacagagaaagacagccccgtgaatatcgaagcagagccgccatttggagattcttatattattataggtgtcgaacctggacaactcaaactgaactggttcaagaaaggatcaagtataggacagatgtttgaaacaacaatgagaggagccaaacgaatggcaatactcggagacacggcatgggacttcgggtcattaggtggagtatttacaagcattggtaaagccttacatcaagtattcggggcaatttacggagcagcgttctcaggagtatcgtggaccatgaaaattttaattggggtaattataacgtggataggcatgaactcaagaagtacaagtctttcagtcagcctagtcctagtgggagttgttacactatatttgggcgttatggtacaagccgattctgggtgtgtcgttagttggaaaaataaagaactgaaatgcggatctggaatttttataaccgacaacgtacatacttggactgaacaatacaaatttcaacctgaatcaccctccaaactagcgtcggccatacagaaagcccatgaagagggaatttgtggaatacgatctgttactagattggaaaatttaatgtggaaacagattactccagaattaaatcatatactgagtgaaaacgaggttaaactaacaatcatgactggtgatataaaagggataatgcaggcaggcaaaaggtcattaagaccacagcctactgaattaaaatacagttggaaaacgtggggaaaagctaaaatgttaagtaccgaatcgcacaatcaaacctttctaatagacgggccagagaccgctgaatgccccaatacaaatcgagcatggaactcgcttgaagttgaagattacggatttggtgtgttcagcaccaacatatggctcaaactgagagaaaaacaagatgttttctgcgatagcaaattaatgtcagcagcaataaaagacaatagagcagtacatgccgatatgggttattggatagaatctgcattaaacgacacttggaaaatggagaaagcatcttttatagaagtgaaatcgtgtcattggcctaaatcacataccctctggtcaaatggagtattggaatccgaaatgattataccgaaaaatttcgccggacctgtttcgcagcacaattatagacccggatatcatactcaaacagccggtccctggcatctagggaaattagaaatggattttgatttttgtgaagggacaactgttgtggtgactgaggattgcgggaacaggggtccgagtttaagaactacgactgcttctggaaaattaatcacagagtggtgttgtagatcttgtacgttgcctcctttacgatatcgcggtgaagatggatgctggtacggaatggaaattcgcccgttgaaagaaaaagaagaaaacttagtgaactcgttagtcaccgccggccatggtcaaatagacaacttttcattaggagtattaggcatggccctcttcttagaggaaatgcttaggacaagagtcggaactaaacacgccattctacttgtagctgtttcattcgtaacactgataacggggaatatgtctttccgggatttagggcgagttatggttatggtgggtgctaccatgaccgatgatatagggatgggagtaacttacttggcattactagcagccttcaaagtaagaccaacattcgccgccggactattactacgaaagctgacatcaaaagagcttatgatggcaacaataggcatcgctttgctctcccagtcgacgattcccgagacaattttagaactaaccgacgcgttggcacttggtatgatggttttaaaaatagtacgaaatatggaaaagtatcagctagctgtgactattatggcaattagctgtgtgccaaatgcagtgatattacaaaacgcatggaaagtgagttgtaccatattagccgcagtaagcgtctcaccactcctcctaacatcttcgcaacaaaaagcagactggattcctctagcactcactataaaaggactcaaccctacagcgatctttctcacaacgttatcaagaacttccaagaaacggagctggcctctaaatgaagcagtgatggctgttggcatggtcagtatattagcatctagtttacttaaaaatgatattcctatgacaggacctttagtcgcgggcggtcttttaacagtatgttatgtgttaacaggaagaagcgcggacctagaactagaacgagcagcagacgtcaaatgggaagaccaagccgaaataagtgggtcctcacccatactttcaataactataagcgaagacggttcgatgagtataaagaatgaagaagaagaacacacgctaacaatacttatcaggacaggcttattagtaatctccggcgtgtttcctgtatcaatccctataactgcagctgcgtggtacctatgggaggtcaagaaacaaagggcaggagtactatgggatgtaccgagtcccccacctgtcggaaaagccgagctggaagatggtgcttacagaataaaacaaaggggtattttcggctactctcagatcggggctggtgtatacaaggaaggaactttccacaccatgtggcatgtaacaaggggagcagtcctaatgcatcgagggaaacgaatagagccttcgtgggctgatgtcaagaaagaccttatttcttatggaggtggatggaagttagagggtgagtggaaagaaggcgaagaagttcaggttctcgcactcgaaccaggcaaaaatcccagggctgtgcagacaaaacctggtctatttaaaacgaatacgggaactattggggccgtatccttagacttttctccaggtacaagtggaagtcccatagtggaccgtaaaggaaaagtagtcggtttatatggaaatggagtagtcaccagaagtggggcttatgtctctgctatcgcacaaactgaaaagtcaatagaagataacccggaaatagaagatgatatatttagaaagaaaaggctaaccatcatggacttacatcccggcgcaggtaaaacaaaaagatatcttccggcaatagtacgagaggctatcaaaaggggacttaggacattgatactggctcctacacgagtagtagcggctgaaatggaagaggccttaagaggattacctatacgatatcaaacaccagcaattcgtgctgaacatacaggacgagaaattgttgatctcatgtgtcacgcgactttcactatgcgtctactatcgccggtaagagttcccaattataatctaataataatggacgaggctcactttacagaccccgcttcaatcgcggctagaggatatataagtacgcgcgtggagatgggcgaggcagcaggaatattcatgactgcaacaccacccggatctagagatccattccctcaatcaaacgcacccattatggacgaagagagagagataccggagcgatcatggaacagtggtcatgaatgggtcacagattttaagggaaaaactgtttggtttgtaccaagtattaaagccggaaacgatattgcggcttgcttgaggaaaaatggtaagaaagtaatacagttatctagaaaaacgtttgacagtgaatacgttaaaacgcgggcaaatgattgggattttgtcgtaacgactgatatcagtgaaatgggagcaaattttagagcagagagagtcatagacccaagacgttgtatgaaaccagtaattttaacagatggtgaagagagagttatactggctggacccatgccggtaacacattcgagtgcagcccaaagacgaggtagaataggtagaaatccaaagaatgaaaatgatcagtatatttatatgggggagccactagaaaatgacgaagattgtgcccactggaaagaagcaaaaatgttgttggataatattaatacacctgaaggaattataccatcaatgttcgaaccagaacgggaaaaagtagatgccatagacggtgaatacagactacgaggagaagcgcggaaaacatttgtggaccttatgagacgtggagatcttcctgtatggcttgcttaccgggtcgcagcggaaggcattaattatgctgataggagatggtgttttgatggtatcaaaaataaccagatactcgaagagaatgttgaggtagaaatatggactaaagagggggaacgtaagaaattaaaacccagatggttggacgcccgtatatattcggatccattagctctaaaagaatttaaggaatttgcagccggccgaaagtcattaaccttaaatttaatcactgaaatgggtcgattacctacttttatgacacaaaaagctcgggatgcactagataacttggcggtactccataccgcagaagtcggcggcagagcttacaaccacgccttaagcgaacttcccgaaacactagaaactctactattacttacattacttgcaacagtgacaggtggaatctttcttttcctgatgtctggaaagggaataggtaaaatgacattaggtatgtgttgcataattacagcgtcgatacttctatggtatgcacaaatacaacctcattggatagcagcttccattatattagagttctttctaatcgtgttgttaataccagaaccagaaaagcaaagaacaccacaagataatcagcttacatatgttgttatcgccatcctaactgtagtagcagccactatggccaatgaaatgggttttctagagaagaccaagaaagacctggggttagggtctattaccacgcaagaaagtgaaagtaacattctagatatagacctacgacccgcctcagcgtggaccctgtacgcagtggctacaacatttgtaacacctatgttacggcactccatagaaaatagttcagtaaacgtgagcttgacagcgattgctaaccaggcaaccgtattaatggggcttggtagagggtggccactaagcaaaatggacataggtgtacccctgcttgcaatcggctgttattcacaagtaaatccaattacgcttacagcagcactacttcttcttgtcgcacattatgctattatagggcccgggctacaggctaaggcaaccagagaagctcagaaaagagcagccgctggtataatgaaaaatccaacagtcgatgggataacagtgatagaccttgaaccaatcccttacgaccccaaatttgagaaacaactcgggcaagtcatgctgctagtcttgtgtgtaactcaggtacttatgatgagaacaacttgggctttgtgcgaagcgctgacactagcaacgggaccgatatctaccttatgggaaggtaacccaggtagattctggaacacaacaattgccgtcagtatggccaatatatttcgcggatcctacctcgccggggcagggcttttatttagcataatgaaaaacacaactaatacacgacgcggtactggaaacattggtgaaacgctcggagaaaagtggaaaagtcgattaaatgctttaggaaaatcggagttccaaatttacaagaaatctggcattcaagaagtcgatcgcacactggcaaaagaaggaattaagcgcggcgagacagatcaccacgctgtcagtagaggatcagccaaactgcgatggtttgtggaaaggaatatggtgacacctgagggcaaagtagtcgatttaggatgcggcagaggtggctggtcctattactgtggtggcctaaagaatgtccgagaggttaaagggttgacaaaaggagggcctggtcacgaggagcccatccctatgtctacatacggatggaatctcgttaggctacagtccggtgtggacgtattctttaccccaccagagaaatgcgatactctattatgtgacattggagaatcttcaccgaaccctactatcgaggcagggcgaaccttgcgagtcctaaacctggttgagaactggttgaacaataacacacaattctgcataaaagtcttaaacccttatatgccttctgtaatagagaaaatggaaacacttcaacgcaaatatggtggggcattagtaaggaatcccctttcgcgaaatagcacacatgagatgtattgggtgagcaacgccactgggaacatagtatcatcggtaaatatgattagccgaatgctaatcaatagatttactatgaaacataagaaagcaacatacgaaccagatgtggatttggggagtggtacccgaaatataggaattgaaaatgagattccaaatcttgatatcataggaaaacgcattgagaaaataaaacaggaacatgaaactagctggcactacgaccaagaccatccatacaagacctgggcatatcatgggagctacgagacaaagcagacagggagtgcaagctccatggttaatggcgtcgttaagctcctaaccaaaccctgggacgtggtccccatggtaactcaaatggcaatgactgatacaactccattcggtcaacagagagtttttaaagaaaaagtagatacgcgaactcaagagcctaaagaaggaaccaagaaattgatgaggataacagcagaatggttatggaaagaattaggcaagaagaaaacaccaagaatgtgtacaagggaggaatttacaagaaaagtacgatcaaacgctgcgctcggagccatctttacagacgaaaataaatggaaatcggctagagaagcggttgaagatagtagattttgggagttagtggatagagaacgaaatttgcatttagagggaaaatgtgagacttgtgtctataacatgatgggtaaacgtgagaagaaattaggcgaatttgggaaagcaaaaggaagcagagctatttggtatatgtggctaggcgctaggtttttggagttcgaggcactgggatttttaaatgaagatcactggttttcgagagggaatagtttgagtggagtggagggcgaagggctacataaattaggttacatactgcgtgatgtaagtaagaaagaaggaggagctatgtacgccgatgacactgctggttgggacacccgtattactttagaagacctgaaaaatgaagaaatggtaacgaaccacatgaagggggaacataagaaactcgccgaagctatatttaaattgacataccaaaacaaagtcgttagagtacaaagacctactcctggaggcacggtgatggacatcataagcagaaaggaccaacggggtagtggacaggttggaacctacggactgaataccttcaccaacatggaggcccaactaataaggcaaatggagggtgagggaattttcaaatcaatacagaggttaaccgtcacagaagaaatcgctgtacaaaattggttagcacgtgtggggagggaacgactgtcgcgtatggccatatcaggtgatgattgtgtagttaaaccactagatgatcgttttgcaagtgccctcactgcacttaatgatatgggtaaagtcaggaaagatatccaacaatgggaaccatcccgtggctggaacgactggacacaagtcccgttttgttcacaccactttcacgaactcgtcatgaaagatggtagagttctagtagtcccatgcaggaaccaggatgaactaataggaagggcaagaatttcccaaggggcaggatggtcactcaaagagactgcatgtttgggaaagtcgtacgcacaaatgtggactttgatgtacttccacagaagggacttaaggctggcagctaacgcaatatgttctgcagtgccctctcattgggttcccaccagtcgaacaacttggagcatacatgccaagcatgaatggatgaccacggaggacatgctcgcagtttggaacagagtttggatacaagagaacccatggatggaagacaagactcccgtggaaagctgggaagaggttccctacttaggaaaaagggaagatcagtggtgtggttcgttaatcggcctaacaagccgtgccacatgggccaaaaatatacaaacagcaataaatcaagtacgctctttaatcggtaacgaagaatatacggattacatgccatcaatgaaaagatttaggaaagaagaagaagaggcgggtgtactatggtaa

SEQ ID NO: 22578 - RNA, 9876 nt, synthetic construct
  misc_feature 1..9876: note = derived and/or modified CDS sequence (opt6) from DENV-2__EU569716__SS-prME
  source 1..9876: mol_type = other RNA
accgctggagtaataatcatgctaatacctacggcgatggcttttcaccttactacccgtaatggagaaccgcatatgatagtcggaagacaggaaaaaggtaaatcattactttttaagacagaagacggagttaacatgtgtacgctaatggccatagatttgggagaactatgtgaagatacaatcacatacaagtgccctctgttaagacagaacgagccagaagacattgactgttggtgcaactcaacctccacatgggtaacatatgggacctgcactacgactggagaacatcgaagagagaaaagatcggttgcactagtgcctcacgttggtatgggattggaaacgcgaaccgagacatggatgtcgtcagaaggagcatggaaacatgtccaaagaatagaaacatggatattaagacatccaggattcacaattatggctgcaatcttagcatacaccatcggaactactcacttccaacgagctctaatatttattttgcttacagcagtggcaccaagtatgacgatgaggtgcataggaatttccaaccgagactttgtcgagggagtaagcgggggttcttgggttgatatagttttagaacatggatcgtgtgtgactactatggcaaagaataaaccgacactagatttcgagttaataaagacggaggctaaacagccagcgacactaagaaaatattgcattgaagctaaattgactaataccacaaccgaatcgaggtgccctacccaaggggaaccatcactcaatgaagagcaagacaaacgatttatttgcaaacattcgatggtcgaccgtggatggggtaatggatgcgggctatttgggaaaggaggtattgtaacctgtgcaatgttcatttgcaaaaaaaatatggaaggaaaggtagtactgccggaaaatttggaatatacaatagtgatcactccacattcgggggaagaacatgcagtgggaaatgatactggaaaacacgggaaggaaatcaagatcacgccacagagtagtattaccgaagcagaacttactggctacggaacagtgactatggaatgcagtcccaggacaggtttagacttcaacgaaatggtcttgctccagatggaagataaagcatggctagtccacagacaatggtttctcgacttaccattaccctggctgccaggtgctgatacccaaggctctaactggatacaaaaagagacattagtgacattcaaaaacccacatgctaagaaacaagacgttgttgtactcgggagccaagaaggggcaatgcataccgctctaacaggggctacggagattcaaatgtccagtgggaatctattattcacaggccatttaaaatgtagacttcgtatggataaactacaactaaagggaatgagctacagtatgtgcacaggaaagtttaagattgtaaaggaaattgcagagacgcaacacggaactatagtaattcgggttcaatatgagggagacggaagcccttgtaaaatcccattcgaaatcatggatttggaaaaacgttatgttttaggacgcctcattactgtcaatccgattgtaacagaaaaagatagtccagtaaatatagaggcagaacccccttttggtgattcctatataatcattggagttgaacccggtcaactgaaattaaactggttcaaaaaaggaagtagtataggtcaaatgtttgaaactacaatgagaggcgccaaacgaatggcgatattaggtgacacagcatgggacttcggaagtttaggtggagtctttactagcatagggaaagcactacatcaggtatttggtgctatttatggagcagctttcagtggcgtgtcatggaccatgaaaatcttaataggagttataatcacatggatcggaatgaatagcagatccacgtcattatcagtttcactcgtcctggtaggtgttgtgaccctgtatctcggagtgatggtacaagcagattcaggttgcgttgttagttggaagaataaggagttaaaatgtggaagcggaatctttattactgacaatgtccatacctggaccgagcaatacaagtttcaacctgaaagcccatcaaaattggcttctgcgatacaaaaggcacacgaggaaggtatttgtggaatacggagtgtaactaggttagaaaatctgatgtggaaacaaatcacaccagaattaaaccacatattatcggaaaacgaagttaagcttacaattatgaccggcgacataaaagggattatgcaggcgggaaagagatccctgcgaccacaacctacggaactcaaatattcctggaagacctggggtaaagcaaaaatgttaagcactgagtcacacaatcagacatttctcattgacggacctgaaacagcagaatgtccaaacacaaatcgagcttggaattccctagaagttgaagactacggatttggtgttttcagtaccaacatttggttaaaattgagggaaaaacaagacgtgttttgtgacagtaaattaatgtcagcagcaattaaagacaatagagcagtccatgcggatatgggctattggattgaatcagcccttaatgatacttggaagatggaaaaggcctctttcatagaggtaaagagttgccattggccgaaaagccatacattgtggtcaaacggagttttggaaagcgaaatgataatacctaaaaatttcgctggcccagtatcgcaacacaattaccgaccaggatatcatacgcagactgctgggccatggcacctcggaaagcttgagatggactttgatttttgcgaaggtaccactgtagtggtaacagaagactgtggaaatcgagggccgagcttaagaaccactacggcaagtggaaaattgataacagagtggtgttgccgtagttgcacattaccgccgctacgttataggggcgaagatgggtgctggtacggaatggagataaggccactaaaagaaaaagaagaaaacttagtaaactcgctagtaacggcaggtcacggccagatagataacttcagtttgggcgttcttgggatggcgttgtttctggaagaaatgcttagaacaagagtaggaacaaaacatgcaatattattggtcgcagtatcatttgtaacgctgatcacaggcaatatgagcttccgagatttaggaagagtaatggtgatggttggtgcgaccatgactgatgatattggaatgggggtaacttatctagccctcttagctgcgtttaaggtacgtcctacatttgctgccggcttattgttaagaaagctcactagcaaagaactcatgatggcaacaatcggaatagctttgttatctcagagtaccataccggaaacaatcctggaattaactgatgcacttgctctcggcatgatggtacttaaaatcgtaaggaacatggaaaagtatcagttagcagtaactattatggctattctttgtgttccgaatgcagtaatattacaaaacgcctggaaggtatcatgcacaattttagcagcagtaagtgtatcaccattattactaacgtcatcacaacaaaaagcagattggattccacttgcactcactataaagggattaaatcccacagccatattcttgacaaccttaagtaggacatcaaagaaacggtcatggcccttgaatgaagcagttatggcagtaggtatggtctctatattagccagtagtttgctgaaaaatgacataccaatgacaggaccgttggttgctggaggcttattaactgtatgttatgtacttacaggaagatcggctgacttagaattagaacgcgcagctgacgtaaagtgggaggatcaagcagaaatttctggatcatcaccaatattgtcaatcacaataagcgaagatggatcaatgagtataaagaatgaggaggaagaacaaactttaaccatattaataagaacaggtttactagtcatttctggagtatttccagtaagcatacccataaccgctgccgcatggtacttgtgggaagtaaaaaaacaacgcgccggagtactttgggacgtacccagtcctccaccagttgggaaggctgaactcgaagatggagcttatcgaatcaaacaaagaggtatattcggatattcacagataggcgcaggtgtttataaagaaggaacttttcacaccatgtggcatgtaacacgtggggcggttctgatgcatcgaggaaagcgaatcgagccttcctgggctgatgtaaagaaagatttaatctcatatggaggaggttggaaactagaaggtgaatggaaagaaggggaagaagtccaagtcttggccttagaaccgggtaaaaacccaagggcagtacaaaccaagccaggtctctttaagacaaatacaggaacaattggcgccgtatctctggattttagtccaggaacatcagggtcacctattgtggacaggaaaggaaaagtggttggactatatggaaacggtgtggttacaagatcgggcgcctacgtgtcggccatagctcaaacagagaaaagcatcgaagacaaccccgagatagaagatgatatcttcagaaaaaagaggttgacgataatggaccttcacccaggcgctggaaaaaccaaaagatacctcccagccatagtgcgcgaagccataaaacgaggtttaagaacattaattcttgcgccaacgagagtcgttgctgccgaaatggaagaggcactaagaggactacccataagatatcaaacacctgccatacgagctgaacacactggtagggagattgtagacctaatgtgtcacgctacgtttaccatgcgactgctttctcctgtgcgggtgccaaattataatttgataataatggacgaagcacatttcacggatccagcaagtattgccgcaagggggtatatttctacacgggttgagatgggtgaagctgcaggaattttcatgacagcaacaccaccaggttcacgtgacccgtttccccaatcaaacgccccaattatggatgaagaaagggaaatccctgaacgatcctggaacagtgggcatgaatgggtcacagattttaaaggtaaaacagtgtggtttgtaccctcgattaaagctgggaatgatatcgcagcttgcttacgaaagaatggaaaaaaagttatacagctatcccgaaagaccttcgatagtgaatatgtgaagacaagagctaatgattgggactttgtcgtaacgactgatatttcggaaatgggtgctaacttcagggcggaaagagtcatagatccaagaaggtgcatgaagccagtcatcttgactgatggcgaagaacgggtaatacttgcagggcccatgcccgtaactcatagctcagcggctcaacgcagaggacgtataggcagaaatccaaaaaatgaaaacgaccaatatatttatatgggtgaaccattagaaaatgatgaagactgtgcgcattggaaagaggcaaaaatgttactcgataatataaatacaccagagggtataatcccctcaatgtttgaacccgaaagggaaaaggtagatgcgatcgacggagagtatagactcaggggagaagcaagaaagacattcgttgatttgatgagacgaggagacctaccggtttggcttgcttatagagttgccgcggagggaataaattatgctgacagaagatggtgctttgacgggatcaagaacaatcaaattctagaagaaaatgttgaagtagaaatttggactaaggaaggtgaaaggaaaaagctaaagccacgatggctggacgcgaggatttatagtgaccccctggcattgaaagaatttaaagagttcgcggctggccgtaaaagcttgaccctaaatctgattaccgagatgggacggttaccaacctttatgacccaaaaagcacgcgacgcactggataatctggcagttttacatactgctgaggtaggagggagagcttataaccacgccttatcagaactaccggaaactttggaaacattattgctattgacattgttggccacagtgacgggtggcatctttctgtttttaatgtctggaaaaggaataggcaagatgacgctcggcatgtgctgcatcattacagcaagcatactcttatggtatgcacagatacaaccccactggatagcggcgtcaattatattggaattttttctaatcgttctgctaataccagagcctgaaaaacaaaggacgccacaggacaatcaactaacatatgttgtcatagcaatactaacagtcgttgcggcaacaatggctaatgaaatgggttttcttgaaaaaaccaaaaaggatttaggactagggtcaatcataacccaagaatcagaatcgaacatcttggatatcgacttgcgaccagctagcgcttggacattgtacgctgttgctacaacttttgttactccaatgttaaggcattcgatagaaaattcgtctgtcaacgtatccctcacggccatagcaaatcaggctacggtactcatgggtctagggcggggatggcccctgagtaaaatggatataggtgtccctctactagcaattggatgctacagccaagtcaacccaattaccttgacagctgctctactcttactcgtcgcacattatgcaatcattggtcctgggctacaggcgaaagcaacccgggaagcacaaaagagggccgcagctggaattatgaaaaatccaacagtcgacggcatcacggtaatagacttagaacctataccttacgatccaaaatttgaaaagcaattaggacaagtaatgctactagttttatgcgtcactcaggttcttatgatgaggactacatgggccctctgtgaagctcttactttagctactggtccaatatcaacattgtgggaaggcaatccaggtcggttttggaacactacgatagctgtttcgatggctaacatctttagaggttcttacctggcaggagcgggacttctcttcagtataatgaaaaatacaacaaacacaaggagaggtacgggaaatataggagaaacgttaggagaaaagtggaagtcgagactcaatgccctggggaagtccgaatttcaaatttataaaaaaagtggtattcaagaagtcgacagaacactggcaaaagaaggaataaagcgaggggaaaccgatcatcacgcagttagccgaggcagtgccaaattaagatggttcgttgaaagaaacatggttacaccagaagggaaagtagttgatttaggttgtggaagagggggatggtcctattattgtggtgggttaaaaaatgtaagagaggttaagggtttaactaaagggggccctggacacgaggaaccgataccaatgtccacgtacggatggaatctagtaagattacaatcaggcgttgacgtattttttaccccccctgagaaatgtgacacactcctatgtgacataggggaatcgagtccgaatccaactattgaggcaggaaggacactaagggtactaaatcttgtagaaaattggttaaataacaacactcaattttgcatcaaggtactaaatccatatatgccttcagtaatagaaaaaatggaaacactgcaaagaaaatacggaggagccctagtaaggaatccattgtcacgaaactccacccacgagatgtattgggtatccaacgcaacaggaaacatcgtcagttcagtcaatatgatcagcagaatgttaattaatagattcacgatgaaacataaaaaagcaacttacgagccagatgtagatttaggaagtggtacaagaaatatagggatagaaaacgaaataccgaatttagacataatagggaagcgcattgagaaaattaaacaggaacatgagacatcgtggcactatgaccaagaccatccatacaaaacatgggcataccatgggtcgtacgaaacaaaacagaccgggtccgcctcatcgatggtcaatggtgtagtaagactcttaacgaaaccatgggatgttgttccaatggtcactcaaatggcaatgactgatacaactcctttcggtcaacagagagttttcaaagaaaaagttgatacgagaactcaagaacccaaagagggcacgaaaaaattaatgaggattacagcagaatggttatggaaagagttagggaaaaaaaaaacgccacgaatgtgtacccgtgaggaatttacaaggaaagtccgaagtaatgcagcattaggtgctattttcaccgatgaaaacaaatggaagagcgctagagaagcagtagaggactcccgcttttgggagttagtagacagggaaagaaatcttcacttagagggaaagtgtgaaacctgtgtatataatatgatgggtaaacgtgaaaagaaactcggtgaatttggtaaagcgaaaggttcaagggctatatggtatatgtggctgggggcccgctttcttgaattcgaagctttaggttttttaaacgaagatcattggttctcacggggaaattcgctatcgggagtagaaggagaagggcttcataaattggggtacatattgcgggatgtttccaaaaaagaggggggggcaatgtatgcagatgacacggcaggctgggatactagaattacattagaagatcttaaaaatgaagaaatggtgacaaatcatatgaagggggaacacaaaaaattagccgaagcgatatttaagttaacttatcagaataaggtggttcgcgttcaaaggccaaccccacgcggcacagtaatggacatcatttcaagaaaagaccaaagggggtctggacaagtcggtacatatggcttaaatacatttactaatatggaagcgcaactcataagacaaatggaaggtgagggaatcttcaaatccatacaacatttaacggtcacagaagagatcgcggtacaaaattggctagcacgagtgggtagagaacgcctctctagaatggcaatctcaggagatgactgtgttgtaaaacccttagacgatagatttgcctcagcattaactgcactcaatgatatgggtaaagtccgtaaggatattcagcagtgggaacccagtcgagggtggaacgattggactcaggtaccattttgtagtcaccactttcacgaattagttatgaaggatggtcgcgtattggtggttccatgtaggagtcaggatgaactcataggaagagcacgaattagccaaggtgcaggttggtcgttaaaagaaactgcttgcttagggaaatcatacgcacaaatgtggacgcttatgtatttccatcgcagagatttaagacttgccgcaaatgctatttgcagtgcggtaccaagtcactgggtgcccacatcgcgaaccacttggagcatccacgcaaagcacgaatggatgaccacggaggacatgctagccgtatggaatcgagtgtggattcaagaaaacccatggatggaggacaagacccccgtcgagtcatgggaagaagtaccgtacttaggtaaacgagaagaccaatggtgtggttcgctaattgggttaacaagcagagcaacgtgggcaaagaatattcaaacagcaattaaccaagtacgaagtttgataggtaatgaagaatacacagactacatgccttcaatgaaaagatttagaaaagaagaagaagaggccggcgtattatggtag

SEQ ID NO: 22579 - RNA, 9876 nt, synthetic construct
  misc_feature 1..9876: note = derived and/or modified CDS sequence (opt6) from DENV-2__EU569717__SS-prME
  source 1..9876: mol_type = other RNA
acagctggagtaattataatgcttataccaacagcgatggcattccaccttacaaccagaaacggggaaccacacatgatagttggtagacaggaaaaagggaaatctcttctatttaaaaccgaagatggtgtaaacatgtgtactctaatggcaattgatttaggggaactctgtgaagacactataacctataaatgtccgttgttaagacagaacgaacctgaagatatagactgttggtgcaattcgacttcaacatgggtgacctacggtacatgcactacaacgggggaacatagaagggagaaaagaagcgttgcactggtaccgcacgtaggaatgggcttagaaacgaggactgaaacatggatgagtagtgaaggcgcttggaaacacgtacaaaggatagaaacatggattcttaggcatccggggttcactataatggctgcgattctagcatatacaattggaacaacacattttcaacgcgctttgatctttatattactcacagcagtagcaccatcaatgacaatgcgttgtataggcatctcaaatcgagatttcgttgaaggcgtatctggagggtcgtgggtcgatatagttttagaacatggatcatgtgtaacaacgatggccaaaaataaaccgacccttgattttgaactcatcaagacagaagctaaacaaccagcaactctaagaaaatactgtattgaagcgaaattaactaacactacaactgaaagtaggtgcccaacacagggagaaccaagtttgaatgaagaacaagacaaaagattcatttgtaagcattcgatggtcgatagaggatggggaaatggatgtggattatttggtaaaggaggcatagtcacgtgtgcgatgttcacctgtaaaaagaacatggaaggtaaagtagtattgcctgaaaacttagaatatacaatagttataacaccacatagcggcgaagaacacgcagtcggaaacgacacaggaaagcacggaaaagaaataaaaataacgcctcaatctagtatcactgaagcagaactaaccggatatggaacggtgaccatggaatgttcaccccgcacgggcttggactttaatgagatggtattacttcagatggaggataaggcttggcttgtgcaccgccaatggttcctggatttaccgttaccgtggcttccgggtgccgacacacaagggtcaaactggatccaaaaagaaacacttgtaactttcaaaaaccctcacgcaaagaaacaagatgttgttgttctgggaagtcaagaaggtgcgatgcacaccgctttgacgggggctacagaaatacaaatgtctagtggtaatttgttgtttactggtcatcttaaatgcagactaaggatggataaattgcaactgaaaggtatgtcatattctatgtgcacaggaaaatttaagatagttaaagaaatcgctgaaacacaacacgggactattgtgatcagagtgcaatatgagggtgatgggtcaccatgtaaaataccttttgaaatcatggatcttgagaaaagacacgtgctaggaagattgattacggtaaatcctattgtcacggaaaaagattcaccagtaaacattgaagctgaacctccattcggcgacagttacattattattggagtcgaacccggacaactaaaattaaattggttcaagaaaggctccagcataggacagatgttcgagacaaccatgcgcggagcaaagaggatggctattctcggagataccgcttgggattttggctcattaggtggagttttcacgtcaatcgggaaagcccttcatcaagtatttggcgcaatatatggagcagcattttcaggtgtatcatggacaatgaaaatcttgattggtgtaattatcacatggatagggatgaactccagaagtacgagcttaagcgtgtcattagttctcgtgggagttgtgacattatacttaggagtaatggtgcaagcagatagtgggtgcgtagtatcatggaaaaataaagagctgaaatgtggttcaggtatatttatcactgataatgtacatacttggacagaacaatacaagtttcaacctgaatcgccaagtaaacttgcatctgcaatccagaaagctcatgaggagggtatttgtggaattagaagcgtgacacgacttgaaaatttgatgtggaaacaaataacaccggagttaaatcatattttatcagagaatgaagttaaactcacaataatgactggagacataaaagggataatgcaagcaggaaagagaagtttaagaccccaaccaacagagttgaagtatagttggaaaacttggggaaaggctaaaatgctgtcaaccgagtcccacaatcaaacattccttattgatggtcccgaaactgctgagtgtcccaatacgaatcgggcatggaactcgttagaagttgaggactatggattcggtgttttctcaacaaatatctggcttaaactacgtgaaaaacaagacgtattttgtgacagtaaactcatgtcagcagctatcaaggacaaccgtgcagtacatgcagacatgggttactggatagaaagcgcgcttaacgatacatggaagatggagaaagcgagttttatagaagtgaaatcatgtcactggcctaaaagtcatactttatggtccaacggagtgttggaatcggagatgattatacctaaaaacttcgcaggtccagttagtcagcacaactataggccaggatatcacacacaaaccgcaggaccatggcatctgggcaaattggaaatggacttcgatttttgcgaaggcacgacagtggtggtgacggaagattgtggtaaccgaggcccaagtttacgaactaccacagcaagtgggaaactaatcacagagtggtgttgtagatcgtgtactctacctccacttagatataggggtgaggatggatgttggtatggaatggagattcggcctttaaaagagaaagaagaaaatttagtaaactcattggtcacagcaggacatggtcaaatagataacttctctttaggtgtcttgggaatggcactatttttggaagaaatgctacgaaccagagttggtacaaaacatgctattttgctagtagcagtttcgtttgttacattaattactggtaatatgtcgtttagggacttaggtagagtgatggtcatggtaggggccactatgactgatgatattggaatgggtgttacatatttagcccttctagctgctttcaaagtacgaccaacgtttgcagctgggttactattgcgaaaacttacaagtaaagaattaatgatggctacaattgggatagccttgctttcccaatccactataccagagactatcttagaactaacagacgcattagcactaggaatgatggtattaaagattgtgaggaacatggaaaagtaccaactagccgttactataatggcaatatcttgcgtaccaaacgcggtgatattacaaaacgcgtggaaagtgagctgcacaattctagccgcagtgtctgtttcaccattgctgctgacaagcagtcagcaaaaagcggattggattcctctagcgctaacaataaagggtttgaaccctactgccatatttcttacgaccctaagcagaacttctaagaaacgcagttggcctctaaacgaagcagtaatggctgttggcatggttagcatacttgcgagtagccttctcaaaaatgacataccgatgaccgggccgctagtagcaggaggattactcacagtatgttatgtattaacgggaagaagcgcagatttagaactagaacgagctgccgatgtaaagtgggaagaccaggcggagataagtgggtcaagccctatattatcgattactatcagcgaagacggaagtatgtctatcaaaaatgaagaagaggaacacactttgacaatcttaataagaacaggattgctggttataagtggcgttttcccagtatctataccaatcaccgcagcagcatggtatctttgggaggtgaagaaacaacgtgcgggggtactatgggatgtaccttccccaccgcccgttggtaaagccgaactagaggatggcgcttataggatcaagcaaaggggtatatttggttattcccaaataggcgccggagtttacaaagaagggacatttcatacaatgtggcatgttacccggggagcagtattaatgcacagaggtaaaagaatagaaccgtcatgggctgatgtgaagaaagacctgatatcttacgggggaggttggaaactagaaggagaatggaaagaaggcgaagaggttcaagttttggccttagaaccgggcaaaaatccccgagcagtccagacaaaaccaggtttatttaagacaaatacaggaactataggtgcagttagtttagacttttcacctggaacatcaggaagtccaatcgtagacagaaaagggaaagttgtcggactatatggaaatggcgtggtaactagatctggcgcatatgtttctgctattgcccaaacagaaaagtcgatagaagataatccagaaatagaagatgacattttcagaaagaaaagacttacaattatggacttacaccctggtgcaggcaaaacaaaaaggtacctcccagcaattgttagggaagctataaaaagaggtctgaggactttaatactcgcgccgactcgagtcgttgctgccgaaatggaagaagctctgcgaggcctgccaatcagatatcaaactccagcgatccgggcagaacatactggtagagagatcgtagaccttatgtgtcacgctacattcacgatgcgacttctgtcgcctgtaagagtacctaactacaatctaattatcatggatgaggcacattttacagacccagccagcatagcagcaagagggtatattagtactcgggtagaaatgggagaagcagcaggcatcttcatgacggccactcctcctgggtcacgagatccattcccgcaaagcaacgcaccgattatggacgaagaaagggagatacccgagcgcagttggaatagcgggcatgaatgggtaacagatttcaaagggaagactgtttggttcgtaccctcaataaaagctggaaatgacatagctgcgtgtttaaggaagaacggcaagaaagtgatccaactctcgcgcaaaacgttcgattcagaatacgtcaagacaagagctaatgattgggactttgttgttaccactgacatatctgaaatgggagcaaattttagagccgaaagagtaatagacccacgtcgttgtatgaaacccgtcatattgacagatggcgaagaacgcgtaattctagcaggaccaatgcccgtcacacattcaagtgcagcccaaagacgagggagaataggaagaaatcccaaaaatgaaaatgatcagtatatttatatgggagagccgctggagaatgacgaagactgtgcacattggaaggaagctaaaatgctactcgataacatcaacaccccagagggaatcattccaagcatgtttgaaccggaaagagaaaaagtcgacgctattgatggagaatacagactaagaggtgaagcaaggaaaaccttcgtcgatcttatgagaagaggggatttgcctgtttggctggcctatagagtcgcagcagaaggaattaactatgcagatcgccgatggtgctttgatggtattaaaaataatcaaatattggaagaaaacgttgaagtagaaatctggactaaagaaggagaaaggaagaaattaaaacctagatggctggatgctcgtatatatagcgatcccttggctctcaaagaatttaaagaatttgcagccgggaggaaatctctgaccttaaatttaattaccgagatgggcagattaccaacttttatgacacagaaagcacgagatgcactggataacttagctgtattacatacagcagaagtaggtggaagggcttacaatcatgctctaagcgaattacctgaaacactagagacgttactattgttaaccttgctagctactgtcactggagggatttttcttttcctcatgagtggaaagggtattgggaaaatgaccctgggcatgtgctgcataattacagctagcatcttgttatggtacgcccaaatacaaccacattggatcgccgcctctataatactagaatttttcttgattgttcttctaataccggaaccagaaaaacagagaacaccacaagataaccaactaacatatgtagtaatcgccattcttacggttgtagcagctaccatggccaacgagatgggatttttagaaaagacaaagaaagatctaggactcggtagtatcactactcaagaatccgagtccaatatattagatatagatcttcgtcctgcttcagcatggaccctatacgcagttgcaacaacgttcgtaacgccgatgttacggcattcaattgaaaattccagcgttaacgttagtttaacagcaatagcgaaccaagctacagtgttgatgggcttggggaggggttggccgctttcaaaaatggacataggtgtaccacttttagctataggctgttactcccaagtcaatccaatcacattaacggcagctttactattacttgtagctcattacgccataataggccctggcctgcaagcaaaagctacaagggaagcacagaaaagggcagctgcaggaataatgaagaaccctacagtagatggcataacagtgattgacttagaaccgataccttacgatcccaagttcgaaaaacaactcggccaagttatgttattagtactatgtgtgacacaagtgctaatgatgcgtacaacatgggcgctttgtgaggctttaactcttgcaacgggccccatttcgaccttgtgggaaggaaatcctgggcgtttctggaacacaacaatagccgtgtccatggctaatatatttcgaggttcttacttagcaggcgcgggcctgcttttcagtattatgaaaaataccacaaatactagacgtggtactgggaatataggagaaaccttaggggagaaatggaaatcaaggctaaatgcacttggtaaatcagagttccaaatatacaagaaatcaggaatccaagaagtggaccgcactctggctaaagaaggtattaagagaggagaaaccgaccaccatgcggtatcacgaggatcagccaaactacgatggtttgttgaaaggaatatggttacaccggaaggtaaagtcgtggatttaggctgtggaagaggaggttggtcatattattgcgggggcctaaagaacgtaagggaggtgaaagggttaaccaaaggaggcccgggacacgaagaaccgatacctatgagcacttacgggtggaatttagttcgtcttcaaagtggtgtcgatgtattctttacacccccagagaaatgtgacactttactctgtgatatcggtgaatcgagtcctaacccaacgatagaggctggacgcacactgagagttttaaatttggttgagaattggctgaataataatacacaattctgtataaaagtcttaaatccatatatgccatctgtaattgagaaaatggagactcttcagagaaaatacggtggcgccttagttcgaaatccgctatctaggaactcgacacatgagatgtactgggtctcaaatgccacaggcaatatcgtatcatcagtcaacatgataagccgcatgttagtcaatcgcttcacgatgaaacacaagaaagctacgtacgaaccagatgtagacctaggaagtggaacgagaaatataggaattgagaatgaaattcctaacttagacattattggcaaaagaatagagaaaataaagcaagaacatgaaacatcttggcactatgatcaggatcacccttataaaacgtgggcctaccatggaagctatgaaaccaaacaaacaggctctgccagctccatggtaaatggagtcgtacgcctacttaccaagccatgggatgtggtaccaatggtcacacaaatggccatgaccgatactacgcctttcggacaacagagggtatttaaagaaaaggttgataccagaacacaagaaccaaaggaaggtactaagaaactaatgcggatcaccgctgaatggttgtggaaagagttaggcaaaaagaaaacacccaggatgtgcactagggaagagtttactcgtaaagtaagatctaatgcagcgttaggagcaatatttacagacgaaaataaatggaaatcagcaagggaagcggtggaagactccaggttttgggagctagttgaccgagaacgaaatttacatttagaaggaaaatgcgaaacatgtgtgtataatatgatgggaaaacgagagaagaaattgggtgagttcggaaaagcaaaaggaagtagagcaatctggtatatgtggctgggagctagattcttagaatttgaagcattaggattcttaaatgaagaccactggtttagtcgaggaaatagcttgagcggtgtagaaggagaagggttacacaaactaggctacatattaagggacgtaagcaagaaagaagggggagcaatgtatgctgatgatacagctggttgggatacgaggataaccttagaagatcttaaaaacgaggagatggtgacaaatcatatgaaaggtgaacataaaaagctagctgaagcgattttcaagctaacttaccaaaacaaagtggtacgtgttcaaaggccaacgccaaggggtactgtcatggatataatttccagaaaagatcaacgggggtcaggtcaggtagggacctatgggctaaatacattcacaaacatggaagctcagttaatacggcaaatggaaggtgaaggaatattcaagtcgattcagagactaacggtcacagaagagatagcagtacaaaattggttggcaagggtaggccgagagcgactaagcaggatggcaatatcaggcgatgattgtgtagtaaaacccttagatgaccgctttgctagtgccctaacagctctgaacgacatgggtaaggtgaggaaagatatacaacaatgggaacctagtcgaggatggaatgattggacccaagtaccgttttgtagtcaccacttccacgaactggtaatgaaagatggcagggttcttgtagtaccctgtcgtaaccaagatgaattaattgggagagccagaatctctcaaggtgccggttggagcttaaaagaaaccgcatgtttaggtaaatcatatgcacaaatgtggaccctgatgtatttccatcgacgtgacctgagactggcagcaaacgctatatgttctgcggtgccgagtcattgggtaccaacaagcagaacgacgtggtcaattcacgcaaaacacgaatggatgaccaccgaagatatgttagcagtatggaaccgtgtctggatacaagaaaacccctggatggaagacaagacgccggttgaatcctgggaagaagttccctatttaggcaaaagagaagatcaatggtgcggaagtctaattggattaacgtccagggctacttgggcaaagaatattcaaacagcgataaaccaagtaaggtccctaataggcaacgaggaatacacagactatatgccttctatgaaaagatttcgaaaagaagaagaagaagctggtgtgctatggtag

SEQ ID NO: 22580 - RNA, 9876 nt, synthetic construct
  misc_feature 1..9876: note = derived and/or modified CDS sequence (opt6) from DENV-2__EU569718__SS-prME
  source 1..9876: mol_type = other RNA
accgcgggtgttataatcatgctcataccgacggctatggcatttcacctgactactcgaaatggtgaaccacacatgatcgtgggccgacaagaaaaaggaaaatccttattgtttaaaacggaagacggagttaatatgtgcactcttatggctattgatctaggtgaactatgtgaagatactatcacttacaaatgtccacttctccgacaaaatgaaccagaagatatcgattgttggtgcaattccacaagtacttgggtaacgtacggaacatgtactacgacaggagaacatagaagagaaaaacgaagcgtagccttagtaccacatgtgggaatgggtctagaaacaagaactgaaacctggatgtcaagtgaaggtgcatggaaacatgtacaaagaatagaaacatggatccttagacacccaggatttaccataatggcagcaatacttgcatacacaatagggacaacccactttcaacgagctcttatttttattctattaacagccgtagcaccgagtatgaccatgcgatgtataggtatttctaatagagactttgttgaaggagtatccggaggttcatgggtcgatatagtactcgaacacggcagttgtgtaacaacaatggcgaaaaataaaccgacactagacttcgaattaattaaaacagaagctaaacaacctgcaaccctacgcaaatattgtatcgaagcaaaactaacaaacacaactacagagtcgcgttgcccgacccagggagagccaagtctaaatgaggaacaagataaaagatttatatgcaaacatagcatggttgaccgaggatggggtaacgggtgcggcttatttggaaaaggtggtatagtgacatgtgcaatgtttacgtgtaagaaaaatatggaaggcaaagtggtactaccagaaaatctagaatatacgattgtgataacgccacactcaggagaggagtatgccgttgggaatgacactggtaaacatggaaaagagataaaaattacgccgcaatccagtattaccgaagcggaacttactggctatggaacagttacaatggagtgctcgccgcggaccggcctagactttaacgaaatggttctattacaaatggaagacaaagcgtggctagttcaccgtcaatggtttcttgatctacctttgccgtggctcccaggcgcagatactcaaggaagcaattggatacaaaaagaaactttagtgacatttaaaaaccctcatgcgaagaaacaagatgtggtcgtattaggaagtcaagagggggctatgcatacagcactaacaggagcgacagaaatccaaatgtcatcaggcaacctgttatttaccgggcatttaaaatgtaggcttcgtatggataaactacaactaaaagggatgtcatattcaatgtgtactggaaaatttaaaattgtaaaagaaatcgctgaaacgcagcatgggaccattgtcatacgtgtccagtatgaaggagatggaagtccttgcaagattccttttgaaataatggatctcgaaaagcgccatgtcttagggcgactcataactgtcaatccgatagttactgaaaaagactcaccagtaaacgtcgaagcagaaccgcctttcggagattcctacattataatcggcgtagagccgggacaactcaaactcaattggttcaagaaaggttcttccatcggacaaatgttcgaaactactatgaggggagctaagcggatggctatattgggcgacacagcatgggatttcggctctctaggaggtgtgtttacaagcataggaaaagcactacatcaagtttttggagctatatatggagcggcgtttagcggagtaagttggacaatgaaaatattaattggggtcattataacttggatagggatgaactcacgttcaacatcattatcagtatctctggtcttggtcggagtcgtaacattgtacctgggagtcatggtacaagcagatagtggatgcgtagtatcctggaaaaacaaagaacttaaatgcggttctgggatttttattacagataatgtacatacctggacagaacagtataaattccagcctgaaagcccatcaaaattagcttctgcaatacaaaaagcgcatgaagaagggatatgtggcatacgtagcgttactagactagagaatttaatgtggaaacaaataacaccggaattgaaccacatcttgagcgagaacgaagttaaactcactattatgaccggtgatatcaaaggaattatgcaagcaggaaaacgtagtctacgcccacaaccaacagaactaaaatattcatggaaaacttgggggaaggcgaagatgctatccactgaatctcacaatcaaacattccttatagatggacccgaaactgccgaatgtccaaacactaacagagcttggaactctttggaggtagaggactatggattcggtgtattttcgacaaacatttggcttaaattaagagagaaacaggatgtattctgcgattcaaaacttatgtcagcagcaataaaagataaccgagccgtacatgcggacatgggatactggattgaatcggcactgaacgatacatggaaaatggagaaagccagtttcatagaggtcaaatcatgtcactggcctaagtcacatacactatggagtaatggtgtactggaaagtgaaatgataattccgaagaattttgctgggccagtaagtcaacacaactataggccaggttatcatacgcaaaccgctgggccgtggcacttaggaaaattagaaatggacttcgacttctgtgaaggcacgacagtggtcgtgactgaggattgtggaaatagaggaccgtcgttgcgaaccaccaccgcgtcaggcaaattgataacagaatggtgttgcaggtcttgtactcttcccccactacgctaccgcggagaagatggatgttggtacggtatggaaataagaccgttaaaggagaaagaagaaaaccttgtcaacagtttagtcaccgcagggcatgggcaaattgacaatttttcacttggcgttcttggaatggctttatttttagaagaaatgctccgtacacgcgtgggaacaaaacacgctatactattagttgcagtatcgttcgttacactaataacgggaaacatgtcattcagagatctaggacgagtcatggtcatggtaggggcaacgatgaccgatgatatcggaatgggcgtaacctatcttgcactcctcgctgccttcaaagttcgaccaacatttgcagccggactgcttttgaggaagctgacaagcaaggaacttatgatggctacaattggaatagcactcctgagtcagtcaacaataccagaaacgatccttgagctgaccgacgcattagccttaggtatgatggttctaaaaatagtacgtaatatggagaaataccaactagctgtgacaataatggcaatcagttgtgtgcccaacgcagttatactacaaaacgcatggaaagtgagttgtactattctagccgcggtttccgtatctccattacttttgacatcctcccagcagaaggcggattggatacccttggcattgaccataaagggattgaacccaacggctatattcttaaccaccctatccagaacatctaagaaacgaagttggccattaaatgaggctgtaatggcagtgggaatggtatcaatattggcttcgtcactcctcaaaaacgatatacctatgacaggtccattagttgcaggaggacttctaaccgtgtgctatgtactaacaggaaggtcggcagaccttgagctagaacgggcagcagacgtaaagtgggaagatcaagcagaaataagtggaagctcaccaattttgtctattacaataagtgaagacggtagtatgtcaattaaaaatgaagaagaagaacaaacactaacaatattaataaggacgggacttctagtcatctcaggcgtgttcccagtctctattccaataacggcggcggcatggtatctatgggaggtcaagaaacaaagagccggggtactctgggatgtgccgtcaccccctcccgtgggaaaagctgaattagaagacggcgcctatagaattaaacagcgagggatattcggctacagtcagattggcgcgggggtgtataaagaaggcaccttccacacaatgtggcacgtaactaggggagcggtattgatgcatcgaggtaaaaggattgagcctagttgggctgacgtaaagaaagatttaataagttacgggggaggatggaaattagagggagagtggaaagaaggcgaagaagtccaggttttagcgttagagcccggtaaaaatcctcgcgcggtacagacgaaaccgggattatttaaaacgaataccgggactataggcgccgtatcattagatttttcaccgggaacttccggcagtccaatagtcgatcgtaagggtaaagtcgtaggtctctacggtaacggagtggtgacaaggtctggagcgtatgtatcagcaatagctcaaacagagaaaagcattgaagataaccccgaaatagaagatgacatatttaggaagaaacgattaacaattatggatttacaccccggggcaggcaaaacaaaacgctacttaccggcaatagtacgagaagcaattaaacgaggactcagaaccctaatattagcaccaactcgtgtcgttgccgcagaaatggaggaagcacttaggggactaccgatacgctatcagacgcccgcaatcagagcagagcatactggtagagaaatcgtagacctcatgtgtcatgccacatttacaatgagattattatcccctgtacgtgtccctaattacaacttaattattatggatgaagcacatttcactgatccggcaagtatagccgcgagagggtacatatccacgagagtagaaatgggtgaagccgctggtatatttatgacagctaccccacctggctccagggacccatttccacaaagtaatgccccaataatggatgaagaaagagaaatcccagaaaggagctggaacagcggacatgaatgggtaactgactttaaaggaaaaaccgtctggttcgtaccaagtataaaggcaggaaacgacatcgctgcttgtttaaggaaaaatgggaagaaagttatacaattaagccgaaaaacattcgatagcgagtacgtgaagacaagagctaatgattgggatttcgtagtcaccaccgacatttctgaaatgggagctaactttagagctgaaagagtaattgatcccagaaggtgtatgaaacctgtaatattaactgatggagaagagagagtgatactggcaggtccaatgcccgtgacacactcatcggcggctcaacgaagaggacgtattggaagaaatcctaagaatgaaaacgatcagtatatttacatgggagagccattagaaaatgacgaagattgcgcacattggaaagaagcgaaaatgttattagacaatattaacaccccagaaggcattataccgagcatgtttgaacccgagcgggaaaaagtagatgctatcgacggagaatatcgattacgaggagaggcgcgtaaaacctttgtagacctaatgcggaggggtgacctaccagtctggctagcttatcgagtagccgcggagggtatcaactacgctgacagacgatggtgtttcgacggcattaagaataaccaaattttggaagaaaacgtagaggttgaaatatggacaaaagaaggggagagaaagaaattgaaaccccgatggttggatgcaaggatatactctgatcccttagcactcaaagaatttaaagaatttgctgctggacgtaagagcttgacactaaacttaataactgagatgggtagattgcctactttcatgacgcaaaaagctcgagacgctttagataacctcgctgtgctgcatacggctgaagtgggagggaaggcatataaccacgcgttatcagaattgccagaaacattagaaacgctcttacttctaacactactagcgactgtgactggtggtatctttctatttctcatgtcgggaaaagggataggaaaaatgaccctaggcatgtgctgtataataactgcatcaattctgctctggtacgcacaaatacagcctcattggatcgcagcttcaataatacttgaatttttccttatagtcctattaattcctgagccggaaaaacaaaggacaccacaagataaccaactaacatacgtagtaatagctatactgacggtagtggcggcaacaatggcaaacgaaatgggatttttagagaaaaccaagaaagatttaggattaggatcgattaccacacaagagagtgaatctaacatcctggatattgaccttagaccagcgtctgcttggacattgtacgcagtggcaacaacgtttgtaacacctatgttacgacatagtatagaaaatagttccgttaacgtatcgcttacggcaatagccaatcaggctaccgtactcatgggtttgggccgtggttggccgttaagtaaaatggatatcggagttcctcttctagccataggatgttacagccaggtgaatccaataacactaacggccgccttacttttgttagtagcgcactatgccatcataggtccaggattacaagccaaagccacacgagaagctcaaaaacgagcagcggctggcattatgaaaaacccaacagtagacggaataactgttattgatttagaaccgataccctatgacccaaagtttgaaaaacaattagggcaagttatgttgctcgtattatgtgttacacaagtgttaatgatgcgtacaacatgggcactctgcgaagcgctaacattagcaactggaccgatcagtactttatgggaagggaatccaggaaggttttggaatactacgatagctgtatcaatggcaaacatatttcgagggtcatacctcgctggagcagggttattattctctataatgaaaaatactacaaacactagacgaggaactggcaatattggggaaaccctaggagaaaagtggaagagtcgattaaatgctttaggaaagagtgagttccaaatttataaaaagtcgggaatacaagaagtggatcgaactttagcaaaggaggggataaagcgaggtgaaaccgaccaccatgccgtaagtcgcggttctgctaaattgaggtggttcgttgaacgcaatatggttacacctgaaggaaaagtagtggatttaggatgcgggagaggcggatggtcatactactgcggaggccttaaaaatgtcagagaagtaaaagggttaactaaaggcgggccgggtcacgaagaacccataccaatgtctacctacggatggaatttggtcagactacaaagcggggtagatgtgttctttacaccacccgaaaaatgcgacacactgctatgcgatataggggaaagttctccaaacccgactatagaagcaggtcgaacacttagggtattaaacttagtcgaaaattggctgaataataatactcagttttgtatcaaggtgttgaatccgtacatgccttcggttattgagaaaatggagactctacaacgaaaatatggtggagctttggtaagaaacccactatccagaaactcaacccatgaaatgtattgggtttcaaacgctacgggaaacatagtatccagcgttaatatgataagtcgaatgttgataaatcgattcacaatgaaacataagaaagcgacgtatgaacctgatgtagatttagggtcggggacacgaaatattggaatagagaacgaaataccaaatttagacataataggtaaaagaatagaaaagatcaagcaagaacatgagacatcatggcattacgaccaagaccatccttataaaacatgggcctatcacggtagttacgaaacaaaacaaactgggagcgcgtcttccatggttaatggtgtcgtcagattactaacaaaaccgtgggatgtagtccccatggttactcaaatggccatgacagacacaacgccattcggacaacaaagagtatttaaagaaaaggtcgacaccaggacccaagagccgaaggagggtacgaagaaactcatgcgaataactgcagaatggctatggaaggaacttggaaagaagaaaacaccaagaatgtgcacacgagaggaatttacacgtaaagttagatcaaatgcagcactaggcgccatatttaccgacgaaaacaaatggaaaagtgcacgtgaggctgtcgaagattcaagattctgggaattagttgatagagaacgtaatctccatttagaaggaaaatgtgagacatgtgtttacaatatgatgggaaaaagagagaagaaacttggagaatttgggaaagctaaagggtcaagagcaatatggtacatgtggcttggtgcacgtttcttagaatttgaagcattaggatttttaaatgaagaccattggttctctcgaggcaatagtttaagtggcgttgagggagagggtcttcacaaactaggttatatcttgagggacgtatcaaagaaggaaggaggagccatgtatgcggatgacacggcaggatgggatacgaggattacgcttgaagatctcaaaaatgaggaaatggtaacgaatcacatgaaaggagaacacaagaaattagcagaagcgattttcaaattgacgtatcagaataaagtcgtgcgagtacaacggcctactcccaggggaaccgtcatggatataataagtaggaaggaccaacgaggtagcggacaagtgggaacatatggactaaacaccttcactaatatggaggctcaacttatcaggcagatggaaggcgaaggaatcttcaaaagtatacaaagacttacagttactgaagaaattgccgtacaaaattggctcgcacgtgttggacgtgaaagattgtcacgcatggccatatcgggtgatgattgcgtcgtcaaaccactagacgaccgatttgcgtccgcacttaccgcactaaacgatatgggaaaagtaagaaaagatatacagcaatgggaaccgtcaagaggatggaatgactggacacaagtacctttttgctcgcatcacttccacgagctggtaatgaaggatggtcgtgtacttgtggttccttgcagaaatcaagatgagttaataggacgagctcgcataagtcaaggagcaggttggtcattaaaagaaaccgcttgcctcggtaagtcatatgcccaaatgtggactctcatgtactttcatagacgcgaccttaggcttgcagctaacgcaatttgctcggcagttcctagtcactgggttcccacaagccgaaccacatggtcaatacacgcaaagcatgaatggatgactacggaagatatgctggcagtctggaatagagtatggatacaggaaaacccgtggatggaagataaaacaccggtcgaatcgtgggaagaagtaccttatctcggaaagagagaggatcaatggtgtggatcactgatagggcttacttcaagagccacctgggcgaaaaatatacaaactgcaatcaaccaagtccggagcttaatcggaaacgaagagtacacggactacatgccctccatgaaaagattcagaaaggaagaagaagaagccggggttttatggtaa

SEQ ID NO: 22581 - RNA, 9876 nt, synthetic construct
  misc_feature 1..9876: note = derived and/or modified CDS sequence (opt6) from DENV-2__EU596488__SS-prME
  source 1..9876: mol_type = other RNA
accgcaggagtaattataatgctcataccaaccgtaatggctttccatttaacaacaagaaatggtgaacctcatatgatcgtagggcgtcaagaaaaaggaaaatctttacttttcaaaacagaagatggcgtaaatatgtgtacattaatggcgattgatttgggagaattgtgcgaagataccattacgtacaaatgtcctctactaaggcaaaatgaaccagaagacatagactgttggtgcaacagtaccagtacatgggttacttatggtacttgtactacgacaggagaacaccgcagagagaaacgatcagtggcacttgtaccccatgtaggaatgggactagaaacaagaacagaaacatggatgagtagtgaaggagcatggaaacatgtacaaaggatagaaacttggatattacggcatcctggtttcacgataatggcagctatccttgcttacacaattggtaccactcactttcaacgagctcttatttttatcttactaacagcagtagctccaagcatgacaatgagatgcatcggtattagtaacagagactttgttgagggcgtatcaggaggaagctgggtagacatcgtcttagaacatggttcatgtgtgactaccatggcgaaaaataaaccgacattagactttgaactaatcaaaacagaagcaaaacaaccagcaaccttacgaaaatattgtatagaagcaaaactcactaacacgacgacagagtcacgatgtccgacccaaggcgaaccatccctaaacgaagaacaggataaacgatttatttgcaaacattccatggtagatcgaggatggggtaatggctgtggtctctttggtaaaggtggaattgtcacctgtgccatgtttacctgtaagaaaaacatggaaggcaaagtcgtattaccagagaatctcgagtatacgatagttattacacctcactcaggagaagaacacgctgttggaaatgacaccggaaaacacggaaaagaaataaaaataactccacaatcatccataacagaagcagaactcacggggtacgggacggttacgatggaatgtagtcctagaaccgggttagacttcaacgaaatggtcctacttcagatggaagataaagcgtggctagtccaccgtcaatggttcctagatttacctctaccatggcttccaggtgctgacacgcaaggaagtaactggattcagaaagagacattagttaccttcaaaaatccccatgctaagaaacaggatgtggtggttttgggcagtcaagagggagcgatgcatactgcattaactggagctacagagatacagatgtcatcaggcaatttactatttactggccacttgaaatgtaggttgaggatggataaactacaacttaaaggtatgagctattctatgtgtacgggaaaatttaaaattgtcaaagaaatagcagaaacacaacatgggaccatagttataagagtgcaatacgaaggtgatggtagcccatgtaaaattccattcgagattatggacctggagaaaagacatgtactaggacggcttataacagtaaatcccattgtaacggaaaaagactccccagtgaacatagaagctgaaccgccgtttggggacagttacataatcatcggagtggaaccaggtcaactcaaactgaactggtttaagaaaggctcatcaattggacaaatgtttgaaacgacaatgcgtggtgcaaaaagaatggcgatactaggtgacacggcatgggattttgggtccttgggcggtgttttcacaagtatcggaaaggcactgcatcaagtattcggagcaatatatggagccgctttttcaggggtatcatggacaatgaaaatattaattggggttattataacatggataggaatgaatagtagatctaccagcctgtcagtcagcttggtattagtgggggtagttacgctttatcttggagtaatggtacaagcagatacagggtgcgtagtttcgtggaagaataaggaattaaaatgtgggtcaggtatattcataactgacaatgtacatacgtggactgaacaatacaagttccaacccgaaagcccatcgaaacttgcgtctgcaatacaaaaggctcacgaagaagggatatgtggaatacgaagtgtcactagattagaaaatttaatgtggaaacaaataactcccgagttaaatcatatcctcagcgagaacgaggtaaaattaactattatgaccggagacataaaaggaattatgcaagctggtaaaagatcattgaggccacaaccgacagaacttaagtattcatggaagacatggggtaaagcgaaaatgttaagtacagaaagccacaatcaaacttttctaatagacggacctgaaacagcagagtgtcctaacacaaatagagcgtggaactcacttgaagtggaggattacggattcggagtattttcaacaaatatatggctcaaattacgtgagaaacaagatgtattttgtgactctaaactgatgagtgctgcgataaaagacaatagagctgtacatgctgacatgggttattggatcgaatccgctttaaacgatacttggaaaatggaaaaagctagctttatagaaattaaaagctgtcattggccgaagtcgcatacgctatggtcaaatggagtattagaatcagaaatgattataccaaagaacttcgcgggaccagtatcacaacataactatagacctggatatcatacacagactgcaggcccttggcatctaggaaaattagaaatggattttgatttttgtgaaggaacgacggtggtcgttacagaagattgtgggaacaggggaccatcgttgagaacaactaccgcgtctggaaaactaattaccgagtggtgttgtcgttcatgcacactgcctcctcttcggtatagaggtgaagacggatgctggtacggaatggaaatacgcccattaaaggagaaagaagagaatctagtgaactccttagtgactgctggacatggtcaaatagataacttttctctcggagtcctgggcatggcgctttttctagaggaaatgctaaggacccgagtaggaactaagcatgctattttgttagtagccgtttcatttgtcacacttataactggtaatatgtcctttagggatctaggtagagtaatggtaatggtgggggcaacaatgacagatgacattggcatgggtgtaacatatcttgcattattagctgcgttcaaagtaagacctacctttgcggcaggcctactgctcagaaagctgacgagtaaagaactcatgatggcaactattggtatagccctactgtcacaaagtacgatacccgaaacaatattggagcttacagatgcgctggctttaggtatgatggtattgaaaatagtacgcaacatggaaaaatatcaactggctgtaacaatcatggctatatcttgtgtaccgaacgctgttatattacaaaatgcttggaaagtgagctgtacgatcttggcagctgtcagtgtatccccgctccttctgacaagcagccaacaaaaagcagattggatcccgttagcgctgacaatcaagggtttaaaccctacagcgattttccttacgactctatcaaggacatccaagaaaaggagctggccactaaatgaagcggtcatggccgtaggcatggtatcaatacttgcaagttctttactcaaaaacgacataccaatgacaggccccctagtagcagggggtctattaacagtatgctacgtattaacggggcgaagcgctgatcttgaattagaacgagctgcggatgtaaaatgggaggaccaggcagagataagtggtagtagtccaatactatcgattacgatatcagaggatgggtctatgtcgattaagaacgaagaagaagaacatactctaacaatactaatcaggacaggattattagtgatctcgggggtgtttccagtgtcgatacctataactgccgctgcatggtacttgtgggaagtcaagaaacagcgagcaggagtcttgtgggacgtaccgtcaccaccgccggttggcaaagcagaattagaagatggtgcatatagaataaaacaacgaggaatttttggatactcgcaaatcggtgccggtgtgtacaaagaaggaaccttccacacaatgtggcatgttacaagaggggctgtattaatgcatagaggaaaaagaatagagcctagctgggcggacgtcaagaaagatctaatctcatatgggggaggatggaaattggagggagaatggaaagaaggtgaggaagtacaggtgctagctttggaacctggtaagaacccacgggcagtacaaacaaaacctggcttattcaaaacaaatactggaactattggagctgtctcacttgacttttcaccaggaacttcagggagtccaatcgtcgatagaaaaggcaaagtcgtcggcctatatggtaacggagtcgtcacgagatctggtgcttatgtctcagcaattgcacaaacggagaaaagcatcgaagataatccggagatcgaagacgatatatttagaaagaaacgattgaccataatggatctgcatccaggagccggaaaaaccaagaggtatttaccagctatagtaagggaggcaattaaacgcggacttagaaccttaatcttggctcccacgcgtgtggtcgcagcggaaatggaagaggccctaagagggctacctatcaggtaccaaactcccgccataagagccgaacatacagggagagaaattgttgacttaatgtgtcatgcgacatttactatgagacttctctccccagtaagagtaccaaattataatttaataataatggatgaagcacattttacagacccagcctcgatagcagctagaggttatatcagtactcgagttgaaatgggagaagccgcaggaatattcatgactgcgaccccgcctgggtcaagagatcccttcccgcagtcaaacgccccaattatggacgaagagagagaaatccctgaaaggtcatggaactctggacatgagtgggtgacagacttcaaaggaaaaacagtttggttcgtaccttccattaaagctggcaatgacattgctgcgtgcttacgtaagaatggtaaaaaggtcatccaactcagccgaaaaacatttgactcagaatatgttaaaacacgtgccaacgattgggattttgtcgtaacaactgatataagtgaaatgggcgcaaacttcagagcggaacgagtaatagatcctagaagatgtatgaagccagtcattttaactgacggcgaagaacgagtaatccttgcaggcccaatgccagttactcattcatcagcagcgcaaaggagaggaagaatcgggcgaaacccaaagaacgaaaacgaccagtacatttatatgggagaacctcttgagaacgatgaggactgtgctcactggaaagaagccaaaatgttattagacaatataaacacacctgaaggcataattcccagtatgtttgaaccggagcgagaaaaggtagatgcaattgatggtgaatatcggctaagaggagaggcaagaaaaacatttgtagatctaatgcgaagaggtgatttaccagtctggctggcatacagggtcgcggcagaaggcataaactatgctgaccgacgctggtgtttcgatggtattaaaaataatcaaatattagaagaaaatgtcgaagtagaaatctggacaaaggaaggagaaaggaagaaactaaaacctaggtggctagacgcgaggatctacagcgacccattggcactaaaagagtttaaggaatttgcagcaggccgaaagtctctgaccttaaatctcattacagagatgggtcgtttaccgactttcatgacccaaaaagccagggatgccctagataatttagcagtgttacacacagcggaagtaggaggacgagcatacaaccacgcactttcggaattaccagaaacactagaaacgctcttgcttcttacattactagctaccgtaacaggaggtatatttctctttctgatgtctggtaaaggaatcggaaaaatgactttagggatgtgctgtatcatcacggcctcaatactactgtggtacgctcagatacaaccgcactggatagcggcaagcatcatcttggaatttttcttaattgttctactcataccagaacctgaaaaacaaagaacaccccaagacaaccaactaacttatgtcgttatagcaatacttacagttgtcgcagccacaatggcgaatgaaatgggtttcttagaaaagacgaagaaagatctaggtctagggagtataactactcaagaatcagaatccaatatcctagatatagatctgcgtcctgcctctgcgtggactttatatgctgtcgcaactacatttgtaaccccaatgctacgacactccatagagaactcaagcgtgaacgtgagcctaacagcgatcgccaatcaagcgaccgtcctaatgggactaggaaggggctggccattgagcaagatggacatcggtgtgccactcttggcgattggatgctattcacaggtaaatccaataacccttacagccgcactgttattattagttgcacattatgcaattattggcccaggcttgcaagcaaaagctacgcgcgaggcacagaagaggacagcggctggtattatgaagaacccgaccgtggacggcattaccgtcattgatctggaaccaattccgtacgaccccaaatttgaaaaacaactaggacaagtaatgttattagtattgtgcgtgacccaagtcctgatgatgaggactacatgggctctatgtgaagcactaacactggcaacgggaccaatatcaacgctgtgggaaggcaatccgggtaggttttggaatacgacaattgcagtttcaatggcaaacatattcagaggatcatacttagcaggagccggactactattttcaattatgaagaacaccattaataccaggagaggaactggtaatataggggagacactaggagaaaagtggaaatcaagattaaacgcacttggaaaatccgaatttcaaatatacaagaaatcggggattcaggaagtagatcgaactctcgccaaggagggtataaaacgtggtgaaactgatcatcacgctgtaagtcgaggctctgccaaactccggtggtttgtggaaagaaacatggtcacccccgaaggtaaggtagtggatctaggatgtggaagagggggctggtcatactactgtggaggtttgaaaaatgtccgagaagtcaagggattaaccaaaggaggtccaggccatgaagaacccattccaatgtcgacttatgggtggaacctagttagactgcaatcaggagtcgatgtcttcttcacacccccagaaaagtgtgatactttactatgtgatattggagagtcatcgcccaatccgacaattgaggcaggcaggacactgcgagtactaaatctcgtcgaaaattggctaaataacaacactcaattttgtgtaaaagttctcaatccctatatgccgtcagtcatagagaaaatggagacgctacaaaggaaatacggtggggctctagttagaaaccctttatcaagaaactcgacccatgaaatgtattgggtatcgaatgcaactggaaacatagttagtagcgtcaacatgatcagtaggatgttaatcaaccgatttactatgaaacacaagaaagcgacatatgaacctgacgtagatttaggttcgggaacaagaaacataggaattgaaaatgaaatacccaacctcgatatcatagggaagcgcattgagaaaataaagcaagagcatgaaacatcttggcattacgatcaagaccatccgtacaaaacatgggcttaccatgggtcctacgagaccaaacaaactggctcagccagttcaatggtgaacggtgttgtgaaattgttaacaaaaccttgggacgtggtaccaatggtcacacaaatggcaatgacagacaccacaccatttggacagcaaagagtattcaaagaaaaagtggatactagaacccaagaaccaaaagaaggaacgaaaaagctaatgagaattacagcagagtggttatggaaagagctgggtaagaagaaaacccctcgaatgtgtacaagagaagagtttacacgaaaggttcgcagtaatgcagcacttggcgctatatttacagatgaaaataaatggaaatcagcgagagaagcagtagaagattcaaggttctgggaattagttgatcgtgagagaaatctgcaccttgaaggaaaatgtgaaacatgtgtctataacatgatgggcaaacgggagaagaaacttggagagtttggcaaagcaaaaggtagcagagccatatggtacatgtggttaggagcaaggttcctagagttcgaagcactaggtttccttaatgaagaccattggttcagtagaggtaatagtctaagcggggtagaaggtgaaggccttcataaacttggttatatcttacgagatgtatctaagaaagaaggcggagcaatgtatgcagatgatactgcaggttgggacacacgaatcaccttagaggatttgaaaaacgaggaaatggttactaatcatatgaagggcgaacataagaaactagctgaagcgattttcaagttaacatatcagaataaggtagtacgggtccaaagaccaactccccgaggaacggtaatggacataattagccgaaaagaccagcgaggaagcgggcaagtaggaacctatggtctaaatacattcacgaatatggaagctcaattgattagacaaatggaaggagaagggatttttaaatccatacaacgtcttacagtaacggaagaaattgcagttcaaaactggttggcaagagtaggaagagaaaggttatcacgaatggctatatccggcgacgactgcgtcgtcaaaccgttagacgatagatttgcaagcgcattgacagccttaaatgatatgggtaaggtacgtaaagatatacaacagtgggaaccatctaggggatggaatgattggacacaagttcccttttgtagtcaccatttccatgagttagtgatgaaagatggaagagttttagttgtaccttgtagaaaccaagacgaacttataggacgtgcacgtatatcccaaggcgctgggtggtcattaaaagaaaccgcatgtttaggtaaaagttatgcacaaatgtggaccttaatgtattttcatagaagggatcttagacttgccgcaaatgctatatgtagcgcagttccaagccattgggtaccaacatcacgcactacgtggagcattcatgctaaacacgaatggatgacaacagaagatatgttagccgtatggaacagagtatggattcaagaaaacccatggatggaagacaaaacacctgtggaatcatgggaggaggtcccttacttgggcaaaagggaagatcaatggtgcggatccttaataggactgacctcaagggcgacctgggcgaaaaatatacaaactgctataaatcaagtacgctcattaatcggtaatgaagaatatacagactacatgccgtcaatgaagcgctttcgaaaagaagaagaagaagcaggcgtgctatggtaa

SEQ ID NO: 22582 - RNA, 9876 nt, synthetic construct
  misc_feature 1..9876: note = derived and/or modified CDS sequence (opt6) from DENV-2__EU596489__SS-prME
  source 1..9876: mol_type = other RNA
acggcgggagtcattatcatgctaatacccacagccatggcattccatctaaccacaaggaacggcgaaccccacatgatagtcgggaggcaggagaaaggcaaaagtttactctttaaaacagaagacggcgttaatatgtgtacgcttatggctattgatttaggtgagctttgtgaggacacaataacatataaatgcccattactaaggcaaaatgaaccggaggatatcgattgctggtgtaattctacatcaacctgggtaacttacggtacatgtactacgactggagaacacagacgagaaaagaggtctgtggcattggtaccacacgtaggtatgggactagagacacgaacagaaacttggatgagttccgaaggcgcttggaaacacgttcagaggattgaaacttggatactgcgtcatccaggatttacgactatggcggcaatcttagcttatacaatcgggacgactcactttcaaagggcacttatattcatattattgacagccgtagcaccctctatgacaatgaggtgtattggaattagtaatagagactttgttgaaggggtcagtggaggctcatgggtcgacatagttctagaacatggtagctgtgttactaccatggcgaagaataaacctactcttgactttgaactaataaaaaccgaagcgaagcaaccagcaacactaagaaaatattgtatagaggcgaagctaacaaatacaacaacagaatcaagatgtccaacccaaggagaaccatccctaaatgaagaacaggataaaagattcatatgtaaacacagtatggtcgatcgtgggtggggaaatgggtgtggattatttggtaaaggaggtatagttacatgcgccatgtttacatgcaaaaaaaatatggaaggtaaagttgtacttccagaaaatcttgaatatacaatagtgattacccctcacagcggtgaagaacatgctgtgggaaatgatactggcaaacacggaaaagagataaaaattactcctcaatcatcaatcactgaagctgaattaacgggatatggaacagtaactatggagtgctcccccaggacaggattggatttcaatgaaatggttttgttacaaatggaagacaaggcatggttagtacatagacagtggttccttgacctcccattaccatggttacctggcgctgatacccaaggtagtaattggattcaaaaggaaacactagttacatttaaaaatccacatgccaaaaaacaagatgttgtggtacttggttcccaagagggtgctatgcacacagcacttacaggtgcgacagaaatacaaatgtcttcaggtaatctattatttactggtcatctcaaatgcaggttacgaatggataagctacagctcaaaggcatgtcgtactcaatgtgtacaggaaaattcaaaattgtgaaagaaatagcagaaacccagcatggaacaatagtaatccgggtacaatacgagggtgacggatcgccttgtaagattccatttgaaataatggatcttgaaaaacgtcacgtactaggccgtttaatcacggtcaacccgattgtaactgaaaaagatagtccggtcaacattgaagcggaacctcccttcggcgactcttatataataatcggcgttgaacccggccaattgaaattaaattggtttaaaaagggatcgagtataggacaaatgtttgagacaacaatgaggggagcgaaacgaatggcaatcttaggggatactgcgtgggatttcggatccttaggaggcgtcttcacttccattggtaaggctcttcatcaagtattcggagccatatatggagcggccttcagtggggtgtcatggacaatgaaaatacttattggagtgataataacatggataggaatgaacagccggtcgactagtctctctgtatctttggttttagtcggcatagtcacactatatctaggtgttatggtacaagcagatactgggtgtgtagtgagctggaaaaataaagaattaaagtgtggaagcgggattttcataaccgacaatgtccatacatggactgaacaatacaagttccagccagaatttcctagtaaactcgcatcggctatcaaaaaggcccacgaagagggcatatgtggtataagatccgttacaaggttagaaaacctcatgtggaaacagatcacaccggagttaaaccacattctttcagagaatgaagttaaacttacaatcatgaccggtgatattaaaggtataatgcaagcaggcaagagatcgcttcgacctcagccaacagaattaaaatactcttggaaaacatggggtaaagcaaaaatgctttccacggaaagtcataaccaaacctttttgatcgacggaccggaaactgctgaatgtccaaacacaaatagagcttggaactctcttgaagtagaagactatggtttcggagtatttagcacgaatatttggttaaaactacgggaaaagcaagacgtgttttgtgattcaaaattaatgtcggcggctattaaagacaatcgagcagtacatgcagacatgggatattggatagaatcggcactaaatgatacgtggaagatggaaaaagcatcgttcatagaaattaaaagctgccattggcccaaatcccatacactatggtcgaacggtgttttagaaagtgaaatgatcataccaaaaaactttgccggtcctgtcagccaacataactatagaccagggtaccacactcaaacagccgggccttggcacttgggcaaattagaaatggattttgatttctgtgaggggactacggtcgtagtgaccgaagactgcggaaacagaggaccttcccttaggacaaccactgcttcaggcaagctaataactgaatggtgctgtcgcagctgtacattaccaccgttaaggtatcgaggggaagacgggtgttggtacgggatggaaattagaccgttgaaggagaaagaagagaatctagtaaatagtctcgtaacagccgggcatggacaaatagacaatttcagcttaggcgtattgggaatggctttatttttagaagaaatgctacgcaccagggtaggtactaaacacgccattctcctggtagcggtaagctttgtaaccttaatcacaggaaacatgtcgtttagagacttaggaagagtaatggttatggtaggggctaccatgaccgatgatataggaatgggagtcacatatctagcactccttgcagcgttcaaagttagacctacttttgcggctggattgctcttaagaaaattaactagcaaagaactaatgatggccacaattggaatagctttattaagtcaaagtaccattcccgaaacaatactagaacttacagacgcgctagccctaggcatgatggtcctaaagattgtacggaatatggaaaagtaccagttagcggtaacgattatggcgatcagctgcgtgcctaatgcggtaatattacaaaatgcgtggaaggttagctgtactattttagcggcagtcagtgtgtcaccgctacttcttacatcctcacagcaaaaagcggactggataccactagcattgactattaagggcctaaatcctactgcaatatttttaacaacactatctcgaacttccaaaaaaagaagctggcctcttaacgaggccgtgatggcagtgggaatggtcagtatcctagcgtcaagcttattaaaaaatgatataccaatgacaggacctttagttgcgggaggccttttaactgtatgctatgtcctaacgggaaggtctgcagacctcgaattggaaaaggctgcagacgttaaatgggaagatcaggctgaaatctcagggagtagtcctatcctatcgattacgatttcagaagatggttccatgtctataaagaatgaagaagaagagcacacactaacaatcttaatacgtacaggattactagtaatcagcggtgtatttcctgtgagcataccaattacagccgcagcctggtacttatgggaagttaagaaacaaagggcgggagtcttgtgggatgttccgagcccaccaccagtaggaaaagcagagctcgaagatggggcatataggatcaaacaaagaggtatatttggatactcgcaaatcggtgcaggggtatataaggaaggtacctttcatactatgtggcatgtaacccgtggcgcagtactaatgcatcgaggaaaacgcatagaaccgtcttgggcagatgtcaaaaaggaccttatatcatatgggggtggttggaaactcgagggagaatggaaagaaggggaagaagtacaagtcttagcactagaaccaggcaagaatcctcgggcagtacagactaagccaggattgtttaaaacgaacactggaacgataggagctgttagcttagacttctcaccgggaacttctggctctccaatagtggatcgtaaagggaaagttgtaggattatatggaaacggcgtagtgacaagatcaggagcgtatgtttcagcaattgcgcaaacagagaaaagtatagaagacaatcctgaaatagaagacgacatttttcgtaagaaaagacttacaattatggatctacacccaggtgcaggaaaaactaaacgataccttcctgccattgtacgagaagcaataaagagggggttgcgaacattaattttagcaccgacaagagtagtggctgcggaaatggaagaggcattacgaggattacccatacggtaccaaacgcctgctataagggcagaacacacgggacgagagattgtagatttgatgtgccatgctacattcaccatgagacttttaagccccgtacgggttccaaattataacctaattatcatggatgaagctcactttacggacccagctagcattgctgcgagggggtatatttcaactagagtagaaatgggagaggcagcaggtatatttatgacagccactccgcctggctctagagatccattcccccagagtaatgcaccaattatggatgaagaaagagaaatacccgaacgtagttggaactccgggcacgaatgggtgacagatttcaaaggaaaaacagtatggtttgtaccaagtataaaggcgggaaacgatatagccgcctgtctaagaaaaaacggtaaaaaagtaattcaattaagtcgcaaaacgtttgacagtgaatacgtaaagacaagagcgaatgactgggattttgtggttactacagacatatctgaaatgggcgctaatttcagagcagaaagagtgatagaccctcggcggtgtatgaaaccagtcattctgaccgatggagaggaacgggttattctcgctggcccaatgccagtaacgcattcctcagcagctcagcgacgtggcagaatagggagaaatccgaaaaatgaaaatgatcagtacatttatatgggagaaccgttagagaacgatgaggattgcgcacattggaaagaagcgaaaatgctgttagacaacataaacacaccggaaggtattatcccgagtatgttcgaacctgaaagagaaaaagtggacgcgattgacggtgaatatcgtctaaggggcgaagcacgaaaaacctttgtagacttaatgcggagaggcgatttacctgtatggttagcatacagagtagccgcggaaggaattaattacgcggaccgacgatggtgcttcgatggaataaaaaataatcaaatattggaagaaaatgttgaagtagaaatctggaccaaagagggggagaggaaaaaactaaaaccaaggtggttagacgcgcggatctatagtgacccattagcattgaaagaatttaaggaattcgcagcagggcgaaaatcacttaccttaaatctcattacagaaatgggtagactgccaacgtttatgactcaaaaagcaagagacgctctcgataatctagctgtcttacatactgctgaagttggggggcgagcttataatcatgctttaagcgagttacctgaaaccctagaaactctattgctactaaccttattagcaactgtaactgggggtattttcttattcttaatgtcgggaaaaggtatagggaaaatgactctaggtatgtgctgtataatcactgcatcgattctactgtggtatgctcaaatacaaccgcactggatagctgcatctataatactggaattctttctgattgtattactaattccagaacccgagaaacagagaactccccaagacaatcagttaacgtacgtagtaatagctatcttgactgtcgtagccgccacaatggcgaatgaaatgggtttcctggaaaaaaccaagaaggacctaggcctaggatctattacaactcaagaatccgaatccaatattttagatatagatctacgacctgcatcggcgtggactttatatgcagtggcaacaacgtttgttacaccaatgctcaggcatagcatcgaaaacagcagcgttaacgtttcgttgacagccatcgcaaatcaggcaaccgtattgatgggtttgggacgggggtggccacttagtaagatggatattggagtaccattattagcaataggatgttattcacaggtaaatccaattacactaacagcggcgcttctattactagtagctcactatgcgataataggaccaggacttcaggcaaaagcgacacgagaagcacaaaagagaactgcagcaggaatcatgaaaaacccgacagtggatgggataactgttatagacttagagccaataccatatgatccaaaattcgaaaaacagttaggccaggtaatgttactagtactatgcgtgacgcaagtgcttatgatgagaacaacttgggcactgtgtgaagctctaacattggcaacagggccaatctcgacactatgggaaggtaatccgggcagattctggaataccactatagcggtaagcatggccaacatcttcagaggttcctatctagcaggcgccgggctattgttcagtataatgaaaaacactactaatacaagaaggggaacagggaacataggcgaaacgctaggggaaaaatggaaaagtagactaaacgctttagggaaatccgagttccaaatttacaaaaaatctggtatacaagaagtagatagaacattagcaaaagaaggaataaaaagaggtgagacagaccatcatgcagtttcacgaggtagcgcaaaactccggtggtttgtagaaagaaacatggtgactccagaaggaaaagtagtggatttgggatgtggaaggggcggttggagttattactgtggcggactaaaaaacgttagagaagttaaggggcttactaaaggtggacctgggcatgaagaacctattcctatgagcacatatggttggaatctggtacgattacagtccggtgttgatgtgtttttcacgcctcctgagaaatgcgacacgctgctatgcgacataggagaatcatcaccaaatcctacaatagaggccggacgcacattaagagtattaaatttagtggaaaattggttaaataataacacacagttttgtgtcaaagtgttgaatccttacatgccgtcggttatagaaaaaatggaaactctccaaagaaaatacggtggcgcactagttagaaatccactttcaagaaatagcacccacgaaatgtattgggtatcaaatgccacaggtaatattgtaagctcagtcaatatgataagtcgaatgcttataaatcgctttacaatgaagcataaaaaagcaacatacgaaccagatgtagatctagggtcagggacaagaaacataggaatagagaatgagatcccaaatcttgatattataggtaagcgaatagaaaaaattaaacaagagcacgaaactagctggcactatgatcaagatcatccatacaaaacatgggcataccatggatcatacgagactaaacaaaccggatcggcttcgtcaatggttaacggtgttgttaaattattaactaaaccgtgggatgttgtaccaatggtaactcaaatggccatgactgatacaacacccttcggccaacaaagagtgtttaaagaaaaggtagacacacgcactcaggaaccaaaagagggaactaaaaaacttatgagaatcacggcggaatggttatggaaagaactggggaaaaaaaagacaccaaggatgtgtacgcgagaagagtttactcgcaaggtaagaagtaatgcggcccttggcgctatatttacagatgagaacaaatggaagagtgctcgagaagcagtagaggacagtcgtttctgggaattggtggatagagaacgcaatttacatctagagggaaaatgtgaaacttgtgtgtataatatgatggggaaacgtgaaaaaaaattgggtgaatttggaaaagcaaaaggatctagggcgatatggtatatgtggctaggtgctaggttcttagaattcgaagcactcgggttcctaaacgaggaccactggttcagccgcggaaattcgttaagtggggttgaaggtgaaggattacataaacttgggtatattctacgagacgtcagtaaaaaagaaggaggagcaatgtacgctgatgacacagcgggatgggatacacgaattacattggaagatctgaaaaacgaagaaatggtaacgaaccacatgaagggagaacacaaaaaattagcggaagcaatattcaaattaacatatcagaataaagtagtccgagtacaacgccctacaccgaggggcactgttatggacatcattagtagaaaggaccagagaggatcaggccaagtaggtacatacggtttaaacacttttacaaatatggaggcacaattgataaggcaaatggaaggtgagggcatatttaaaagtatacaacgtctaacagtaacagaggaaatagccgtacaaaactggctcgcccgggtagggcgggaacgacttagtcgcatggcaatcagcggtgatgactgcgttgtcaaaccgttagatgatagattcgcatcagcattaaccgctttaaatgacatgggcaaagttagaaaagacatacagcagtgggaaccgagccgcggttggaacgattggactcaagttccattttgtagccatcactttcacgagctagtaatgaaagacggtcgaatgctcgtagtcccctgcagaaatcaagacgaacttataggcagggcacgaattagtcaaggagccggatggtcacttaaagaaaccgcatgcttaggcaaaagctatgcgcaaatgtggactttaatgtactttcatagaagagatctacggctagcggcaaatgcaatatgtagcgcagttcccagtcattgggtaccaactagtcgcacgacatggtcaatccatgctaaacacgaatggatgaccaccgaggatatgctcgcggtttggaatcgagtgtggattcaagaaaacccatggatggaggacaaaaccccagtggagagctgggaagaagtaccgtacctcggaaaaagagaagatcagtggtgtggtagccttataggactaacttcacgtgcaacctgggcaaaaaatatccaaacagcgattaatcaggttcgatcgttaataggcaacgaagaatataccgattatatgccaagtatgaaaagattccgaaaggaagaagaagaggcaggtgtcttatggtag

SEQ ID NO: 22583 - RNA, 9876 nt, synthetic construct
  misc_feature 1..9876: note = derived and/or modified CDS sequence (opt6) from DENV-2__EU596490__SS-prME
  source 1..9876: mol_type = other RNA
acagcaggagtaattattatgctgataccaaccgttatggcctttcacttaacaaccagaaatggagaaccacatatgattgtaggaagacaagaaaaagggaaatccctattgttcaaaacggaagacggagtcaacatgtgtacgctaatggcaatagacttaggagaattatgtgaagacacaataacatataaatgccctttgctacgtcaaaatgaacctgaagacatagactgttggtgtaacagtacgagtacatgggtcacttacggtacctgcactaccacaggtgaacatagaagggaaaaacggagtgtagctttagtaccacatgtgggaatggggctagaaacacggactgaaacgtggatgagttctgaaggagcatggaaacacgtacaaaggatcgaaacgtggatacttcgacaccctggatttaccataatggcagctatactagcatacactattggaacaacacattttcaacgtgccttaatattcatattactgacagccgtcgcaccaagcatgacgatgcgatgtattggaattagtaacagagactttgtagaaggagtcagtggtggaagctgggttgatatcgtacttgaacacggatcgtgtgtaaccacaatggcgaaaaacaaacctacgttagattttgaattaataaaaacggaagcgaaacaaccagctacgttacgaaaatactgcatagaagcaaaactaacgaataccactacggagtcgaggtgccccactcaaggcgaaccaagcctaaacgaggagcaagacaaacgatttatctgtaaacactccatggttgacagaggctgggggaatggatgcggactatttggcaaaggaggtatagtcacttgcgcgatgttcacatgtaagaaaaatatggaaggcaaagtagttttacccgaaaatctagaatacacaattgtaattacgccacatagcggtgaagaacatgccgtcggcaatgataccggcaaacatgggaaagagatcaaaatcactccgcaatctagtatcacagaagcggaacttaccgggtatggaacagttacaatggaatgttcaccaagaactggtttagacttcaacgaaatggtattgttacaaatggaagataaagcgtggttggtccaccgtcaatggttcctagacctgcccctgccctggctaccaggagcagatacacagggatcgaactggatacaaaaagaaactcttgtgacattcaaaaatccgcatgctaagaaacaagatgttgttgtcctaggaagtcaagagggagccatgcacacagctcttaccggagcaactgaaatacagatgtcaagcggtaatctactatttacaggtcacctaaaatgtcgtctaagaatggataaattacaattgaaaggtatgagctatagtatgtgtacagggaaatttaaaatagtaaaagagatagctgagactcaacatggcaccattgttattagagtacagtatgaaggtgacggtagcccgtgtaaaattccatttgaaataatggatctcgaaaaacgtcacgtattgggaagactcattacagtgaacccaattgtgacagaaaaagatagtcctgtgaacattgaagctgaaccgcccttcggagattcctacatcattataggggtcgaacctggtcaattgaaattaaactggtttaaaaaggggagttccattggacaaatgtttgagacgacgatgagaggtgccaaacggatggccatactaggagatacagcctgggattttggttccttaggtggtgttttcacaagtatcggtaaggcgttacatcaagtatttggtgctatatacggtgcagctttcagtggagtatcatggacgatgaagatccttataggagtaatcataacatggattggaatgaactccaggtcaacgagtcttagtgtaagcctagttctcgtaggagtcgtaaccttgtatctaggggtaatggtacaagcggacacaggctgtgtagtttcgtggaaaaacaaagagctaaagtgtggctcggggatattcataaccgataacgtccacacctggaccgagcaatataaattccaacctgaaagcccctctaaattagctagtgccatccaaaaggcacatgaggaggggatttgcggtatccgtagtgtcacgagattggaaaatttaatgtggaaacaaattacaccagaacttaatcacattctatcggaaaatgaagtgaaattaacaataatgactggggatataaaaggaataatgcaagcagggaaaaggtcactacgaccacaacccactgaattaaaatactcatggaaaacgtgggggaaagcaaagatgctatcgacggaatcgcataatcagactttcttaattgacggtcctgaaacagcggaatgcccgaacaccaatagggcctggaatagtctagaggtcgaggattatgggtttggcgtattcagcacgaatatatggctaaagctgcgtgagaaacaagatgtattttgtgatagtaaattaatgtcagcagcaatcaaagataatagggcagttcatgcagacatgggatactggatcgaaagtgcgctaaatgatacctggaaaatggaaaaggcatcatttatagaaatcaaatcatgccactggcctaaatcgcacaccttatggagtaacggggtgttagaaagtgaaatgataatccccaaaaattttgctggaccggtttctcaacacaactataggcccggctatcacacacagacagctggaccgtggcatcttggtaaacttgagatggactttgatttctgtgaggggactaccgtggtggtgacggaggactgtggcaatagaggaccgtcgttgcgaacaacaactgcgagtggtaagctgattacggaatggtgttgtagatcatgcacacttccaccactgaggtatcgtggagaagacggatgttggtatggaatggaaattcgaccattaaaagagaaagaagaaaatttagttaacagtctggtaactgctggccacggccaaatagacaattttagcttaggtgtgctgggaatggccttgtttctcgaggaaatgttacgaaccagagtagggactaaacacgccatattattggtagccgtttcgtttgtcaccttaatcaccggaaacatgagttttcgagacctagggagagttatggtaatggtaggagcgactatgactgatgacattggcatgggagtcacatatcttgcattactagcagctttcaaagtaagaccaacatttgcagcgggcctattgcttcgtaaactaacaagtaaagaattaatgatggcaactataggaattgctttgctctctcaatcaacgatcccagaaacgatattagaattaaccgacgccttagcattaggaatgatggtactaaaaatagttaggaacatggaaaaatatcagttagcggtaacaataatggctatcagctgcgttccgaatgcagtaattcttcaaaatgcatggaaagtaagttgtacaattttagctgctgtatcagtctctccattattattaacatcaagtcaacagaaggcagattggataccactagctttaacaataaaaggattgaaccctaccgcaatttttctaactactctaagtcggacaagcaagaaaagatcatggccattgaacgaggcagtcatggcagttggcatggtgagtatattagcctcatcgttacttaaaaatgatatcccaatgacgggtcccctagttgctggcggcttattgacagtttgttacgtgctaaccgggagatcagcagatttggagttagaaagagcagcagacgtaaagtgggaggatcaagcagaaataagcggatcatctcccatattgtcgattactatcagtgaagatggatccatgagtatcaaaaatgaagaggaggaacacacactaacaatacttattcgaacagggttattagtaatatcaggggtttttcccgttagcattcctattactgcagctgcttggtatctttgggaagtgaagaaacaaagagcgggagtgctttgggatgtacccagtccgcctccagtgggaaaagctgagcttgaagacggagcttatagaattaaacaacgaggtatctttgggtacagtcagattggggccggtgtatacaaagagggtaccttccacactatgtggcacgtgacgaggggtgcagttttgatgcatcgcgggaaaagaattgaaccatcgtgggccgatgttaagaaagatctgatcagttatggtggaggttggaaattagagggggagtggaaagagggggaggaggtgcaagttttggcattggaacctggcaaaaaccccagggctgtgcagactaagcctggactattcaaaaccaatacgggcacgataggtgcagtatcactggattttagtccaggaacaagcggcagcccgatagtagataggaaaggcaaagtcgttggattatatggtaacggagtggtaactaggagcggagcgtacgtctcagccattgctcaaactgagaaatcaatcgaagataacccagagatagaggatgatatattcaggaagaaaagattgacaataatggatctacacccaggagctggaaaaacgaaacgatatcttccagcaatagtaagggaagccataaaaaggggcctacgaacactcattttggcacccactagagtcgtagccgcagaaatggaagaagcacttcggggtctaccgattaggtatcagacacccgcaatccgggcagaacatacaggaagagaaatagtggatcttatgtgtcacgcaacattcactatgcgattactctcacccgtcagggttccaaattacaatctaataattatggacgaagcacacttcacagatcctgcctctatcgcagcgcgcggctatatttctacgagggtcgaaatgggcgaagctgcaggtattttcatgactgccacaccaccaggatcgcgagacccgtttccacaaagtaatgcacctataatggatgaggagcgagagataccggagcgttcttggaactcaggccatgaatgggtgactgatttcaaagggaaaaccgtttggtttgtaccttcgataaaagccggcaacgatattgctgcatgtctgcggaaaaatggtaagaaagtcatccaactttctagaaaaacctttgatagtgaatatgtaaaaacaagggcgaatgattgggatttcgtagttacaacagacatctcggaaatgggggctaatttcagagcagaacgagtaattgaccctagaagatgcatgaagcctgtgatattgacagatggagaagaaagggtaatcttagcgggtccaatgccggttacccatagttctgcggcccaacgacggggaagaataggacgaaatcctaaaaatgagaacgaccagtatatatatatgggagaaccgctagaaaacgatgaagactgcgcccattggaaagaagcaaaaatgttattagataacattaatacaccagaaggaataattccgtcgatgttcgaaccagaacgagaaaaagtagatgctattgatggcgaataccgattgaggggcgaagctcgaaagacatttgtggatctaatgagaagaggcgatttaccagtatggctagcatatagggttgctgctgagggtataaattatgcagataggcgctggtgcttcgacggaatcaagaataatcaaatactagaggagaatgtagaagtagagatatggacgaaggagggagaaaggaagaaactaaagcccagatggttagatgcaagaatatactcggatccattagcgttaaaggaatttaaggaatttgcggcaggacgaaaatcgttgacacttaatttgatcaccgaaatgggaagacttccgaccttcatgacccaaaaggcacgcgacgcattagacaacttagccgtgttacacacagctgaggtaggagggagggcatataatcacgctctaagtgaactgcctgaaacactagaaactttgctgctattaactctacttgctacagtaacgggtggcatttttctatttcttatgtcaggaaaaggaattggcaaaatgactctaggaatgtgctgtataataactgcatctattctcctttggtatgctcaaattcagccccattggattgcagcttctattatattagaatttttcttaatcgtgctcctaataccagaaccagagaagcagcgtactccacaggataatcaacttacatatgttgtaatagcaatcttaacagtcgtagccgcaactatggcaaatgagatgggctttctcgagaaaaccaagaaagatttagggttaggatcaataacgacgcaagaatcagaatcaaacatactcgacattgacttacggcccgcatcagcatggactttgtatgcagtggccaccacatttgttactccaatgctacgacattctattgaaaatagttcagttaatgtatcactgacagctatcgccaatcaagcaaccgtactgatgggtttaggaagaggatggccactatctaaaatggatgttggcgtaccgttactggcgattgggtgctattctcaggttaaccccataacgctaacagcagcattgctactccttgttgctcactatgcaataattggccctggtctacaagctaaggccacaagggaagcacaaaaacgaacggcagcaggtataatgaaaaatcccacggttgatgggattacagttattgatttagagcctataccatacgacccgaaattcgaaaagcaattaggacaagtaatgttgctcgtattgtgcgtaacgcaagtcctaatgatgagaactacatgggcgctgtgcgaggcattaacattagccaccggcccaatttctacactgtgggaaggaaaccctggaaggttttggaacactacaattgcagtcagtatggccaatattttccgtggatcatatttagccggggcaggacttcttttctctattatgaaaaacacaaccaatacgagacgaggtacaggaaatataggtgagacattaggcgagaagtggaaaagtcgtcttaacgcacttggaaaatcggagttccaaatatataagaaatcagggatacaggaggtagaccgaacattggcgaaagaaggcatcaaacggggtgaaaccgaccatcacgcagtaagtagaggttccgcgaaactgcgatggtttgtagaacgtaacatggtgactccagagggcaaagtagttgatttaggatgcggaagaggaggctggagctattattgcggaggcctcaaaaatgtcagagaagtaaagggattaacaaagggagggcctggacacgaagaaccaataccaatgtcgacttatgggtggaatctcgtacgccttcaaagtggagttgatgtcttctttacaccacccgagaagtgtgatacactactgtgcgatattggagaatcatctcccaaccctacgatagaagcaggacgcacacttagggtactaaatttagttgaaaattggttgaataataatacacagttttgcgtgaaggtattaaatccttatatgccaagcgtcatagagaaaatggaaactctacaaagaaaatatggtggagcattggtcagaaacccattgtctaggaatagcacacatgaaatgtattgggtaagcaatgctacagggaacattgtaagtagcgtcaatatgatatcaaggatgttgatcaataggtttactatgaagcacaagaaagcaacttatgagccagatgtagacctcgggtcgggtactagaaacatcggaatagagaatgaaattccaaacctggatatcataggtaaaagaattgaaaagatcaaacaagagcacgaaacatcttggcactacgatcaggaccacccatataagacgtgggcctaccatgggagttatgaaacgaaacaaacggggagcgccagttcaatggtaaacggtgtagtcaagctactgactaaaccgtgggatgttgttccaatggtcacgcaaatggcaatgacggacactactccatttggtcagcaacgagtattcaaagaaaaggtagacacgaggactcaggaacccaaagaagggacaaagaaactaatgcgtatcactgctgaatggctttggaaagaactgggcaaaaagaaaacccctagaatgtgcacgagagaagaatttactagaaaagttagaagcaacgccgctctaggtgcaatattcacggacgaaaacaaatggaaatcagctcgagaagcagtagaagattctcgattctgggaattggttgacagagaaagaaacctgcatctagaagggaaatgtgaaacctgtgtttataacatgatggggaaacgagagaagaaactaggggagtttggaaaagccaaaggaagcagagcaatttggtatatgtggctgggtgctagattccttgagttcgaagccttggggttccttaatgaagaccactggttcagcagaggaaactccctaagcggagtcgaaggcgaagggttacataaattgggatatatacttagagacgttagtaagaaagagggtggggctatgtatgcagacgatactgcaggatgggacacaaggataacgttagaggatcttaaaaacgaggaaatggtgacaaatcatatgaagggtgaacataagaaattagcagaagctatattcaagttaacctaccagaacaaggttgtccgagtacagcgacctacacctagaggcacagtgatggacataatctccagaaaagatcagagagggtcaggacaggtcggtacctacggattaaatacatttacaaatatggaggcccagttgattaggcagatggaaggtgagggaatatttaaaagcattcagagattgaccgtgaccgaagagatagcagtacaaaactggttagcaagagttggaagggagcgtctaagcaggatggcaattagcggcgacgattgcgtggtaaagcctctcgacgatcgtttcgcatccgccctaactgcgttgaacgacatggggaaagttcgtaaggacatacaacaatgggagcctagtagaggatggaacgactggacgcaagtacctttttgctctcatcatttccacgagctagttatgaaagatggaagagtattagtcgtcccatgtcgcaatcaagacgagcttattggcagagctagaatttcacaaggagcaggttggagtcttaaggaaacggcatgtttaggtaaatcatacgcacaaatgtggacactaatgtatttccaccgtagagaccttcggttagcagctaatgcaatatgcagtgccgtaccgtctcactgggtccctaccagtcgtacaacctggtcgatccatgcgaaacacgaatggatgacaacagaggatatgctagctgtgtggaacagagtttggatccaagaaaatccttggatggaagataagacgcctgtagaatcatgggaggaagtaccctacctggggaaaagagaagatcagtggtgtggcagcttaattgggttaacatctagggctacatgggcaaagaacatacaaaccgctataaaccaagtcagaagtctaataggaaatgaagaatacactgactatatgccatcaatgaagagatttcgtaaagaagaagaagaggctggtgtactatggtaa

SEQ ID NO: 22584 - RNA, 9876 nt, synthetic construct
  misc_feature 1..9876: note = derived and/or modified CDS sequence (opt6) from DENV-2__EU596491__SS-prME
  source 1..9876: mol_type = other RNA
accgcaggggttataattatgttaataccgactgtgatggcatttcacttgactacacgtaacggagaacctcatatgatagttgggagacaagaaaaagggaaatcgcttctctttaaaacagaagatggagttaacatgtgtacgctcatggcaatagatctaggggaactttgtgaggatacgataacatacaaatgtccactactaagacaaaacgagcccgaggatattgattgctggtgtaacagtacatctacgtgggtaacctacggaacatgcactacaactggagaacatcgcagggaaaaacggtctgttgccttagtaccgcacgtaggtatgggtctcgaaacaagaacagaaacttggatgagctcagaaggtgcgtggaaacatgtacaaagaattgaaacctggatcctaaggcatccaggttttactataatggccgccatattagcttacactataggaacgacgcattttcaaagagccttgatattcatcctactaactgccgtagcacctagtatgactatgcgctgcataggaatttccaatcgcgactttgttgagggcgtttcaggaggaagttgggtcgatatagtccttgaacatgggtcctgtgtaaccactatggcgaaaaacaaaccaacattggactttgaactaatcaaaacagaggcaaaacaaccagcaactcttcgaaaatattgcattgaagcgaaattaactaatacaacgactgagagtcgctgtcccacccaaggagaaccaagtctcaatgaagaacaagataaacgcttcatttgcaaacattctatggtagatagaggatggggaaacggatgtggactatttggaaaaggcggaatagtcacatgcgcaatgtttacatgcaagaaaaacatggagggcaaaatagtgcaacctgagaatttagaatacacaatagtgattactccacatagtggcgaagaacatgcagttggaaacgacacaggaaaacatggtaaggaaattaaaattacaccacaaagcagcactacagaagccgaattaactggttatgggactgtaacaatggagtgcagcccaagaacggggctagattttaatgagatggttctcctacaaatggaagataaggcctggttagtgcaccgtcaatggtttctagatttgccattgccatggttgccaggagccgacacccaaggtagtaattggatacaaaaagaaaccttagttacgttcaagaatccacatgccaagaaacaagacgtagtcgtactgggaagtcaagagggggcaatgcatacggcgcttaccggggccactgagattcaaatgtcctctggtaacctcctatttactggacatctaaaatgtcgtttaagaatggacaagctacaactaaaaggtatgtcatacagtatgtgcaccggtaaatttaaaatagtaaaagaaatagctgagacacaacacgggacaatagtaataagagtacaatatgaaggagatggatccccctgcaagataccgtttgaaattacggacctggaaaagcgtcatgtcctcggacggttaattacagtcaaccccattgttacagagaaggatgcaccagtaaatatagaagcagaaccacccttcggagatagttacattatcgttggcgtcgaacctgggcaactaaagctgaactggtttaagaaagggtcttcgatcggacaaatgttcgagacaacgatgcgaggagcaaaacgtatggccatattgggcgacaccgcgtgggattttggatctctaggaggggtcttcacttcaatagggaaagcacttcatcaggtattcggtgctatttatggcgcagccttctctggagtgtcatggactatgaaaatacttattggtgttattattacctggatagggatgaactccaggagcacttctctttcagtatcactggtcctagttggggttgtaacactctatttaggagctgtagtacaagctgacagcggctgtgtcgtgtcctggaaaaacaaagaattaaaatgcgggtcgggaatattcataacggacaatgtccacacatggacagaacaatataaattccaacctgagtcaccttcgaaactcgcttcagctatacaaaaagctcatgaagaaggaatatgcgggataagatctgttacaaggttagaaaaccttatgtggaagcaaattacaccggagttgaaccatatactaagtgagaatgaagttaagctaaccataatgacaggtgatatcaaaggtattatgcaggctggaaagagaagcctccggcctcagccgacagagctcaagtacagctggaagacatggggaaaagccaaaatgttatctacagagtcacacaaccagactttcttgatcgacgggccagaaacggctgaatgcccaaacactaacagagcttggaatagtttagaggtcgaagactacggatttggagtcttcacaacgaatatatggctaaaacttagagaaaaacaggatgtcttttgcgactccaaattaatgtcagcggcaatcaaagataatcgagcagttcacgctgacatgggctattggatagagagcgcactcaatgatacttggaagatggaaaaagccagctttatagaagtcaaatcctgtcactggccaaaaagtcacactttatggagtaatggagtgctagaatccgagatgattataccgaaaaacttcgctggacctgtaagtcaacataactatagaccaggctaccatacacaaacggctggaccatggcatcttggcaaattagaaatggactttgatttttgtgaaggaaccacagttgttgttaccgaagattgtggaaaccgaggtccgtcacttaggactaccacagctagtggtaaactaattacagaatggtgctgtcgatcgtgtacacttccaccgcttagatatagaggtgaggacggctgttggtatggcatggaaataaggccattaaaagaaaaagaggaaaatctcgttaacagcttagtcacggctggccatggtcagattgataacttttcactaggggtcttaggaatggcattattcctcgaggaaatgctaaggactcgggttggcactaaacacgctaccctcctagtagccctctcttttgtaacactaataacaggcaatatgtccttcagagacttagggcgagtaatggtaatggtaggtgcaactatgactgatgacataggcatgggagtaacttacctcgctttattggcggcttttaaagttcggccaacttttgcagcaggcttattactacgcaaattaacaagtaaagaactaatgatggcaacaataggtattgcgttactatctcaatccacattacccgaaacgatacttgaactgacagatgcgctcgcattggggatgatggttcttaagattgtccgaaacatggaaaaatatcaactcgcagtaactataatggctatatcgtgcgtaccaaacgcagtaatcttgcaaaacgcctggaaagtatcatgtacaattctagcggcagtctcggtatcgccattattattaacatcatcacaacagaaagctgactggatccctctggcacttacaataaaagggctgaatccaacagccatattccttaccacattatcccgtacgagtaagaaacgttcatggcctctgaacgaagcaataatggcagtagggatggtgagcattttggcttcttcattgctgaaaaacgatatcccaatgactggtcctcttgttgcaggagggcttctcactgtatgttatgtgttaaccggtagatcagcagacttggaactagagcgagcagctgatgtaaaatgggaggaccaagcggaaatatccgggtcttctcccatcttatctattactatatctgaagacggctcaatgagtattaaaaacgaagaggaagaacaaacacttacaatactgattcgaacagggctattagttatcagcggagtgtttcctgtttcaattcccataacagcagctgcgtggtatctatgggaagtgaagaaacaaagggccggtgttctatgggacgtcccttcaccacctcccgtaggtaaagcggaacttgaagacggtgcttacagaataaaacaaagaggtatccttggatactcacaaataggagctggtgtttataaggaaggaacatttcacacaatgtggcacgtaacacgcggtgctgtacttatgcatcgaggaaaaagaatagagccaagctgggcggatgttaagaaagatttgatctcatatggaggaggatggaaattagagggcgaatggaaagagggagaagaggttcaggtactagcattggaaccagggaaaaatccgagggctgtccaaacaaaaccaggtattttcaaaacaaatacgggtacaataggagccgtatcgctcgatttcagtccaggaacctcgggaagcccaatagtcgatagaaaggggaaagtcgttggcctgtacgggaatggagtagtaacaagatcaggtgcgtatgtttcagccattgctcaaacagagaaaagtattgaggataacccagaaatcgaagacgacatttttcgtaaaaagaggctaaccatcatggacttacatccaggtgctggaaaaaccaaaagatatcttccagctatcgtacgggaagcaataaaaagaggactcagaacattaattctagcaccaacaagagtagtggcagcggaaatggaagaggctttaagagggcttcctattcgatatcaaacacccgccattcgtgcggagcataccggtcgcgaaattgtagatcttatgtgccatgcaacatttacgatgagacttctcagcccagtaagagtcccaaactacaatcttatcattatggacgaagcacatttcacagaccccgcctcaatagctgccaggggatacattagtacaagggtggagatgggagaagctgcaggtattttcatgacagcgacacccccgggcagtagagatccatttccacaatcaaatgcacccattatcgacgaagaaagagaaattccggaacgttcatggaatagtggacatgaatgggttacagatttcaaggggaaaaccgtttggttcgtaccttctataaaagcaggaaacgacatagcagcgtgtctaaggaaaaatggcaagaaagtaatacaacttagtcggaaaacctttgatagtgagtacgtaaaaactagagcgaatgattgggacttcgtcgtaaccactgatatctcggagatgggagcaaatttcaaagcggaaagagttatagatccgcgacgatgtatgaaaccggttatattaaccgatggtgaagaaagagttatattggcaggaccaatgcctgtaacgcattcgtcagcagcccaacgaagaggaagaatagggcgaaaccccaaaaatgaaaatgaccaatacatttatatgggtgaacctttagaaaatgatgaagattgcgcgcactggaaagaagcgaaaatgttactggataacataaacacacccgaggggataatcccttctatgtttgaacctgaacgagaaaaggtggatgcagtagatggagagtatcgcttaagaggagaagcaaggaagacgttcgttgatctgatgcgaagaggagacctcccagtctggctcgcttacaaagttgccgcagagggaatcaactatgcggatcgcaaatggtgttttgatggcatcaaaaataatcaaatcctagaagagaatgtagaagtggaaatatggacaaaagaaggggaaaggaaaaagctaaaaccaagatggctggacgcgcgaatttattcggatcctttagcattaaaggagtttaaagaatttgctgcgggtagaaaatcgttaactttaaatttaataactgagatggggagattacccacatttatgactcaaaaagcgcggaacgcactagataacctagcagttctacacactgcagaagtaggaggcagagctcataaccatgcactgtcagaactaccagaaaccttagaaacgctgttactattgaccctgctagctactgtaaccggagggatatttcttttcttaatgagtggtaaaggaataggaaaaatgactctaggaatgtgctgcatcataacagcatccatattattatggtatgcccagattcaacctcattggatagcagcaagcattattttagagttctttttaattgtattattgattcccgaaccagagaagcaacgaacaccacaagataatcagctaacatacgttgtaatagctattttaacagtagttgccgcaaccatggcaaatgaaatggggtttttggaaaagaccaagaaagacttaggttttggttctatcacgacacaagaatctgaatcaaatatcctagacattgatttacgtccagcaagtgcgtggaccctatatgctgttgcaactactttcgtaacaccaatgttaagacatagtatcgaaaatagttcagttaatgtcagcttaacggcgatcgcaaatcaggccaccgttctaatgggattaggcaagggatggccattatcaaagatggatattggcgttcctctcttggccataggttgttattcacaagttaatcctataacgctgacagcggcactactgctacttgtagcacattacgcaatcataggtccgggactccaagcaaaagctacaagagaagcccaaaagagggctgcggctggaataatgaaaaaccccacagtggatggaattactgttatagatttggaacccataccctacgatccaaaatttgaaaaacaacttggacaagttatgttgctgattctatgtgtaactcaagtcctaatgatgagaacaacatgggctctttgtgaggcgcttactttggcgacaggccctataagtactttatgggaaggaaatccaggacgattctggaatacaacgattgccgtatcaatggctaatatttttaggggctcgtacctcgcaggggctggtttactattcagtattatgaaaaacacaacgaatactagaagaggaacagggaatgtcggtgagacactaggagaaaaatggaagagtaggttaaatgcattgggaaagtctgagtttcaaatatataaaaagtcaggaatacaagaagtagaccgaactttagccaaagaagggataaaaagaggtgaaacggatcaccacgcggtaagtagaggttctgcgaaactaaggtggtttgtagaaaggaacatggttaccccagagggtaaagttgtcgacttaggatgtggtagagggggatggtcatattactgcggaggattgaagaacgtacgagaagtgaaaggattgactaaaggaggacccggccatgaagaaccaataccaatgtcaacctatggttggaaccttgtcagactacaaagtggagtggatgtattctttaccccacctgaaaagtgcgacacactactgtgcgatatcggggaaagtagccccaaccctactatcgaggcagggaggacattgagggtactaaaccttgtagagaactggctgaataacaatacccaattttgtatcaaagtccttaatccgtacatgccatccgtaatagagaaaatggagaccttgcaacgcaaatacggaggggctcttgtaagaaatcccctgagcaggaactcaacacacgaaatgtattgggtatcaaatgcaacgggaaacatagtaagtagtgtcaatatgatctctcgaatgctcattaatagatttacaatgaagcataagaaagcaacgtacgaaccggacgtagacctgggcagcggcactaggaatattggtatagaatcagagataccaaacttagacataattggaaaaaggatcgagaaaatcaaacaagaacatgaaacatcatggcattacgatcaagaccatccatacaaaacatgggcatatcacggatcttacgagaccaaacaaacaggctcagcctcaagcatggttaatggagtagtacgattattaacaaaaccgtgggacgtagtaccaatggtaacgcagatggcaatgactgatacaacaccctttggtcaacaaagagtattcaaagaaaaggtcgatactaggacacaagaacccaaggaaggtaccaaaaagttaatgaaaattactgcggaatggttgtggaaagagttgggcaaaaagaaaacccccagaatgtgcacccgtgaagaatttacaaggaaagttcgttctaatgctgctcttggggctatttttacagatgaaaataaatggaaatcagcaagagaagcagttgaagatggtcgattttgggaattagttgatagagaaagaaatctccatttagagggtaaatgtgaaacatgtgtatacaatatgatgggaaaaagagagaagaaacttggagaatttggaaaagcaaaaggatctcgggccatttggtatatgtggctaggagcaagatttctagaatttgaagcactcggctttttgaatgaagatcattggttttcaaggggcaattcattgtccggagttgaaggagaaggtttacaccgactaggatacatcttgagagaagtgggcaagaaagaaggaggggcaatgtatgccgacgatacggctggttgggatacaaggattactttagaggatctcaaaaatgaggagatggtaacgaatcatatgaagggagaacacaagaaacttgcggaagctatatttaagctaacctaccaaaataaggtcgtaagagtacagagaccaacgccccgagggactgtaatggatataatcagccgaaaagaccaacggggtagcggacaagttggtacatacggactaaatacttttactaacatggaagcacagcttatacggcaaatggaaggagaagggattttcaagagcatacaacatctaacagctactgaggaaattgcagtacagaattggctggcacgagtgggaagggagaggctatcacgcatggcaatcagtggcgacgactgtgtagtgaaaccgattgatgacagattcgcctcagcattgacggcacttaatgatatgggaaaagttaggaaagatattcaacaatgggaaccatccagaggatggaatgattggacacaggtaccattttgcagtcaccactttcatgagctagtaatgaaagacgggcgagttttagttgtaccatgtagaaatcaagacgaactgatcggtagggcccgcatctcccaaggggcaggatggagcctcaaggaaacagcctgcttaggtaaaagctacgcgcaaatgtggactcttatgtattttcacagacgtgaccttcgattagccgctaatgcgatatgttcggccgtgccatcccattgggtaccaacttcaagaaccacttggagtattcacgcaaaacacgaatggatgacgacggaagatatgctagctgtttggaatagggtgtggatacaagaaaacccatggatggaagacaaaacacccgtggaatcttgggaggaagtgccatacttaggaaaaagggaagaccagtggtgtggatctttaatcggactcacaagccgagccacttgggccaaaaacattcagactgccattaatcaagtacgcagcttaatcggtaacgaagaatacacggattacatgccaagtatgaagagatttaggagagaggaagaagaagcgggggtattatggtaa

SEQ ID NO: 22585 - RNA, 9876 nt, synthetic construct
  misc_feature 1..9876: note = derived and/or modified CDS sequence (opt6) from DENV-2__EU677141__SS-prME
  source 1..9876: mol_type = other RNA
accgcaggggtaataattatgctcattcccacagctatggcatttcacttaacaacaaggaatggggaaccacatatgattgtaggtcgccaagaaaaaggaaaatctttgcttttcaaaacagaagatggagtgaatatgtgtacattgatggcaattgatctaggagaattatgcgaagacacaataacatacaaatgtccattgttgcgacaaaatgaaccagaagatatagattgctggtgcaactcaacttcgacttgggtcacttatgggacctgtacaactacaggtgaacaccgaagagaaaaacgaagcgtagcacttgttccgcatgttggaatgggactagaaacacgtacagaaacgtggatgagcagtgaaggagcatggaaacatgttcaacgaatagaaacttggatactacgacaccctggatttactataatggcagcaatactcgcttataccatcggcactactcatttccaacgcgcgcttatctttatcctcttaaccgctgttgctccgtcaatgacaatgagatgtattggaatatcgaatagggacttcgtagaaggagtcagtgggggatcttgggtagacatcgtgttagaacacggatcatgcgtcacaacaatggctaaaaataaacccacgctagattttgaactcatcaaaaccgaagcaaaacaacctgccaccttaaggaaatactgtatagaagcaaaacttacaaatacaacaaccgaatcccgttgccccacacaaggtgaaccgagtttaaacgaggaacaagataaaaggtttatttgtaaacactcaatggtagatcggggttggggtaatggatgtggtttattcggtaaaggaggaatagtcacttgtgcgatgttcacgtgcaagaaaaatatggaaggaaaagtagtattgcctgagaacctggagtacaccatagtcataaccccgcattcaggtgaagaacatgcggtgggaaacgatacggggaaacatggtaaagagataaaaatcactcctcaaagttcaataacggaagcagagttaacagggtatggtaccgtcacaatggagtgttcaccaaggaccgggttagattttaacgaaatggttttactgcaaatggaagacaaggcttggttagtacacagacaatggtttctggatttaccgttaccatggctcccaggagccgatacgcaaggaagtaactggatacaaaaagaaacattagttacatttaaaaatccacacgcaaagaaacaagacgtagtggtactaggaagtcaggaaggagccatgcatacagcccttacgggcgcgacagagattcaaatgagctccggaaacttgctattcaccggtcatcttaaatgtcgtctcagaatggacaaactgcaactcaaagggatgagttactcaatgtgtactggtaaatttaaaatagtcaaagaaatagctgagacacaacatggaactattgtaattagggtccagtacgaaggagatggttcgccatgtaaaattccattcgaaattatggacttagaaaaacgttacgtattgggtcgtttaatcacagtaaaccccattgtaaccggtaaggattctccggtaaacattgaagccgaaccgccgttcggcgattcctatataataattggtgtcgaacctggccagttgaaactaaattggttcaaaaagggttcttctattggacaaatgttcgagacaacaatgagaggggcgaaacgcatggcaatactgggcgatacagcatgggatttcggatcactaggaggggtattcacaagtatcgggaaagcacttcatcaagtattcggtgcaatttatggagcagctttcagtggagtctcatggacgatgaaaatcctaattggagtaattattacatggatagggatgaacagcaggagcaccagcttgtcagtcagcctagtccttgtaggagtagtgacactttacttgggggtaatggtgcaggcagatagtggatgtgtggtatcctggaagaacaaagaattaaaatgtggaagtggaatattcataacggataacgtacatacatggaccgaacaatacaagtttcagcccgaatccccatcaaaattagcatcggctattcaaaaggcacacgaggaaggaatatgtggcatacggtcggttactagactcgaaaatctcatgtggaaacaaataacaccagaactaaaccatatactgtccgaaaacgaggtcaaactaacaataatgacaggagacattaagggtataatgcaggcgggtaaaagatctttgcgtcctcaaccaacagaattaaaatattcatggaaaacatggggtaaagcgaaaatgttgtctacagagtcacacaatcaaacctttctaatagacggtccagagacagccgaatgcccaaacactaatcgcgcctggaatagtttagaagttgaagactacggatttggggtgtttagtacaaatatttggttaaaactgcgcgagaaacaagatgtattctgtgattcaaaattaatgtcagcagcgataaaagacaacagggcggtacacgcggacatgggttactggattgagagtgctttaaacgacacatggaagatggaaaaagcgagctttatagaagtcaaatcctgtcactggcccaaaagtcacaccctatggtccaacggagtattagaaagcgaaatgatcatccctaaaaattttgcaggaccggtctctcagcataattatcgtcctggttatcacacacaaactgcagggccctggcatctaggtaaattagagatggacttcgacttctgtgaaggcacaacagtagtcgtaactgaagactgtggaaatagagggccgtctctccggacaacgaccgcatcgggtaaacttataacggaatggtgttgtagatcttgtacacttcctccactacgctatcgtggagaagatggatgctggtacgggatggaaattagaccactgaaagagaaggaagagaatctcgtaaatagtttggtaacggcaggtcatgggcagatcgacaatttctccctaggtgttctgggcatggctctatttctagaggaaatgttgcgaacaagagttggaacaaaacatgcaatattattagtggccgtaagttttgtaacattaataacagggaacatgtcatttcgcgatctagggagagttatggttatggttggcgcaactatgacagacgacatagggatgggtgtcacttacttagcactcttagcagcgttcaaagtaagacctacatttgcagcggggttactattacggaaactaaccagtaaagagcttatgatggccacaataggaatagccctacttagtcaatcgacaattcccgaaactatactggaattgactgatgcactcgcactaggtatgatggttcttaaaattgtcagaaacatggaaaaatatcaattggccgtgacaattatggccattttatgtgttccaaacgcagttatactgcaaaacgcctggaaagtttcctgcacaatcttagctgcggtaagtgtaagtcctctacttctaacatctagtcaacaaaaggccgattggataccattagcccttacgattaagggattaaaccccacggcaatatttttgacgacactgtctagaacatccaagaaaagatcttggccactcaatgaggctgtcatggccgttgggatggttagtatcttagcaagctcattactcaaaaatgacatacctatgacgggtccactggttgccggaggtctactcacagtgtgttatgtactaacaggccgatccgcggatctagaactcgaaagagctgcagacgtcaaatgggaagatcaagccgaaattagcgggagcagtcctatcttaagcataactatatcagaagatgggtccatgtcgatcaaaaatgaggaagaagaacaaactttaacaatattaatacgaaccgggctacttgtgatttccggtgtttttcctgtatcgataccgataactgctgcagcgtggtatttgtgggaggtgaagaaacagagggctggtgttttatgggacgttcccagtccccctccagtaggtaaagcagaattagaagatggagcatatagaattaaacaaagaggcatttttggatattcccaaatcggagccggtgtgtataaagagggtacttttcatacaatgtggcacgttacgcgaggggcagtactaatgcatcgaggtaagcgtattgagccttcatgggcggatgtaaagaaagacttaataagttacggcggcggatggaaacttgagggagaatggaaagaaggagaagaggttcaggtcctggctttagaaccaggcaaaaatccaagagccgtgcaaactaaaccaggactttttaaaacaaacacaggaactattggcgccgtaagccttgacttttccccgggcacaagcggctcaccgatagtagatagaaaaggaaaagtagtgggtctatacgggaatggagtggtaacgcggagtggagcgtacgtgagtgctatagcacaaactgaaaaatcaatagaagataacccagaaatagaagatgacatctttaggaagaaacggttaacaatcatggatctgcaccctggagcaggcaaaaccaaaagatacctgcccgcaatagtacgagaagcaataaaacgcggcttaaggacacttatcttagcccccaccagagtagtagcagctgaaatggaggaagcgctgcggggcctacctatacgttaccagacaccggctatccgtgctgaacacactggaagagagatagttgatttaatgtgccatgccacattcacaatgagactactttctcccgtgcgcgtacccaattacaatcttataatcatggatgaagcacattttacagatccagccagtatagcagctagaggatatatatcgacccgtgttgaaatgggggaagctgcgggaatttttatgacagcaacaccacccggcagtcgcgatccctttcctcagtcaaatgcacctataatggacgaagaaagagaaataccagaacggtcctggaactctgggcacgagtgggtaacggactttaaaggcaaaaccgtatggtttgtgccatcaatcaaggctggtaatgacattgcagcatgcttaaggaaaaatggcaaaaaggttatccaattgagtagaaaaacttttgatagtgaatatgtaaaaactcgtgctaatgattgggacttcgtcgttacaacagatatttcagaaatgggggcaaacttccgtgccgaacgcgttattgatccacgacgttgcatgaagccagtgattcttacagacggcgaggaaagggtcatactggccggacctatgccagtaacacattctagcgcagcgcaacgacgaggtagaatagggcggaaccctaaaaatgaaaacgatcagtatatttatatgggtgagccactagagaacgatgaggactgcgcgcattggaaagaagccaagatgctattagacaacataaacactccggaaggtattattccatctatgttcgagcccgaaagagaaaaagtggacgcgatcgatggtgaataccgtttaagaggtgaagcacgtaaaacattcgtcgacttaatgcgccggggagatttacctgtttggctcgcctatagggtagctgcagaaggcattaattatgcagatagaagatggtgcttcgatggaattaaaaataatcaaattctcgaagagaacgtagaagttgagatatggacaaaggaaggcgaacgaaagaaactaaaaccgaggtggttagatgctcgtatatactcagatccgctagcgcttaaggaatttaaagaatttgcagcaggaaggaaaagtcttaccctaaatttaattacagaaatggggcgattgccaacatttatgacccagaaagccagggacgcactagataacctagcagtgttacatacagcagaagtgggaggacgcgcatataatcacgcactctcggaattacctgaaactttagagacgctgctcttgctaacattgctcgcgactgtcacgggcggaatatttctttttctaatgagcgggaaggggataggaaagatgacgttgggaatgtgttgcattataaccgcaagcattcttctctggtatgcacagatacaaccgcattggatagcagcttccattatattagagttcttccttattgtattactaattccggaacctgaaaaacaaagaacaccccaagataatcaactaacatatgtagtcattgcaatactcactgtcgtagccgcaaccatggctaatgagatgggcttccttgagaaaaccaagaaagacttaggactcggtagtattattacgcaagagtcagagagcaatattctggacatagacctgaggcctgcgtcggcttggacgttatatgcagtagcaactacttttgtcacaccgatgttgagacactcaatagaaaattccagcgtaaatgttagcttaacagctatcgctaaccaggcgacagtgctgatgggattaggtcgtggctggcctctcagcaaaatggacataggggttccattattggccataggttgctattctcaggtaaatccgatcaccttgaccgctgctctattattattagttgcgcattatgctattataggtccagggctacaagccaaagcgacccgggaagcccagaaaagagctgcagcaggcatcatgaaaaatccaactgttgatggtattacggttatcgatctagaacctattccttacgaccccaaatttgagaaacaattgggccaagtaatgctcttagtgctatgtgtgacccaagttctaatgatgagaactacatgggccctgtgcgaagccctgacattggcaaccggccccatcagtactttgtgggaaggaaatcctggacgattctggaatactaccatagcggtttcgatggctaatatcttcaggggaagttacttagccggagcaggattactcttctccattatgaagaatacaaccaatacaagaaggggcacagggaatataggcgaaacattaggggagaaatggaaaagtaggctaaatgcattaggaaaaagtgagttccaaatttataagaaaagtggaatccaggaggtagatagaaccttagcaaaagaaggaataaaaaggggagaaactgatcatcatgcagttagtagaggaagcgcaaaactaagatggtttgttgaacgaaacatggtaacaccagagggaaaagtagtagatttgggctgtggcagaggtggatggtcatattattgcggagggctgaaaaacgttcgtgaagttaagggtctaacaaaaggaggaccagggcacgaagaacccattcccatgtcaacgtatggatggaatttggtaagactacaatcaggggtcgacgtattctttacgcctccagaaaaatgcgatacattgttatgtgacatcggggaaagcagcccaaatccaaccatcgaggcaggaaggactttaagagtcttaaacttagtcgaaaactggctaaataataatacacagttctgtatcaaggtcctgaatccgtatatgccatcagttatagagaaaatggaaacgcttcaacgtaaatacggtggtgcccttgtaagaaatccattatcccgaaattccactcatgaaatgtattgggtcagtaatgctacaggtaacatagtatcatccgtaaatatgataagtagaatgttaatcaatcgatttacaatgaagcataaaaaggccacctatgaaccagatgtggaccttggaagtggaacacgaaatataggtattgaaaacgaaatacccaatttagatatcattgggaaacggattgaaaagattaaacaagagcatgagacaagctggcattatgaccaggatcatccatacaaaacctgggcttatcatggctcttatgaaacaaaacaaactgggtccgccagtagcatggtaaatggagttgtgagattactaacaaaaccttgggacgtagttccaatggtcacacaaatggcgatgacagatacaaccccatttggccaacaaagggtgtttaaggaaaaagtcgatacccgtacacaagagccaaaagagggaactaagaaactaatgaggataacggcagaatggctatggaaagaactaggcaagaagaaaacccctaggatgtgtactagagaagagttcacaaggaaagtgagatccaatgcggcattaggagctatatttactgatgagaacaaatggaaaagcgcaagagaagcagtcgaagacagtagattttgggaacttgtggacagggaacggaatttacatctagagggaaaatgcgaaacatgtgtttataacatgatgggtaaaagagagaagaaattgggagagtttgggaaggcaaaaggcagtagagcaatctggtatatgtggctaggagcaagatttctggaatttgaggctctaggtttcttgaatgaagatcattggttctcaaggggaaattcactaagcggcgttgaaggagaaggacttcataagttgggttacatattaagagacgttagtaagaaagaaggcggtgcaatgtatgccgacgataccgctggatgggacactcgcattacattagaagacttaaagaatgaagaaatggtaacgaaccatatgaaaggtgagcataagaagttagccgaagctatattcaaattaacatatcagaataaagtagtaagggtacaacgaccaacaccaaggggcactgttatggacatcattagcagaaaagatcagcggggctccggacaagtaggaacttatgggctgaataccttcactaacatggaggcccaactcatcagacagatggaaggtgagggcatctttaagagtatacaacacttaacagtcaccgaagaaatagctgtacagaattggttagcacgagtgggtcgagagcgtttaagccgaatggccatctctggggatgactgtgtagtcaagcccttagacgaccgatttgccagtgcactcacagcgttaaatgacatgggaaaagtgagaaaggacatacagcaatgggaaccttcccgaggatggaacgattggacgcaagttcctttttgttcacatcactttcatgagttggtgatgaaagatggcagagtcctagtagtaccgtgtagaaatcaagacgagttaataggtagggctcgtatttctcaaggagctggctggtcactcaaagagacagcatgcttaggaaaaagctatgcccaaatgtggactttaatgtattttcatagaagggatttaagactagcggcaaacgctatttgcagtgctgtaccatctcattgggtacctacgtctcgaacaacttggtcaatacatgccaaacacgaatggatgacaaccgaagatatgttagcagtttggaaccgagtctggatacaagaaaacccgtggatggaagacaaaacaccggttgaatcatgggaggaagtcccttatctaggcaagcgagaagatcaatggtgtggatcattaatcggtctaacctctagagcaacttgggctaaaaacatacaaactgcaatcaaccaagtaaggagcttaattgggaacgaggaatatacagattacatgccgagcatgaagcgatttaggaaagaagaagaagaagcaggagttctatggtaa

SEQ ID NO: 22586 - RNA, 9876 nt, synthetic construct
  misc_feature 1..9876: note = derived and/or modified CDS sequence (opt6) from DENV-2__EU677144__SS-prME
  source 1..9876: mol_type = other RNA
acagcaggaatgataattatgttaataccaactgcaatggcgtttcatttaacaacccgcaacggcgaaccacatatgatagtcgggagacaagaaaaagggaaatctctgttgtttaaaaccgaagatggggtaaatatgtgtacattgatggcaattgatctaggcgaattgtgcgaagatacaataacttacaaatgcccgctgctaagacaaaacgaaccagaggacatagattgttggtgtaacagcacgagtacctgggtgacttatgggacttgtacaacgacaggcgaacacagacgcgagaaaagaagtgttgccctggtaccacacgttggaatgggtctagagaccagaaccgagacctggatgtctagcgagggggcgtggaaacatgtgcaaagaatagaaacatggattctccgacatccaggctttactataatggctgctattctagcatacacgataggcacgacacactttcaaagagctttaattttcatactattaacagcagttgcaccttctatgactatgagatgcataggtatttctaatcgggactttgttgagggagtctcaggtggatcctgggtagacatagttttagaacatggatcttgcgttaccactatggcgaaaaacaaaccaaccttggattttgaattgataaaaacagaggcaaaacagcctgcaaccttgagaaaatattgcatagaggctaaattaacgaatactacaactgaatcgcgatgcccaactcaaggcgaaccaagtttaaatgaggagcaggataaacgattcatttgtaaacattctatggttgaccgaggatggggtaatggttgcggactgtttggaaaaggtggtatcgttacttgtgctatgtttacctgcaagaaaaacatggagggaaaagttgtattgcccgagaacctggaatataccattgttataactccacactcaggggaagaacacgcggttggaaacgacacgggtaaacatggaaaagaaattaaaattactccacagtccagtatcacagaggcagaacttacaggatatggaaccgtcacgatggaatgctcaccaagaacaggattagactttaacgagatggtactcttacaaatggaggataaagcctggttggtacatagacaatggtttcttgatttgcctttaccatggctaccgggggctgacacgcaaggactaaattggatccaaaaagagactctagtaacatttaaaaacccacacgcgaagaaacaagatgtagtagttttaggttcgcaagagggcgctatgcatacagctttaacaggagcaacagaaattcaaatgtcttcaggaaatttacttttcacaggacatttaaaatgtagactccgaatggataaattgcagcttaaaggaatgagttacagtatgtgtacgggaaaatttaaaatagtcaaagagatagcggaaacacaacacggaacaatcgtgatacgagtacagtatgaaggggacggatccccttgcaaaataccatttgagattatggatttagaaaaacggtacgttcttggtagacttataacagttaaccctatagtcaccgaaaaagactcaccagtaaatattgaagctgaaccgccctttggtgacagctatattatcattggcgtagaaccggggcaattaaaattaaactggtttaagaaaggcagttcgatagggcagatgttcgaaacaacaatgcgcggagcaaaaagaatggctatactcggagatacagcatgggattttggatctctaggaggggtttttacatccataggaaaggctttacatcaagttttcggtgccatatacggcgccgcattttcgggtgtatcctggacgatgaagatcttaataggagttataataacatggataggaatgaactcccgttcaacatctctaagcgttagtctcgttctagtaggagtagtaaccctttacctcggagtaatggtgcaagcggactcaggatgcgtagtctcctggaaaaacaaagaactaaaatgcggaagcggcattttcatcacggacaatgtacatacttggactgaacaatacaagtttcaaccagaatccccgtctaagctggcatcggctattcaaaaagcacacgaagaaggaatatgtggcatacgctcagtaactcgcctcgaaaatctaatgtggaaacaaatcacaccagaactgaatcatattttgagcgaaaacgaagttaaattgactataatgacgggagatataaagggaataatgcaagccggcaaaaggagcttaagaccccaacctacagaattaaagtatagttggaaaacttggggaaaagccaaaatgctatcgactgagtcgcacaatcaaacattccttattgacggaccggagacagcagaatgtccaaacacgaaccgggcttggaactctctagaagttgaagattacggatttggtgtattttcaacgaatatatggttaaagttgagagaaaagcaagacgtattttgcgacagtaagttgatgagtgcagccataaaagacaatcgggcagtgcacgcagatatgggatattggatagagtctgcacttaatgacacctggaaaatggaaaaagcatccttcattgaagtcaaatcgtgtcattggccgaaatctcatactttatggtcaaatggtgtgctagaatctgagatgataatacccaaaaactttgcggggccggttagccaacacaattacagacccgggtatcatacacaaacggcgggcccatggcatcttggaaagctagaaatggacttcgacttctgcgaaggtacaaccgtggtggtcaccgaggactgcggtaacagaggaccttctttacggacgacaacagcttcaggaaaattaatcactgaatggtgttgtagatcatgcacattaccccctttaagatatcgcggcgaagacggttgttggtatggcatggaaatccgaccgctgaaagaaaaagaagaaaacctggtaaattccctagtaacggcgggacatgggcaaatagacaacttttcccttggagttctcggtatggcattatttttagaggaaatgctgagaactagagttggaactaaacatgcaatactgttggttgcagtttcttttgtaaccctgattacgggaaatatgagtttcagagacttaggaagagtaatggtaatggtaggagccacaatgacagatgacattggtatgggagttacatatctcgctttgttagcggcatttaaagtaagaccaacattcgcggctggattgttactaagaaagttaacatcaaaagaactcatgatggcgactatagggatagctttactatcgcaaagcacaataccagaaacaatcttagaattaacagatgcattagcgttaggaatgatggtattaaaaatagtaagaaatatggaaaaatatcaattagccgtaacaatcatggccatattatgtgtgcctaacgctgtcatactacaaaacgcatggaaagtatcatgcacaatacttgccgctgtgtctgtatctccacttctattaacttcatcgcagcaaaaagccgactggatcccattggccctaacaatcaaagggttgaatcctacagcgattttcttaaccactcttagcagaacaagtaagaaacgcagttggccattaaacgaggcggttatggccgttggtatggtatcaatattagcgtcctctttactcaaaaacgatattccaatgactgggccgctagtagcaggaggattattaacagtatgttatgttttaacaggtcggtcagcagaccttgaattagaaagagctgcagatgttaaatgggaagaccaagcggagatcagcggttctagccccatcctatccataactatatcagaagacggatctatgagtatcaaaaacgaagaagaagaacaaacattaactatattaattcgaacgggcctgctagtgataagtggagtattcccagtatccataccgatcaccgctgcagcatggtatctatgggaggttaagaaacagcgggctggagttttgtgggacgtaccgtcacctcccccaatggagaaagctgaacttgaagatggggcctatagaattaaacaaagaggaatctttggatactcacagataggggcaggagtctacaaagaaggtacgttccatactatgtggcatgtaactaggggagctgttttaatgcaccgtggaaaaagaatagaaccgtcctgggctgatgtaaagaaagacctaatatcttacggcggtggatggaaacttgaaggcgaatggaaagaaggtgaagaagtacaagtattggcattagagccagggaaaaacccccgtgcagtccaaacaaaacccggcctcttcaaaaccaacacgggtacgataggagcagtcagcctagatttctcaccaggaacaagtgggtcacctatagtagaccgcaaaggaaaagttgtcggtttatatggaaacggtgtcgttactaggtcaggtgcttacgtcagcgccattgcacaaacagagaaatcgattgaagacaatcctgaaatcgaggacgatattttcaggaagaaacgacttacgattatggacttacacccaggcgcaggaaaaacaaaacgatatttgccagcgattgttagagaggctatcaaaagagggttaagaactttaatactagctccaacgagggtagtcgcagctgaaatggaagaagctctacgagggttaccgattcgataccaaacgccggcaatccgtgcggagcacacaggaagagaaattgttgatcttatgtgccacgccacatttacaatgagattactatcaccagtccgagtaccaaactataatctaataattatggatgaagcgcacttcactgatccagcatcaatagcagcgagagggtacatatctacgcgagtagaaatgggtgaggctgctggaatattcatgaccgctaccccaccgggcagcagagatcccttccctcagagcaacgctcccatcatggatgaggagagggaaataccagagagatcgtggaactccggccacgaatgggtcaccgacttcaaaggcaaaacggtctggttcgtacctagcataaaagctggtaatgatatagcagcctgcttgaggaagaatggaaagaaagtaatacaactaagtcgaaaaacatttgattcagagtatgtgaaaactagagccaatgactgggatttcgtggtaacaacagacatttcagaaatgggggcaaatttcagagcggaaagagtaatagatcccagacgctgtatgaaacctgtaatactgacagacggagaggagcgtgtaatattagcaggtccaatgcctgtaactcatagttcagcagctcagcgaaggggaaggattggaaggaatcctaaaaacgaaaacgaccagtatatttatatgggggaacccttagaaaacgacgaggattgtgcgcattggaaagaggcaaaaatgttgcttgacaacattaacacaccagaaggaattataccttcaatgtttgaaccagagagagagaaagtagacgctatagatggcgaatatcgacttcgtggagaagcaaggaaaacttttgttgatctaatgagaaggggagacctccctgtctggttggcgtatcgtgtagcagcggaagggattaattatgctgatagaagatggtgctttgacggaattaaaaacaatcaaattttagaagaaaatgtagaagtagaaatctggacaaaagaaggcgagcgaaagaaattaaaaccgagatggctagatgcccgaatttatagtgacccattagcgttgaaagaatttaaggagttcgcagccggtcgcaaaagtttgactttgaatctaataacggagatgggaagactacctaccttcatgacacaaaaggcaagggacgcactagacaatctcgcagttttacataccgcagaagtaggtgggagagcgtacaaccatgcattatctgagttaccggaaacgcttgagaccttattactacttacacttctggctactgttacagggggtatctttttgtttttaatgtccgggaaagggattggaaaaatgacacttggaatgtgttgtataataaccgcgagtatacttttatggtacgcacaaatacagcctcattggatagcagcatctatcattctagagttcttcctaatagtactattaatcccagaaccagagaaacagagaactccccaagataaccaactaacttatgtagtaattgccatactgacagttgtagctgcgacaatggcaaatgagatgggatttttagagaaaacgaagaaagacctgggactaggatcgataatcacacaagaaagtgaatctaatatcttggacatcgatctacgtccagcaagtgcgtggaccctctacgcagtagccacgacttttgtaacacctatgttacgacacagcatagagaacagcagtgtaaacgtatctctaacagcgatcgctaatcaggcaaccgttctcatgggcctgggacgtggatggccactttcgaagatggatattggagttccgttactagccattggatgttatagtcaagttaacccaataactctgactgccgccctacttttacttgttgcgcattacgccataataggcccaggattacaagctaaagcaacgcgagaggcacagaaaagagcagctgcaggcataatgaaaaacccaacggtcgatggcataacagttattgacctcgaacctataccttacgaccctaagtttgaaaaacaattgggtcaagtaatgctcctagttttatgcgtcactcaggtattaatgatgcgaacaacttgggcattatgcgaagccttaacactagctacaggacctatatcgacattgtgggaaggaaacccgggccgattctggaacacaaccatagcagtaagtatggctaacatatttaggggtagttacttagcaggggcgggtctactcttttcaataatgaaaaatacaacaaatacaagacgaggtacaggaaatattggagaaacgctaggagaaaagtggaagtcaaggctcaatgcactaggtaaatccgaatttcaaatttataagaaaagtggaatacaagaagttgaccgaaccctagcgaaagagggaattaaaagaggagaaaccgatcaccatgccgtgagtaggggatctgccaaactacgatggttcgtagagcgaaatatggtcacacccgaaggaaaggtcgtagatctaggctgcggtagaggagggtggagctactattgtggagggctcaaaaacgtcagagaagtgaagggcctcactaagggagggccaggtcacgaagaaccgatccccatgagtacatatggttggaatctggtgagattacagagtggagtagatgtattctttacaccccctgagaagtgtgatactttgttgtgtgatataggagaatcatctccgaaccccactatcgaagctggcaggacgttaagagttctaaacttggtagaaaactggctaaacaataatacacagttctgtatcaaagtgctcaacccatacatgccatcagtaatagagaaaatggaaacactccaaagaaaatatggaggagcacttgtgcgaaatccgctatcaaggaatagtactcatgaaatgtattgggtatcaaatgcaactggaaacatagtatcgtcggtgaacatgataagccgaatgctaatcaatagattcacaatgaagcataagaaagctacatatgaaccggacgtggatctgggaagcggaactagaaatattggcatcgagaatgaaataccaaatttagacataatagggaagcgtatagagaaaataaaacaggaacatgaaacttcctggcattacgatcaggatcacccatataaaacttgggcatatcatggctcatatgagacaaaacaaacagggagtgcatcctcaatggtgaatggagtggttcgtttgcttactaaaccctgggacgttgtgcctatggttacacaaatggcaatgacagacacaactccgtttggccaacaaagagttttcaaagaaaaggtagatactagaacacaagaacccaaagaaggaactaagaaattaatgagaattaccgcagaatggctatggaaagagctaggcaaaaagaaaactccacggatgtgtactagagaagaatttacaaggaaagtcagaagcaatgctgccctcggtgcaattttcacggatgagaataaatggaaatctgcaagagaagccgtagaggatagtcgattctgggaactcgtcgatcgggaaagaaatctacatctagaaggtaaatgtgaaacttgcgtatataacatgatgggaaaaagagaaaagaagttgggggaatttgggaaagctaaaggcagtcgggcaatatggtatatgtggctcggagcacgctttctagagttcgaggcgcttgggttcttaaacgaggaccattggtttagcagaggtaatagtttgagtggagtagaaggagagggattacataaactcgggtatatacttagggacgtcagcaagaaagaagggggtgccatgtatgctgacgatactgctggttgggacacgcgtataacactcgaagacttgaagaatgaagaaatggtcacaaatcacatgaaaggcgaacataagaagttagcagaagcgatattcaaattaacataccaaaacaaagtcgtgagagtacaacgaccgacaccaagaggtaccgttatggatattatatcccgaaaggatcaaagaggctctggacaagtaggaacgtacggactgaacactttcacaaatatggaggcacaattgataaggcagatggaaggagaggggatattcaaatcaatccagcatttaaccgtaactgaagagattgcagtccgcaactggttagccagggttgggagagaaagattaagtaggatggcaataagtggcgatgattgtgtagtcaagccgttggatgatagattcgcttcagcattaacagctctcaatgacatgggaaaagttcgtaaagatatccaacaatgggagccgtcaagaggttggaatgattggacacaagtaccattctgttctcatcatttccatgaacttgtaatgaaagatggacgagtattagtcgttccgtgccgtaatcaagacgaactaattggtcgagcccggataagtcaaggggcggggtggagtctaaaggaaaccgcgtgcctgggcaaatcatacgcccaaatgtggaccttaatgtactttcacagaagagatttaagactggctgccaacgctatatgctcggccgttccctcgcactgggtaccaacgtctcgaacaacctggtcaatacacgctaagcatgaatggatgacaaccgaagatatgctcgcggtatggaacagagtatggatacaagaaaatccatggatggaagataagacgccagtagaatcatgggaagaggtaccttatttgggaaaaagagaagatcaatggtgtggaagcctgattggtttgacaagtcgggcaacgtgggccaaaaatattcaaactgcgataaatcaggtaagatcactgatagggaacgaagaatatacagattacatgccatccatgaagaggtttcgaaaagaggaagaagaggctggagtcttgtggtaa

SEQ ID NO: 22587 - RNA, 9876 nt, synthetic construct
  misc_feature 1..9876: note = derived and/or modified CDS sequence (opt6) from DENV-2__EU677145__SS-prME
  source 1..9876: mol_type = other RNA
acagccggagtaattgtaatgctgattccgacggcaatggcatttcatcttaccacacgaaatggtgaaccacatatgattgtgggacgacaagaaaaaggaaaatcgttactttttaaaacagaagacggagtcaacatgtgcacgctgatggcaatagatttaggagaactatgtgaagatacaattacctacaaatgtccgcttttaagacaaaatgaaccagaagacatagactgctggtgtaactccacatctacgtgggttacatatggaacttgcactacaacaggtgaacatagaagagagaaaagatcagtagctttagtaccacacgtagggatggggctagaaacaaggactgagacttggatgtctagtgagggtgcttggaaacatgtacaacgaatagaaacttggatactacgtcatccaggatttactattatggccgcaatattagcgtatacaattggaactactcatttccaaagggccctcatattcatactactcacagcagtcgcaccttccatgactatgcgttgtataggaataagtaacagagattttgtggaaggcgtttctggaggttcatgggttgatatagtattagaacacggtagctgtgtaacaacaatggccaaaaataaaccgactctagactttgaactaattaaaacagaagcaaaacaacctgcgacccttagaaaatactgtatcgaggccaaattaacgaataccactacagaatccagatgtccaacgcaaggagaaccgtcactaaatgaagaacaagataaaagatttatctgcaaacattcaatggttgaccgcggatggggcaatggatgcggactatttggaaaagggggtatagtaacgtgtgctatgttcacatgcaagaaaaatatggaaggaaaagttgttcaaccggaaaacttagagtataccatcgtaatcacgcctcattctggtgaagaacatgcagtgggaaacgatacaggaaaacacggcaaagaaattaaaataactccacaaagctcaatcacagaggctgagctaaccggctatggcaccgtaacaatggaatgctctcctagaacaggccttgattttaatgagatggtattactccaaatggaggataaagcatggttagtacatagacaatggtttttagatctcccattaccatggctcccaggcgctgatactcaagggtcaaactggattcaaaaagaaacgcttgttacattcaaaaatccacatgctaagaaacaggatgtagttgttttaggctcacaggaaggggcaatgcacactgccttgacaggggcaaccgaaattcaaatgagtagtggaaatttactattcacgggacatttaaaatgtaggctacgcatggacaaactccaattaaaaggtatgagctatagcatgtgcacaggtaagttcaaaattgttaaggagattgccgaaacacagcatggcacgatagtaataagagtacaatatgaaggagatggaagtccatgcaaaatacctttcgagattacagatttagagaaacgtcatgtattgggccgtctgatcactgtcaatcctattataacggaaaaagattcaccggtcaatattgaagcggaaccgcctttcggtgatagctacataataattggcgttgaacccggccagttaaagctaaattggtttaagaaaggctccagtataggccaaatgtttgaaactacaatgcgtggggcgaaacgaatggccatactaggtgatacagcctgggactttggttccttaggcggagtcttcactagcataggaaaagccctacatcaggtatttggtgcaatttatggcgcggcattctcaggagttagctggacgatgaaaatattgataggagtaataataacttggatcggcatgaacagcaggtcaacctcgctgtcagtatctttagttttagttggagttgtaaccctttacttaggagcaatggtgcaagcagactctggttgtgtcgtcagttggaaaaataaggaactaaaatgtggaagcggtatctttataacagacaatgtacacacatggacagagcagtataagttccaaccggaatcaccgtcgaagttagcatcggctattcagaaagctcatgaggaaggaatttgtggtatacgctcagttacaaggttagaaaatctaatgtggaagcaaataacccctgagctaaatcatatactatccgaaaatgaagtaaagttaacaattatgacaggagatataaaaggaataatgcaagcaggaaaacgatctttacggccgcaacccacggagttaaaatatagttggaaaacgtggggtaaggcgaaaatgttgagcacagaaagtcacaatcaaacatttttaattgatggacccgaaaccgcagaatgtcccaatacaaatcgagcctggaactctttggaggtggaggactatggatttggagtatttacgacaaatatttggttgaaacttagagaaaagcaagatgtgttttgtgattctaaattgatgagcgcagcaattaaggacaatcgagcagttcatgcagatatgggctattggattgaatctgcccttaatgatacttggaaaatggaaaaggcttccttcattgaggtgaaatcttgtcattggcctaaaagtcacactttatggtcgaatggcgtattagagtcggaaatgataattccaaaatcatttgccgggcctgtcagccaacataactacaggccaggttaccacacgcaaacggcgggaccctggcatctcggaaaacttgagatggatttcgacttctgcgagggaactacagtagtggttacagaggattgcggtaaccgaggccctagcttaagaacaacaacagcatccggtaaacttatcactgagtggtgttgccgttcttgtacattacctcctctcagatatcgaggtgaggatggttgttggtatggcatggaaattagaccacttaaggaaaaagaagagaatctagtcaatagcctggtgacggctggtcatgggcagatcgacaatttttcgctcggagtattaggaatggcactctttctagaggaaatgctccgaactcgtgtagggacgaaacacgccattctgctagtagcggtctctttcgtaaccttaataaccggcaatatgtcttttagagacctaggacgagtcatggtgatggttggagcaacaatgacagacgatataggcatgggagtaacgtacttagccttattagccgcgtttaaggtcagacctacgtttgcagccggactgctgcttcgtaaattgacaagtaaagagcttatgatggcgacaattggaatcgcactattatctcagagcacaatgcctgaaacaatacttgaactaacggatgctctagcactaggtatgatggtcttaaaaattgtgagaaacatggaaaaataccaattagcggtaacaataatggcaatatcatgcgttcccaatgcagtaatcctacaaaatgcctggaaggtcagttgtacaattcttgcgactgtgtccgtatccccattgttactcacttcctctcagcaaaaagctgattggatacctctcgccttgacaattaaaggattaaaccctacagcaatatttttgaccactttatcacgaacaagcaagaaaagaagctggcctttaaatgaagccatcatggcagttggcatggtgtcgatattagcatcgtcactacttaaaaacgacataccgatgactggccctcttgtagctggaggcctcctaacagtatgctatgtactaaccggcagaagcgcagatctagaattggaaagggcagcagacgttaaatgggaggatcaggcggaaatatcgggatcctcgccaatattaagcattaccattagcgaagatgggtctatgagcatcaaaaatgaggaagaagaacagactttaacaattttaatacgtacaggattgctagtcatatcaggagtatttccagtatccatcccaataacagcagcagcctggtatctttgggaagtcaagaaacaaagagcaggagtgttatgggatgtcccatcaccgccaccagtggggaaagccgaactagaggatggtgcttaccgaattaaacaaaggggaatcctgggatactcccaaataggcgcgggagtgtataaagaagggactttccacacgatgtggcatgtaacacgaggcgctgtattaatgcaccgtggaaaacgaatcgagccatcatgggcggatgtaaagaaagatctgatatcctatgggggtggctggaaattagaaggagagtggaaagaaggagaggaggtacaagtacttgcattggaaccaggcaaaaacccacgagcagttcagacgaagcctggaatattcaagacaaatactggcacaataggcgcagtctctctagatttcagtccaggtacaagtggtagtccaatcgtggacagaaaagggaaagttgttggattgtacggcaacggagtagttactagaagtggggcatatgtatcagcaattgcccaaacagaaaaatccatagaagacaatccagaaatagaagacgacatttttcgtaagaaacgacttaccattatggatttacacccaggggctggaaaaaccaaaaggtacttgccagccatagttagagaagcaatcaagaggggattaagaacgcttatcttagcaccaacccgtgttgtagctgcagaaatggaagaagcgttacgcggactgcccatcagataccaaactcctgctatacgagctgaacatacaggacgtgaaatcgttgacttgatgtgtcatgcaacctttactatgaggctgctaagcccagttcgcgtacctaactacaatctaattataatggatgaagcacattttacagacccagccagcatagcagcccgagggtatatttccacgcgtgtagagatgggagaagcagcgggtatttttatgacagccaccccaccaggatcaagagatccctttccccagtcgaatgcacccataatggatgaagaaagggaaattccagagagatcatggaacagtggccatgagtgggtaaccgactttaaggggaaaacagtatggtttgtacccagcatcaaagctggaaacgatatagcggcttgtcttcgtaaaaatgggaagaaggtgatacaactaagtaggaaaaccttcgattcagaatacgtaaaaactagggcaaacgattgggatttcgtagttacaactgacataagcgaaatgggcgcgaattttaaagctgaaagagtaattgatccccggagatgcatgaaacctgtaatattgaccgatggagaagaaagagtgatactagccggcccgatgccagtcactcattcatcagcagcccaacggagaggccggatcggaagaaatcccaaaaacgaaaacgaccaatacatttacatgggagagccgctagaaaacgacgaagactgtgcgcattggaaagaagcaaagatgttattagataacataaatacaccagaagggattatcccatctatgttcgaacctgagagggagaaggttgacgcaatcgacggagagtatagattgcgtggagaagcccgaaaaacattcgtggatttaatgaggcggggtgatctgccagtatggcttgcttaccgagtagctgcagaaggaataaattatgccgaccgtaaatggtgctttgatgggatcaaaaacaaccaaatattggaagaaaacgtagaagtagaaatatggacaaaagaaggtgagaggaagaaattgaaacccagatggctcgacgctcgaatctacagcgacccgttggccttaaaagaatttaaagagtttgcagctggacgaaaatcgctgacccttaaccttataacagaaatgggcagattacctacattcatgacccaaaaagcgagaaatgcattggataatctggcggtgttgcacacagctgaagctggtgggagagcatataatcatgctttaagtgaactgccagaaacgctagaaactctcttactattaaccttattagctacggtgacaggtggtatattcttattcctaatgtctggcaaaggcattggaaaaatgacgttgggtatgtgttgtattataaccgcgtcaatactcctctggtacgcacaaattcagccccattggattgcggcgtcaataattctagagttctttcttatagtgttacttatacctgaacctgaaaagcaaaggacaccgcaagacaatcaattaacgtacgttgtaatagctatattaacggtggtggcagccacgatggcaaatgaaatgggattcctggagaaaacgaagaaagatttgggattaggatctatcactacacaagaatcggaatcaaatatccttgacatagatttaagaccagcgtcggcctggacattatacgcagtggccacaacgtttgtaacaccaatgcttagacatagtatcgaaaattcgagtgttaatgtatccttaactgccattgcaaatcaggcaacagtattaatggggttaggaaaaggatggcccttgtcaaaaatggacataggggttcctttattagcaataggttgttatagtcaagtaaacccaattacactaacggcagctctattactccttgtagctcactacgctatcattggacccggacttcaggcaaaagcaacccgcgaagctcagaaaagagctgctgcaggtataatgaaaaatccaacagtagatggcattactgtgatagatttagaaccgatcccatacgatccaaaattcgagaaacaattgggacaagtaatgttattgatcttatgtgttacacaagttttaatgatgaggacaacgtgggccctatgcgaggcgctaaccctcgctacgggaccgattagtaccttatgggaaggcaaccctgggaggttctggaacactacaattgctgtaagtatggcaaacatatttcgcggcagctatctggcgggggctgggttgctctttagtatcatgaaaaatacgacaaatactcgaagaggaacaggtaacataggagaaacattgggggaaaaatggaaaagtcgactaaacgcacttggtaaaagtgagttccaaatatacaagaaatcaggaatccaagaagttgatagaacgttagcaaaagagggaattaaaagaggagaaactgaccatcacgccgtgagtagaggctctgctaagctgcggtggtttgtggaacgaaatatggtaactccggagggaaaagtggttgaccttggatgtggaaggggaggatggagttactattgcggaggtctaaagaacgtccgagaagttaagggtcttacaaagggaggtcccggtcacgaagaacctgtaccaatgtctacttatggatggaatctcgtaaggttacaatcgggtgtagatgtcttcttcacaccccctgaaaagtgtgatacattactatgtgacattggcgaatcgtccccgaatccgacgatagaagcaggcagaacattgagagtactaaacttagtcgagaactggctaaataataatacacaattttgtataaaagtgttgaatccttatatgcctagcgtaatagagaaaatggagacactccaaagaaaatatggaggggcactcgtaagaaaccctttgtccagaaacagtactcatgaaatgtactgggtcagcaatgccacaggaaacatagtctcttcagtgaatatgatatccagaatgctaatcaacagattcaccatgaaacataagaaagctacatacgaaccagatgtggatttgggttctggtacccgaaacataggtatagaaagtgagatacctaacttagatataatcggcaagaggattgagaaaataaaacaagaacatgaaacatcttggcattatgaccaagatcacccgtataagacgtgggcatatcacgggtcatacgaaacaaaacagacaggatccgcaagtagtatggtaaatggagtagtccggttactcacaaaaccatgggacgtcgttccgatggtcacgcagatggcgatgactgatacgacgcccttcgggcaacaaagggtatttaaagaaaaggttgatacaagaacgcaggaaccaaaagagggaactaagaaactaatgaaaataaccgccgaatggctctggaaagagctgggaaagaagaaaacaccaagaatgtgtaccagggaagaatttacaaagaaagtaagaagtaacgctgcgctaggggctatattcacggatgagaacaaatggaaatctgccagagaagcagttgaggatggtagattttgggaactggtagatagggaaagaaatttacaccttgaaggaaaatgcgaaacttgcgtgtataatatgatggggaagagagagaaaaagctcggagagttcggaaaggcgaaaggaagtagggctatttggtatatgtggctaggtgccagatttttagaatttgaggccctaggatttctgaacgaagaccattggttttctcgaggaaattctctttctggtgtagaaggtgaaggtttgcatcgattgggttatattctgcgcgaggtaggcaagaaagagggaggagccatgtatgcagacgatactgcgggatgggacacaagaataacactagaagatctcaaaaatgaagaaatggtgacaaaccatatgaagggcgagcataagaaattagctgaagcgatttttaaacttacttatcaaaataaagtggtaagggtccaacgaccaacacctagaggtacagtgatggacataatatcgagaagagaccaaagaggatcagggcaggttgggacatatggattgaatacctttaccaacatggaagcacaattaatcagacaaatggaaggagaagggatttttaagtcaatccaacaccttacagctacggaggaaatagctgtacaaaattggcttgctagagtaggtagagagcgtttaagccgaatggctatttccggggatgattgtgtcgtgaaacctatagatgatcggtttgcatcggctcttaccgcattgaatgatatgggtaaagtccgaaaagatatacaacaatgggagccatcacggggatggaatgactggacacaagtacctttctgtagccatcactttcacgagctagttatgaaagatggtagagttttagtcgtaccctgtcgcaaccaagatgaattgataggcagagcacgcatatctcaaggcgcaggatggagcctaaaagaaacagcgtgtttaggaaaatcttatgcgcaaatgtggaccctgatgtattttcacagacgagacctgcggcttgccgcaaacgccatttgcagtgcagttcctagtcattgggtccctacgagccgaacaacttggtccatacacgcaaaacacgaatggatgacaacagaagacatgctagccgtttggaatcgagtgtggattcaagaaaacccttggatggaggacaaaaccccagttgaatcatgggaggaagtgccatatcttggcaaacgcgaagatcaatggtgtggtagtttgataggacttacgtcaagggccacatgggcaaagaacattcagactgcaataaaccaagtaaggagtttgataggtaatgaagaatatactgactatatgccttcaatgaagcggtttcgtagggaagaagaagaggcaggcgttctgtggtga

SEQ ID NO: 22588 - RNA, 9876 nt, synthetic construct
  misc_feature 1..9876: note = derived and/or modified CDS sequence (opt6) from DENV-2__EU677146__SS-prME
  source 1..9876: mol_type = other RNA
acggtaggtgttatagtaatgctcatacctaccgcgatggcatttcacttaactactagaaacggggaaccacacatgattgttggaagacaagagaaagggaaatcactgttatttaaaactgaagacggggttaatatgtgtactttaatggcaattgatttaggagaattgtgtgaagacacaattacatacaaatgtcctttactaagacagaatgagccagaagacatagactgttggtgtaatagtacaagtacgtgggtgacctacggaacctgtacaacaactggtgaacacagacgagagaaaagatcggttgcactcgtaccccacgtgggaatgggattggaaaccagaacggagacctggatgtcaagtgaaggtgcttggaaacatgttcaacgaattgaaacatggatcctgagacacccaggtttcacgattatggctgcgatccttgcttacacaatagggactacccactttcaaagagctttaatttttattttacttacagctgtagcgccttcaatgactatgaggtgtatcggaatctccaatcgagattttgtagagggagtttcgggaggctcttgggtagacattgtactcgaacacggctcatgtgtaacaactatggctaaaaacaaacccacattagactttgaattgataaaaacggaagcaaaacaaccagcaacactacgtaaatactgtattgaagcgaaattaacaaatactaccacagagagtcgatgtcctacccagggagaaccatctctaaatgaagaacaagataaaagattcatctgcaaacactcaatggtggaccgaggatgggggaatggatgcggcctcttcgggaaaggaggtatagtaacatgcgcaatgttcacttgtaagaaaaatatggaaggcaaagtcgtacttcctgaaaacttggaatacactatagtcataactccccattcaggagaagaacatgctgtaggaaatgacaccggaaaacatggtaaagaaattaaaattactccacaatcgtctatcactgaagcagaactaacgggatacggtacagttactatggaatgtagtccaaggacaggattggatttcaatgagatggtactccttcaaatggaagacaaagcatggttagtacacaggcaatggttcctagacttgcctttaccctggctaccaggagctgacacacaagggtctaattggatacagaaagaaacattagtaaccttcaaaaacccacatgcaaagaaacaagacgtggtcgtcttgggttcacaagagggggcaatgcatacagcattaacgggagcaacagaaatccaaatgtcgtcaggtaatctcctgtttaccggccacttgaaatgtcgtctaagaatggataaactccaactgaaaggaatgagttactcaatgtgcactgggaaattcaaaatagttaaagaaatagcagagacgcaacacggtacaatagttatcagggtccaatatgaaggggacggctcgccatgtaaaatcccattcgaaataatggatctagagaaacgacatgtgctgggtcgacttataacggtcaatcctatcgtcaccgagaaagatagcccagtaaatatcgaagctgaaccaccatttggtgatagctacataatcattggggtcgaaccaggccaactcaaactaaactggtttaagaaaggcagtagtatagggcagatgttcgaaactacaatgagaggggccaaaagaatggcaatcttgggtgacacagcatgggattttggcagtctaggtggtgtgttcactagcataggcaaagcacttcatcaagttttcggcgcaatctacggtgctgccttttcaggagtaagttggaccatgaaaattctaataggagtaataatcacctggataggcatgaatagtcgttctacatctctgagcgtctcattagtattagttggagtagtaacactataccttggggtaatggtccaagctgactcaggttgtgtggttagttggaaaaataaagaattaaaatgcggatcaggaatattcattacagacaatgtccatacttggaccgagcagtataaattccaacctgagtccccctcgaaacttgcatctgccatacaaaaagcgcacgaagaaggaatatgcggaatacgtagcgttacccgattagagaatcttatgtggaagcaaataaccccagaacttaaccatatcctgtccgaaaatgaagcaaaacttacaatcatgacaggagatattaaggggatcatgcaagccggcaaaagaagtttaagaccacagcccactgaattaaaatattcatggaaaacatggggtaaagcaaagatgctatcaacagaatcacataaccaaacattcttaatcgatggtcccgaaacggcagagtgccctaatacgaacagagcttggaactcactcgaagtagaagactacggtttcggtgtttttagcactaatatatggctcaagctaagggaaaagcaagatgttttctgtgacagcaaattgatgtcagccgctatcaaagacaacagggcagtacacgcagacatgggatattggattgaatcagctttaaacgacacatggaaaatggaaaaggcttcattcatagaaatcaaaagctgccactggcctaaatctcacacattatggtccaacggagtattggaatcggagatgataatacccaaaaattttgcagggcctgtctctcaacataattacaggccagggtatcatacacagacggcgggcccttggcacctcggaaaattagagatggattttgacttttgcgaaggcacgacagtggtggtaacagaagattgcggtaaccgcggaccttcactgaggacaacaactgctagcggtaaattaatcacagagtggtgctgccggagttgcactctcccacccctaagatatcgaggagaagatgggtgttggtatggtatggaaatacgtccattgaaagaaaaggaggaaaacctggtaaattcacttgtaaccgcgggacatgggcaaatagataatttttcattgggggtactaggtatggcactctttttggaggaaatgttaaggactcgcgttggtactaagcatgcaatattgcttgttgcagtatcgtttgtgacacttattaccggcaatatgtcctttagagatttaggcagagtcatggtcatggtaggagcaacaatgacagacgatataggaatgggcgtaacctatttagctctcctagctgcattcaaagtaagaccaaccttcgctgctggattgttactgaggaagttaacaagtaaggagttgatgatggctacaatcggcatcgccttattaagtcaatcaaccattccagaaaccatacttgagttgactgatgcgctcgcccttggaatgatggtactcaaaatcgtaagaaatatggagaaatatcagttagcagtaacaataatggccatttcatgtgtgccaaacgcagtgatactccaaaacgcatggaaagtcagttgtacaatattagctgctgtaagtgttagccccttactcttgacaagtagccaacaaaaagcagattggatacctctcgctcttaccataaagggtttgaacccaacagccatatttttaactacattatcgagaaccagcaagaaacgaagttggccactcaatgaggcggttatggctgtagggatggtttctatcctcgcttcttcactactcaaaaacgacatccctatgactggtcccctagtcgctgggggactgttaacagtgtgctatgtcctaacaggacgaagcgcagacttagaactagaaagagctgcagatgtaaaatgggaggatcaagctgaaatatcaggatcctcaccaattctttcaatcacaataagcgaggatgggtcgatgagtatcaaaaacgaggaggaggaacatacattaacaatcctaataagaacgggtctgctagtaatcagtggcgtatttccggtttcaattccgattacagcagcagcctggtatctatgggaagttaagaaacagcgagccggagtcctatgggatgtccctagtcctccacccgtgggaaaagctgagctggaagatggggcgtacaggattaaacagagagggatctttggttatagtcaaattggcgccggtgtttataaagaaggaacctttcatacgatgtggcatgtgacaagaggagctgttttaatgcatcgtggtaaacgcatagagccttcatgggcagatgtcaagaaagaccttattagttatggaggaggatggaaactcgaaggggaatggaaagaaggagaagaagtgcaggtcttagcactagagccaggtaaaaatccccgagcagtgcaaaccaaacctggcctttttaaaacgaatactgggaccatcggagcggtatcgttagatttttcgcctggaacaagcggctcaccaattgttgataggaagggaaaagttgtaggattatatggtaatggtgtcgtaacaagaagcggtgcctacgtctcagcaattgctcaaacggaaaagtctatagaagacaatcccgagatagaagatgatatatttagaaagaaaagactaacaattatggacttacatccaggggcaggtaaaacaaaaaggtatttgccagcaattgtgagggaggctattaagcgcggattaaggactctaatattggcgccaaccagagtagttgccgccgaaatggaagaagcactccgtggattgcctatcagatatcaaactccggcgatccgggcagaacatactggacgtgaaatcgttgaccttatgtgtcatgctacatttacaatgcgcttgctgagcccggttagagttccaaattataatcttattattatggatgaagctcattttacagatcctgcttcaatagctgccaggggatatatatcaacaagggtagagatgggagaagcagcaggaatatttatgactgctacacccccggggagccgagacccattcccacaatctaacgccccaattatggatgaggagagagaaattcctgaaagatcatggaactcgggtcacgaatgggtgaccgattttaaaggtaaaacagtttggtttgtcccgtccataaaagccggaaatgatatagctgcatgcttaaggaaaaatggtaagaaagtgattcaattgtcaagaaaaacttttgacagtgaatacgttaagacaagggcaaacgactgggatttcgtagtaactactgatatatcggagatgggagccaatttccgtgcagagagagtgatagacccacgaagatgtatgaaaccagtaatcttaactgatggcgaagaacgcgtgattctggctggacctatgccagtgacacactctagcgcagcgcaacgacgtggtagaatcggtagaaatcccaaaaacgaaaatgatcagtacatttatatgggagaaccccttgaaaatgacgaagactgcgcacattggaaggaagctaaaatgttactagacaacatcaacactccagaaggcataatcccttctatgtttgagccggagcgcgaaaaggttgatgcaatcgacggtgagtaccgtttacggggtgaagcaagaaaaacctttgttgatcttatgcgacggggagatcttccggtctggcttgcgtatagagttgcagcggagggaataaattacgctgatcgtaggtggtgttttgatggcattaagaataaccaaatattagaagagaacgtagaagtggagatctggacgaaagagggagaacggaagaaattaaaaccaagatggctagatgcgagaatctacagtgatccgttggccctaaaagagttcaaggaatttgcggcgggtagaaaaagtctaactctaaacttgatcactgaaatggggagactacctacatttatgactcagaaagcgcgagacgctctagacaacctcgctgttctacatacggccgaagtaggaggcagagcatacaatcatgctctgtcagaactaccagaaacgcttgagacactattactcttaacactactcgccactgtaacagggggtatatttctatttttaatgagtggaaaaggaataggaaaaatgaccctaggaatgtgttgtatcataacagccagcatattgttatggtatgctcaaatacaaccacattggatagcagcatcaattatactggagttctttctgatagtcttactaatacctgaacctgagaaacaaaggactccacaagataatcaattaacctacgtggttattgccattttaacagtcgtagcggcgacaatggcaaacgaaatgggctttctagaaaagactaagaaagatttaggactaggaagtattacaacccaagaatcggaatctaatatcttagatatcgatctgaggccagcgagtgcctggacattatatgctgtagcgactacctttgttacaccaatgctacgtcatagtatcgaaaatagttcagtaaatgtatccctcacagcaatcgcaaatcaagcaacagtattaatgggtctcggaagaggctggccactaagtaaaatggatattggagtgccattgcttgccataggatgttattctcaagttaatccaattacattaacagcagctctgctcttgctagttgcccactacgctattattggaccaggattgcaagccaaagcaaccagagaagcacaaaagagaactgctgcaggcattatgaaaaatccaaccgtagatggtataacggttatagaccttgaaccaataccctatgatccaaaattcgaaaaacaactgggacaagttatgttattagtcctgtgtgtcacacaagtgctaatgatgagaactacctgggctttgtgtgaagcacttacgttagccacaggacccataagtaccctttgggaaggtaacccaggcagattttggaacaccaccatagcggtatctatggctaatattttccgtggttcatatctcgcgggcgctggacttttattcagtattatgaaaaacacgacgaatactagacggggtacaggtaacatcggtgaaaccctaggcgaaaaatggaaaagcagactcaacgcattagggaaatctgaatttcaaatctacaagaaatcaggtattcaagaagtagacaggacattagccaaagagggaataaaacgcggagaaaccgaccatcacgcagtatcaaggggatcagctaagctgagatggttcgtcgagcggaatatggtaactccagaggggaaagtagtggacttgggttgcggaaggggtggatggtcgtactactgtgggggcctgaagaacgtcagagaagtcaaggggttaacaaaaggcggcccaggacacgaagaaccaatcccgatgagtacgtacggatggaacttagtaagattacaatcaggcgttgatgttttctttacaccccctgagaaatgtgatacactattatgtgacataggtgaatcaagtcctaaccccactatagaggcaggacgaacattaagggtccttaatctagtagagaattggctaaataataatacgcagttttgcataaaggtcttaaacccatatatgccgagcgtcatagaaaagatggaaactctacaacgaaaatatggaggtgctctggtaaggaaccctctcagtcgaaatagtacacatgagatgtactgggtcagtaatgcaacaggaaacattgtcagctccgtcaatatgataagtagaatgttaattaataggttcactatgaaacacaagaaagcaacatatgaacccgatgtagacctcggttcgggtacgagaaatatcggaatagaaaatgagatacctaatctggacattataggaaagagaattgagaaaattaaacaggagcatgaaacatcatggcactacgaccaggaccacccctataagacctgggcatatcatggttcatatgaaacaaaacagacaggttcagcatccagcatggttaatggagtagttaaattattgacgaaaccatgggacgtagtacctatggtcacacagatggcaatgacggacactacaccttttggtcagcaaagagtttttaaggagaaggtggatacgagaactcaggaacccaaagaaggtacgaagaaacttatgcgcattaccgctgaatggttatggaaagagctgggcaagaagaaaacgcccagaatgtgcacccgcgaagaatttacgcgtaaggttcgctcaaatgcagcacttggagcaatattcacagacgaaaacaaatggaaatcagctcgtgaagcggtcgaagacagtaggttttgggagctagtagatagagaacgcaatctacatctcgaaggaaaatgtgaaacatgcgtatataatatgatgggtaaaagagagaagaaattaggtgagtttggaaaagccaaaggtagcagggcaatatggtatatgtggttaggagcaagattcttagagtttgaagcacttgggttcttaaatgaagaccattggtttagcagagggaatagtcttagcggtgttgaaggtgaaggactacataaattagggtatatcttaagagatgtaagcaagaaagaaggcggggctatgtatgcagatgatactgccggttgggacactagaataaccttagaggaccttaaaaacgaagagatggtaacaaaccacatgaaaggagaacacaagaaactagcggaggcgatattcaaactaacatatcaaaataaagtagttagagttcaaagacctacaccaagaggaacagttatggatataatttcacggaaagaccaaagaggatctggacaagtgggtacttatggacttaacacattcacgaacatggaagctcaattaatacgccaaatggaaggggaaggtatttttaaatcaattcaacgtttgacagtaactgaggaaatcgccgtacaaaattggttggctagagttggcagagaaaggttaagtcgaatggctatcagcggcgatgattgtgtcgtaaaaccacttgatgatagatttgcctccgcgttgaccgctcttaatgatatgggtaaggtaaggaaagacatacaacagtgggaaccctcgagaggctggaacgactggacccaggtaccgttttgtagtcaccattttcacgaattagtaatgaaagatggtcgggtcttagttgtaccatgtagaaaccaagacgaattaattggacgagcgagaataagccaaggtgcaggctggtccttaaaagaaacggcatgtctgggaaaatcttacgcgcaaatgtggactttaatgtactttcacaggagagatttaagattggcggccaatgctatttgtagcgctgtgccatcacactgggtgcccacttcaagaactacctggtcaatccatgcgaaacacgaatggatgacaacggaggacatgcttgctgtctggaatcgggtctggatccaagaaaatccatggatggaggataaaaccccagtggagtcatgggaagaagtaccatatctaggaaaacgggaagatcaatggtgtggctcattgatcggattgacttcacgagctacgtgggccaaaaacattcaaactgcaataaatcaagtcagatcattaataggtaacgaggaatacaccgattatatgccctcaatgaagcgctttcgcaaagaagaagaagaggcaggagtactgtggtga

SEQ ID NO: 22589 - RNA, 9876 nt, synthetic construct
  misc_feature 1..9876: note = derived and/or modified CDS sequence (opt6) from DENV-2__EU687214__SS-prME
  source 1..9876: mol_type = other RNA
actgctggggtaataataatgttgattcctactgcaatggctttccatttaacgacaagaaatggcgaacctcacatgatagtaggaagacaagaaaaaggaaaatctttgctttttaaaacagaagatggggtcaatatgtgtactttaatggcaatagacttgggagaactatgcgaagatactattacatataaatgtcctttattacgccaaaatgaaccggaagatatcgattgttggtgtaattccacaagtacatgggttacgtatggtacgtgtaccacaacaggagaacatagaagagagaaaagatcggttgccttagtaccacacgttgggatgggattagaaacacgtactgaaacttggatgagttcagaaggtgcgtggaaacatgttcaaaggattgaaacttggatactgcgccaccctggatttacaattatggcagcaatccttgcttatacaatagggaccacacatttccaaagggcgctaatattcattttattaacggcagtggcgccaagcatgacaatgagatgcattggtatttcgaatcgtgatttcgtagaaggggtaagcggaggctcgtgggtggatatagttttagaacacggatcatgtgtaaccacaatggctaaaaataaaccaacattggattttgaactaataaaaaccgaagcaaaacagcccgcaaccttacgtaaatattgtattgaagcaaaattgacaaataccactaccgaatcacgctgccctacccaaggtgaaccatcgctcaatgaagaacaagataaaagatttatctgtaaacatagtatggtagataggggatggggaaatggatgtggattatttggcaagggaggtatcgtgacatgtgcaatgttcacctgtaagaaaaatatggaaggaaaagtagttctgccagaaaacttagaatacaccattgtgataacaccccattccggtgaagaacatgcagtcggaaacgacaccggtaaacacggcaaagaaatcaaaatcacaccgcaatcttccatcactgaagcagaactaacagggtacggtacagtgacaatggaatgttcaccgaggactggattagacttcaatgaaatggtactgttacagatggaagataaggcttggttggtacatcggcaatggtttttggatctgccattaccgtggcttcctggagccgacactcaaggaagtaactggatacaaaaagaaaccttagttacatttaaaaacccccacgccaagaaacaagacgttgttgtactgggaagccaagaaggagcaatgcacactgctctaaccggcgcaacagaaatacagatgtcctcgggcaatctactttttactggtcacttgaaatgccgactacgtatggataagttacaactcaaaggtatgtcatatagcatgtgcacaggaaaatttaaaatagtaaaagaaattgctgaaacacaacacgggacaatagtaatccgggtccaatatgaaggtgatggatcaccatgtaaaatccctttcgaaataatggatttagaaaagcggcacgttctagggaggttgattactgtaaaccctatagtaactgaaaaagattcaccagtaaacatagaagccgaacctccatttggtgactcctatataataattggagttgaacctggacaactaaagttgaattggtttaagaaaggtagttcaatcgggcaaatgtttgaaacgacaatgagaggagcgaaaaggatggctatattgggagatacagcttgggattttggaagtctaggaggggtgtttacatctatcggaaaggccctgcatcaagtatttggtgccatttatggtgccgcgtttagtggtgtcagttggaccatgaaaatcctgattggtgtcattattacatggataggaatgaactcccgtagcacctccctttcagtcagcctagtgttagtaggtgtagtcacattatacttaggtgtaatggtacaagccgacacagggtgtgtggtgtcatggaaaaataaagaacttaaatgcggaagcggtatcttcattactgacaatgtacacacatggacagaacaatataaattccaacccgaaagtcccagtaaactagcctcggcaattcagaaagcacacgaggaaggaatttgtggaatacgatcagtcacaagattagaaaacctaatgtggaaacaaattactcccgaactaaatcatatattatcagaaaacgaagtgaaacttactattatgacaggagatattaaagggatcatgcaagcaggaaaacgctctctgcgaccacaacctacggaactcaaatacagttggaaaacctggggcaaagctaaaatgttatcaacagaatcacacaaccaaacgtttcttatagatggaccagaaacagcagaatgcccgaacacaaatcgagcatggaactcgctggaagtagaagattatggttttggcgtatttagcacaaacatatggttgaaacttcgggagaaacaagacgtattctgcgattcgaaattaatgtcggcagcgatcaaagacaatagagctgttcacgccgatatggggtactggatagagtctgcattaaatgacacgtggaaaatggaaaaagcctcatttatagaaataaaaagttgccattggccaaaatcacatactctatggagtaatggtgtgctggagtcagaaatgattattcctaaaaactttgcagggccagtttcccaacataattatcgtcctggatatcacactcaaacagccggaccttggcaccttggaaaacttgagatggatttcgatttttgcgaggggacaactgttgtagtaacagaagattgtggtaatcgagggccgagtttgagaacaacaacagcctccggaaaactaatcacagaatggtgttgtcgtagctgtaccttacctccccttagatacaggggcgaagatggatgttggtatggcatggagattaggccacttaaggagaaagaagagaatcttgttaattcattagtaacggctggacacgggcaaattgataatttttcattgggcgttctaggaatggctcttttcttggaagaaatgctaagaactagagtcggaacaaagcacgcgatcctccttgtcgcagtcagcttcgtgactttaattacaggaaatatgtcatttcgtgacttgggtagggtgatggtaatggtaggggcaacaatgacagacgatattgggatgggggtaacatacctagcccttttagctgctttcaaagttaggccgacattcgcggctggcttattacttcgaaagttaacatcgaaagaattaatgatggctacaattggcatagcgcttttaagccagagcaccatacccgaaaccattttagaattaacagacgcattagcactcggaatgatggtgctaaaaatagtaagaaacatggaaaaataccaattagcagttacaatcatggcaataagctgtgtacctaacgccgtaatacttcagaacgcgtggaaagtgagctgcacgatactagcagccgtatctgtatcacctttgttattgactagcagccaacaaaaagcagactggatcccattagcactgactattaagggattaaatcctacggctattttccttacgacgctaagtagaacgtcaaagaaaagatcgtggccattaaacgaagcggttatggcagtcggtatggtctcaatattggcatcttctctactaaagaatgatatacctatgacgggaccattagtggcaggaggactactgacagtttgttatgtactaactggaagatccgctgacctagaactcgagagagcagcggatgtcaaatgggaggaccaagctgaaattagtggaagctcacccattctatccattactataagcgaagacggcagcatgagcattaaaaatgaggaagaagaacacacactaacaattcttattagaacaggattattagtaatctctggagtttttcctgtaagtattccaattaccgccgctgcttggtatctatgggaagttaaaaagcagagagccggtgtcctgtgggatgtaccttctccacctccagtgggtaaggcagaactagaagatggtgcttaccgtattaaacaaagaggaatatttggatattcacaaataggtgcaggcgtgtataaagaaggtacttttcataccatgtggcacgttacaagaggagctgtacttatgcaccgcggtaaaagaatagaaccctcatgggcagatgtgaagaaggacctaataagttatggaggtggttggaaattagagggagaatggaaggaaggagaagaagtgcaagtgttagccctagaacctggaaagaatccaagagcagtccagacaaaacccgggttatttaagacaaacaccggtacaataggcgctgtctctttggatttttctccaggaacaagtgggtcacctattgttgacaggaaaggcaaggttgtaggactttatggaaacggggtagtaacccgcagcggcgcatacgtatcagctatagcacaaacagagaaatctatagaagacaacccagaaatcgaagacgacatctttcgtaagaaaagactaactatcatggatcttcatccgggagcgggcaaaaccaaaagatacctacctgcaatagtacgggaagcaataaaaagaggactgcgtacgttgatactagcacccacacgggtagtcgcggcagaaatggaagaagccttgcgaggattacctatccgttaccaaactcctgccatacgcgccgaacacaccggaagggaaatagtagatcttatgtgtcatgcaaccttcactatgcgtttattgagcccagttcgagtgccaaattacaatcttatcattatggacgaagcgcatttcacagaccccgcgtctatagcagcaaggggatacattagcacaagagtagaaatgggggaagcggcgggaatcttcatgacggccactccaccaggtagtcgagatcccttcccccagagtaatgcccctatcatggatgaagagagggaaataccggaaagatcttggaacagcggacatgaatgggtgacaaattttaaaggtaaaacagtgtggttcgttccatcgataaaagcgggaaatgacatcgcagcttgcctcaggaaaaatggcaaaaaggtcatacaactcagtagaaagacatttgattccgaatatgtaaaaacgcgagctaacgactgggacttcgtcgtgacaacagatatatcagaaatgggtgcgaatttccgcgcggaaagagttatagatccccgaagatgtatgaaaccggtgatacttaccgacggtgaagaaagggttattttagcaggtcctatgccagtaacacactcatccgcagctcaacgacgcggacggattggcagaaacccgaaaaatgagaatgaccaatatatctacatgggggagccactcgagaacgacgaagactgtgctcactggaaggaagctaaaatgctactagataatattaacacgcctgaaggaattattcctagcatgttcgaacctgaaagagagaaagtcgacgcgattgacggcgagtataggctaagaggtgaagcaagaaaaacgtttgtcgatttgatgaggcgaggagatctaccagtatggctcgcttatagagtcgcggcagagggaatcaattacgctgaccgacggtggtgctttgacggtattaagaacaatcaaatattggaagaaaatgttgaagtagaaatatggactaaggaaggggaacgtaaaaagttaaaaccgagatggttggacgcacgtatctacagtgacccgctagcccttaaggagttcaaagagttcgctgccgggcgcaaatctctgacacttaatttaattaccgagatgggacgactacctactttcatgactcaaaaagctcgcgacgctttagataatttggcggtattacatacggcagaagtaggtggacgagcatacaaccacgcgctaagcgaattaccagaaacattagagaccctattacttcttaccctacttgccacagtcacaggaggtatattcctatttttgatgagcggtaagggcataggaaaaatgacattaggaatgtgctgtataataacagcctcaattttgctctggtatgcgcagatccaaccccattggattgctgccagtatcattttagagttctttttgatcgttttattgattccggaacctgaaaaacaaagaacaccccaggataatcaattaacgtacgtcgtaattgctatacttactgtagtagcagcaacaatggcgaacgagatggggttcctggagaaaactaaaaaggatctagggttgggatcaattacaacccaggaatcagaatccaatatattagatatagatctgcgccctgccagcgcatggactttgtacgctgtagccaccacattcgtcacgccgatgttgcgacattcgattgaaaacagtagcgtgaacgtcagtttaaccgctatcgcgaaccaggcaacagttttaatggggctaggaagggggtggccattatcgaaaatggacattggcgtacctctactagcaataggctgttactcgcaggtcaaccctatcacacttacagccgcactcttgctattagtagcgcactatgccataataggacctggactacaagccaaagctactagagaagcgcagaaaaggactgcagctggaataatgaaaaatccgacagtagacggaataacggtgatcgatctagaaccaataccatacgatccgaaattcgaaaaacaacttggccaagtgatgcttttagttctatgtgtaacccaagtattaatgatgagaacaacatgggcactgtgcgaggcattaacattagcaactggccctatttccactctctgggagggaaatccggggagattttggaatacgacaattgcggtatcaatggctaacatatttcggggttcatacttagctggagctgggttactatttagcattatgaaaaacactactaatactagacgtggaaccgggaatatcggagaaacactaggcgagaaatggaaaagcagattaaatgcattggggaaaagtgagttccaaatctataagaaatctggaatacaggaagtcgacagaacattggcaaaagaaggaatcaaaagaggagaaactgatcaccacgctgttagcagaggatccgctaaactacgatggttcgttgaaagaaacatggttacaccggaaggaaaagtagtcgacttaggttgtggaagagggggttggtcttactattgcggcggactcaaaaatgtacgggaagtaaaaggattaaccaaaggaggtccaggtcatgaagaaccaattccaatgagtacatatggttggaatttggttagactacagtcaggagtggatgtgtttttcactcccccggaaaaatgtgatacgcttttatgcgatataggcgaatcaagtcctaatccaacaatcgaagccggaaggaccctgagggtccttaacctagtcgaaaactggttaaataacaatacacaattttgcgtaaaagtacttaatccatacatgccatcagtaatagagaaaatggaaacattgcaacgaaaatacggcggagccttagtaagaaatcctctatcgagaaattctacgcatgagatgtattgggtatcaaacgcgaccggaaatatagtgtcgagtgtaaacatgataagccgaatgcttattaacaggtttacaatgaagcacaagaaagccacctacgaaccagatgtagatctaggtagtggaacacgaaatattggtatagaaaacgaaatacccaacctcgatatcataggaaagcgtatagaaaagatcaagcaagagcatgaaacatcatggcattacgaccaggaccatccttataagacttgggcataccatggatcatacgaaaccaaacagacaggttcggcatcgagtatggtaaatggagtagtcaaattgcttacaaagccatgggatgtcgtacccatggtaactcaaatggcaatgaccgatacaacaccgtttgggcaacaacgagtgtttaaagaaaaagtggataccagaacacaagaacccaaagaaggaactaagaaattaatgcgcataacagcagaatggttatggaaagaactaggcaagaagaaaacacccagaatgtgtactagggaggaatttacacgtaaagtccgtagcaatgcagcacttggtgccatcttcacggacgagaacaaatggaagtccgcgagagaggcggttgaagacagtcggttctgggaattagttgatagagaacgaaacctacatcttgaagggaaatgcgaaacatgtgtttacaacatgatgggaaaaagagagaaaaagctaggcgagttcgggaaagctaagggatcacgtgcgatatggtacatgtggttaggggcacgatttttagagttcgaagcccttggatttttaaatgaagaccactggttcagtcgaggaaacagtctaagcggcgttgagggtgaaggcctacataagctcggatatatcttacgtgacgtctcaaagaaagaaggtggggcaatgtatgctgacgatacagcagggtgggatacacgcattacattagaagatcttaaaaatgaagaaatggtaacaaatcatatgaaaggcgaacataagaaactagctgaggcgatatttaaattaacatatcaaaataaagtggtgagagttcagcgacctaccccaagaggaacagttatggatattataagccgtaaggatcagagaggcagtggtcaagtaggtacatacgggctgaacactttcaccaacatggaagcccagttaatacgccaaatggaaggagaagggatttttaagagtatccaaagacttaccgtgacagaagaaatagctgtacaaaactggctcgcacgtgttggacgagaaagactatcacgaatggctatctcaggcgacgactgtgtggtaaagccattagatgaccgatttgcaagtgctctcattgcattaaacgacatgggaaaagtacgaaaggatatacaacagtgggaaccatctcgaggctggaatgattggacacaagtaccattctgttcgcatcattttcacgagctagtaatgaaggatggtagggttcttgtagttccatgcagaaaccaagacgagctgattggacgcgctagaatatcgcaaggggcaggctggagtttaaaagaaacagcctgcctggggaaatcgtatgctcaaatgtggactctgatgtactttcatagacgtgatttacggttagccgcgaatgcaatttgtagcgctgtacccagtcattgggttcccacatctcgaaccacttggagcattcatgctaaacacgaatggatgacaacggaagacatgctggccgtctggaatagagtatggatccaagagaatccttggatggaagataagaccccggtagaaagctgggaagaggtgccatatttaggaaagcgtgaagaccaatggtgtggctccttaataggactcacctcaagggcaacatgggctaaaaatatacaaacagcaataaaccaagtccgatctttaataggcaacgaagaatataccgattacatgccgtccatgaaacgattcaggaaagaagaggaagaggcaggagtgctgtggtag

SEQ ID NO: 22590 - RNA, 9876 nt, synthetic construct
  misc_feature 1..9876: note = derived and/or modified CDS sequence (opt6) from DENV-2__EU687215__SS-prME
  source 1..9876: mol_type = other RNA
accgcaggagtaataatcatgttgatcccaacagctatggcgttccatttaacaactaggaatggtgaaccacacatgatagttggtaggcaagaaaaaggtaagagtctgctgtttaaaaccgaagacggtgtaaatatgtgtaccttaatggccatagacctaggagagttatgtgaggacacaatcacatataaatgccccctattaaggcagaatgaaccggaggatatagattgctggtgtaattccacttctacgtgggtcacgtacgggacatgtactacaactggcgagcatcgcagggaaaaaagatccgtagccctagttccacatgtaggaatgggactcgaaacacgcacagaaacgtggatgagttccgaaggcgcttggaaacacgtccaacggatcgaaacatggatattgcgacaccctggatttacgatcatggcggcgatcttagcatatactatcggaacaactcacttccagcgggccctaatatttatactattaaccgcagtggctccaagtatgacaatgcgatgtataggcatttcgaaccgtgattttgtggaaggagtctcaggaggtagttgggtagacatagttttggaacatggttcctgtgttacgactatggcaaaaaataagccaactctagacttcgaactaataaaaaccgaagcaaaacaacccgcaacactaagaaaatattgcatagaagctaagttaacgaacacaacaactgaatctcgttgcccgacacaaggcgaaccttctctgaatgaagaacaggataaaaggttcatttgtaaacatagcatggtcgatagaggttggggtaatggatgcgggctgttcggaaagggcggaatagtgacgtgtgccatgtttacctgcaaaaaaaatatggaaggaaaagtagttctgcctgaaaatcttgaatatactatagtaataacaccacactccggcgaagaacacgcggtaggcaacgatacaggtaaacatggcaaggaaataaagataacaccacaatccagcattacggaggcagagctcacaggctacggcactgtaacaatggaatgttcacctcggactggtctagatttcaatgaaatggttctactacaaatggaagacaaagcatggttagtccacaggcaatggttccttgacctacctttaccttggctcccaggggcggatacacagggaagcaactggatacaaaaagaaaccctagtcacgtttaaaaacccacatgcaaagaaacaagatgtggtcgtactaggaagtcaagaaggcgcaatgcataccgccctaactggagctaccgaaatacagatgagctcaggtaatttactttttacggggcatctcaaatgccgacttcgaatggacaaactacaactaaaaggtatgagttattcaatgtgcacaggaaaatttaaaattgtgaaagaaatagcagagacccagcatggtaccattgtaatacgagtacagtacgaaggtgatggtagtccctgtaaaattccatttgaaatcatggatttagagaaaagacacgtattaggaagactaatcactgtaaacccaatcgtaacagaaaaagactctccagtcaatatagaagccgaaccaccgtttggagactcttacataattattggcgttgaacctggccaattgaaattgaattggttcaaaaaaggaagcagcattggccaaatgtttgaaacaacaatgaggggggccaaacgaatggccattttgggtgatacagcgtgggatttcggaagtctcggcggggtatttacatctataggtaaggcattacatcaagtgttcggagcgatttatggtgcagcatttagcggagtctcatggactatgaaaatactgatcggagtcattattacttggatagggatgaacagcagaagtacgagtctgagcgtatctttagtcttggtaggagtagtaactctatatttaggtgtaatggtacaagccgatactggatgtgtagtaagttggaaaaacaaggaactaaaatgtggatcaggaatatttataacagacaatgtacacacatggactgaacaatacaaatttcaaccagaatctccatctaaattggcttcagcgatacagaaagcacacgaagaggggatatgtggtataagatcagttactaggttggaaaatttaatgtggaaacaaatcacgcctgaactaaaccatattttgtcagagaatgaagtcaaacttaccataatgactggagacataaaggggataatgcaagcaggaaaacgttctctaagacctcagcctacagaactaaaatattcgtggaaaacatggggtaaagcaaaaatgctttcaacagaatcccataaccaaacatttttgatagatggaccggagacagcggaatgccctaatacaaacagagcgtggaacagtctcgaagttgaagactatggatttggtgtcttttcaacaaatatatggctaaaacttagagagaaacaagatgttttttgcgattcaaaactcatgagcgccgcaataaaagacaaccgagctgtacacgcagacatgggatactggatagagtctgcactgaacgacacgtggaaaatggaaaaggcatcatttatagagataaaatcatgtcattggcctaaatcccatactttgtggtcgaacggagtactcgaatctgagatgattattccaaaaaacttcgcaggaccagtttctcaacacaattaccgacctggataccacactcaaacagcaggcccctggcatcttggtaaattagagatggattttgatttttgcgaaggaacaaccgtagtcgtgacagaagactgtgggaacagaggaccatctctaagaacgactacggccagtgggaagttgataactgagtggtgttgtagatcatgcactttaccacccttaaggtatcgaggtgaggatggttgttggtacggtatggaaattagaccattgaaagaaaaagaagaaaacttagttaactcactagtgaccgctggtcacggccaaatagacaatttcagtctaggagtattgggaatggcactattcctagaagaaatgttgcgcacaagagtaggtacaaagcatgctatactcctagtcgccgtgagcttcgtaaccttaatcacagggaacatgtcattccgagatctcggaagagtaatggttatggttggtgcgacaatgacggatgacatcggaatgggagtaacatatcttgcactcctagctgcttttaaagtgcgaccaacatttgcagcaggactattactaagaaaactaacttcgaaagaacttatgatggcgaccataggaattgcactcctctctcagtcgactatccctgagacaatattagaacttactgatgccttggcactgggaatgatggtgttaaaaatagttcgtaacatggagaaataccaattggcagttacaataatggcaatctcttgcgtccctaatgccgtaatcttacagaacgcctggaaagtgagctgtacaatcttagcggcagtgtctgtttcaccgttattattaacctccagccagcagaaagcagattggattccgctcgctttaacaattaaagggttaaacccaactgctatatttttgactaccctgtcccgcacttcaaaaaaacgatcttggccattgaacgaagctgtaatggcagttggtatggtatcaatcttagcgtcctctttactaaaaaacgatataccaatgacaggtccgctggtcgcaggtggactgctcaccgtatgctatgtcctaaccggcagatctgcagatcttgaattagaacgcgctgcggacgttaaatgggaagaccaagcggaaataagtggatcatcacccatcttgtctatcactatatctgaagatggaagtatgagcattaagaatgaggaggaggaacatacattaacaatcttaattaggacaggcttattagtcatctcgggagtgtttccagtatccatacctatcacagcagctgcatggtatctatgggaagttaaaaaacagagagctggagttctatgggatgtgccttctcctccccccgtaggaaaagctgaactagaagacggagcttatagaatcaaacaaagaggtattttcggatacagtcagattggggcaggagtatataaagaaggtacattccacactatgtggcacgtaaccagaggtgcagtattaatgcatagagggaaacgtatagaaccatcttgggccgatgtcaaaaaagacctaatttcctatgggggaggctggaaactagaaggtgaatggaaggagggagaggaagtgcaggtacttgcgcttgagccaggtaaaaacccacgagcagttcaaacaaagccagggctttttaaaactaaaactggaacgattggagcagtctccctggattttagtcctggcacatccggttcacccatagtggataggaaaggtaaagttgtggggttatatggaaatggagtcgttacacgttccggggcatatgtgtcggcaatcgcacaaacagaaaaaagcatcgaagacaatcccgaaattgaggacgacatattccgtaaaaagcgcctcaccattatggatctacacccgggagctggtaaaacgaagaggtatttgcctgctatagttagggaagccattaagagaggacttagaacgctgattcttgcaccaaccagagtagtggcagctgaaatggaagaagccctaaggggtctgcctatcaggtaccaaacacctgcaattcgtgctgagcatacaggtcgggaaatcgttgatttaatgtgtcatgccacttttacgatgaggctacttagtccagtgagggtgcctaactataatttaataataatggacgaagctcatttcacagatccagcctcaatagctgcccggggatatataagtacgagggtagaaatgggcgaggctgccggaatattcatgactgctaccccaccaggaagccgagatccattcccccaatctaacgcaccaataatggacgaagagagagagatcccagaaaggagctggaattcaggccatgaatgggttacagattttaaaggaaaaacagtctggttcgtaccctcaataaaggccggtaatgacatagctgcctgccttaggaagaacggaaaaaaagtgattcaacttagtagaaaaactttcgacagtgaatatgtaaaaactcgagccaatgattgggatttcgttgtcactacagatatctcagaaatgggggctaatttccgtgcagaacgtgtaatagatcctaggcgttgtatgaaacccgtgattttaacagatggggaagaacgagtcatacttgctggtccaatgcctgtcacacattcaagtgcagctcaaagaagaggaaggatcggcagaaacccaaaaaacgaaaatgaccagtatatatacatgggcgaaccgttagaaaatgacgaagactgtgcgcactggaaagaagcgaaaatgcttttggacaatataaacactccagagggtattattccaagtatgtttgaacctgaacgagagaaggttgacgcgatcgacggagaatatcgcctaagaggtgaagccaggaaaacgtttgttgacctaatgcgtagaggtgatttaccagtatggttggcatatcgagtcgcagcagaaggtataaattacgctgatcgtagatggtgctttgacggtatcaaaaataatcagatactggaagaaaacgttgaggtggagatatggactaaagagggagaaagaaagaaacttaagcctcggtggctagacgcaaggatatattccgacccacttgccttaaaagagtttaaagaatttgcagcagggaggaaaagcttaaccctcaatttgatcaccgaaatgggaagactcccgacatttatgacacaaaaagctagggatgctttagataatctagcggtgctacatacggcagaagttggtggacgagcatataaccatgcactatctgaattaccagagacattagagacactgttgttactaacccttttagcgaccgtaactggaggtatattcctatttctaatgtccggtaagggaataggaaagatgacacttggtatgtgttgcataattactgcaagcatactcctatggtatgcacagattcagcctcactggatagcagcgagcataatattagaattcttcttaatagtgcttttgattccagaacctgaaaaacagcgaactccacaagataatcaactcacttacgtagtaatcgcgatactgaccgtagtagcagctacaatggcaaatgaaatgggtttcctagaaaagactaaaaaagatctggggttgggatctatcacaacacaggaaagtgaaagtaatattttagatatagatctacgccctgcatcggcttggaccctatacgctgtcgcgacggcgttcgtaactccaatgctacgacacagtattgaaaattcaagcgtgaacgtatctctaacagcaatagcaaatcaggcaacagtccttatgggcttgggacgaggatggccactttcgaaaatggacataggagtcccacttttagcaatcggttgttactcacaagtgaacccaataactttgacagcggcattactgctcctcgtggcacactacgcaattataggccctggactacaagcaaaagcaactagggaggcacaaaaacgcaccgcagcagggataatgaaaaacccaaccgtcgatggaataactgtaatagacttggaaccaataccttatgacccaaaatttgaaaaacaactaggtcaggttatgcttctagttctctgtgtcactcaggtattgatgatgcgcacaacttgggcattgtgcgaagcattaaccctagcgacaggtcctatatcgacattatgggaaggtaaccctggaaggttctggaatactactatagccgtatccatggctaatatttttcgtggcagttatctcgccggagcaggactcctattctcgattatgaaaaatacaacaaacaccaggcggggtactggtaatattggtgaaacgttaggcgaaaagtggaaatcacgattaaacgcgttaggaaagtctgagtttcagatatacaaaaaaagtggcattcaagaagttgatagaacgttagcaaaagaaggtataaagagaggggaaacagatcatcatgcagtatctagaggtagcgctaaattacgctggtttgtagaacgcaatatggtaacgccagagggaaaagtagtcgatctggggtgtggtagggggggatggtcttactattgcgggggccttaaaaatgtaagagaggttaaggggttaacaaaaggcgggccaggccacgaagagccgatcccaatgagtacgtacgggtggaacctagttagactgcagtccggagtcgacgtattctttacccccccagaaaaatgtgacacgttattatgcgacataggcgaaagcagccccaaccccactatagaagctggaagaactctcagagtactcaaccttgtagaaaactggttaaacaataatacacagttttgtgtaaaagtcctcaatccatacatgccaagcgttattgagaagatggaaaccctccaacgtaagtatggtggtgcacttgtcagaaatcccctaagtagaaacagcactcacgaaatgtattgggtaagtaacgctacaggtaatatagtatccagcgttaatatgataagcagaatgttaattaacaggtttactatgaaacacaagaaagcaacttatgaacccgatgtagatttgggtagtgggactagaaatataggaatcgagaacgaaattcccaacttagacatcataggaaaaagaattgaaaaaataaaacaggaacacgaaactagctggcactacgaccaggatcatccatataaaacttgggcctatcatggcagctacgagacaaaacaaaccggttctgccagctcaatggtaaacggtgtggtaaaactactgactaaaccgtgggatgtagttccaatggtcacacaaatggcaatgacagacacgacaccttttggtcaacaaagagtgttcaaggaaaaagtggatactcgtacacaagaacctaaagagggtacaaaaaaacttatgaggatcacagcggaatggttgtggaaagaactgggtaaaaaaaagacgcccaggatgtgcacacgggaagaatttactaggaaagtacgatcaaatgcagcattgggcgcaattttcaccgatgaaaataaatggaaatctgctagagaagcagttgaagacagtagattctgggaattagtggatagagagaggaacctacatcttgagggaaaatgcgaaacttgcgtttataatatgatgggcaaacgggaaaaaaaattaggggaattcggaaaggcaaaaggcagtcgtgctatttggtacatgtggttaggtgcccgatttttggaatttgaggcattaggttttctgaatgaagaccattggttttcaaggggtaatagcttatcaggcgtggaaggagagggactacataaactaggatacatacttagagatgtaagtaagaaagaaggtggagcaatgtacgcagatgacacagcaggttgggatacaaggataaccttggaagacttaaaaaatgaagagatggtaaccaatcatatgaaaggcgagcataagaaactagcagaagctatattcaaattaacgtatcaaaataaagtagtccgagtccaaaggccgacacccagagggacagtaatggatataatttctcgtaaagatcaaagggggagcggacaagtcgggacttacggcctaaatacgttcaccaatatggaagctcagttaatcagacaaatggagggagaaggaatctttaaatctatccagcgactaactgtgaccgaggaaatagcagtacaaaattggctggcacgggtaggtcgggagcgcctatcacgcatggctatctcgggagatgactgtgttgtcaagccgctagatgacagattcgcttcggccctcacagcactaaatgacatgggtaaggttcgcaaagacattcagcaatgggaaccgtccaggggatggaacgattggacgcaagtaccattctgcagccaccacttccacgaattagtaatgaaagatggtagagttctagttgttccctgtagaaaccaagatgaacttataggccgggctaggataagccagggtgcaggatggtctcttaaggagacagcttgtctaggtaaaagttacgcacagatgtggacgttaatgtattttcacagacgcgatctaagactagcggctaacgctatatgcagcgctgtcccttctcattgggttcctaccagtagaacaacctggtcaatccatgcaaaacatgagtggatgacaacagaagatatgttagctgtatggaatagggtatggatacaagaaaatccttggatggaggacaaaacgccggtggaatcttgggaagaagtcccctatctcggaaagagggaagatcaatggtgcgggagtctgataggtctgacctcacgtgctacttgggcaaaaaatatacaaacagcaatcaaccaggtacgatcactaataggaaatgaagagtataccgactacatgcctagtatgaaaagatttcgaaaagaggaagaggaagccggagtactctggtaa

SEQ ID NO: 22591 - RNA, 9876 nt, synthetic construct
  misc_feature 1..9876: note = derived and/or modified CDS sequence (opt6) from DENV-2__EU687216__SS-prME
  source 1..9876: mol_type = other RNA
acggctggcgttatagtaatgcttattccaactgctatggcttttcacttgacaactagaaatggagaacctcatatgattgtggggcgacaagaaaaaggaaaatctttactatttaaaactgaagatggtgttaatatgtgtactttaatggcaatagatctaggagaactatgcgaggatacaataacatataaatgcccgcttttgcgtcaaaatgaacccgaagacatagattgttggtgcaatagtacgtcaacttgggttacctatgggacatgcacaacaactggtgagcacagaagggagaaaagaagtgttgcattagtccctcatgtaggaatgggtcttgaaactagaacagaaacatggatgtcttccgagggagcatggaaacatgttcaaaggatagaaacgtggatattacgtcaccctggttttacaataatggcagcaattctggcatataccataggaactacacactttcaaagagctctaatatttatactattaaccgcagtagcaccaagtatgactatgagatgcataggcatatccaatcgagatttcgtcgagggagtgagtggaggctcatgggtagacattgtactagaacatgggtcttgtgtaactaccatggctaaaaacaaacccacactggattttgagttaattaaaacggaagcaaaacaaccagcaactttgaggaaatactgcattgaagcgaaattaaccaacactacaactgaaagtagatgtccgacacagggtgaaccttccctaaacgaagaacaagacaaacgtttcatatgtaaacattcgatggttgatcgaggctggggtaatggatgtggcctatttggtaaaggcggtatcgtaacgtgtgcaatgttcacatgcaagaaaaatatggaaggaaaaatagtgcaaccagaaaacttagaatacactatagttatcactccacattcaggagaggaacacgcagtaggaaatgacaccggaaaacatggaaaagaaattaaaatcaccccacaaagtagcacaacagaagccgagttaacaggttatggcaccgtcactatggagtgctcacctaggacggggttggactttaatgagatggtgctactccaaatggaggataaagcgtggctggtccacaggcagtggtttttagacctaccactaccctggttaccaggggctgatacacaaggttctaattggatccaaaaagaaacgctagtcacttttaaaaatcctcacgcgaagaaacaggatgtggtagtattaggatctcaggagggtgccatgcacacggcattaacaggtgcgaccgaaatccaaatgagctcagggaatctcttatttacggggcatttaaaatgtcgactcagaatggataaactacaactcaaaggcatgtcatatagtatgtgtactggaaaatttaagattgttaaagaaatagccgaaacgcaacatggtacaatagtaataagggttcaatacgaaggagatggctcaccctgtaaaataccctttgaaattacagatctagagaaaaggcatgttttaggaaggttaataaccgttaaccccatagttacagagaaagactctccagtaaatatcgaagccgaaccgccgttcggggactcatatataattgttggagtggaaccaggacaactgaaactaaactggtttaagaaaggaagctctatcggacagatgttcgagacaacaatgcgtggagctaaaaggatggcaatactcggtgatactgcctgggattttggcagcctcggaggtgtcttcacgagcataggtaaggcattacaccaggtattcggagcaatctacggagcagctttcagtggagtatcgtggacaatgaaaatattgattggtgtaataataacatggataggtatgaatagcaggtcaacctccttatccgttagcctagtcttagtgggggtagttacactatatttaggagcgatggtccaagccgattcaggatgtattgtgtcgtggaagaacaaagaactaaaatgcggaagtggaatctttataactgataacgtacatacatggacagaacaatataaatttcaaccagaaagtccatctaaacttgcgagcgctattcaaaaagcacacgaagaaggaatatgtggaataaggtcggttacaagactagagaatctaatgtggaaacaaatcacaccggaattaaaccatattctatcggaaaatgaagtgaaactaacaattatgaccggagatataaaaggcatcatgcaagctggcaaacgtagcttaagaccacaacccacagagttaaagtattcatggaaaacgtggggaaaagctaagatgttaagcacagaaagccataaccaaactttcctaatcgatggtcctgaaactgcagagtgtcccaataccaacagagcttggaactcattagaggtagaggactatggtttcggtgtgtttactacgaacatctggctaaaacttcgtgaaaaacaagatgtattttgcgacagcaaactgatgtcagcagctatcaaggacaatagggctgttcacgcagacatgggttactggatagaatctgcccttaacgatacatggaagatggagaaagcgtcgttcatagaagttaaaagttgccattggccaaaatcccacacgctctggtcgaacggcgtcttagagtccgagatgataatccccaaaaatttcgcaggtcctgtttcacaacataactacaggccaggctatcatacacagactgccggaccgtggcacctgggtaagttggaaatggattttaacttttgcgaagggacaaccgtagttgttacagaagactgtggaaaccgaggcccatctttaagaacaactacagcttcaggaaagctaataacggagtggtgttgtaggtcatgtactttaccacctttacgctatagaggtgaagatgggtgctggtacggcatggaaataagacctctcaaggaaaaagaggaaaatttggttaacagcttagtgacagcgggtcatggccaaatagacaattttagtctaggagtattgggtatggcactttttctcgaggaaatgcttaggacgagggtaggcacaaaacacgccatattactcgtagccctctcatttgtcacgctaatcaccggaaacatgagctttagagacctagggcgtgtaatggtaatggttggagctacaatgaccgatgatatcggtatgggcgtaacatatttagcgctactcgccgcattcaaagttagaccaacgttcgctgcgggtttgttgctcagaaaattgacgtcaaaagaactaatgatggccactattggcatcgctctactctcacaaagtacactgcctgaaacaatcttggaactgactgatgcacttgctctaggaatgatggttttaaaaatagttagaaatatggagaaatatcaactagccgttacaattatggcgatttcatgcgtccccaacgccgtcattctacaaaacgcctggaaagttagttgtaccatactggcagctgttagtgtttctccattattacttacatcatcacaacaaaaagcggattggatcccactagctcttacgatcaaagggttaaacccaacagccatctttctaaccactctaagtagaacatctaagaaacgaagttggcctttaaatgaagcaattatggctgttggtatggtaagtattctggcatccagcctccttaaaaacgacattccaatgacgggtcctctagtggccggagggttactaactgtatgctatgtacttactgggagaagtgccgatttagaactggagcgagccgctgacgttaaatgggaagaccaagccgaaataagtggaagttctcctatactaagcataacaatctctgaagatgggagtatgtccattaaaaatgaggaagaggaacaaacactcactattcttatccgaactgggctgttagtcatttcaggcgtttttcccgtcagtattcctattacagcggccgcatggtatttatgggaagtgaaaaagcagagagctggggtgctctgggacgtaccttcaccgcctcctgtagggaaagcagaacttgaagatggcgcgtacagaataaaacaacgagggattcttggttatagccaaataggagccggtgtatacaaagaaggaacttttcacacgatgtggcatgtaacaagaggagcggttttaatgcataggggaaaaagaattgaaccttcatgggcagacgttaagaaagatttgattagttacgggggcggttggaaattagagggagagtggaaagagggtgaggaggtacaagtactagcactcgaaccagggaagaatccacgtgcagtccagacaaaaccgggaatatttaaaacaaatactgggacaattggtgctgtcagtttagacttttcgcctgggacaagcggttcaccgatagttgataggaaaggcaaagttgtaggcttgtacggaaacggcgttgtaacgcgatccggagcttatgtgtcagcaattgcgcaaactgaaaaatcaatagaagataacccagaaatagaagatgacatttttagaaagaaacgccttaccataatggacctacatcctggagccggtaaaaccaaaagatatttacctgccatagttcgggaagccataaaaagaggtttgcgcacgttaatattggccccaactcgcgttgttgctgctgaaatggaagaagctctgcgtggcctaccaataaggtatcagactccagcgatacgagctgagcacacaggtagggaaatagtagatctaatgtgccatgcgacttttacaatgcgtctgttaagcccagtgagagtacccaattataatcttataataatggatgaggctcattttactgatcctgcaagtatagcagctaggggttacattagcacgagggtcgaaatgggagaggcagcgggaatttttatgacggcaacaccccctggatcaagggatccatttccgcaaagtaacgcgccaatcatggatgaagaacgtgaaatacccgaacgcagctggaactcgggtcatgaatgggttacggatttcaaaggtaagacagtatggtttgtaccaagtataaaagcgggtaatgatatcgcagcatgccttaggaaaaatggtaagaaggtaatacaattaagtcgtaaaacatttgattccgagtatgtaaaaacccgcgccaacgattgggattttgtagtaactacagatatttcggaaatgggcgcaaactttaaagcagaacgtgtaattgatccacgaagatgtatgaaacccgtaattctaacagatggtgaggaaagggttatattggcaggacccatgccagtaacacacagtagtgcagcccaaaggaggggacgaattggtcgcaatcccaaaaatgaaaatgatcaatatatctacatgggagaaccactagaaaatgatgaagattgtgctcattggaaggaagctaaaatgcttctagataatataaatacaccagaagggatcattccaagtatgtttgaaccggaaagggaaaaggtagatgcaatcgatggtgaatacagacttagaggagaagcaagaaagacatttgtagaattaatgagaagaggagacctcccggtctggctagcgtataaggtagctgcagaaggtatcaactatgcagatcgtaaatggtgctttgacggaataaagaataatcaaatactagaagaaaatgtagaagttgaaatatggacaaaagaaggcgagcgtaagaaacttaagcctagatggttggatgcacgtatatattcagatccactagcgctaaaggagtttaaagagtttgctgccggtaggaaatcattgacattaaatttaatcacagagatgggccgtcttcccacgtttatgacacaaaaagctcgcaacgctctggacaacttagctgtgttacatacggcagaagtaggagggagggcgtataatcatgctttaagcgaactaccagaaactctagaaactcttctactactaacgctactagctacagtgacaggtggcatatttttgttccttatgtcaggaaaaggagtaggaaaaatgactcttggtatgtgctgtattatcacagcatctattcttctatggtacgctcagattcaaccacactggatcgcagcaagtataattctcgaatttttccttatcgtccttttgatcccagaaccagaaaagcaaagaacgccccaagataaccaactaacatacgtagttatagcaattttaacagtggttgcggccacaatggcgaatgaaatgggcttcttagagaaaacgaagaaggatttaggctttggtagcatcacaacacaagaatcggaatccaacatcctggatatagacctacggcccgcatcagcctggactttgtatgccgttgcgacgaccttcataacacccatgctacgtcatagcatagaaaattcatctgtgaatgtcagccttacagccatagctaatcaggcgacggtcttaatggggttaggaaaaggttggccactgtcaaaaatggatataggcgtgccgctattggctataggatgttacagccaagtaaatccgataacactaacggcggcccttctactcttagttgctcattacgcaattattggtccaggattacaggccaaagcaactagagaagcacagaaaagagctgcagctggaatcatgaagaatccaaccgttgacggaataacagttattgacttagaaccaattccgtacgaccctaaatttgaaaaacaactcgggcaagttatgttattaatcctctgcgtcacgcaagtattaatgatgcgaactacttgggcattatgcgaagcattgacactagctaccggtcctatttcaacgctgtgggaaggtaacccgggtcgtttttggaacacaacaatagctgttagtatggcaaatatatttagaggttcctatctcgctggagctggactcctattttcgataatgaaaaacacaactaatacccggcggggcacaggaaacgtaggcgaaactctaggtgagaaatggaaaagccggcttaatgcgcttggaaagtcagaatttcaaatctacaagaaaagtggaatacaagaagtagacagaactttagctaaggaggggataaaaagaggagaaactgatcaccacgcggtaagtaggggaagcgcgaaactgagatggttcgtagagcggaatatggtaacaccagaaggcaaggtagttgacctaggatgcggacgcggcggttggagttattattgcggcggattgaaaaatgtaagagaagtaaaaggtctaactaaaggtggccctggacacgaagaacctatacccatgagcacatatgggtggaatctagtccgactacaaagcggagtagatgtattctttacacctccggaaaaatgtgacactctactatgcgacataggcgagagcagccctaatccaaccatagaagcaggaagaacattacgagtacttaacttggtggaaaactggcttaataacaatacccaattttgcataaaagtcttaaatccttatatgcccagtgttatagagaaaatggaaacattgcaaagaaaatacggtggcgctcttgtgcgtaatccattgtctcgaaactccacgcacgaaatgtattgggtctcaaacgcaacaggtaacatcgtgtcttccgtgaatatgattagtcggatgttgataaatagatttacaatgaagcacaagaaagcgacatatgaaccagatgtagacctcggtagtggaacgcgaaacattggtattgagtcagaaataccaaacctagacatcatagggaagagaatagaaaagatcaaacaagaacatgagacctcatggcattatgaccaagaccatccatataaaacatgggcctatcacgggtcctacgaaacaaaacaaacagggagtgcctcatccatggtaaacggggtagtgagattattaacaaaaccctgggatgtagtaccaatggtaactcaaatggcaatgacggacactaccccatttggtcaacaaagagttttcaaggagaaagtggacacgagaacacaagaacccaaagaaggaaccaagaaacttatgaaaattacagcagagtggctgtggaaggaactaggaaaagagaaaactccccgtatgtgtactagggaagagttcactagaaaagtgcgttcgaatgctgctctcggagcaattttcacggacgaaaataaatggaaaagtgctagagaagctgttgaagatggtagattctgggaattagttgatcgagaaaggaacctgcacctcgagggaaaatgtgaaacttgtgtatataatatgatgggcaaacgagagaagaaattaggagagtttggtaaagcaaagggttccagagccatttggtacatgtggctgggggccaggtttttagagtttgaagcactaggctttctaaatgaggatcattggttttctcgcggcaacagtttatcgggagtcgagggagagggacttcatcggttaggctacatactgagagaagtaggcaagaaagaaggaggagcaatgtatgcggacgatacagcaggatgggatacaagaataactctcgaggaccttaaaaatgaagaaatggtaactaatcacatgaaaggcgaacacaagaaactagcggaagcaatattcaagctaacgtatcaaaataaagtggtgagggtgcaaagaccgacgccgcgaggaacggttatggacatcattagtagaaaagatcaacgaggttcaggtcaagttggtacctacggtctcaatacatttactaatatggaagcacaattgattcggcaaatggaaggcgaaggaatctttaaaagtatacaacatttaaccgcgacggaagaaatagcagtacaaaattggttagctcgtgtgggacgggagcgattaagtaggatggccatttcaggtgatgattgtgttgtaaaaccaattgatgaccgattcgcatctgcactcacagctttaaatgacatgggtaaagtcaggaaggatatacaacaatgggaaccttcgagaggatggaacgattggactcaagtgccattctgctctcatcattttcatgagttggtgatgaaggacggtagagttctagtagtgccgtgtagaaatcaagatgaactaataggacgcgcgagaatatcacaaggtgcaggctggtcattgaaggaaacggcctgccttggaaaaagctacgcgcaaatgtggactctcatgtatttccacagacgagatctcagactagccgcaaatgcgatctgttcagcagtcccttcacactgggtaccaaccagcagaaccacatggtccatccatgcaaagcatgaatggatgacgacggaggatatgttagccgtatggaaccgagtatggatacaagaaaatccctggatggaggataaaacaccagtggaaagctgggaggaagtgccgtatcttggaaaaagagaagatcaatggtgtggctctctgataggcttgacaagtagagctacctgggccaaaaatattcaaacagcaataaaccaggtgcgcagtctcatcggcaatgaagagtatactgattacatgccgagcatgaaaaggtttagacgagaagaagaggaagcgggagtcctctggtaa

SEQ ID NO: 22592 - RNA, 9876 nt, synthetic construct
  misc_feature 1..9876: note = derived and/or modified CDS sequence (opt6) from DENV-2__EU726770__SS-prME
  source 1..9876: mol_type = other RNA
accgctggtgttataattatgttaattccaacagcaatggcatttcacttaactacaagaaatggagaaccgcatatgatagtaggtcgtcaggaaaaaggaaaatctttattatttaaaacggaagatggtgtaaacatgtgtacgttgatggctattgacttaggcgaactgtgtgaagatacaataacatataaatgcccattacttagacagaacgaaccagaagatatagattgttggtgcaatagtacatcgacatgggtaacttatggcacgtgtactacaacaggagaacacagaagagagaaaagatcagtagcattggtacctcatgtcggaatggggctagaaacacgtacagaaacatggatgtcctccgaaggcgcatggaaacatgtgcaaaggattgaaacatggattcttagacatccaggatttaccataatggcggcaatattagcatatacaatcggcacaacacatttccaacgagccttaatatttatcctgctaacagcagtagcgccttccatgacaatgcgatgtattggaataagcaaccgtgatttcgttgaaggagtttcaggagggagctgggtggacatagttttggaacacggcagttgtgtaacgacgatggccaaaaataaaccaacgctagacttcgaattaattaaaacagaagccaaacaacctgctactttacgcaaatactgtatagaagccaaactaacgaacactacgacagagagtcgctgccccactcagggagaaccgtcactaaatgaagaacaggataaacggttcatatgtaaacattcaatggttgaccggggctggggcaacggttgcggcttattcggaaaaggaggtatcgttacgtgcgcaatgttcacttgcaagaaaaacatggaagggaaagtcgtattaccagaaaatttagaatatactatagtgataacaccgcattctggcgaagaacacgcggtaggtaacgatacaggtaaacatggtaaagaaataaaaatcactccccaaagtagcataacggaagcagaattaactggatatgggacggtaacaatggaatgcagtcccaggaccgggctggactttaatgagatggttttactccaaatggaagacaaagcctggctagttcaccggcaatggtttttagatcttccactaccctggctgcctggagctgacacccaaggttccaattggatacaaaaagaaaccttagtaacgtttaaaaaccctcacgctaagaaacaagacgtagtggtactgggatcacaagaaggtgcaatgcacacagctttgaccggagcaactgaaatacaaatgtcatcaggaaatcttctcttcaccggacacttaaaatgtagacttcgaatggataaattacaattgaaaggcatgtcctattctatgtgtactggaaaattcaagatagtaaaagaaatagcagaaactcaacacggaactattgtgatacgagtacaatatgaaggcgatggaagcccatgtaagattccctttgaaataatggatttagagaagagacacgtccttggcagactgattacagtgaaccccattgtcaccgaaaaagactccccagtgaatatagaagccgaaccgccgtttggagacagttacataataatcggagtcgaaccaggacaattaaaattgaactggttcaagaaaggaagttcaattggccaaatgttcgaaacaacgatgagaggcgcaaagcgtatggctatactcggcgacacagcatgggatttcgggagcttagggggagtcttcacatcaattggtaaagcgctccatcaggtgtttggagccatctatggagctgcgttcagcggggtaagttggacgatgaaaatcctgataggagtcatcataacctggattgggatgaacagtcgaagtacaagtctaagtgtaagtttagtcctagtaggtgtcgtcaccttatacttaggagtaatggtacaagctgatacgggatgcgtcgtatcgtggaaaaacaaagagcttaaatgcggtagcgggatattcataacagacaacgtacacacgtggaccgaacagtacaaatttcaaccggaatctcccagcaaactggcgagtgccatacaaaaagctcacgaggagggaatatgcggaataagatctgtgactaggcttgagaatttaatgtggaaacaaataacacctgagcttaatcatatactttcagagaatgaagtaaaacttacaattatgacgggagatattaaaggcatcatgcaggctggtaaacgatctttaaggcctcagccaacggagctgaaatattcgtggaagacatggggtaaagcaaaaatgctatcaacggaatcacacaatcaaactttccttattgacggtcccgaaacagctgaatgtccgaatacaaaccgggcgtggaactcattagaggtagaagattacggtttcggagtctttagcaccaatatatggttaaaacttcgcgagaaacaggatgtattctgtgactctaaacttatgagtgctgcaataaaagataacagagctgttcatgcagatatgggttactggattgaaagcgcattaaatgacacatggaaaatggaaaaagcgtcgtttatagagatcaagtcgtgtcattggcctaaatcacacacactctggtctaatggagtactggaatccgaaatgataatccccaaaaatttcgcaggaccagtatcacaacacaattacagaccagggtaccacacacaaacggccggtccttggcacttaggcaaactcgaaatggacttcgacttctgcgaaggtacaactgtagtagtgacagaagactgcgggaaccggggaccctcattacgcacaactaccgcctctggtaaactaataacagagtggtgttgtagaagctgtaccttgccacctcttaggtacaggggcgaagatggatgctggtacggaatggaaatacgtcctttgaaggagaaggaagaaaatttagtcaattccttggtcacagccggtcacggacaaatagacaacttttcgcttggagtgttagggatggcgttattcttagaggagatgcttcgtaccagggtaggcactaaacacgcaatcttactcgttgccgtcagctttgtcacccttattacaggcaatatgtcctttagggacctaggccgagtaatggtaatggtaggagcaactatgaccgacgacattgggatgggggtgacttaccttgctttattagccgctttcaaagtacgacccacctttgcagccggtctcttattacgcaaattaacttcgaaagaactaatgatggctaccataggcatagctttattaagccaatcaacaattcctgaaactatcttagagctaacagatgctctcgcattgggaatgatggtgttaaagattgtgaggaatatggaaaaataccaattagcagttaccataatggcaattagctgcgtgccaaacgcagttatactacagaacgcctggaaagtatcatgcaccatactagcagcagtgagcgttagcccattacttctgacatcgagtcaacaaaaagcagattggataccattagctctcacaatcaaagggctgaatccgacagcaatatttttaacaactttgtcacgaaccagcaagaagagaagttggccattaaatgaagcggtaatggcagttggcatggtaagcatattggccagtagcttattgaaaaatgatataccaatgacaggccctctcgtcgcaggaggtttattaacagtctgctatgtgctaacaggtagatcggctgatttagagttagaacgggcagctgatgtaaaatgggaagatcaggcggaaatatctggcagctccccgattctcagtattacaatatcggaagatggatcaatgagcattaaaaacgaagaagaagaacatacattgacaatacttattcgaacgggactattagtgataagtggagtttttccagtctccataccgattactgcggcagcatggtacctatgggaagtcaagaaacaaagagctggtgtactttgggatgttcctagtcctcctccagtaggaaaagcagaactcgaagacggtgcctaccgcatcaaacaacgagggatattcggctacagtcagatcggagcgggtgtatataaggaaggcacattccatactatgtggcatgttacgagaggggcagtactaatgcatcgaggcaaaaggattgaaccttcatgggccgacgtaaagaaagatctaatatcgtatgggggaggttggaagctagaaggagaatggaaagagggggaggaggtgcaagtgctggcccttgaacccggcaaaaatcccagagccgtgcaaacaaaacctggactgtttaaaacaaacactgggacgataggtgctgtctctttagactttagccctggcacctctggttccccaatagtagatcggaagggaaaagtagtaggattgtatggaaacggagtagtgacaagaagcggagcatatgtaagtgcgatagcacaaacagagaaaagtatagaagacaatccagaaatagaagacgatatattcaggaagaaaagactaacgataatggacctacaccctggtgcaggaaagactaaaaggtacctacctgctatagtgcgcgaagccataaaacgaggactaagaacgctaatacttgctccaacgcgagtggttgctgccgaaatggaagaagcacttagagggctcccgatacgttatcaaacgccagcaatcagagcagaacataccggtagagaaatagttgacttaatgtgtcatgcgaccttcacaatgcgcttactaagcccggtaagagttccaaattacaatttgataataatggacgaagcacacttcacagatccagcatccatagcagcacgtggatacattagtaccagggtggaaatgggagaggcagcaggtatattcatgacagcaacgccacccggttccagagacccgttcccgcaaagtaacgcgcccataatggacgaggagagagaaattcccgaaaggtcttggaactcaggacacgaatgggttacggattttaagggtaagacggtatggtttgtacctagtataaaagcaggaaatgacattgctgcatgtctaaggaaaaacggcaagaaagtaatacaattaagcaggaagacattcgattcagaatacgtgaaaaccagagcgaatgactgggactttgtagtaacgactgacatatctgagatgggtgccaacttcagagccgagagagtaatagatccacgcagatgtatgaagcccgtcatacttacagatggcgaggaacgtgtaatactagcaggacccatgccagttacacattcctcagcagcacaacgcagaggtcgaatcggaagaaatccgaagaacgagaatgatcaatacatatatatgggtgagcccttggaaaacgatgaagactgcgcacactggaaagaagctaaaatgttgttagataatataaatacacctgagggcataattccatcaatgttcgagccagaacgagaaaaagtagacgccatagacggcgaatataggctgagaggagaagcacgtaagacattcgtcgatcttatgagaaggggcgatcttccagtatggttggcctatagagtagcagcggagggtataaattatgccgatagaaggtggtgcttcgatgggattaagaacaatcagatcttggaggaaaatgtcgaagtagaaatatggacgaaagagggcgagaggaagaaactaaaaccaaggtggctagacgcaagaatttatagcgatcctctagcattgaaagaatttaaagaatttgcagcagggcgtaaatctcttacgcttaatctcattactgaaatgggtagactcccgaccttcatgacacaaaaggctcgtgacgccttggataatctcgcagttctccatacagcagaggtaggtggccgcgcgtataaccatgctctctctgaactaccagagaccctggaaactctgttacttttgaccctccttgcaacagtaacaggagggatatttcttttcttaatgagcggaaaaggaattggtaagatgacattgggcatgtgttgtattattacggcatcaatactattatggtacgcccaaatacaaccacattggattgcggctagtataatacttgagttctttctaatagtgttgttgataccagaacccgaaaaacagaggacaccacaagataatcaattaacatatgtagtgattgcaatactgacggtggtagcagctacaatggcaaacgaaatgggatttctagaaaagaccaagaaagatttaggtctaggaagcatcacaacgcaagaatcagaatcgaatatattagatatagacctacgaccagcatcagcatggacgttgtacgcagtagcgaccactttcgtaacgccgatgcttcggcattcgattgaaaacagtagtgtaaacgtttcgctaaccgcaattgcaaatcaagccactgtgctaatgggcctaggaaggggctggccgttgtccaaaatggatattggcgtgcctttgttggcaatcgggtgctattctcaagttaacccaattacactaaccgcagctctactccttctagtagcacattatgcaataattggaccaggattacaagcaaaagcaacgagagaggcccagaagcgcacggcagcgggaataatgaaaaatccgacagtagatggtataacagtgatagatcttgagccgataccgtatgatcctaagttcgaaaaacaactcggccaggtgatgctcctggtcttatgcgtcacacaagtactgatgatgagaacaacatgggcgctctgcgaagcattaaccctcgcaacaggtcctatatctacactatgggaaggaaatcctggacggttctggaatacaactatagcagtaagtatggccaacatattcagaggatcatatctagcaggagcagggttgttattttcaataatgaaaaatacaaccaataccagaagaggaacaggtaatattggtgagactttaggtgaaaagtggaaatctaggttaaacgcactgggaaaaagtgaatttcaaatatacaagaaatcaggtatccaggaagtcgatagaacgcttgcaaaagaaggaataaaaaggggagaaactgatcatcatgctgtatcaagaggttccgcaaaacttcgctggtttgtggaaaggaatatggtaacacccgaaggaaaggtggttgatttaggctgtggtagaggcgggtggtcatattactgtgggggtttaaagaacgtaagagaagttaagggattaacaaaagggggacctggacatgaagaaccgatacccatgagcacatacgggtggaatcttgtacgactgcaatccggggtagacgtgttctttacgcctccagagaaatgtgatacactactgtgtgacattggagaatctagcccaaatccgaccatcgaagctggacgaacgttaagagtactgaatctagtcgaaaactggttaaacaacaatactcaattttgtgtaaaagtattaaacccgtatatgccaagcgtcatagagaaaatggagacactccagcgaaaatatggaggggctctagttagaaacccactaagcagaaattcaactcatgaaatgtactgggtatcaaatgcaaccggaaatatagtaagtagcgtgaatatgatatcgcgtatgctcataaataggtttaccatgaaacataagaaagcgacatatgaaccggacgtcgatttgggctctgggacaagaaatataggcattgaaaatgagataccaaacttggacattataggaaaaaggattgagaaaataaaacaggaacatgagacatcttggcattatgatcaagaccatccctataaaacctgggcataccatggttcgtacgaaactaaacaaactggcagtgccagtagtatggtgaacggtgtcgtaaaattactaacgaaaccttgggatgtagttcccatggtcacgcaaatggcaatgacagacactactccgtttggtcaacaaagggtctttaaagagaaagtggacaccaggacacaagagccaaaagaaggaactaagaaactgatgaggataaccgctgaatggttatggaaggaacttgggaaaaagaaaacacctcgaatgtgtacccgagaggaatttacaagaaaagttagatccaacgcagcgctcggcgcaatattcactgacgaaaataaatggaagagtgccagagaagctgttgaagactcaagattctgggagctagttgaccgagagcgaaatttgcatcttgaaggcaaatgtgaaacctgcgtttataatatgatggggaaaagggagaagaaattaggtgaatttgggaaagccaagggaagccgcgcgatatggtacatgtggctaggagccagatttctagagtttgaagcgctaggatttttaaacgaagaccattggttttcaagaggtaattcgttaagcggagtcgaaggagagggtctacataagctaggctacatacttagagacgtgagtaagaaagagggaggtacaatgtacgcagatgataccgcaggatgggatacacgcataaccttagaagatttgaaaaacgaggaaatggtcacaaatcatatgaaaggagagcacaagaaactagcagaagctatctttaaactgacctatcaaaacaaagtggtaagggttcagcggccgacaccaagagggactgtcatggacatcataagcagaaaagatcaaagaggcagtggacaagttggtacatacggactgaatacttttacaaatatggaagctcagctaataagacaaatggaaggagaaggcatctttaaaagtatacaaagactaactgttacggaagaaatagcagtacaaaattggctagcacgcgttggaagagaaaggctttcaagaatggccataagcggagatgattgcgtggtcaagcctttagacgaccgtttcgcgagtgccctaactgcactgaacgatatggggaaagtaagaaaagacatccagcaatgggaacccagtaggggctggaacgattggacccaagtcccattttgcagtcatcactttcatgagctagtaatgaaagatggacgggtattagttgtaccatgtcgtaatcaagatgagctaattggcagagcaaggataagtcagggtgccggctggtctcttaaggaaactgcatgtcttggaaaatcatacgcacagatgtggacccttatgtattttcatcgtagagacttaagacttgctgcaaacgccatctgtagcgctgtccccagccattgggtaccaacatcacgcacaacctggagcatacatgcgaagcacgaatggatgacaactgaagatatgcttgcggtatggaatcgcgtttggatacaggaaaatccatggatggaagacaagacacctgttgaatcttgggaagaggtaccttatcttggtaaaagggaagaccaatggtgcggtagcttaattggcctaacttcacgggcgacatgggctaagaatattcaaactgcaattaaccaggtacgcagcttaataggaaatgaagaatatacagattacatgccaagtatgaaaagattccgaaaagaagaggaagaagccggagttctctggtga

SEQ ID NO: 22593 - RNA, 9876 nt, synthetic construct
  misc_feature 1..9876: note = derived and/or modified CDS sequence (opt6) from DENV-2__EU781135__SS-prME
  source 1..9876: mol_type = other RNA
actgcaggggtgataattatgttaataccaacagccatggcttttcatttaactacaagaaatggtgaaccacatatgattgtagggagacaagaaaaaggaaaatctctcctgtttaaaacggaagatggtgtgaatatgtgcacattgatggcaatagatctaggagaactgtgtgaagatacgattacatacaaatgtccgctactacgccaaaatgaaccagaggatatagactgttggtgtaattcaacatcgacatgggtaacatatggtacttgtactaccaccggagaacaccgtcgagagaaacgatcggtggctttagtgcctcatgtgggaatgggacttgagacaagaacagaaacttggatgtcaagtgaaggtgcttggaaacacgttcagagaatcgagacttggattttgaggcacccaggtttcacgatcatggccgcaatcctggcatacaccattggaacaacacacttccaaagagcacttatatttattttacttactgccgtagcgccgtccatgacaatgcggtgcatcggtataagcaatagagattttgtagaaggggttagcggtggatcgtgggtagatattgtactagaacatggttcttgcgtaactacaatggccaaaaataaacctactcttgactttgaattaataaaaactgaggcaaaacaacccgcaacacttcgaaaatattgtatagaagcaaaattaactaatactactacagaatcacggtgccccactcagggggaaccttcattaaacgaagaacaagataaacgcttcatatgtaaacattcaatggtagatcgaggatggggtaacggatgtggtttattcggaaaaggaggaatagtaacttgcgcgatgtttacctgcaagaaaaacatggaaggaaaagtcgtcctgcccgaaaatctagaatatacaattgtaattactcctcattcaggtgaagaacacgctgtcggcaatgacacaggtaaacacggcaaagaaattaaaataacaccacaatcaagcattacggaggcagaattaacaggatatggcactgttacgatggagtgcagccctcgaacaggtttagattttaacgaaatggtcctattacaaatggaggataaagcatggcttgtacataggcagtggttccttgacctgccgttaccatggctgccaggagcagatactcaaggttcaaactggatccagaaagaaactttagtaaccttcaaaaatccacacgccaagaaacaagacgtagtcgtactcggaagccaagaaggagcaatgcacactgcgcttaccggcgcaactgagattcagatgagctccggcaatctccttttcacagggcacttgaaatgtagactacggatggacaaactgcaacttaaaggtatgtcatacagcatgtgcacgggaaaatttaaaatagtcaaagaaattgccgaaacacaacatggtactatcgtaatccgtgttcagtacgagggcgacggtagcccatgtaaaataccctttgaaatcatggacttagaaaaacgacatgtgctgggacggttaattactgtaaacccaattgttacagaaaaagactcacccgtaaatatagaggcggaaccaccgtttggagactcgtatataataataggcgtagaacccggccaattgaaactaaactggttcaagaaagggtcatcaataggacagatgtttgaaacgacgatgcgaggtgcaaaaaggatggccattctgggcgacaccgcctgggactttgggagtttgggcggggtatttacatcaatcgggaaagcactacatcaggtctttggagcaatatatggggctgcattctcaggcgtttcatggacaatgaaaatcctaattggcgtaattataacctggattggaatgaactcgcgtagtacttccttaagtgtgagcttagtattagtgggggtcgtaacattatatttaggagtgatggtacaagctgataccggatgtgtagtgagctggaaaaataaagagctgaaatgtggaagcggaatatttattacagataatgtacatacatggactgaacaatacaaatttcaaccagaaagtcctagtaaactcgcctctgcaattcaaaaagcccatgaagaagggatttgcggaatccgtagcgtaaccagactagaaaatcttatgtggaaacagataacacctgagctaaatcacattctttcggaaaatgaggtaaaactaaccataatgacgggggatataaaaggcataatgcaagcgggaaaaaggtcactacgtccacagcccactgaactcaaatacagctggaaaacgtggggtaaagccaaaatgttaagtacagaatcgcataaccaaacatttttaatagatggtcctgaaacagccgaatgccctaacacaaacagagcctggaactcacttgaagtcgaggattacggcttcggagtttttagtaccaacatttggctaaaacttagagaaaaacaagatgtcttttgtgattcaaaacttatgagcgccgcaataaaagacaatcgagcagttcacgcagatatgggttattggattgaatctgctctaaacgacacttggaaaatggaaaaagcgtcctttatagagataaaatcttgtcattggccaaaatctcacactttatggtcaaacggagtgctcgaaagcgagatgattataccgaaaaattttgcaggaccggtaagccaacataactacagaccaggataccatacacagaccgcaggtccttggcatttaggcaaattagaaatggactttgatttttgcgagggaacaacagttgtcgtaaccgaggactgcggcaatagggggcctagtttacggactacaacagcttccggtaaacttataacagaatggtgctgtcgctcttgtaccctaccgcctctacgatatagaggagaggatggatgttggtatggaatggagatccgccccctaaaggagaaggaggagaacttagttaatagtttagttacagcaggccatgggcagattgataatttttcattaggagttctagggatggcattatttctcgaagaaatgttaagaactcgcgtggggactaagcatgccatcctgctcgtggcagtctcctttgttactttgatcacaggaaatatgagttttcgagatctagggcgcgtaatggtaatggttggagcaacaatgacggacgacataggaatgggagtcacgtacctagcactactcgcagcttttaaggtaagaccaacttttgctgcaggactgctattgaggaaactgacaagcaaagagttaatgatggccacaataggtatagcattactaagccagagtacaatcccagaaacaatactagaactaacagacgcgttagctttagggatgatggttcttaagatagtaagaaatatggaaaagtatcaactagcggttacaataatggcgatatcttgcgtgccaaatgctgttatactacaaaatgcttggaaagtctcttgcacaatattagctgctgttagtgtctcccccttactattgacaagtagtcagcaaaaagcagattggataccgttagcactgaccataaaggggctgaacccaacggcaatatttctaacaactttatctcggactagcaagaaaagaagttggccattaaacgaggcaattatggcagtaggcatggtatcaatcctagctagctctctacttaaaaatgatatccctatgaccggccctctagtcgctggaggccttctgactgtttgctacgtactgacgggaaggagcgctgatttagagctagaacgcgcagccgacgtaaaatgggaggaccaagcagaaatatccggatcatcaccaattctaagtataacaatatccgaggatggaagcatgtcaatcaaaaatgaagaagaagaacacacattaacaatattgataagaacaggactgctagtaataagtggtgtttttcctgtatccatccctataactgctgccgcttggtacttatgggaagttaagaaacaacgagccggagtgctatgggatgttccctctcccccaccagtgggcaaagcagaattggaagatggagcatataggataaaacaacgcggcatattcggatactcacagatcggagcgggagtctataaagaaggaactttccacacaatgtggcacgtcacaaggggagctgtattgatgcatagaggtaaacgaattgaaccaagctgggcggatgtaaagaaagacttaattagctatggtggaggatggaaactcgaaggggagtggaaagaaggggaagaagttcaagtattggcccttgaaccaggtaagaatccaagagcagtccagacaaagcccggattatttaaaacaaacaccggcactataggggcagtctcgttagacttttcgccaggtaccagcgggtcacctatagtcgacagaaaaggaaaagtagtaggattgtacgggaacggtgtagtaactagatcaggggcatacgtgtctgcaatcgcgcaaaccgaaaaatctatagaagataacccggaaatagaagatgatatctttagaaagaaacgactgaccattatggatttacaccctggggccggaaaaactaaacgttacctacccgccattgtccgtgaagcaataaaaagaggattaagaactctaattctcgccccaacacgcgtagtagcagcggagatggaggaggcattacgaggtttacccataagatatcaaaccccagcaatcagagctgagcacactggacgagaaatagtggatttgatgtgccacgcaacatttactatgcgtctactgtcccctgttagggtcccaaattataatttgataataatggatgaagcacatttcaccgacccagcatctattgctgctcgcggctacatttcaacaagagtcgaaatgggtgaggcagcgggaattttcatgaccgctactcctcccggtagccgagatccattcccacagagcaatgcaccaataatggacgaggagcgagaaatacccgaaaggtcatggaactcaggtcatgaatgggtcacagacttcaaaggcaaaacggtatggtttgttccaagtatcaaggctggaaatgatatcgcggcttgtttacggaaaaatggcaagaaagtaatacagttgagcagaaaaacatttgacagtgaatatgtgaagacccgagcgaatgattgggacttcgtagttacgacagatatctcagagatgggggctaattttcgtgctgaacgtgtgatagaccctagacgatgtatgaaaccagtcatactcacagatggagaggaaagagttatactagccggacccatgcccgtgacgcattccagtgcggctcagcgtaggggacgaattggaagaaacccaaagaatgagaatgatcaatatatttacatgggagagcccctagaaaacgatgaagattgtgcccattggaaagaggctaaaatgttgcttgacaatataaacacgcccgaaggaattatcccatcgatgtttgagccagaaagagaaaaagtagacgcaattgacggagaatatcgactaagaggagaagctaggaaaacctttgtggatttgatgcgacgaggagacctgccagtatggctcgcatatagagtagctgcagaaggaattaattatgctgatcgacgctggtgttttgacgggatcaaaaacaatcaaatcttagaggaaaacgttgaagtagagatatggaccaaggaaggggaacgtaagaaattaaaaccacgatggcttgatgcaagaatatactccgacccgttggctctaaaagagttcaaagagttcgctgccgggagaaaatcattaacgctaaatctgattactgaaatgggccgtttacccacttttatgacacagaaagcaagagatgcactagacaacttggctgtattacatacggctgaagttggaggtcgagcatataaccatgcgctttctgaactaccagaaaccttagaaacactattattactcaccttactagctacggtgaccggagggatatttctttttctaatgtcgggcaaggggatagggaaaatgacattaggaatgtgttgtataattactgctagcattctcctctggtatgcacagatacagcctcattggattgcggctagtataatcttggagtttttcttaatagtacttttaatacctgaaccagagaagcaacgtacccctcaagataatcaacttacatacgtggtaatcgcaatcttaactgtggtagcagcgactatggcaaatgaaatgggattcctagagaagaccaagaaagacctgggtttgggaagcattacaacgcaggaatcagagtccaacatactcgatatagatttacggcccgcttcagcatggacactatatgcggtggctacaaccttcgtaacaccgatgctccgccattccatagaaaattcgtcggtaaatgtgagtttaactgccatagcaaatcaagctacggttctcatgggcttagggcgtggctggccattgagcaagatggatataggagtgccacttctagccatcggatgttattcacaagtaaacccaattacactcacagcagctctgctccttctagtagctcattatgcgatcattggaccaggattgcaagctaaagccacgagagaagctcagaaaagaactgcggcgggcattatgaaaaatccgaccgtcgacggtataactgttatagatttggaaccaataccctatgacccaaaattcgagaagcaattaggacaggttatgctgctagtactgtgcgtcactcaagtactgatgatgagaacgacctgggccctatgcgaagcactaacactagcaactggaccaataagtactctctgggaaggaaacccagggaggttctggaacaccacaattgcagttagtatggcgaacatattcagaggatcctacttagccggtgcaggattactattctcaattatgaaaaacacaacaaataccaggcggggaacaggcaatattggagaaacgttgggagaaaaatggaagtcgagactaaatgcactaggcaaatcagagtttcaaatatataagaaaagtggaatacaagaggtcgatcgaacattagccaaagagggtattaaacgaggtgaaactgaccaccatgccgtgagccgaggctccgcaaaactaagatggtttgttgaacgcaacatggtaacgccggaagggaaggttgtagatcttgggtgtggaagagggggatggtcatattattgtggaggactaaagaatgttcgagaagttaaaggattaactaaaggaggcccaggccatgaagaaccaattcccatgtcaacttacggatggaacctcgttcgtcttcaatccggagtcgatgtattcttcacacccccagaaaaatgtgacacgcttttatgcgatatcggagaatcaagtccaaatcctacgattgaagccggacgaacattaagagtattaaatctagtagagaattggctaaataataatacacaattttgcgtaaaagttttaaatccgtacatgcctagtgtcattgaaaagatggaaacattacagagaaaatacggaggggctctagtgcgtaacccactctcaagaaactccacccacgaaatgtactgggtcagtaatgcaaccggtaatatagtgtcttccgttaatatgatttctcgtatgctaattaacagatttactatgaaacacaagaaagcaacgtatgaaccagacgtagacttaggaagtgggacccgtaatataggtattgaaaatgaaataccgaacttagatatcattggaaaaagaatagaaaagattaaacaagaacatgagactagctggcactatgatcaggatcacccttacaaaacatgggcttaccatgggagttacgaaactaaacagactgggtccgcatccagtatggtcaacggagttgtcaaactattaacgaaaccttgggatgttgtaccaatggtaacccaaatggctatgacagatacaacacctttcggtcagcaacgagtgtttaaggaaaaggtagacactagaacacaggaaccgaaggagggcaccaagaaacttatgcggataacagcagaatggttatggaaggaactaggcaagaagaaaacccctcgaatgtgtacaagagaagagttcaccaggaaagtacgctcaaatgcggcactcggcgccatattcactgatgaaaataagtggaaaagtgcaagggaagccgtagaagactcaagattttgggagttagtcgacagggaacgaaatttacacttagaaggaaagtgtgaaacctgtgtttataatatgatgggaaaaagagagaagaaactgggggagtttgggaaagccaaaggatcaagagcaatatggtacatgtggctaggcgcccgatttttggaatttgaagcgttaggatttctcaatgaagatcactggttttcccgagggaatagcttaagtggtgttgaaggtgaaggccttcataaattgggatacatacttagagacgtttccaagaaagaaggaggggcaatgtacgctgatgatacagcaggatgggatactagaattacacttgaggacctcaagaatgaggaaatggtaactaaccacatgaaaggagaacacaagaaactagccgaggcaatatttaaactcacttatcaaaataaggtcgtacgcgtacaaaggccaacaccaaggggaacagtaatggatatcatcagtagaaaggatcagagaggatcaggtcaagttggtacctatggtttaaatacatttacaaacatggaagcacaacttatacgtcaaatggaaggagaaggaatcttcaaatctattcagagacttaccgtcactgaagagattgctgttcaaaattggttagcaagggttgggagagaaagattatcaaggatggcaatatccggggatgattgtgtagtaaagcctttggatgaccgctttgccagcgcactcacagcgttaaacgatatgggaaaagtacgtaaagacatccaacaatgggaaccatcacgaggctggaatgattggacccaagtacctttttgctcccatcattttcacgagctagtgatgaaagatggtagagttctagttgtgccatgtcgtaatcaggatgaactaatcgggcgtgctcgaatttcacaaggtgctggttggtcattgaaagagactgcatgcctcggtaagtcatatgcgcaaatgtggaccctaatgtactttcatcgcagagacttacgattagccgcgaacgctatttgcagtgccgttccaagtcactgggtaccaacatcaagaacaacgtggtccatacacgcaaagcatgagtggatgacaaccgaagatatgctagcagtttggaatagggtctggatacaagaaaatccttggatggaggacaaaacgccagtcgaatcctgggaagaggtgccttacttaggcaaacgagaagaccaatggtgcggatccttaataggacttacatccagggcgacatgggccaaaaatatacagacggcaataaatcaggttcgttcactgataggtaatgaagaatacactgattatatgccaagcatgaagagattccgtaaagaggaggaagaagcaggagtgttgtggtga

SEQ ID NO: 22594 - RNA, 9876 nt, synthetic construct
  misc_feature 1..9876: note = derived and/or modified CDS sequence (opt6) from DENV-2__EU687222__SS-prME
  source 1..9876: mol_type = other RNA
acagctggagtaatcataatgctgatacccactgcaatggcgtttcacctaacaaccagaaacggcgaaccccacatgattgtcggacgacaagagaaaggtaaatccttactattcaaaacagaggatggcgtaaatatgtgtacattaatggcaatagacttaggagaattgtgtgaagacacaataacttacaaatgtcccctacttagacaaaatgaaccggaggatattgactgctggtgtaatagtacttccacctgggtgacatatgggacatgcactacaacaggagagcatcgacgtgagaaaagatcagtagcgttagtacctcatgttgggatgggtctagaaaccagaacggaaacttggatgagcagtgaaggtgcatggaaacatgtacagcgaattgaaacatggattctgcgacatccggggtttactattatggcagcaatattggcatacacaatagggacgacgcactttcaacgagctttaatatttatcttattgacagcagttgcaccaagtatgaccatgagatgtataggaatatcgaatcgagacttcgtagaaggggtctcaggagggagttgggtagatatagtccttgaacatggcagttgtgttacaacaatggccaaaaataaaccaaccttagatttcgaactaataaaaaccgaagcgaaacaaccagcgacgttaagaaaatactgcatagaagcaaaactaaccaatacaaccactgaaagtagatgccccacccaaggagaaccctccttaaatgaagaacaagacaaacgatttatttgcaaacacagtatggtagatagagggtggggaaatggatgcggtctatttgggaaaggaggtatagtcacctgtgctatgtttacttgcaagaaaaacatggaaggtaaagtagtcttaccagaaaatttagaatatacgatcgttattactccacatagtggtgaagaacatgctgttggcaatgacaccggtaaacatggtaaagaaataaaaattactccgcaatcgtcgattacagaagcggagttaacaggatatggaacagtgacgatggagtgctcgcctagaactggattagacttcaatgagatggtgttgctacaaatggaagacaaggcttggctagtacatcgccaatggttcctggaccttccattgccatggctacccggtgcagacactcaaggttctaattggatccagaaagaaacattggtaacttttaaaaacccacatgcaaagaaacaagacgtggtggtccttgggagtcaagaaggagcgatgcatactgcattaacgggagcaactgagatacaaatgagtagtgggaacttattgtttacagggcacctaaaatgtcgtttaagaatggataaattacaattgaaaggaatgtcatactcgatgtgcaccggcaaatttaaaatcgtgaaagagatcgcggaaacacaacacgggaccattgtaataagagtccagtatgaaggggacggtagtccttgtaaaataccatttgaaatcatggacctagaaaaacgccatgtcctagggagactaatcacagtcaatccaatcgtgacggaaaaagacagtccggttaatatagaagcagaaccaccattcggggactcatacatcataattggggtagaacctggacagttaaaactgaattggtttaagaaagggtcctccattggacaaatgtttgaaacaactatgagaggcgcaaaaaggatggccattttgggagacacagcttgggattttgggtcattgggcggagtcttcacttcaattggtaaagccttacatcaagtcttcggagcaatctacggtgcagctttttctggcgtcagttggacgatgaaaatactaataggagttataataacatggatcggtatgaactccaggtcgacatccctatccgtatcattagttttagtaggtgtcgtaacactctacctgggagtgatggtacaagctgattcgggatgtgtggtatcatggaaaaataaagaattaaaatgtggctcgggaatattcataacagacaatgtccatacatggacagaacaatacaaatttcaaccagagtcaccaagtaaacttgcgtcagcaatccaaaaagctcacgaagaaggaatatgcggaataagatcagttacaaggctcgaaaatttaatgtggaaacaaataacgccagaacttaaccatattctgtcagaaaatgaagtaaaactcaccattatgactggggacattaagggtataatgcaggcaggaaaacgttcactcagacctcaacccacagagctcaagtatagttggaaaacttggggcaaggccaaaatgttgtctacagagagccataaccaaaccttcctcatagatggtcctgaaactgctgagtgccctaacaccaatcgtgcttggaacagtttggaagttgaagattatggatttggggtcttcagtacaaacatttggctcaagttaagggaaaaacaagatgtgttttgtgattcgaagctaatgtccgcagccattaaagacaatagagctgttcatgctgatatggggtattggatagaaagcgcactaaacgacacttggaagatggaaaaggcatcatttattgaaataaaaagttgccattggcctaaaagtcacacattatggagtaacggagttttggagagtgagatgataatccccaaaaattttgccggtccagtatcacaacacaattatcgtccaggttatcatacccaaacagccggaccatggcatttagggaaattagagatggattttgatttttgcgaaggaactacagtagtagttacagaagattgtggaaaccgaggcccatcacttagaacgaccacagcatcggggaagttaattacagaatggtgttgtagaagttgtacgttacctcctttacgatatcgcggagaggacggatgttggtatggtatggaaataagaccacttaaagaaaaggaagaaaacctcgtaaattcgttagtgaccgctgggcatggccaaatcgacaattttagcctcggcgtattagggatggcactcttcctagaggaaatgttaagaacaagagtaggcactaaacacgcgatactgctagttgccgtgagcttcgttacacttattaccggaaacatgagttttcgggatcttggacgagtgatggttatggtgggagcaacaatgacagatgacatcggaatgggagtgacttaccttgcacttctagcagcttttaaagttcggccaactttcgcggctggtctattattacgaaagttaacgagtaaggaactaatgatggccactatagggatcgcactactctcacaaagtactataccggaaacaatactagaactgacggatgcgctcgccctcggaatgatggtacttaaaattgtcaggaatatggagaaatatcaattggcagtaacaataatggctatcagttgtgtacccaacgccgtcatactgcaaaacgcttggaaggtatcgtgcaccatcttggcggcagtgtcggtatcgccattgcttttaacatccagtcagcaaaaagcagattggatcccccttgctttaacaattaagggactgaacccaacggccatcttccttacgacgctatcacgaacgagcaagaaacgaagttggcccttaaacgaagcggttatggcagtagggatggttagcatattggcctcaagcctacttaaaaatgacataccaatgactggaccattggtcgctggtgggctactaacagtttgctacgtattaacaggcaggtctgcagatttagagcttgagagagcagcagacgtaaagtgggaagatcaagctgaaatttcgggtagctctcccatactttctataacaatatcagaagacggatccatgagtattaaaaacgaagaagaggaacacacactcacaatactaattcgaactggcctcttagtaatatctggcgtattccctgtaagcattccaataacagctgccgcttggtacctctgggaagttaagaaacagagagccggtgtattatgggatgtgccaagtccaccacccgtaggtaaagcggaactggaagatggtgcctaccgaataaaacagagaggaatatttggttactcacaaattggagcgggcgtatataaagaaggaacattccataccatgtggcatgtgacacggggagcggtactaatgcacagaggaaaacgaattgaaccaagttgggctgacgtgaagaaagacctgatttcttatggaggaggatggaaactcgaaggagaatggaaagaaggtgaagaagtacaagtactagctcttgaacccgggaagaacccccgtgcagtgcaaactaaaccaggtttatttaaaactaacacaggtacaatcggagctgtgtctttggattttagtccaggtacctcgggttcaccgatagtagatcgaaaaggcaaagtggttggattatatgggaatggagtagttacgagatctggcgcctatgtaagtgcgatagcacaaaccgaaaaatcgatagaagataaccctgaaatcgaagacgatatattcagaaagaaacgcttgacaataatggacttgcatccgggggcgggaaaaactaaacgttatctaccggccattgtgagagaagctataaagagagggttacgcactctgattttagctcctaccagggtcgttgcagcagaaatggaggaagcactgcgtggactcccaataagataccaaaccccagctattagggccgagcacaccggacgagaaatagtggacctaatgtgtcatgctacattcaccatgcggctattatctccagttagggtaccaaactacaatctaattataatggacgaagctcattttactgatccagcaagcatcgctgcgagaggatacattagtacgagagtagaaatgggcgaagctgctggcatctttatgaccgctacaccaccaggaagtagagatccatttcctcaaagtaacgctcctattatggatgaagaaagagaaatccctgaaagaagctggaatagtggacacgaatgggtaacagactttaaaggaaaaaccgtttggttcgtgccttccatcaaagcaggtaacgatatcgcagcatgtctaaggaaaaacggcaagaaggtaatacaactatcaagaaaaacttttgatagtgaatacgttaaaacaagagcgaacgattgggactttgtagtcacaaccgacataagcgaaatgggagccaactttagggcagaaagagtgattgatccccgtcgatgcatgaagcctgttatattaactgacggtgaagaaagggtaatactagcaggacctatgccagtaacgcactcttctgccgcacaacggagaggtaggataggaagaaatccgaagaatgagaacgaccagtacatctatatgggagaacctttagagaatgatgaggattgcgcacattggaaagaagcaaagatgcttttggataatatcaatactccagaaggtataataccatcaatgttcgaacctgaaagagaaaaagttgatgcaattgacggagaataccgtttaagaggcgaggcaagaaaaacttttgtggacctaatgcgcagaggggatttgcccgtttggttagcatacagggtcgccgctgaaggtataaactacgctgatagaaggtggtgttttgacggcatcaagaacaaccaaatacttgaagaaaacgttgaggtcgagatctggacaaaagagggagaaaggaagaaactaaaacccagatggctagatgcgaggatatattcggatcccttagctttaaaggagtttaaagaatttgcggcaggcagaaagtctttaacacttaatctcattactgaaatgggtagactccctacctttatgacgcaaaaagcacgtgacgcactcgataatctagcagtgttgcacacagctgaagtaggtggacgtgcatataaccacgctctctcagaacttccagaaacattagaaactttactgctactaacactcctagcaacagtcactggtggaatattcttatttttaatgagtggtaagggtattggaaagatgactctagggatgtgctgcataatcacagcatcaatattactatggtatgcacaaatacaacctcactggatagcagcctcaattatactcgaatttttcctaatcgtcctacttataccggaaccggaaaaacaaaggacccctcaagataatcagctgacatacgtagtaattgctattctaacagtagtagccgctactatggcaaatgaaatgggcttcttagagaaaaccaagaaagatttaggtttaggatctataaccacacaagaaagcgaatctaatatacttgacatcgatttgcgaccagccagtgcatggactctgtacgcagtagcaacgacattcgtgactcccatgctacgacatagtatcgaaaattccagcgtaaacgtaagtcttacagcaatagccaaccaggccacagtcttgatggggcttggccgcggctggcccttgtcgaagatggacataggggtccctcttctagcgattgggtgttactcgcaagttaatcctataacattaacagctgcgctattattactcgtagcacattatgcgatcataggacctgggttacaagccaaagcaaccagggaagcacagaaacgtacggcagcagggatcatgaaaaatccaactgttgatggaataacagttatcgaccttgaacctataccgtatgacccgaagtttgaaaaacaattaggacaagtaatgctattagttctctgtgtcacacaagtcttaatgatgcgcactacatgggctctttgcgaggctttaacattagctacagggcctatatcgaccctatgggaaggtaacccaggaaggttctggaacacaaccatagctgtatcaatggctaatatcttccgagggtcctacttagcaggggcaggactcctcttttcgataatgaaaaacactacgaacacaagacgaggaacaggtaacatcggagaaaccttaggcgaaaaatggaaaagtagattgaatgctctaggaaaaagcgaatttcaaatatacaagaaatcaggcatacaagaagtagaccggactctagctaaagaaggtattaagcgaggagaaacggaccatcacgcagttagcagaggatcagctaagctacgatggttcgtggaacgaaatatggtgacaccagagggtaaggtcgtagacttgggttgcggccgaggtggatggtcgtattattgcgggggactaaagaacgtaagagaggttaaaggattaacaaaaggcgggccaggacatgaagaaccaattcccatgtcaacttatggctggaacttagtgcgtttacaatcaggtgtagatgtattctttaccccaccagaaaaatgcgatacactactatgtgatatcggcgaatcaagtcctaatcccactatagaagcagggcgtactctcagagtattgaacttggtggaaaattggttaaataataatacacaattttgcatcaaggtactaaatccttatatgcccagcgtgattgagaaaatggaaacacttcaacgcaagtatgggggagcgttagtaagaaaccccttatcccggaatagtacacatgagatgtattgggtttcaaatgcaactgggaacattgtcagttcggtgaatatgatcagcagaatgctcataaaccgatttacaatgaaacataagaaagcaacatatgaacccgatgtagatttgggtagcggaaccagaaatataggtatcgaaaatgaaatacccaatttagacataatagggaaacgaatagaaaagataaaacaagaacacgaaacttcatggcattacgatcaggatcatccatacaaaacatgggcatatcatgggtcatacgagactaaacaaactggaagcgcgtctagtatggtaaacggcgtcgtcaaactactaacaaaaccttgggatgtggtcccaatggtgactcaaatggcaatgactgatactactccatttgggcagcagagggtttttaaggagaaggtagacacacggactcaagaacccaaagaaggcacaaagaaattgatgagaattacagcagagtggttgtggaaagagctaggaaagaagaaaactccacgaatgtgtacaagggaggagttcacaagaaaggttagaagcaacgcagcactcggcgcgatatttacggatgagaacaaatggaaaagcgctagagaagctgttgaggacagccgattttgggaattggttgatcgagagcgtaaccttcatctcgagggaaaatgtgaaacttgtgtttataatatgatggggaaaagggagaagaaattaggcgagttcggtaaagcaaagggtagtcgtgccatatggtatatgtggctaggagcccgattcttagaatttgaagccctaggattcttaaacgaggatcattggtttagcagaggaaacagtctgtctggagtggagggggagggattacacaagttaggatacatactgagggacgtgagcaagaaagaaggcggagctatgtatgctgatgatacggctggatgggacactagaataacattagaagatctcaaaaacgaagagatggtaacaaaccatatgaaaggcgaacacaaaaagctagcggaggcaatctttaaactgacatatcaaaacaaggttgttagagtacaaaggccaacaccccgaggaacagtaatggatataatttccagaaaagaccaaagaggaagtgggcaagttgggacatatggattaaacacattcacaaacatggaagcgcaactaattcgacaaatggaaggtgaaggaatcttcaagagcattcagaggctaaccgtaaccgaggagatagcggtacagaattggttggcgagagtaggacgcgaaaggttaagccgaatggctatttcaggagacgattgcgtcgtcaagcctttggacgaccgattcgccagcgctttaacagccttgaatgatatggggaaggtccgcaaagacattcaacaatgggaaccctcacgaggttggaatgattggactcaggtcccattctgtagtcatcactttcacgaattggtaatgaaagacggtcgagtattagtagtaccatgcaggaaccaagatgagttaataggaagggctagaatatcccaaggagctggctggtcgcttaaagaaacagcatgcttggggaagtcatacgcgcagatgtggacactaatgtattttcatcgtcgagatctaaggctggcggcaaatgcaatctgcagcgctgtgcctagtcattgggtgcctacaagcaggacaacatggagtattcatgcaaagcatgaatggatgactacagaggatatgctagcggtttggaatcgagtatggatacaagaaaatccgtggatggaggacaaaactcctgtggaatcttgggaagaggtcccatacctaggaaaaagggaagatcaatggtgcggttcacttataggattaactagccgtgcgacgtgggctaagaatatacaaacagcaataaaccaggttcgtagcttaataggaaacgaagaatatacagattatatgccaagcatgaaaaggtttcgtaaagaagaagaagaagctggcgttttgtggtaa

SEQ ID NO: 22595 - RNA, 9876 nt, synthetic construct
  misc_feature 1..9876: note = derived and/or modified CDS sequence (opt6) from DENV-2__EU687223__SS-prME
  source 1..9876: mol_type = other RNA
acggcgggagttattataatgttgatacctactgcaatggcgtttcatttaacaacaaggaatggtgaaccgcatatgatagtgggacggcaggaaaaaggaaaatcacttctatttaaaactgaagacggtgttaatatgtgcacattaatggctatagatttaggggaattatgcgaagatacaataacatataaatgtcctttactcagacagaatgaaccggaagatattgactgttggtgcaatagcacttccacatgggttacttacggcacgtgcacaactactggcgaacacaggagggagaaacgatccgttgccctagtaccacatgtcggtatgggcctggaaacaagaacggagacttggatgagctcagagggagcctggaaacacgtccaaagaatagaaacatggatattacggcatcctggctttacgattatggcggcaatattagcgtatacaataggaaccacgcactttcagcgggcactcatattcatactgctcactgccgtggcgccatcgatgacaatgcgctgcattggaatcagtaatcgcgattttgtagagggagtatctggtggatcatgggttgatatagtactagaacacgggtcatgtgttacaacaatggccaaaaataaaccaactctagattttgaacttataaaaactgaagctaaacagccagcgacattgcggaaatactgtattgaagctaaactaacaaataccaccacagaatcgagatgcccaacacagggagagcccagtttgaatgaagaacaagacaaaagatttatttgcaaacatagcatggtggatagagggtggggcaatggatgcgggctctttggaaaaggagggatagtaacatgcgcaatgttcacatgtaagaaaaatatggaaggtaaagttgtgttgccagaaaatttagaatacactatagtaatcacgccacatagtggtgaggagcatgcagtaggcaacgacacaggcaaacatgggaaagaaatcaaaataactcctcaatcatccattacagaggcagagcttacaggatatgggacggtaaccatggaatgtagcccaagaacaggtttggattttaatgaaatggtattactacagatggaagataaggcttggctagtacaccgtcaatggtttttagaccttccattaccatggctaccaggggccgacacgcaagggtcaaattggatacaaaaagagacattagtcacctttaaaaacccacatgcaaagaaacaagatgttgttgtcctgggatctcaagaaggtgcgatgcatacagcgctaactggagcaactgaaatacagatgagttcaggtaacctattgtttacagggcatctgaaatgtagattgaggatggataaattacagcttaaaggaatgtcgtatagcatgtgtacagggaaattcaaaatagtaaaagaaattgctgaaactcaacatggtacaattgtaattcgagtacaatacgagggggacggatcgccatgtaaaattccatttgaaatcatggacctggagaaaagacatgtgctaggacggttgattacagtaaacccaatcgttactggtaaagacagtcctgtcaacattgaagcggaaccgccttttggggatagttatataattataggtgttgaaccaggacaactgaaattaaattggtttaagaaaggtagcagtataggacaaatgtttgaaacaacaatgagaggagcaaaaaggatggctatactaggagacacagcatgggactttgggagcttaggaggcgttttcacgagtattggtaaagccctccaccaagtctttggagccatttatggggccgctttctctggagtgtcatggacaatgaaaattctgatcggagtaataatcacatggatcggtatgaatagccgcagtacatctttatcagtgagcttagttttagtaggtgtcgtcaccttatatttgggtgtgatggtacaggcagacagtggatgcgttgtcagttggaaaaataaagaactgaaatgtgggagcgggatatttattacagataatgtacacacttggacagagcaatataaatttcaacctgaatcaccatctaaactagcaagcgctattcaaaaagcacacgaagaggggatttgtgggatacggtccgtcactcgccttgaaaacctcatgtggaaacagattactccggaattaaatcatatcctatccgagaacgaagtaaaactaactataatgacaggagatataaaaggaattatgcaggccggtaaaaggagcttacgacctcaacccacagaactaaaatattcttggaaaacttggggcaaagctaaaatgctcagcactgaatcacataatcagacgtttctaatagatggccccgaaacagcggaatgtccaaatactaaccgtgcatggaactccttagaggtggaggactacggatttggggttttctcaacgaatatctggttgaaattgagagaaaaacaggatgtattttgcgattcaaaacttatgtcagctgcgataaaagacaatagagccgttcacgctgatatgggctattggatagaatcagctctgaatgatacatggaaaatggaaaaggcttctttcattgaaattaaatcatgccattggccgaaatcacatacattatggagcaatggtgtcttggaaagtgaaatgattattcctaaaaattttgcaggtccggtatctcaacacaactataggccaggttaccacactcaaacagccgggccatggcatcttgggaaacttgagatggacttcgatttttgcgaaggcactacggtagtagttacagaagattgcggaaatcgaggaccgtcattgagaactactacagcttctgggaaactcatcaccgaatggtgctgcagaagttgcaccttaccacctttgcgataccgaggtgaggatggatgctggtatgggatggagattaggccactgaaagagaaagaagagaatttggtaaactctttggttactgcgggccacgggcaaattgataatttcagtcttggagttctaggtatggcactattcctagaagagatgctacgaacaagagtaggtactaaacatgcaatcctcctagtggcggtgtcttttgtgacactaataacaggaaacatgagcttccgcgatttaggacgtgtgatggtaatggtaggtgcaaccatgaccgatgacataggtatgggtgtaacatatctagcacttcttgctgctttcaaagttagacctacatttgcagccggtttactgttgaggaaattaacatcaaaagaattaatgatggctactatagggatcgctctactttcccaaagtactataccagagaccatattggaactaacagatgctctcgctttaggaatgatggttctcaaaattgtcagaaacatggaaaaataccaactagcagtgacaataatggccatctcatgtgtacctaatgcggttatactgcaaaatgcttggaaagtaagttgtacaatacttgcagcggtgtctgtttctccgcttttgttaacttctagccagcaaaaagctgactggatacccctagctctgaccatcaaaggattaaatccaacggcaatattcctgacaacgcttagtagaactagcaagaaaagatcatggccacttaatgaggccgtcatggcagtaggtatggtttccattcttgcaagctctctactgaaaaacgacatacccatgacaggccctttagttgcagggggtcttctcacagtatgttacgtattaacgggacgcagtgcagatctagaactcgaaagagcggcggatgtgaaatgggaagatcaagcagaaatttctgggtcgtcaccaatattaagcatcacaatatccgaggacggatccatgtcaatcaaaaatgaagaagaggaacacacactaacaatattaatacgcacggggctgctggtaataagtggggcatttccagtttcaataccgattacagcagctgcctggtatttatgggaggttaagaaacaacgcgccggagtactctgggacgtccccagtcctccaccggtcggaaaagctgaattagaagatggggcgtatcggataaaacagagaggcatattcgggtatagccaaatcggggccggagtttataaagaaggaacatttcatactatgtggcacgtcactcgaggcgcagtattaatgcatagaggaaaaagaattgagccaagctgggcagatgtcaagaaagatctaatatcttacgggggtggttggaaactagaaggagaatggaaagaaggggaagaagtacaagtccttgcattagaacccggaaagaatccaagagctgttcaaactaagcctggcctttttaaaacaaatacaggaacaataggggcagtatcattagatttcagccctggcacaagtggatctccgattgttgatcgcaaaggaaaagtggtaggtttatatggtaacggagtcgtaactcgctctggagcatacgtctcggcgattgcacaaactgaaaagtctatagaagataacccagaaattgaagatgatatttttaggaagaaaagacttacaattatggatcttcatcctggcgcaggtaaaacaaaaaggtacctaccagcaatagtaagagaggccataaagagaggattaagaacgcttatcttagcaccaacgagagtagtagcagcagaaatggaggaagcactcagaggcctacctattaggtaccaaacgccagcaataagagcagaacatacgggcagagagatagtggatttaatgtgtcatgcgacatttactatgagattgttatctccagtccgggttcccaattacaacctaattattatggatgaggcgcattttacggatccagccagtatagcggcacgaggatacatatctacacgtgtcgaaatgggagaagcggccgggatatttatgaccgcgactcccccgggatctagggatccctttccgcaatctaatgcaccgatcatggacgaagaaagagagattcctgagagatcatggaactccggtcatgaatgggtgacagatttcaaaggaaaaaccgtttggtttgtaccttcgattaaagcaggtaatgacatcgctgcatgccttcgtaagaatggaaagaaagtaattcaactctcaagaaagacatttgactcagaatatgtaaaaacgagagccaacgactgggattttgtagttacaacagatatatcagagatgggagcaaattttcgcgccgaaagggttatcgatccgagaaggtgtatgaaacccgtaattctaactgatggtgaggaaagagttatattagcaggtccaatgcctgtaacacactcgagcgcagcccagcgaagaggccggattggacgaaatcccaaaaatgaaaatgatcaatacatatatatgggtgaaccactagaaaacgacgaggattgtgcccattggaaagaagctaaaatgctcttagataatataaacacacctgaaggcattatcccatctatgttcgagccggagagggagaaggtggacgcaatcgatggcgaataccgtctgagaggagaggcaaggaaaacatttgtagatctaatgagacgaggggatttgccagtttggctagcgtatagagtggcagctgaggggattaactatgcggaccgcagatggtgtttcgatggtattaaaaataaccagatcttagaggagaatgtagaagtagagatttggaccaaagaaggtgaaaggaagaaattgaaacctcgttggctggacgctcgcatatatagtgatccattagcgttaaaagaatttaaagaatttgcagcgggccgtaaatcactaacactgaacctaataactgagatgggccgcttgcctacatttatgacacaaaaggcaagagacgcattagataatctagcagtcctacatacggcagaggtaggagggcgagcttacaatcacgctttaagtgaattaccagagacacttgaaactttattattattgaccttacttgccaccgttacagggggaatattcttattcctaatgtctggcaaaggtataggaaaaatgacccttgggatgtgctgtataataactgcctcaatactgctatggtatgctcaaattcaaccacactggatagcggcgagtataatactggagttctttctaattgtgttgcttatcccggaacctgaaaaacagcgaacccctcaagacaaccagttgacgtatgtagtgattgcaatacttacggttgtagcagcaacgatggcgaacgaaatgggattcttagagaaaacaaagaaagatcttggactgggcagtattacaacacaagaatcagaaagtaatattttagatatagatctaagacccgcaagcgcttggactctttacgcagtcgcaactacattcgtgacccctatgctcagacactctatagaaaactcgtcagtcaatgtgagcctcacagcaatagctaaccaagcgacagtgttaatgggcttaggaagaggctggcccttaagcaagatggacatcggagttccactactcgcaattggttgttattcacaagtaaatcccataacgttaactgcagctctgttgctcctagtcgcacactatgccattatcggtccaggcttgcaggctaaagccacaagggaggcgcagaaacggacagcagccggtattatgaaaaatccaacagtagatggaattacagtcattgacttagaacctattccttacgatcctaaatttgaaaaacaacttggtcaggtcatgctgttggtactatgcgtcacacaggtgttgatgatgagaacgacatgggcgctgtgtgaggcgttaactcttgcgacaggcccaatcagtaccttatgggagggcaatcctggaagattctggaacaccacgatagcagtgtcaatggccaacatctttagaggaagttatcttgctggtgccggtttgcttttcagcataatgaaaaataccactaatactagacgaggaacaggcaatataggagaaaccttaggcgaaaaatggaagtctagattaaatgcattaggaaaaagcgaatttcagatttataagaaaagcgggattcaagaagtagatagaactcttgcaaaagaagggataaaaagaggggagacagaccaccatgcagtttcgcgtggatcagccaaattacgctggtttgtagagcggaacatggtaacccctgagggcaaggttgttgaccttggttgtggaagaggaggttggagctattactgcgggggtctaaagaatgttcgagaagtgaaaggtttaacaaaagggggacctggacacgaagaacctatcccaatgtcgacatacgggtggaatctagtgcgccttcagtccggagtggatgtattctttacccctccagaaaaatgtgacaccttattatgtgatataggtgaaagttcaccaaatccaacaatagaagccggcagaaccttacgagtgctgaatttagtagaaaactggttaaataataatacacaattctgcattaaagttctaaacccgtatatgccttccgtaatcgagaaaatggaaactctgcagcgcaagtatggtggcgcacttgtacgtaacccactatcacgaaattcaacgcatgagatgtattgggtgtctaacgcaactggtaacattgtctcttccgttaacatgatatcaagaatgttaattaaccgtttcacaatgaagcacaagaaagctacatacgaacctgatgtagaccttggatctggaacacggaatatcggcatcgaaaatgaaatcccaaatttggatataataggaaaacgcatagagaaaataaaacaagaacatgaaacttcctggcattacgatcaggatcacccatataaaacttgggcttaccatggaagctatgaaacaaaacaaacaggatccgcatcctcaatggtgaacggggtcgtgaaactattgacaaaaccttgggatgtggtgcctatggtaacacaaatggcgatgacggatacaacaccatttggccagcaaagagtatttaaagagaaagtcgatacccgaacgcaagaaccaaaagaaggaaccaagaaacttatgagaataaccgcggagtggctttggaaagagttaggtaaaaagaaaactccaagaatgtgcactcgagaggaatttactagaaaagtcagatcaaacgcagcattgggagcaatatttacagatgaaaataaatggaaatctgcaagggaagcagtcgaggatagcagattctgggagttggtggatcgtgagaggaacctacatctagaaggaaagtgtgaaacatgtgtatataacatgatgggcaaacgtgaaaagaaattaggagaatttggaaaagcaaaaggctctcgtgcaatctggtacatgtggcttggagcaagatttcttgaatttgaggctttaggatttctaaacgaagatcactggttttcgaggggtaactcactatctggtgtcgagggtgaaggcctccacaaattaggatacattttaagagatgtgtcgaagaaagagggcggtgcgatgtacgctgatgacacagcaggatgggacacgcgaatcacgttagaagacttgaagaacgaagaaatggttactaatcatatgaaaggcgaacacaagaaactagcggaagcaattttcaaactaacttaccagaataaagttgtgagagtccaacgtcctactccaagaggaactgttatggacataataagtcgtaaagaccagcgtggttcaggacaagtaggtacttatggactaaatactttcaccaacatggaagcacaattaatacggcaaatggaaggcgaaggaatattcaagtcgatacaacgattaaccgtcacggaagaaatagccgttcaaaactggctagcgagagtcggaagagaaaggctctcgcgaatggccatttcaggagatgactgcgttgtgaaaccgcttgatgatagatttgcttctgccttgaccgctcttaatgatatggggaaggtacgaaaggacattcagcaatgggaaccgtcaagagggtggaacgattggactcaggtgccattctgtagccaccattttcacgagcttgttatgaaagatggaagggtattggtagtaccttgtcgaaaccaagacgagttaataggtcgagctcgaatatcacaaggtgcaggatggtcacttaaggaaacagcatgcctgggtaaatcctatgcacaaatgtggacattgatgtacttccaccgacgtgatcttagattagccgcaaacgcgatttgctcagccgtgccatcacattgggtacctacttccagaacaacttggtcgattcatgccaaacacgaatggatgacaacagaggacatgttagcagtatggaatagagtctggatacaagaaaatccatggatggaagataaaactccagtcgaatcatgggaggaagttccatacttagggaaacgtgaagatcaatggtgcggatcattaattggtcttacatcaagggcaacctgggctaaaaatatacagacggcaatcaaccaagtaaggagtctaatcggaaatgaggaatatacagactatatgccttcaatgaagcgatttagaaaggaggaagaggaagcaggagtcctttggtaa

SEQ ID NO: 22596 - RNA, 9876 nt, synthetic construct
  misc_feature 1..9876: note = derived and/or modified CDS sequence (opt6) from DENV-2__EU687227__SS-prME
  source 1..9876: mol_type = other RNA
acggctggtgttatcatcatgctgatacctacagcaatggcattccatttaacaaccagaaacggagaaccacatatgatagtaggacgtcaagaaaaaggaaagagcttgctatttaaaacagaagacggagtgaatatgtgcacactaatggcaatcgatcttggtgaactctgtgaagataccataacttacaaatgcccacttttgcgtcaaaatgaaccagaagacatagactgttggtgtaattcaaccagcacttgggttacatatggtacatgtactacaacgggagaacatcgaagagaaaaacggtcagtagcattagtaccgcacgttggaatgggccttgaaaccaggacagaaacgtggatgagttcagaaggcgcatggaaacatgtccaaagaatagaaacatggatattaagacatccaggattcacaattatggcagctatcttagcttacaccattggaactactcacttccagagggcattaatattcattcttctaacagccgtagcaccttcaatgacgatgcgttgtataggtataagtaatagggatttcgttgaaggtgtatcaggcgggtcatgggtagatatagttttagaacacggaagctgcgttacaactatggccaaaaataagcctacgctggatttcgaacttataaaaacagaagccaagcagccagcaacattacgtaaatattgcatagaagctaaactcacaaacaccaccacggaaagtagatgtcctacgcaaggggaaccaagtctaaacgaagaacaagacaaaagattcatttgtaaacactcaatggtggaccgtggctgggggaatggatgtggtctctttggcaagggtggcattgttacctgcgctatgttcacatgtaagaaaaatatggaaggaaaggtagttttaccagaaaatttagaatacactattgtcatcacacctcatagcggagaagaacacgctgtcggaaatgacacaggaaaacacggcaaagaaattaaaataacacctcaatcttcaattactgaggcagaactcacagggtatggtacggtaacaatggagtgttcacctagaaccgggctggattttaatgaaatggtattactgcagatggaagacaaagcatggcttgtacacaggcagtggtttttagatttaccactaccgtggttaccaggagcggatacacaaggaagtaactggattcagaaagaaacacttgtaacatttaagaaccctcatgcaaagaagcaagacgtcgtagtactgggatcgcaagaaggtgccatgcatacagcgctgactggggcgacggaaatacagatgagtagcggaaatttacttttcactggccacttaaaatgcagattacgaatggacaaacttcaattaaagggcatgtcatactcaatgtgcactggtaaatttaaaatagtaaaagaaatagcggaaacccaacacggaacaatagtaatacgcgttcagtatgagggggacggtagtccatgcaaaataccttttgagataatggaccttgaaaaacgtcatgttctcggcaggctaataacagtaaatcctatcgtaacagaaaaagacagtcctgtcaatatagaagcagaacccccatttggagattcctacataataataggtgtggaacctggacaactcaaactaaattggttcaagaaaggttcttcaataggtcaaatgttcgaaacgaccatgcgtggggccaaacgaatggcaatcttgggtgatactgcttgggatttcggaagcctaggaggtgtctttaccagcattggcaaagcacttcatcaagtcttcggtgctatttacggcgcagcattctcaggtgtaagctggacaatgaaaattttaataggtgtgataattacctggatcggtatgaactcccgtagtacctctttgagtgtatcgttagtgctagtcggtgtggttactttataccttggtgttatggttcaagctgacagtggttgtgtagttagctggaaaaataaagaactaaaatgtggaagtggcatctttataaccgataatgtacatacgtggactgaacagtataaatttcagccagaatccccgtctaaactggcgagcgcaatacaaaaagcacatgaagaaggtatatgtggcattcgttcagttaccagattagaaaatctgatgtggaagcaaataaccccagagctcaaccatattttatcagagaatgaggtaaaactaacaattatgacaggcgacattaaaggaattatgcaagccggtaagcggagtcttcgcccccaaccaaccgaactgaaatactcttggaagacgtggggcaaggccaagatgttatcgaccgagtcacataaccaaacatttttaatcgacggaccggaaacagcagaatgtccaaatacaaatagagcatggaactccctagaagtagaggattacggattcggggtattcagtacaaacatatggttaaaactccgtgagaagcaggatgtgttctgcgactccaagttaatgtcagctgccataaaggacaatagagccgtgcatgccgatatgggatattggatagaatcagcattaaacgacacatggaaaatggagaaagcgtcgttcatagaaataaaatcgtgccattggccaaaatctcacacactatggagcaacggtgtattagagtcagagatgattattccaaagaatttcgccggaccggtctcgcaacataattatagacctggctatcacacccaaactgcaggcccgtggcatctaggaaaattggaaatggactttgatttttgcgaaggtacgacagtagtagtaaccgaagattgtggaaataggggacccagtttaagaacgacaacagcttccggaaagttaataacagagtggtgttgtagaagttgcaccctaccgcccttgagatacagaggagaagatggatgttggtacggaatggagataagaccgttaaaagaaaaagaagaaaaccttgtcaatagcttagtgactgccggacacggacaaatagacaatttttcattaggcgtcctcggaatggctttatttctagaagaaatgttaaggacgagggtaggtaccaagcatgcaatactcctggttgccgtttcgtttgtgaccttgattacgggcaatatgtcattcagagacttaggaagagtcatggtcatggtaggcgccacaatgaccgatgatatcggcatgggtgtcacttatttagcattactagccgcattcaaagtccgacccacgtttgccgccggactactcttgcgaaaacttaccagcaaggaattgatgatggcaactatcggaatagcacttctcagtcaatcgactatccctgaaacgatattggaattaaccgacgccctcgccttaggaatgatggtactaaaaatagtcaggaatatggagaaatatcaactcgccgttacgataatggcaatcagttgcgtcccgaatgcagtgatactacaaaatgcatggaaagtatcatgcactatacttgcggcggtatcagtgagtcccctattactaacaagctcccaacagaaggcagattggattccgttagccctaacgatcaaagggctaaatccgacagctatatttctcaccacactatctcggacttcaaagaaacgcagctggcccttaaatgaggccgtaatggcagttggaatggtcagtatcttagcaagttctttattgaagaacgatataccaatgacaggacccctagtggcaggaggcttactgacagtgtgctacgtacttacaggacgatcggccgacctggagctagaaagagccgcagatgtaaagtgggaagatcaggcagaaatatcagggagttctccgattctatcgataacaattagtgaagacggaagtatgagtatcaaaaatgaggaagaagaacacaccttaacaattttgataaggacgggacttttagttatatcaggtgtgttccctgtttctataccaataactgctgcagcatggtatttatgggaggttaagaaacaaagagctggtgtattatgggatgtaccgagcccaccgcctgtaggtaaggctgaactagaggacggagcatacagaattaagcaaaggggcatattcggctactctcaaataggggccggtgtttacaaagagggaacattccatacaatgtggcatgtaacaagaggtgcagtcttaatgcataggggaaaaaggatagaaccgtcatgggcagacgtaaagaaagatttaatttcttatggtggcggttggaaattagaaggtgaatggaaagaaggagaagaagtgcaagtacttgccctagaaccgggtaaaaacccgcgtgctgtacagactaaacctggattatttaaaacgaacacagggactattggtgcagtatcacttgacttctcaccaggaacaagcggcagtccaattgtagataggaagggaaaagtagtagggctatatggtaatggagtcgtcacaagatccggcgcgtacgtaagtgccattgcgcagacagagaaaagcattgaagataaccctgagatagaagacgatatatttagaaagaaacgtctaaccataatggatttgcatccgggcgctgggaaaacgaagcgttatttgccagcaattgtaagagaagcgataaaacgtggattaaggactctaatcttagcccccacccgggtagtagcggcagaaatggaagaggcattgcgaggattaccgataaggtatcaaacacccgcaataagagcagaacacacgggcagggaaatagtcgacctaatgtgccatgcaacatttacgatgcgacttcttagtcctgttagggtgcctaattataatctaattataatggatgaggcgcattttacagaccccgcatccatcgccgcacgaggatatatatcaactagagtcgagatgggagaggcagccggcattttcatgactgcgacgccacccggaagcagggatccttttccacaatcaaatgcacctataatggatgaagaacgcgaaataccagagcgatcatggaactcaggacacgagtgggtcacggactttaaaggtaaaacggtttggtttgtcccatcaatcaaggccggcaatgatatcgcagcttgcttgcgcaaaaatgggaaaaaggtaatacagcttagtcggaaaacattcgacagtgaatatgtaaaaacacgtgctaacgattgggattttgtggtaaccacagatatcagcgaaatgggggcgaatttccgggcagagcgagtaatagacccacgaaggtgcatgaagccagttatactaacagacggagaagaaagagtcattttagcgggtccgatgccggttacgcatagctcggcagcacagagaagaggtcgaattggaagaaatccgaaaaatgaaaacgatcaatatatatacatgggagaacctctagaaaatgatgaagattgcgcacattggaaagaagccaaaatgctcctcgacaatatcaatacacctgaaggaataataccatcgatgtttgagcctgaacgtgaaaaagtagatgcaatcgatggagaatatagattacgcggagaagccagaaagacctttgtagacctgatgagacgtggggatttaccagtgtggcttgcatatagggtagctgcagaagggatcaattacgcggacagaaggtggtgttttgatggcattaaaaacaatcagatactcgaagaaaacgtcgaagtggagatctggacaaaggaaggcgaacggaagaaactaaagcctcgatggttggatgcaagaatatacagcgatccacttgcgcttaaagaatttaaagagttcgctgcgggcagaaaatctctcacattaaacctcataactgagatgggaaggttaccgacatttatgacacaaaaagctagagacgctttagataatcttgccgttctacatacagctgaggtcggtggaagggcctacaatcacgccctttcagaactaccagaaactttagaaactttactgttgctaacacttttagccacagtcactggtggtatctttctcttcttaatgtcaggaaaaggtataggtaagatgactcttggtatgtgctgcattataacagcttcaatattattatggtacgctcagattcaacctcactggatagccgcgtcgataattttagagttcttcttaattgtcctgttaatccctgaacctgaaaaacaaagaacaccacaggataatcagttaacatatgttgtaatcgccatattaactgtagtagcagcaactatggctaatgagatgggattcttagagaaaaccaagaaagatttagggctaggaagcataacaacccaagaaagtgaaagcaatatattagatatcgacttacgtccagcaagtgcttggacactttacgcagtagctacgacatttgtgacgccaatgctaaggcacagcatagaaaactctagcgtcaatgtaagccttaccgccatagctaatcaggcgaccgtcctcatgggtttaggtaggggctggcctttatcaaagatggatataggagtccccttactagcaattgggtgctattcccaagtcaatccaattacattgactgcagcattattactcctagtggcacattatgcaattattggaccagggcttcaagctaaagcgactcgagaagctcaaaaacgaactgctgccggcataatgaagaaccctacagtagatggaatcacggttattgacctagaaccaatcccttatgatccgaagtttgaaaaacagctgggtcaagtcatgctgttagttttatgtgtaacacaggtattgatgatgaggacgacttgggcattatgcgaagcactcactttagccactgggccaattagtacattatgggaaggaaatccgggacggttctggaataccacaatcgccgtcagcatggcaaacatctttagaggaagttatttagctggagcagggttgctgtttagtatcatgaagaatacaactaacacaagaaggggaacaggaaatatcggagaaacccttggagaaaagtggaaaagcagactaaatgccttaggtaaatcagaatttcaaatatataagaagagtggaatccaggaggttgaccgaacattagctaaagagggcataaaaaggggagaaacggaccatcacgctgttagtcgtggttcagctaaactaagatggtttgtagagagaaatatggtcaccccagaaggaaaagttgttgatttaggatgcggtagaggaggttggtcatattattgtggaggtcttaaaaacgttcgcgaagtgaaaggcttgacaaaaggtggaccgggtcacgaagaacctatacctatgagcacgtatggctggaacttagttaggttgcaaagcggtgtagatgtcttctttacaccgccagaaaaatgtgatacgttactttgtgatataggagaatccagtccaaatcctactattgaagcgggacgtacacttagagtactgaacctcgtagaaaattggcttaacaacaatactcaattttgtataaaagtccttaatccttatatgccttcagttattgaaaagatggaaacgcttcagcgcaaatatggtggagcgttggtacggaatccattatcacgaaactcaacacatgaaatgtactgggtatcgaacgctaccggcaatatagtaagcagtgtaaacatgatatcccggatgttaataaatcgattcacgatgaaacataagaaagcgacgtatgagcctgacgtagatttgggcagtggcacaagaaacataggcattgaaaatgaaattccaaacttggacatcattggaaagagaatagagaaaataaaacaagaacacgaaacatcctggcactatgaccaagaccatccctacaaaacctgggcctatcatggaagttacgagacaaagcagacaggatccgcatcctcaatggtaaatggcgtcgtaaaactgctaactaaaccttgggatgtggtcccaatggtaactcagatggcaatgacagatacaactccattcggtcagcaaagagtatttaaagaaaaagtagatacgaggacgcaagaaccaaaggaaggaactaagaaacttatgcgtataactgccgaatggttatggaaggagttgggaaagaagaaaactcccagaatgtgtacgagagaagagttcacaaggaaagtaagatcgaatgcagcactcggcgcgatatttactgatgaaaataaatggaaatcagcaagggaagcggtagaggactccaggttctgggaattagttgatagagaaagaaacctccatctagagggtaaatgcgaaacgtgtgtgtataatatgatgggaaaaagagagaagaaattaggagagttcggcaaagccaaaggatctcgagcaatatggtatatgtggttaggagcaaggtttctggagtttgaagcgttaggctttctgaacgaagatcactggttttctagaggaaactcactaagcggagtcgaaggagaaggtctacacaaattagggtatattttgcgagacgtaagcaagaaagaaggaggagcaatgtacgcggatgatactgccggttgggacacaagaataactttagaagatcttaaaaatgaagaaatggttaccaatcagatgaaaggtgaacataagaaactggcagaagcgatttttaaactaacgtatcagaataaagtagtaagagtccagcgacccacgccacgcggaacagttatggacatcataagtagaaaggatcaacgaggaagcggccaagttggaacttacggattgaataccttcacaaacatggaggcacaactaattcgacaaatggaaggtgaggggattttcaaaagcatacagaggttaacagtaacggaagaaatagcagtgcaaaactggcttgcgagagtgggcagagaacgactatcaagaatggctatctcgggtgatgattgcgtcgtaaagccattggatgataggttcgcatcggcattgactgcattaaacgatatgggaaaagtcagaaaagatatacaacaatgggaaccaagcaggggatggaacgattggacacaggttcctttctgctcacaccattttcacgagctagtaatgaaagatgggcgagtgctagtagttccttgcagaaaccaggatgaacttataggcagagcacgaatttcacagggagctggatggtctcttaaagaaactgcctgcttaggaaaatcatatgcccaaatgtggacgttaatgtacttccatagacgcgacttacggctggcagcaaacgctatttgctcagctgttccatcacactgggtcccaacttctagaacaacctggtcgatccacgcgaaacacgaatggatgaccacagaagatatgcttgccgtatggaatagagtatggatccaagaaaatccctggatggaagataagacacccgttgagagttgggaggaggtaccatatctcggaaagagagaggatcaatggtgtggatcactcataggtctcacctcgagggctacgtgggcgaaaaatatccaaactgccataaatcaagtacgctctttaattggtaatgaagaatacactgattatatgccctcgatgaaacgttttagaaaagaagaagaagaagctggggttctatggtga

SEQ ID NO: 22597 - RNA, 9876 nt, synthetic construct
  misc_feature 1..9876: note = derived and/or modified CDS sequence (opt6) from DENV-2__EU687228__SS-prME
  source 1..9876: mol_type = other RNA
acagcaggggtaattattatgttgattccaactgctatggcatttcacttaacgacaagaaatggtgaacctcatatgatagttggaaggcaagaaaaaggaaaaagtctattatttaaaactgaagatggagttaacatgtgtaccctgatggcaattgatctgggagaactttgcgaagatacgataacatacaaatgcccacttttaagacaaaacgaacccgaagatatagattgttggtgcaattccacttctacatgggtaacctacggtacatgtactacaacaggcgaacatcgtagggagaaaaggtccgtcgcattagttccacatgtcgggatggggttagaaacgcggaccgaaacgtggatgtcatcggaaggtgcttggaaacacgttcaaagaatagaaacatggattctccgacacccaggttttaccataatggcagcaattcttgcttataccataggcaccacgcattttcaacgagcgctcatttttatattactaacagcagtagcacccagcatgaccatgcgatgtatcggaatatctaacagagactttgtagaaggagtaagtggcggtagttgggtagacatagtattagaacacggatcgtgtgttacaactatggccaaaaataaaccgactcttgactttgaattaataaaaactgaagcaaaacaaccggcaacgttacgaaaatactgtatagaagcaaaactgacaaatactacgacagaatcccgttgtccgacacaaggggaaccatctttaaacgaagaacaggacaaacgattcatttgtaaacacagcatggtagatcgaggatggggaaatggttgtggcctgttcggtaaaggcggaatcgtgacatgtgcaatgttcacttgtaagaaaaatatggaaggcaaagttgtattaccagaaaatcttgaatataccattgtaataaccccacactctggagaagaacatgctgttggtaatgataccggtaaacatggaaatgaaataaaaataacaccccagtctagtataacagaagcagaattaactggctacggtacggtcacaatggaatgttctccgcggacgggattagatttcaatgaaatggtcctattacagatggaagacaaagcgtggttagttcaccgccagtggtttctcgatcttccactcccgtggctgccaggtgcagatactcagggatccaactggatacagaaagaaacgttagtaacctttaaaaatcctcatgcaaagaaacaagatgtcgtggtactaggatcacaggaaggcgcgatgcatacagcattgactggtgcaactgaaattcagatgtcgtcaggcaatttattgtttactggacatctaaagtgtagattaagaatggacaagttacaattaaaaggcatgagctactctatgtgtacaggtaaatttaaaattgtaaaggaaatagcagagacacaacatggtacgattgtcatcagagtgcagtatgaaggggacggttcaccttgtaaaataccctttgaaataatggaccttgaaaagagacacgtattaggacgccttataacagtcaatccaatcgttactgaaaaggacagcccagtaaatattgaagctgaaccgccgtttggtgacagctatattatcattggcgtagaaccaggtcaactcaaattaaactggttcaagaaaggtagtagcataggtcaaatgtttgaaacaacaatgcgtggggctaaaaggatggccatattaggagacaccgcatgggacttcggcagcctcggtggcgtatttacctcaatagggaaagcgcttcaccaggttttcggtgcaatatacggagctgctttttctggagtgtcttggacaatgaagatattaataggtgttattattacttggataggcatgaatagcagatctaccagcttgtcggtaagcctagtacttgtcggtgtagttacactatacttaggagtaatggttcaagcagattcaggttgtgttgtatcatggaaaaataaagaactaaaatgtggttctggcattttcataacagataatgtacatacctggacggagcagtataaattccagcctgagagtccaagtaagttggccagcgctatccaaaaagcacatgaggagggcatctgtggcatccggagtgtcacgagattagagaaccttatgtggaaacagattacaccggagctgaatcatatattatctgaaaatgaagtgaagttaacgataatgaccggtgatattaagggtataatgcaagctggaaaaaggagtctacgtccacaaccaaccgaattgaaatactcgtggaaaacatggggaaaagcaaaaatgttaagcacagaaagccataatcaaacatttttgatagatggaccggaaacagcagaatgtcctaacacgaacagagcttggaactcactagaagtagaagattatggattcggcgtttttagcacaaatatatggttaaaattacgtgaaaaacaagatgtcttttgcgattcaaaattaatgagcgctgccattaaggacaatagagctgttcacgcggatatgggttattggatagaaagtgcattaaacgacacgtggaaaatggaaaaagctagtttcatcgaaataaaaagctgccactggccaaagagtcacacattgtggtccaatggagtactagaatcagagatgatcataccaaagaattttgctggcccggtgagccagcataattaccgacctgggtaccatacccaaacagcagggccatggcacttgggaaaattagagatggattttgatttttgtgaaggaaccacagtcgtcgtaaccgaagattgtggaaatagaggaccatcactgaggactacaacggcatccgggaaactgattacggaatggtgctgtagatcatgcaccctccctccgttgcgatatcgaggagaagatggctgttggtatggtatggagatcagaccgttaaaagagaaagaagagaacttagtaaattcccttgtaacagccggtcacgggcaaatcgataatttttctttaggcgtattaggcatggctttgttccttgaagagatgttaagaactcgcgttggaacgaagcacgctatattgctcgtcgctgtttcatttgttactctcataacaggtaatatgagtttccgtgaccttggaagagtaatggtcatggtaggtgctaccatgactgacgatattggaatgggagtgacatatttagcgctcctagccgcattcaaggtaagacccacttttgctgccggattactattaagaaaacttacaagtaaagaattaatgatggcgaccataggtatagcgttactgtctcaatccacaataccagagaccatactggaactaacggacgcgctagctctgggtatgatggttttaaaaatagtgagaaacatggagaaatatcaattagccgtaaccataatggcaatatcatgcgtacctaatgctgtaatattgcagaatgcttggaaggtatcctgtacaatcttagctgcagttagcgtaagcccattattactcacttcaagccaacaaaaagcagactggattccactcgctctcaccataaaaggcctaaacccaactgctatatttttaactacattgagccgtacaagcaaaaagcgaagttggccgttgaatgaggcagtaatggctgttgggatggtaagtatactcgcatcgtctcttctgaaaaatgatatcccaatgacaggcccgctagtagcaggagggctactcacggtttgttacgtactaacaggtcgatcggctgacctagagttggagcgagcagcagatgttaaatgggaggaccaagcagagatatccggttcaagtccgattctatcaataacgatatctgaggacgggtccatgagcatcaaaaatgaagaagaagaacatacactgaccatattgatccgcacaggcctgcttgttatttccggagtattccccgttagtattcctattacagctgccgcatggtatttatgggaagtgaagaaacaaagagccggtgtactatgggacgtcccgtcaccaccgcctgtagggaaagctgaattagaggacggtgcctatcgaataaaacaacgaggcatattcggttactctcaaatcggcgcaggagtgtacaaagaggggactttccacacgatgtggcacgtaaccagaggcgcagtcttaatgcaccgtggtaaacggattgaaccctcctgggccgatgtcaagaaagatcttatatcctacggcgggggctggaagttagaaggagaatggaaagagggagaagaagtacaagtgttagcattggaacctggcaaaaatcccagagctgttcaaactaaacccggcttattcaagaccaataccggcacaatcggtgcagtttcgttagatttctctccaggaactagcggctctcccatagtcgaccgcaagggcaaagtcgtgggattgtacggtaatggagtagtcactagatcgggcgcctacgtatctgcgattgcccaaacggagaaaagtatcgaagacaacccagagatagaagacgacatatttcggaagaaaaggctaacaatcatggatctgcatcctggagctggaaaaactaaacgctatcttcctgcaatcgtcagagaagctataaaacgtggtttacgtacattaattttggcacctacgcgcgtggtagcagcagagatggaagaagctctcagagggttacccattaggtatcaaaccccagcaatccgtgcagagcatactggtcgagagatcgtcgatttgatgtgccatgcgacattcaccatgagacttttaagcccagtacgtgtacctaattacaatttaataataatggacgaagcacactttacagatcccgccagcatagctgctagagggtatatttcaaccagagtagagatgggagaagccgctgggatatttatgacagctacacctccaggcagcagggacccgttcccacaatcaaatgcgccgataatggatgaggaaagggagataccggaacgttcatggaacagcggacatgaatgggttactgattttaaagggaagacagtatggtttgtgccctctattaaggcaggtaacgatattgctgcgtgcctgcgtaaaaatggcaagaaagtgattcaactaagtagaaaaacattcgactccgagtatgtgaaaacacgagcaaatgattgggattttgttgtaacaaccgatataagtgagatgggggctaatttccgggcagagagagtgatagatcctcgacgctgtatgaaaccagtaatcctgacagacggcgaagaaagggtaatccttgctgggcctatgcctgtaactcattcaagtgcagctcagagacgtggaagaataggcaggaacccgaaaaatgaaaacgatcaatatatatatatgggagaaccactcgaaaacgatgaggattgcgctcactggaaagaggcgaaaatgttactggacaatataaatacaccagaaggcattatccctagcatgttcgaacccgaaagggaaaaagtcgatgctatagacggagaatatagattacgaggtgaagctagaaaaacatttgtcgatctgatgagacgaggggatctaccagtatggctagcttatcgtgtcgcagcagaaggaattaattatgctgaccgccgatggtgcttcgacgggattaaaaacaatcaaatattagaagaaaatgtagaggttgaaatatggacgaaagaaggagaaaggaagaaactaaaacctcggtggctcgatgcaaggatttactcagatcccttagcgcttaaagaatttaaggaatttgcagcgggacgaaaatcgttaacgttgaatcttataacagagatgggccgtctacccacatttatgactcagaaagcgagagatgctctggacaatctggcagtgctacatacagctgaggtaggtggacgggcttataaccatgcactatcagagttaccagaaacattggaaacacttctcttattaaccttattagcaacagttaccggaggtatctttctctttttgatgtcgggaaaggggataggaaagatgacattaggaatgtgctgtattatcactgcaagtatattattatggtatgcacaaatacaaccacattggatagcagcttctataattctagaatttttcctaatagttttgctaataccagagcccgaaaaacaacgaacaccccaagacaaccaactcacatatgtggtgattgcaatattgactgtagtagcagcaacaatggctaacgagatgggattcctagagaaaacaaagaaggatctgggattgggtagcattacaacgcaagagtctgagtccaacatattagatattgacttgagaccagccagtgcctggactttatacgctgtagcaacaacttttgtcactccaatgttgagacatagcatagaaaatagttcagttaatgtttcactaactgcaattgctaatcaagcaactgttctaatgggtctaggacgcgggtggcccttatcgaaaatggacataggggtcccgttgcttgcaatcgggtgctactcgcaagtaaacccaattacactcacagcagcacttttgctgttagtggcacattatgcaataataggaccaggactacaagcaaaagccacccgtgaagcacaaaagagaacagctgcggggataatgaaaaatcccaccgtcgacggtataactgttatagacttagaaccaataccttatgatccaaaattcgagaagcaactaggtcaagtgatgttgttagtattgtgcgtaacacaagtactgatgatgagaacgacttgggccttatgtgaagcgttaacattagctacggggcctatatctacattatgggaaggaaacccaggacgtttctggaatacaacaatagccgtttcaatggctaatatattccgaggatcttatctagccggtgctggacttttattctccataatgaaaaatacaacgaataccaggagaggtactggtaatataggtgagacactcggagaaaagtggaagtcaagattaaatgcgctaggaaagagtgaatttcaaatttacaagaaatctggaatacaagaagttgaccgaaccttagctaaggaaggaattaagagaggggaaactgatcaccacgcagtttccagagggtctgcaaaactccggtggtttgtagaacgtaatatggttacaccggaaggaaaagttgtcgacttagggtgcggccgaggaggatggtcatattattgtggtggcctaaagaatgtcagagaagtaaaaggcctaacaaaaggtgggccaggtcacgaagaaccaatcccaatgtcaacgtatggctggaacctcgtgagacttcagtctggcgtagatgtattctttactccgcctgaaaaatgcgatacattactgtgtgatatcggcgaatcgtcaccaaatcccacaattgaggcaggaagaactttgagagttttaaatctggtggagaattggttaaataataatacacaattctgtattaaagtgttaaatccatatatgcctagtgttatagagaaaatggagacactccaaagaaagtatggaggggctctggtgagaaacccgttatcgagaaatagtacacatgaaatgtattgggtgagcaatgcgacagggaacatcgtaagcagtgtaaacatgattagtcgaatgttaatcaataggttcaccatgaaacataagaaggcgacttacgagccagatgtggatttaggttctggaacaagaaatatcgggatagaaaatgaaataccaaatctcgacataataggcaagagaatagagaaaataaaacaagaacacgagacgagttggcattatgaccaggatcatccctacaaaacgtgggcctatcacggttcttatgaaaccaaacaaactggcagcgcgtcatcgatggtaaatggtgtagtaaaattgttaacaaaaccgtgggatgtagttccaatggttacacaaatggccatgaccgatactaccccgttcggccagcaaagagtatttaaagagaaagtagatactaggacacaagaacctaaagaaggaacaaagaaactaatgcgcataaccgcagaatggttatggaaggaactcggcaaaaagaaaactcccagaatgtgcacaagagaagaatttacacggaaagtgcgctcaaacgcagctttaggagccatttttactgatgaaaataaatggaaatcagcacgagaagcagtcgaagattcaaggttctgggagttagtagatcgtgagagaaatctacaccttgagggcaagtgtgagacttgcgtatataacatgatgggcaaacgagagaagaaactcggtgaatttggaaaggcgaaaggatcacgagccatatggtatatgtggttaggagcacgtttcttggaatttgaagcgttgggatttctaaacgaggatcattggttcagtaggggaaattccctaagcggtgtagaaggagaaggactccataaactaggatatatcttaagagatgtttctaagaaagaagggggagctatgtacgcagatgacacagccggatgggacacaagaataaccttggaagacctgaagaatgaagaaatggtcacaaaccatatgaaaggagaacacaagaaacttgccgaggcaatttttaaattaacttaccagaacaaagttgtgagggttcaaagacctacaccccgtggcacagttatggatataatttcccgcaaggatcaaagaggtagcggacaagtcggcacatatggattgaatacatttaccaacatggaagcccaactgattagacaaatggaaggtgagggaatatttaaatcaatacagagactaacagtcactgaagaaatagcagtacaaaactggcttgctagggtcggaagagaaaggttaagtcgaatggcaatttctggtgacgattgtgttgtgaaaccactagatgaccgcttcgcgtcggcacttacagcacttaatgacatgggcaaagtaaggaaggatatacaacaatgggaacccagtaggggttggaatgactggacacaagtccctttttgtagccatcattttcatgagctagtaatgaaagatggtagagtacttgtggttccttgtagaaatcaagacgaattaatcggccgagccagaatttcacaaggtgcaggctggtcattaaaagagacagcgtgtttagggaaatcatatgctcagatgtggacgcttatgtatttccatcgaagagacttgaggttggccgctaatgccatatgctcggccgttccatcccactgggttccaactagcagaacgacgtggagtattcatgctaaacacgagtggatgaccacagaggatatgttggcagtatggaatcgcgtatggatacaagaaaatccctggatggaagacaaaacaccagtcgaatcatgggaagaagtcccttatttaggaaagcgggaagatcaatggtgtggtagtctcataggtctaactagccgagcgacttgggccaaaaacatacaaaccgcaattaatcaagtgagatcgctaattggcaatgaagaatatacggattatatgccaagcatgaaaaggtttcgaaaagaagaagaggaagccggtgtgctatggtaa

SEQ ID NO: 22598 - RNA, 9876 nt, synthetic construct
  misc_feature 1..9876: note = derived and/or modified CDS sequence (opt6) from DENV-2__EU687230__SS-prME
  source 1..9876: mol_type = other RNA
acggctggtgttatcataatgcttattccgaccgcaatggcttttcatcttacgacacgcaatggagaaccacatatgatagttgggcgacaagaaaaagggaaatccctacttttcaaaacagaagatggtgtaaacatgtgcacactaatggcaatagatttaggggaattatgtgaagatacaataacatacaaatgtccattgctgcgacaaaatgaaccagaagacatagattgctggtgtaattccacaagcacatgggtgacttatggtacgtgtacgacgacgggtgaacatagaagagaaaaacgttctgtggcattagtgccgcatgttggaatgggacttgaaacaagaacggaaacttggatgtcctcagaaggagcgtggaaacatgttcaaagaatagaaacctggatactaaggcatccggggtttaccattatggcagcaattttggcctacacaataggtacaactcattttcagcgagcattaatttttatcttattaactgctgttgcaccatcgatgactatgcgatgtatcggaattagcaacagagatttcgtagaaggagtatcgggtgggagctgggttgatattgtactagaacatggatcctgcgttacaactatggctaaaaataaaccgactctagattttgaactgataaaaacagaagcaaaacaaccagcaacactcaggaaatactgcatcgaagctaaattaactaatacgacaacggaatcaagatgtccgacccaaggggaaccatccctcaatgaggaacaagataaacgattcatttgtaaacacagtatggtagaccgtggatggggtaatggatgtggactttttggaaaaggaggcattgttacgtgtgcaatgttcacatgtaagaaaaacatggagggaaaagtcgtcctcccggaaaatctggagtatacaatagtgatcactcctcactcaggtgaagaacatgcggtaggtaacgatacaggcaaacatggtaaagaaattaagattacaccacaatcttcaattactgaagccgagttaacaggatatggtacagtgacgatggagtgttcgccaagaacaggacttgatttcaacgaaatggttctattacaaatggaagacaaagcgtggctagtacacagacaatggtttttagacttaccacttccatggcttccaggagcggacacccaaggttcgaattggatacagaaagaaactctagtcacattcaaaaatccacatgccaagaaacaagacgtcgtcgtgttaggaagtcaagagggagcgatgcatacagcactaaccggagcaactgagatacagatgagtagtggaaatctacttttcacgggtcatttaaaatgtagactacgaatggataaacttcaacttaaaggaatgtcgtattcaatgtgtactggcaaattcaaaatagtgaaggaaatagcagaaacccaacatggaactattgttattagagttcagtacgaaggagacggaagtccttgtaaaataccatttgaaatcatggatttagaaaaacgccatgtactaggacgtctaattacagtgaacccaatcgttacagaaaaagactcacccgttaacatagaagctgaaccaccttttggagactcttatataataataggtgtagaaccaggacaacttaaattgaactggttcaaaaaggggtcatcgatcggtcaaatgttcgagacaacgatgcggggcgcgaagcggatggccattttaggggacacagcttgggattttgggtcactcggaggtgtctttacttcgatcggtaaggccctccatcaggtatttggggcaatttatggtgccgcattctcaggtgtgtcatggacgatgaaaattcttatcggagttatcataacatggattgggatgaatagtagaggtacctcattaagcgtttcattagtacttgttggtgtagtcaccctctatctaggggttatggttcaagctgattccggatgtgttgtatcatggaaaaataaagaactaaagtgtggatcaggtatatttataacggataatgtgcacacatggactgaacaatataagttccaaccggaaagtccaagtaagttagctagcgcgatacaaaaagcacacgaagaaggaatatgtggcatcagatcagtgacacgacttgaaaatctcatgtggaaacaaataactcccgagctgaatcatatcctgagtgagaatgaagtgaaacttacaatcatgactggtgatattaaaggaatcatgcaagcaggtaagagatcactacgaccgcaaccgacagagctgaagtattcctggaaaacttggggcaaggcgaaaatgttgtcaacggaaagccacaatcaaaccttcctaattgacggtcctgaaactgccgagtgccctaacacgaacagagcatggaactcactagaagtagaagactacggttttggtgtattcagtacaaatatttggctcaaactcagagaaaaacaggatgtattttgtgatagtaaattgatgtcagccgccataaaagataatagggctgtacatgcagacatgggatattggatagagtccgcgttaaatgacacttggaagatggaaaaagcatctttcatcgaaataaagagttgtcattggccaaaaagtcataccctatggtcgaacggagtacttgaaagcgaaatgataatacccaaaaacttcgcagggcctgtatctcaacacaactacaggccgggataccacacacaaaccgccggaccttggcatttgggtaaattagagatggactttgacttttgcgagggaactacggttgtggttacagaagactgtggcaatagaggtccgagtctaagaactacaactgcgtctggaaaattaatcacggaatggtgttgccgaagttgtaccctaccaccactaagatatagaggagaagacggatgctggtatgggatggaaattcggccattaaaggaaaaagaggaaaatttagtaaattccctcgtaaccgcaggtcatggccaaatagacaacttttcactaggagttctaggaatggcgttattcctagaagagatgctacgaacaagggtgggcacgaaacatgcaattctattagtagctgtgagttttgttacactaattaccggtaatatgagcttcagagatctgggacgcgtgatggtgatggttggtgcaacaatgacagacgatatcggcatgggtgtgacatacttagcattacttgccgcatttaaagtccgacccactttcgccgcaggccttctcttaaggaagttaacttcaaaggaattaatgatggctacaataggtattgcattactaagccagtccacaatacccgaaactatcctagagcttacagatgcactggcactgggtatgatggttcttaaaatagtacgcaacatggaaaaataccaactagctgtaaccataatggccatatcatgcgtaccaaatgcagtaattttacaaaatgcctggaaagtttcatgcacaatattagcggctgtatcagtgtctccactgttactcacaagttcccaacagaaggctgactggatacccttagcccttacaattaaaggactcaaccccacggcgatattcttaactaccctatcacgaactagcaaaaagagatcttggcccttaaatgaagcagtgatggcagtgggtatggtaagcatcctagcctcgtctctattaaagaatgacatcccaatgacggggcctctagtggcaggaggattgttaacagtgtgttatgtgctaactggccgcagcgcggacttagaattagagagagctgctgacgtgaaatgggaagatcaagcagaaatatccgggtctagcccaattttatcaataactatatcagaggatggaagcatgagtatcaaaaatgaggaagaagaacataccctaacaatcttaataagaacaggtctattggtaatatccggtgtattccctgtgtccattcccatcacagcagccgcatggtacctgtgggaagtaaagaaacaaagagctggggtcctctgggacgttccatcgccaccgccagtagggaaagcagagctggaggatggagcctacagaatcaaacaaaggggaatttttggatatagtcaaattggagcgggagtatacaaagagggaacatttcacaccatgtggcatgtaacaagaggagcggtacttatgcacagaggcaaacgaatagagcccagctgggcagacgtcaagaaagacctcatcagttatggaggcgggtggaaactcgaaggggaatggaaagaaggagaggaagtacaggtcttagcactagaaccaggaaagaacccacgagcagtgcagaccaaacccgggttgtttaaaactaatactggaacaataggagcagtcagcctggattttagtccaggaacttctgggtctcccattgtagaccgtaaaggaaaggtagtcgggctctatggtaacggggtcgtcacaagatctggcgcatacgtaagcgctattgcacaaacggaaaaatcgattgaagataatccagaaatcgaagacgatatcttcaggaagaaacggttgacaataatggacttacatccaggagcaggaaaaacgaaacggtatttgccggcaatagtaagagaggctatcaaaagagggttacgaacactaatcctagcacctacaagagtagtggctgctgaaatggaggaggcattaagaggactaccaatacgataccaaaccccggctataagggcagaacatacaggaagggaaatcgtagatcttatgtgccatgccaccttcactatgcgactgctatcaccggtaagagttccaaattacaacttgataatcatggacgaagcacatttcaccgaccctgccagcattgctgctcgaggttacataagtaccagagtagaaatgggagaagctgcgggcatatttatgacagcaacacctcctggatccagggacccattcccccaatcgaatgccccaataatggatgaagaacgtgagattccggaaagatcatggaactcaggccacgagtgggttactgacttcaaaggaaaaactgtatggttcgtaccatccatcaaagcaggcaacgacatagcagcatgcctacgaaagaatggcaagaaagtaatacaactctcaagaaaaacgtttgattccgaatatgtcaaaacaagagctaatgactgggacttcgtagtaacgactgatatttcggaaatgggggcaaattttcgcgcagagcgagttatagatcccagaagatgtatgaaacccgtcattttgactgacggggaggaacgtgtgatactggcaggtccaatgcccgtaacacattcctcggccgctcaacgcagaggaagaataggtagaaaccccaaaaatgaaaacgaccagtacatatatatgggggaaccattagaaaatgatgaagattgtgctcactggaaagaagccaaaatgctattagataatattaatacaccggaaggtatcataccgtccatgtttgaaccagaaagagagaaagtggacgcaatagatggtgaatatcgattacgcggtgaagctaggaagacttttgtagatctaatgaggaggggagaccttcccgtctggcttgcatatcgcgttgctgccgagggtataaattatgctgatagaagatggtgttttgacggcataaagaataaccaaattctggaggaaaacgttgaagtcgagatttggacaaaggaaggcgaaagaaagaaacttaaaccacgttggttagacgccagaatatattcagatccgttagcacttaaagaatttaaagagtttgccgcagggcggaaatcactaacactaaatcttattacagaaatgggacgtcttccaacgttcatgacacagaaagcacgagatgcattggataatttagccgtgttgcacactgcagaagtagggggtagggcttataatcacgctctgagcgaattaccagaaacactggaaacattattgctgctcactctactcgcaacggttacagggggaattttcttatttttaatgagcgggaaaggtataggtaaaatgacgttaggaatgtgctgtataataacagcttctatcctattatggtacgcacagatacaacctcactggatagctgcttctattatacttgaatttttcctcatcgtacttttaattccggaacccgagaaacagcgaacccctcaagacaatcaactaacatacgtagtaatagcaatcttaaccgtcgtagccgcaaccatggcaaacgaaatgggattcctagagaaaaccaagaaagacttgggtcttgggagtattacaacacaggagtcagaaagcaatattctcgacatcgatctacgtccagctagtgcgtggaccctctatgccgttgccacaacctttgtaacacccatgttacgtcacagtattgagaatagttccgttaatgtgtcattaacggcaattgccaatcaagcaacagtactaatgggcttgggaaggggttggccattgtctaaaatggatataggagtgccccttttagctataggttgttatagtcaagtaaacccgatcaccctcacagcggcactgctgctcctagtcgcgcattacgccatcatcgggccgggactacaagccaaagcaaccagagaagcgcaaaagcgaactgcagctggaataatgaaaaacccaactgttgatggcattacggttatagacctggaaccgatcccgtatgatccaaaattcgaaaaacaactaggccaagtgatgcttttagtcctgtgtgtaacgcaggtattaatgatgagaacaacttgggcactatgtgaggctctgacactagcaacaggaccaatatcaaccctgtgggaaggcaacccagggaggttttggaataccactatagcagtatctatggcaaatatattccgtggatcgtacctagctggtgcaggacttctcttttcgatcatgaaaaatactactaatacccgacgagggacaggcaatattggtgaaacccttggagaaaaatggaaatctagattaaacgccctaggcaaatcggagtttcaaatatacaagaaatccggaatacaagaagtagatagaaccctagcaaaagaaggaatcaaaagaggagaaactgaccatcatgccgtaagtagaggtagtgctaagctccgatggtttgtggaaagaaacatggttacccccgaaggaaaagtagtcgatttgggatgtggaagaggcggatggagttactactgtggaggactaaagaacgtaagagaagtcaagggtttaacaaagggaggaccaggacatgaagaacctatcccaatgagcacatatgggtggaatctcgttagattacaatccggagtagatgtattctttactccacccgaaaaatgtgatacactcctatgcgatataggagagtcaagcccgaatcccacaatagaagcggggcggacactacgggtattaaatttggttgaaaattggttgaataacaatacccaattctgtattaaagtactgaacccgtatatgccgagtgtaatagagaaaatggaaactctacagcgaaaatacggaggggcgctcgtcagaaatccattatcaagaaattcaactcatgaaatgtattgggtttctaatgcgacagggaatatagtgtcttccgttaatatgatttctcgcatgttaattaatcggttcactatgaaacataagaaggctacatacgaaccggacgtagatcttgggtcgggtaccagaaacataggcatcgaaaacgaaatcccaaatttggatataataggaaaacggatcgagaaaataaagcaagaacacgaaacttcatggcattacgatcaggaccatccttacaaaacatgggcttatcatggttcatacgaaacaaaacaaactggttcagcgtcctcaatggttaacggagtcgttaaacttttaacgaaaccttgggatgtagttccaatggttactcaaatggccatgaccgatacaactccgttcggacagcaacgagtgtttaaagagaaggtagacactaggacacaagagccaaaagaaggaactaaaaagctaatgagaataacagccgagtggctatggaaagaactaggcaagaagaaaacacctcgaatgtgcacacgtgaagaatttacaagaaaagtgcgttcaaatgctgcactaggcgccatattcacagatgaaaataaatggaagtcggctagggaagcagtagaggacagtagattctgggaactcgtagatcgcgaaagaaatctacatttggaaggtaagtgcgaaacctgtgtatacaacatgatgggaaagcgagagaagaaactaggtgagttcggaaaagcaaaaggctcacgtgctatatggtatatgtggctcggagctcgcttcttagagttcgaagctctaggcttcttgaatgaagatcattggttctctagaggcaattcattatcaggtgtagaaggagaaggattacataaactcggatatatcttaagagacgttagtaagaaagaagggggtgctatgtatgcagacgatacagcaggatgggacacacgcattacattggaggacttgaagaatgaagagatggttactaaccatatgaagggcgaacataaaaagctagcggaggcaattttcaaattaacgtatcaaaacaaggtagttagagtccaaaggcccactccacgcggtacggtgatggatattataagtagaaaagaccaaaggggctccggacaagtcggtacttatgggctaaatacatttacaaacatggaggcccaactcatccgacagatggaaggtgaaggaatattcaaaagtatacaaagacttacggtaaccgaggagattgcagtacaaaactggttggctcgcgtaggaagagaaagactaagtaggatggctatatcaggggatgattgtgttgttaaaccattagatgatcgctttgcttcagcactgacagcccttaacgatatgggaaaagtccgcaaagatatacaacagtgggaaccatcaagaggctggaatgactggactcaagttcccttttgttcacatcacttccacgaacttgttatgaaagacgggagagttcttgttgtaccttgcaggaatcaagacgagctaataggtagggctaggatttcacagggtgcgggttggagtttaaaggaaaccgcgtgtttaggtaaaagctacgcccaaatgtggacgttgatgtattttcatcgacgagatttaaggttggcagccaacgcgatctgcagtgcagttccaagccattgggtccctacatcaaggacaacatggtcgatacatgcaaagcatgaatggatgactactgaagatatgcttgcagtatggaatcgagtgtggatacaagagaacccatggatggaagacaagactccagtcgaaagctgggaagaagtaccgtacctaggaaagagagaagaccagtggtgtggatcactaattggtttgacctctcgagcaacctgggcaaagaacatacaaaccgcaataaaccaagtaaggtcattaatcggaaacgaagaatacacagattatatgccatcaatgaaacgattcagaaaggaggaagaagaagccggagtactatggtaa

SEQ ID NO: 22599 - RNA, 9876 nt, synthetic construct
  misc_feature 1..9876: note = derived and/or modified CDS sequence (opt6) from DENV-2__EU687231__SS-prME
  source 1..9876: mol_type = other RNA
acagcaggggttatcataatgctaattccaacagcaatggcttttcacttgacaactcgtaacggtgaaccacatatgattgttggaagacaagaaaaagggaaaagcctgctattcaaaaccgaagacggagtaaatatgtgcacgcttatggctatcgacctaggagaactctgtgaagatactatcacatacaaatgtccattattaagacaaaatgaacctgaagatatagactgctggtgcaactcaacgtcgacatgggttacctatggaacgtgtactactacgggcgaacatcgaagagaaaaacggtctgttgcgttagttccacacgtaggtatgggtttagaaaccagaactgaaacatggatgtccagtgaaggtgcatggaaacatgttcaacgcatagaaacatggattcttagacacccaggatttacaataatggcagcaatactagcttacactattggaaccactcatttccaaagggcattaatcttcatccttcttacagcagtagcaccttcaatgacaatgcgctgtataggtatatcaaacagggactttgtagaaggtgtttcgggcggaagttgggtagatatagtcttagaacacggaagttgtgtaacgacgatggccaaaaataaacctacactcgattttgaactgataaaaacagaagcgaaacaaccggcgacgctaagaaaatattgcatagaagccaaattgacgaatacaactacggaatcaagatgtccaacacagggagaaccgtcacttaatgaagaacaggataaaaggttcatctgtaaacactcaatggtcgatcgtggatggggaaatgggtgtggtcttttcggcaaaggtggaatagtgacatgcgcaatgttcacttgcaagaaaaatatggaggggaaagtggtcctacctgagaatctggaatatacaatcgtaataactccacacagtggtgaggaacacgcggtagggaatgacacgggaaaacacggtaaagaaatcaaaataacaccacagagttcaattacggaagccgaattaaccggatacggcacggtcacaatggaatgcagcccgaggacaggactggattttaatgagatggttttattacaaatggaagataaagcatggttagtccacagacagtggttcctagatttacctttaccttggttaccaggcgccgatacacaaggatcgaattggatacaaaaagaaaccctggtaacatttaaaaatccacatgcaaagaaacaggacgttgtagttttgggtagccaagagggtgcgatgcacactgccttaacgggtgcaaccgaaattcaaatgagttcgggaaacttgctatttactggccatcttaaatgtcggttacggatggataaattacaactgaaaggcatgtcttattccatgtgtacgggcaaatttaaaattgtaaaagagatcgcagaaactcaacacggtacaatagttattagagtgcaatacgaaggagatggttcaccatgtaagatcccattcgaaataatggatctggagaaacgacatgtactgggacgtttaataacggttaatccgattgtcacagaaaaagattccccagttaacattgaggcagaaccaccgtttggggactcttatataataattggggttgaacctggacaattaaaattaaattggttcaagaaaggatctagcataggacaaatgttcgaaacgacaatgcgaggagcaaagcgaatggctattttaggggacacagcctgggatttcggctccctgggaggtgtctttacatcaatagggaaagctctccatcaagttttcggtgcaatttacggagcagccttttcaggcgtatcgtggacgatgaaaattctaataggagtaataataacatggataggaatgaactcacgttctacaagtctcagtgtgagcctagtcttagtaggagtagtaacattatatctcggtgtgatggtgcaagccgacagtggttgcgtcgtttcctggaaaaataaagagttaaagtgcggttcaggtatctttataacagacaatgtgcatacatggacagagcaatacaaattccaaccggaatcacctagtaaactagcatctgcaattcaaaaagctcatgaagaaggcatttgcggcataagatcagtcacaagattagaaaacctaatgtggaagcaaattacaccagaattgaatcatatattgagtgaaaacgaagtgaaattaacaattatgaccggggatataaaaggtataatgcaggctggcaagcgctcactcaggccacaaccgactgaattaaagtacagttggaaaacgtggggaaaagctaagatgctatcaacagaaagtcataaccagacattccttattgatgggccggaaacggctgagtgtccaaatactaatagagcatggaactcattggaggttgaggattatggtttcggcgtattctcgactaatatatggctaaaattacgagaaaaacaagacgtattctgtgactcaaaattaatgtccgcggcgataaaagacaacagagcagtacatgcggacatgggttattggatagagagcgcgttgaatgacacttggaaaatggaaaaagctagcttcattgaaataaaatcatgtcattggcccaaaagtcacacactatggtcaaatggggtactagaatccgaaatgataattcccaaaaattttgccggtcccgttagtcaacataattatagacctggatatcacacccaaaccgcaggaccttggcatctagggaaattagaaatggactttgatttctgcgaaggaacgacagtagtagtcacagaagactgcggtaatagaggtccttctttgaggactactactgcttcaggtaagctcattacagaatggtgttgtcgttcctgtacattaccacccctgaggtatcgaggtgaagatggatgctggtacggaatggaaatcagaccactaaaagaaaaggaagaaaatttagttaatagtcttgttacagctgggcacggtcaaatagataatttcagtctaggggtactaggaatggctctattcttagaagagatgctccgaacaagagtcggcacaaaacacgctatactattggtggcagtgagttttgtcacgttaatcaccggaaatatgtccttcagagacttaggaagagtcatggttatggtgggtgcaacaatgacagacgatatagggatgggggtaacttatttagcactcctagcagctttcaaagtaagaccaaccttcgcggccggtcttcttctaaggaagttaacaagtaaagagctcatgatggctacgattggaatagcactcttgtcacaaagtaccatacctgaaactattcttgaactcacagatgcgctggcactgggaatgatggtcttaaaaatagtgcggaacatggaaaagtatcagcttgcagttacaataatggcgataagctgtgttccaaacgcagtaatactgcaaaatgcatggaaagtaagttgtaccattctagcagctgtttctgtatcacctctattattaaccagttcccaacaaaaagctgactggatccctttagcgttaacaataaaaggtctgaatccaactgctatctttttgaccacgttatcgaggactagcaaaaagagatcttggcccctaaatgaagcagttatggcagtagggatggtatctatactagcaagctcattactcaaaaatgatattcccatgaccggacctttggtcgcaggcgggctattaacagtatgttacgtactcactggccgctcggcagacctagagttagaaagagccgcagatgtaaagtgggaagatcaagcggaaataagcggttcttctcccatattatcgataacaatatctgaagatgggtcgatgtcaataaagaacgaagaagaggaacatacattaacgattcttatacgaaccggattgttagtcatctctggagtatttccagttagcattcctataacagcagcagcatggtatctttgggaggtaaagaaacaacgagcaggggtcctatgggatgtcccatcgcctcctcctgtgggaaaagccgaactggaagacggggcttatcggattaaacaaagaggaatttttggctattcacaaataggggcaggagtctataaagagggtacatttcacacgatgtggcatgtaacccgtggtgcagttctaatgcatcgtggaaaaagaatagaaccgagttgggccgatgtgaagaaagacctaatttcatacggtggcggatggaagttggaaggcgaatggaaggaaggtgaggaagtacaggtcttagcattagagcccggcaaaaatccacgtgctgtgcaaacaaaaccaggactatttaaaaccaatacaggcacaatcggagccgttagcctggacttctcacccgggacgtctgggtctcccattgtggaccgaaagggaaaagtagtaggattgtatggaaatggtgtagtaactagatcaggagcgtatgtgagtgctatagcacaaacagagaaatcaatagaagataacccagaaattgaggacgacatcttcagaaagaaaaggttaacaattatggatttacaccctggtgcaggcaagactaaacgttacctccctgcaatagtgagagaagcaataaaacgagggctacgaacgctaattctcgcaccaactagggttgttgctgcagagatggaggaagctctaagaggcttgccgatccgataccaaacaccagcaatacgcgctgaacacactgggcgtgaaatagtagacctaatgtgtcacgcaacgtttacaatgagattactttcacctgtgcgcgtaccgaactataatcttataatcatggacgaggcgcacttcaccgacccagcaagtatagcagcccgcggttacataagcacaagagttgaaatgggtgaagcagccggtatttttatgacggccacacctcctggttcaagagatccattcccccaaagcaacgcgcccatcatggatgaggagagggagatacccgaaaggagttggaactcaggacatgagtgggtaacggactttaaaggaaagacggtatggttcgtaccttcaatcaaagccggaaatgatattgcagcctgtttaaggaaaaatggcaagaaagtaatacaactttctcgtaaaacattcgacagtgagtatgtaaaaacaagagcaaatgactgggactttgtagtaacaacagacatttctgagatgggcgctaattttagagccgaaagggtaattgacccacgtcgttgcatgaaaccagtaatattaactgatggcgaagaacgggttatattggcaggtccaatgcctgtaactcacagttctgccgcacaacgccgaggacgcattggacgcaatcccaaaaatgagaacgaccaatacatatatatgggagaaccattggaaaatgatgaggattgcgcacactggaaagaagctaaaatgttgttagacaacatcaatacacccgaaggtattattccgtctatgtttgagcccgaaagagaaaaggtcgatgcaattgatggagaatacagactcagaggcgaagctaggaagacctttgtggacctcatgaggagaggcgacttaccggtttggcttgcgtaccgagtagcagcagaaggaatcaactatgctgatcgccgttggtgctttgatggtataaagaataaccaaattctggaagaaaatgttgaagtagagatatggaccaaagaaggagaaagaaagaaactaaaacctagatggctagacgccaggatctactcagatccgttagcattaaaagaatttaaagagttcgcagcaggaagaaaatcactcaccctgaacctcatcactgaaatgggaaggttacccacatttatgacgcaaaaagctagagacgcattagataatttagccgttttacatactgctgaagttggtggacgcgcatacaaccatgctctttcagaactgccggaaactcttgagacattgttgctactgactctattagctacagtaacagggggaatatttctgtttctcatgagcggaaaagggataggcaagatgacgttaggtatgtgctgcataataactgctagtatacttctgtggtatgcacaaattcaacctcactggatagccgcctcaatcatattagaatttttccttatagtattgcttataccagagcctgagaaacaacgaacgccacaggataaccaactcacgtatgtagtaatagcgatcctcactgttgttgctgctactatggctaatgagatgggatttcttgagaaaactaaaaaggacttaggcctgggcagcatcaccacgcaggagtcagaatccaacatattagatattgacttgagaccggcatctgcatggacactatacgcagtcgcgaccacttttgtaactcccatgctacgacattctattgaaaactccagtgtaaatgtgagcttaacggcaattgccaatcaagctaccgttttaatgggcctaggaagaggatggccattaagcaaaatggatattggagtgcctctactagccataggatgttacagccaagtaaatcccataaccttaacggcggccctcttactattggttgcacattacgcgataatcggtccaggattacaagccaaagcaaccagagaagctcaaaagcgtacagcggcaggcataatgaagaatccaacagtcgacggtataaccgtaatagatctggagccaattccgtatgacccaaaattcgaaaagcaactaggacaagtcatgctcttagtactatgtgtcacgcaagtacttatgatgcggaccacgtgggctctatgcgaggctttaaccctagccacggggccaatttcaaccctctgggaaggaaatccgggtaggttttggaacactacaatagcggtttcaatggcaaatattttcagaggctcctacctcgctggagcggggcttctctttagtatcatgaagaatacaactaatactcgaaggggcaccggaaatataggcgagaccttgggcgaaaagtggaaatcgagactgaatgctcttggaaaatctgagtttcaaatatataagaaatcagggatacaagaggtcgatagaacactagcaaaggaaggaataaaacgaggggaaactgatcaccatgccgtcagtaggggatcagcaaaattgaggtggttcgtcgaacgaaatatggtgacaccggaagggaaagtagtggacctaggctgtggaagaggcggatggagttactattgcggtggattaaagaatgtccgagaagtaaaaggactaacaaaagggggaccaggacatgaggaacccattccaatgtctacctacggctggaatctagttcgactacaatcaggcgtagatgtattctttactccaccagaaaaatgcgacacacttctttgtgatattggggaatccagtccaaatccaacgatcgaggcagggagaacattgcgagtcttaaacttagtggaaaactggctaaacaataatactcaattttgtattaaagtactcaatccttatatgcccagtgtaatagaaaagatggaaacactgcagagaaaatacggaggtgctctagttcggaatcctctaagtcgaaattcaacgcacgagatgtactgggtgtcaaacgccactggtaacatagtgtcgtcagtaaacatgatttcaagaatgttgataaaccgttttacaatgaagcataagaaagccacatatgagccagatgtagatctagggagtggaaccagaaacataggaatagaaaatgaaatacctaatcttgacatcattggaaaaagaatcgaaaatatcaaacaagagcatgaaacatcatggcattatgaccaggatcacccttataaaacctgggcttaccatggatcttacgaaacgaaacagaccggatctgcctcatctatggttaatggtgtcgtcaaattattaaccaaaccttgggatgtggttcctatggtaacccaaatggcaatgactgacactactccctttggacaacagcgagtctttaaagagaaagtcgatacgcgtacacaggaaccaaaagagggaaccaaaaagttaatgagaattacagcggaatggctatggaaggaacttggcaagaagaaaacaccaagaatgtgtacacgggaagagtttactcgaaaagtacgaagcaatgccgcattaggtgctatctttacagatgaaaataaatggaagtctgcaagagaagctgtagaagactctcgattctgggaactcgtagatagggagcgcaacttacatttagagggtaaatgtgagacatgtgtttataatatgatgggaaaaagggagaagaaattaggcgaatttggtaaagcaaaaggatcgagggcaatctggtatatgtggctgggtgccagattcttagagttcgaagctcttggatttctcaacgaggatcattggttttcaaggggaaacagcctaagtggtgtagaaggggagggactccacaaactcggatacatcttacgtgatgtctcaaagaaagaagggggagctatgtacgctgatgatactgctggatgggacactcgcattacgctggaggatcttaaaaatgaagagatggtaaccaaccacatgaaaggggaacataagaaactagctgaggcaatatttaaactaacataccaaaataaagtagtacgggttcaaagacccacaccaagaggtacagtcatggatattatttcgagaaaagatcagcgtggatccggccaagttggtacatacggtttaaatacgtttactaatatggaagcccaattaattcgacagatggaaggagaaggcattttcaaaagcattcaaagactgacagtaacggaagagattgcagttcaaaactggttagctagggtcggaagagaaagactctcaagaatggctatatcaggcgatgattgcgtggtaaaacccctggacgaccgattcgcttccgctttaacagcattaaacgatatggggaaagtacgaaaagacatacaacaatgggaacccagcagaggatggaatgattggactcaggtaccattttgcagtcaccatttccacgaattggtcatgaaagatggcagagtcctcgttgttccctgccgcaatcaagatgaattaataggccgcgcgaggatatcacaaggtgctggatggtccttaaaagagaccgcctgtttaggtaagtcatacgctcaaatgtggacactaatgtactttcatcgtagagatctaaggcttgctgcgaacgctatttgttccgcagtacccagtcattgggtaccaacatcacgtactacatggtccatccacgccaaacatgaatggatgacgaccgaggatatgctggcagtatggaatagggtgtggatacaagaaaacccatggatggaggacaagacaccagttgaatcgtgggaagaagttccttatctgggaaagcgtgaagatcaatggtgcggtagcctaattggtctcacttctcgagcaacatgggcgaaaaacattcaaacagcaatcaaccaagtccgatctcttataggtaatgaggaatacacagactatatgcctagcatgaaaaggttccgcaaggaggaagaagaagccggtgtactatggtaa

SEQ ID NO: 22600 - RNA, 9876 nt, synthetic construct
  misc_feature 1..9876: note = derived and/or modified CDS sequence (opt6) from DENV-2__EU687199__SS-prME
  source 1..9876: mol_type = other RNA
actgctggggtcattataatgttaataccaactgctatggcatttcatttaactacacgaaatggtgaaccgcacatgatagtgggaagacaagaaaaagggaaaagtcttctttttaaaaccgaagatggggtaaacatgtgtacactaatggctatagatcttggagaattgtgtgaagatacaattacatataaatgtccattactacggcaaaacgaacctgaagacattgactgctggtgtaactccacaagtacgtgggtaacatatggaacatgcaccacgaccggggaacatcgaagagaaaaacgatctgtagctctagttccgcatgtcggaatgggtcttgaaacaagaacagaaacatggatgtcctcagaaggtgcctggaaacatgtgcagagaatagaaacttggatacttaggcacccggggtttacaataatggcagcaatactagcatataccataggtacaactcattttcagagagcgctaatttttatcctcctaactgcagtagctccatctatgactatgcggtgcataggaatatcaaatagagactttgtagaaggtgtatcaggtggttcttgggtcgatatcgttttggaacacggttcatgtgttacaacaatggctaaaaacaaaccaactctagacttcgaactcataaaaactgaagcaaaacagccggcgaccctacggaaatattgcatagaagcaaaattaaccaataccactacggaatcccgttgtccaacacaaggtgaaccgtccttgaatgaagaacaagataaaaggtttatctgtaaacacagtatggtagacaggggttggggaaatggttgcggattatttggaaaaggtgggatagtgacatgcgcaatgtttacatgtaagaaaaatatggaagggaaagtagttttaccggaaaacttggagtataccatagttataacaccccattcaggggaagaacatgcagtaggcaacgacacaggcaaacacggtaaagaaattaaaataactccgcaatcatccataaccgaagccgaactaactggttatggtacagttacaatggaatgtagtcctaggacgggtctagattttaatgaaatggttttgctccaaatggaagacaaggcttggctcgtccaccgacaatggtttctggacctaccattgccgtggctaccaggcgcagacacgcaaggatccaattggatacaaaaagaaacactggttacatttaaaaatccacatgccaagaaacaagacgtagtagttctgggttcccaggaaggagctatgcacaccgcactgacaggggctacagaaattcagatgagtagtggaaatctactttttacaggacatctcaaatgcagactgaggatggataaactccaactgaaaggtatgtcatacagtatgtgcacaggtaaattcaaaattgtgaaagaaatagcagagacccaacacggcacgatagtaattagagttcagtacgaaggagacggctctccttgtaaaataccattcgagatgatggacttagagaaaagacacgtattaggacgtttaataacagtaaatcctatagtaaccgaaaaagactctcccgtgaatatcgaggcggagcctccattcggagatagctacattataataggtgtagagcccggacaactaaaactgaactggtttaagaaaggaagttctataggtcaaatgtttgaaacaacgatgcgaggtgctaaaagaatggcgatactaggcgatacagcatgggacttcggatcattgggaggagtatttaccagcattggcaaagcattacaccaagtctttggagctatttatggagcagcattcagtggggtgagttggaccatgaaaattcttataggagtcataataacttggataggtatgaatagccggagtacatcgctaagcgtcagcctcgttctagttggcgtcgtaacactatacctaggcgtaatggtacaggcagacaccggctgcgtcgtctcatggaaaaacaaagaactaaaatgtgggagcggaatttttataacagacaacgtgcacacatggacggaacaatataaatttcaacccgaatcaccgtcaaaactagcaagtgcgatacaaaaagcacacgaagaaggaatttgtggtataagaagtgtcacaaggcttgaaaatttaatgtggaaacaaattactcccgaacttaatcacatactgagtgaaaacgaagtaaaactcacaattatgaccggggacatcaaagggataatgcaagcaggcaaacgatcgttacggccacaaccaactgaactcaaatatagctggaaaacgtgggggaaagcgaaaatgctttcaacggagtcacataaccaaactttcctcatagatgggccagaaacagcagaatgcccgaatacgaaccgagcatggaacagtctggaagttgaagattatggttttggagtgttttcaaccaacatttggttaaaacttagggagaagcaagatgtcttctgcgacagcaaattgatgtccgcagcaataaaagacaatagggcggtgcatgcagacatgggttattggatagaatctgcgctaaatgacacatggaagatggaaaaggcttcttttatagagattaaaagttgccattggccaaaaagtcatacattatggtccaatggagttctagagtcagaaatgataattcctaagaattttgcgggaccggtctctcaacacaactacagaccaggctaccacacacagactgctggtccttggcacctaggaaaattagaaatggacttcgacttctgcgagggaacaacagtcgtcgtaacagaagattgtggcaatagagggccctcccttaggaccacgaccgcaagcggaaaactaattacagaatggtgttgccgatcctgtactttgccacccttaagatatagaggagaagatgggtgctggtatggcatggaaataagacccctaaaggaaaaggaggaaaatttggttaattcgttagtaactgcggggcacggacaaatagataatttctccttaggagtattgggaatggccctatttctggaagagatgctaagaactcgtgtggggacaaaacacgccatacttttagttgctgtatcattcgttacattgatcacaggaaacatgtcttttcgtgatttaggtagagtgatggtaatggtgggcgcaacaatgactgacgatatagggatgggtgtgacatatttagctctattagcggcttttaaagtccgccctacatttgccgccggcctcttactgcgtaaactaacaagtaaagaactcatgatggctacgatcggaatagcactattaagccaatctacaattccagaaacaatattagaactgacagatgcacttgcactcggaatgatggttctcaaaatcgtgaggaatatggaaaaataccaactcgcagtcacaattatggccataagctgtgtcccaaacgcagtaatattacagaacgcatggaaagtaagttgcacaatcctagcagctgtaagcgtgtcaccgctactattaacgtcgtcacagcaaaaagcagattggataccgctagcactaacaattaaagggctaaatccaacagctatatttctgaccactctttcaaggacaagcaagaaacgcagttggcctcttaatgaagccgtcatggcagtcggcatggttagtatcctagcaagtagcttgttgaaaaacgacattcctatgacaggaccgttagttgctggcggtttattgacagtttgctacgttcttactggaagatctgcagaccttgaattagagcgagcagccgacgttaaatgggaagaccaagctgaaatctcagggtcatcacccatcctatctattacaatttctgaagatgggagcatgtctatcaaaaatgaagaggaagaacataccttaacaatcctaatacgaaccggacttttggtaatctccggcgtttttcctgtgtcgataccaataacagcagctgcgtggtacctctgggaggtgaagaaacagcgagccggcgtattgtgggatgtaccttctccacctcccgtgggaaaagcagaactagaagacggtgcgtatagaataaaacaaaggggtatttttgggtatagtcaaattggtgctggtgtctataaggaaggaacatttcataccatgtggcatgtcacaaggggtgcagttttaatgcatcgagggaaaaggatcgaaccgtcttgggctgacgtaaagaaggacttaatttcttatggtggaggttggaagctggaaggtgaatggaaagaaggagaagaagttcaagttttagctctagagccgggcaaaaatcccagagccgtccaaactaagccgggattatttaaaacaaacacaggcactataggagccgttagtttagatttctcacccggcacatcaggaagtccaatagtagacagaaaaggcaaagtagtgggcctgtatgggaacggtgtagtgactagaagcggggcatatgtctcagctattgcccaaacggaaaagtctatcgaagataatcctgaaatcgaggatgatatatttcgtaagaaaaggttaactatcatggacttacacccgggagcagggaaaacaaaaagatacctgccagctatcgtcagagaagccataaaacgaggacttcgaacattaatattagccccaactagggttgtagcagcagaaatggaggaagccttgcggggtctgccaataaggtatcaaacaccggcaattagggcagaacataccggtagagaaatagtggatttgatgtgccatgctaccttcacaatgcgtctcctatcaccggtacgcgtgccaaattataatttaataataatggacgaagcacattttacagatcctgcatctatagcggcgcgcggttacatcagtacaagagtcgaaatgggagaagcagcgggaatctttatgaccgcaacgccacctgggagccgcgatccgttcccccagagtaacgcacctataatggatgaagaaagagaaatcccagagcggtcttggaactctggtcatgaatgggttaccgattttaaaggcaaaactgtatggtttgtaccaagcattaaagcaggcaatgatatagctgcatgtctacggaaaaacgggaagaaagtcattcaattatcgagaaaaacgttcgactcagaatatgtaaaaacacgtgccaacgattgggattttgtcgtcaccacagatataagtgaaatgggtgctaatttccgcgctgaaagagtcatagatccccgtagatgtatgaaacctgtcatactgaccgatggtgaagaacgtgtaatattggcaggacctatgcctgttacgcactcatcggccgctcagcgaagaggtcggataggtcgcaatcccaaaaatgaaaacgaccagtacatctacatgggggaacccctcgaaaatgacgaagactgcgcacactggaaagaagcgaagatgctcttggacaacataaacactcctgagggtatcattcctagcatgttcgaacccgaaagggaaaaagtagatgcaatagacggggaataccgtctcagaggagaggctaggaaaactttcgttgatttaatgcgaaggggtgatttacccgtatggttggcttaccgagtggcagcagaaggcattaattacgcagataggcgatggtgtttcgacggaatcaaaaataatcagattctagaagaaaatgtggaagttgaaatctggaccaaagaaggggaacggaagaaattaaaaccacgctggttagatgcgagaatttattctgatcccctagcgctaaaagaatttaaagaatttgcagctgggagaaaaagtctgacattaaacctaattacagaaatgggccgcctaccgacatttatgacacaaaaagccagagacgcgctagacaatttagcggtattacatactgcagaagttggagggagagcttacaatcatgcattaagtgaactcccggagacattagagacccttttgttattaacactacttgcaactgttacgggaggtatctttctgtttctaatgagtggaaagggtatcggcaaaatgaccctcggtatgtgctgcattattacagctagtatcctactgtggtacgcccagattcaaccacactggatcgctgcctccattattcttgagttctttttaatagtcctgttgatcccagaacccgaaaagcaacggacaccacaagataatcagcttacttatgtggttatagcgatacttactgtagttgccgctaccatggcgaatgaaatgggctttctggagaaaaccaagaaagacctcggtctgggatcaataacgacacaagaaagcgaatcaaatattcttgatattgatttgagacccgccagtgcatggacgttatatgctgtcgccacaactttcgttactcctatgttaagacattcaatagagaactcaagtgtaaatgtatcgctaactgccatagccaatcaggcaacggtattaatgggccttgggagaggttggccactaagcaaaatggatatcggggtgccgctgttagctattggatgttattctcaagtaaatccaattacgctaaccgccgcccttctgctactcgttgcacattatgcgattattgggccaggacttcaagctaaagcaacacgagaggctcagaaaaggacggctgccggtattatgaaaaatcctacagtcgatggtatcactgttattgatcttgaaccgattccttatgatcctaaatttgagaaacaactgggtcaggttatgctcttagtattatgcgtaacacaagtattaatgatgcgtacaacatgggctttatgtgaagcattgactctcgctacaggtccaataagtactttatgggagggcaatccaggacggttttggaatactacaatagctgtatctatggccaatatatttcgtggaagctacttagcaggagcaggactgctattcagtattatgaaaaatactacaaacacacgtagaggcacaggtaatattggagagacattgggcgaaaaatggaaaagcagacttaacgcgcttggtaaatcagaatttcaaatctataagaaatctgggatccaagaggtggaccgcactttagccaaagaaggaataaagagaggtgagacagaccaccacgcggtctctcgaggttcagccaaacttcgttggttcgttgaacgtaatatggtcacacctgagggtaaggtagtagacttaggatgtggacgaggcggttggagttactattgtggtggactaaagaatgtgagagaggtcaaaggcttaaccaaagggggacctggtcacgaagaaccaattccgatgtctacctacggatggaatctcgtacgactacaatcaggagtagatgttttcttcacgccccctgaaaaatgtgatactctactatgcgatataggggagtccagtccaaacccaactatagaagcaggaaggacactaagagtattaaacttagtagagaattggctcaacaacaatacacagttctgtgtgaaagtccttaacccatacatgcctagtgtaattgaaaagatggaaacactccagcgaaaatacgggggagctctagttaggaatccactttctcgaaactcaacccacgaaatgtactgggtcagcaacgcaacgggaaacatcgtaagttctgtaaatatgatttctcgaatgttaataaaccgattcacaatgaagcacaagaaagcaacatatgagccagacgtagatctaggatcaggaactagaaatataggtatagaaaacgaaataccaaatttagatataattggtaaacgaatagagaaaataaaacaagaacacgaaacgagttggcattatgatcaggatcatccgtataagacatgggcataccacggttcgtatgaaaccaaacaaacaggttctgcaagttctatggttaacggtgttgttaaactactaacaaaaccatgggatgtagttcctatggtcacacaaatggccatgactgatacaactccctttggacaacaaagggtatttaaagaaaaagtggacacacgaactcaagagcctaaagaaggaacaaagaaactaatgcgaataacggcggaatggttatggaaggagctaggtaagaagaaaaccccaagaatgtgcactcgagaagaatttacgcgtaaggtgagaagcaatgcggcactaggtgctatattcactgatgaaaataaatggaaaagtgcccgggaagctgtagaggattcaagattctgggagctagttgatcgtgaacgaaatttacatctcgaaggtaagtgtgaaacatgtgtgtacaatatgatgggtaaacgagaaaagaaactaggggagttcggcaaggccaaggggtcgagagctatatggtatatgtggttaggcgcgagattcctggaatttgaagcactgggatttctaaatgaagaccactggttttcgcgaggaaactcactgtcaggtgttgaaggagaaggcttacataaactaggatacatcctacgcgacgttagcaagaaagaagggggagctatgtacgcagacgatacagcgggatgggacacacggataacgcttgaggatctcaaaaatgaagaaatggtaacaaatcacatgaagggagaacacaagaaactagccgaagctatcttcaaattaacctatcaaaataaagtagtcagagtccaaagacccactccacgtggcaccgtaatggacataatttcgagaaaagaccaaagaggatcggggcaggtaggaacttatggtttaaacacatttacaaacatggaagctcaacttataagacaaatggaaggggaaggaatatttaaatctatccaaaggttgactgtgaccgaagaaattgctgtccaaaattggctagcaagggtcggccgggaacgactgagtagaatggccataagtggagatgattgtgtcgtcaaaccgttagatgatagatttgctagcgcactaactgcattaaacgacatgggtaaagttaggaaagatattcaacagtgggaaccaagtagaggatggaatgattggacacaggtacctttctgtagtcaccatttccacgagctagtgatgaaagacggacgagtattggttgtaccctgtagaaatcaagatgaactaatagggcgcgcacgaataagtcaaggggcgggttggagtctgaaagagacggcgtgcctcggaaaatcgtacgcgcaaatgtggacattaatgtattttcaccggagggacctccgcctcgcagccaacgcaatctgtagtgccgttccctctcattgggtaccgacaagtaggacgacctggtcgatacacgcaaagcatgaatggatgactacggaagacatgctcgcggtatggaaccgagtttggattcaggaaaatccatggatggaagacaaaacacccgtggaaagttgggaggaagtaccatatctaggtaaaagagaagaccagtggtgcggatcattaattggcttgacaagtcgagctacatgggccaaaaatatccaaacagcaataaatcaagtaagatctttgataggaaatgaggaatacactgattacatgccctctatgaagcgatttaggaaagaggaagaagaagcgggagttctgtggtaa

SEQ ID NO: 22601 - RNA, 9876 nt, synthetic construct
  misc_feature 1..9876: note = derived and/or modified CDS sequence (opt6) from DENV-2__EU687235__SS-prME
  source 1..9876: mol_type = other RNA
accgcaggagtgataatcatgttaataccaacggcaatggccttccacttaactacgcgaaatggagaaccacacatgatagtaggaagacaagaaaaaggaaaatcactactatttaaaacagaagatggtgtaaacatgtgcacgctgatggctatcgatcttggagaactatgcgaagatactataacttataaatgtcctctcttacgacagaatgaaccagaagatatcgattgttggtgtaacagcaccagtacatgggtcacatacggaacctgtacaacaacaggtgaacatcgacgagagaaaagatcagtagcattagttccacatgttggcatgggtttagaaactagaacagaaacatggatgtcatcagaaggggcgtggaaacacgtacaaagaatagaaacttggattttacgtcatccaggttttaccataatggcagctattttagcgtatacaattggtaccacccattttcaaagagctctaatattcatactattaactgctgttgcaccatcaatgacgatgcgctgcatagggataagcaacagagatttcgttgaaggagtctcgggcggatcgtgggtagatatcgtcctagaacacggtagttgtgtaacaacaatggcgaaaaataaacctacccttgattttgaactgatcaaaaccgaagctaaacaaccagcaacattgagaaaatattgtattgaagccaaattaacgaatactactaccgactcgagatgcccaacacaaggcgaacccagcctgaacgaagaacaagataaacgtttcatatgtaaacactccatggtagatagaggatggggcaatggatgcggtcttttcggcaaagggggaatagtaacgtgtgcaatgtttacatgcaagaaaaatatggaaggaaaagttgtattaccggaaaatctagaatacacaatcgttatcacacctcattcaggagaggagcatgctgtcgggaatgataccggaaaacatggaaaagaaattaaaataactcctcagtcttcaataactgaagctgaactcacagggtacggaacagttacgatggaatgtagtccccgaaccggattggatttcaacgaaatggtactgcttcaaatggaggacaaagcctggcttgtccatagacaatggtttctagatttacccttaccatggctaccgggagcagacacgcagggatcaaattggatacaaaaagaaacgttggtcacatttaaaaacccacacgcaaagaaacaagacgtggttgttttgggaagccaagaaggcgccatgcacacagcattaaccggggctacagagatacagatgtcatcgggaaatctattatttaccggacatcttaaatgtcgattaagaatggataaattgcaattaaaagggatgtcttattcaatgtgtactgggaaattcaaaatcgtaaaagaaatcgcagaaacgcaacatggaacaattgtaatacgggtccaatatgaaggggatggttcaccatgtaaaattccatttgaaataatggacctagagaaacgtcatgtactcggacggttaattaccgttaatccaatcgtcacggaaaaagacagccctgtcaatatagaggcggaaccgccttttggggacagctatataataataggagttgaacctggacaactaaaactaaactggtttaagaaaggaagcagcattggccagatgtttgaaacaacaatgagaggagctaaaagaatggctattttaggagacactgcttgggatttcggatctctcgggggagtgttcacatcaatagggaaagcgcttcaccaagtttttggggcaatatacggagccgcattttcaggagtatcctggactatgaaaatcctaataggtgtcataataacgtggattggaatgaactctagatccacttcactgagtgtttcattagttctagtaggggtagtaacgttataccttggcgtaatggtgcaagcagatacgggctgcgttgtcagttggaaaaacaaagagttgaaatgtggaagcggtattttcataaccgacaacgttcacacatggacagaacaatataaatttcaacctgaaagtccaagcaagttagcaagcgcaatacaaaaagctcacgaagaaggcatttgtggcataagaagcgtaacccgactggaaaatcttatgtggaaacaaattaccccagaactaaaccacattctctcagaaaatgaggtcaagctaaccataatgacaggtgatattaagggaataatgcaagctggcaagaggagcctaagaccacaacctacagaattaaaatatagctggaagacttggggaaaggcaaagatgctgagcactgaaagtcataaccaaacattcctaatcgatggtcccgaaaccgctgaatgtcccaatacaaacagagcttggaacagtctcgaagtagaggattatggttttggagtattttcaacaaacatctggttaaaactacgcgagaagcaagacgtgttctgtgatagtaaacttatgagcgcagctatcaaagacaatagggcagtgcatgcggatatgggatactggatagaaagtgccttaaatgatacgtggaaaatggagaaagcatcgtttatcgagataaaaagctgccattggcctaaaagtcatactttatggagtaatggcgtactggaaagtgaaatgataattcccaaaaattttgccgggcccgtgtcacagcataactaccgacctgggtaccacacacaaaccgccggaccttggcatttaggcaaactcgaaatggattttgatttctgtgagggaactaccgttgtcgtaactgaagattgtgggaatcgaggaccctccttaagaaccaccacagcttcagggaaattaataacggaatggtgttgcagaagctgcacattaccccctttaagatatcgcggagaagacgggtgttggtacggcatggaaatcagacctctaaaagaaaaagaagaaaatctggtaaattcattggtcacagcaggtcatggacaaattgataatttctcgttgggagttttaggtatggcgctgttcttggaggagatgctaagaactcgtgtggggaccaaacacgcaattctgttagtcgcagtatcatttgtgactttaattactggtaacatgtcattcagggatttgggacgagtgatggtaatggtgggggcaaccatgacagatgatataggtatgggtgtcacatacttagccctattagcggccttcaaggttagaccaacgtttgcggctgggcttctgttacgtaaacttacttctaaggaactcatgatggctaccataggtattgcattgctgtcacaatcaacaatccccgagacaattttagaactcactgatgccttagcactaggcatgatggttcttaagatagttcggaatatggaaaaatatcagcttgcagtaactattatggctattagttgcgtcccaaatgcagtaattctgcagaatgcatggaaggtgtcctgtactatactggcagcagtgtccgtatcgccacttttgctaactagctcccaacagaaagcggattggataccactcgcattaacaattaaaggattaaacccgaccgcaatattcctgacaacactgagtagaacatctaagaaacgttcttggcctttaaacgaagctgtcatggcagtaggaatggtttctattttggcctcatcactattaaagaatgatataccgatgacgggacccctagtagccggaggtctacttaccgtttgctacgttttaacaggtaggagtgcagatttagaactcgaaagagcggcagacgttaaatgggaagatcaagcagagatatcaggtagttctccaatactaagtattaccatttctgaagatggaagcatgagtatcaaaaatgaagaagaagaacataccttaacaattttgataaggaccggacttctcgtaatatcaggagtattcccagtttctatacccatcactgctgctgcatggtatttatgggaagtcaaaaagcaacgagccggcgttttatgggatgtaccttcaccccctctcgttggaaaagccgagctagaggatggagcatacaggataaagcaacgtggtatcttcggatacagtcaaatcggcgccggcgtatacaaggagggcacgtttcacaccatgtggcacgtaacacgtggcgctgtcctgatgcacagaggtaagcgtattgagccttcatgggcagatgtcaagaaagatttaatctcttacggtggagggtggaaattagaaggagaatggaaagaaggagaagaagtacaggtcctagcgttagaaccaggcaaaaatcccagggcagtccaaaccaaaccaggtctctttaagaccaacacgggcaccattggggcagttagtttagatttttctccaggcacctcgggatcccctatagtagatagaaaaggaaaagtagtaggtctttacggcaatggggttgttacacgtagtggcgcttatgtatcagccattgctcaaacagagaagtcaatcgaagacaatcctgagatcgaagatgatatatttaggaagaaaagactaacaatcatggacctccatccaggcgcaggtaaaactaaaagatatctcccagctatagtgagggaagccataaaacggggtctgagaacactcatattggcaccgacacgagttgttgctgcagaaatggaagaggcgctcagaggacttccaatccgctaccaaaccccagctattcgagcagagcacacaggacgtgaaatagtagatttgatgtgccacgcgacattcactatgagactactaagtccggtacgcgtccctaattacaacttgataataatggacgaagcacattttacagatccagcctcaatcgctgcaagggggtatatctcaactagggtagagatgggtgaagcagctgggatttttatgaccgctactccacctggttcccgtgatccattcccgcagtcaaatgcacccataatggacgaagaaagagaaataccagaaagatcatggaactctggccatgaatgggttacagattttaaaggaaaaacagtctggtttgtaccgtcaataaaagcaggaaacgacatagctgcctgtctacgcaaaaacggaaagaaggtgatacagctatcccggaagacattcgactccgaatatgttaaaacacgagcaaatgactgggatttcgtagtgacgacagatatatctgaaatgggagcaaacttcagagcagaaagagttatagaccctcgaagatgcatgaaaccagtcattcttactgatggggaggaaagagtcatactggccggtccgatgccagttacacactcgtctgcggcacagcgtcgaggtaggatagggcgaaatcccaaaaatgaaaatgaccagtacatatacatgggagaaccattggaaaatgacgaagattgtgcccactggaaagaggcaaaaatgttactggataatataaacacacccgaaggtattataccatcaatgtttgaacctgaacgcgaaaaagtggatgcaatagacggagaatatagactaaggggtgaagcgcgtaagacgttcgtagatttaatgaggcgcggggacctacccgtttggctagcgtatcgagtggctgctgaaggcattaattacgcggatagacgctggtgcttcgatggaataaagaataatcagatattagaagaaaatgttgaagttgaaatctggactaaagaaggagagaggaagaaattgaaaccgaggtggctagacgcccgaatttactcagacccattagcgcttaaagagttcaaagagttcgcagcaggacggaaatcgctgactctaaacttaataacagaaatggggcgtctcccgacatttatgactcagaaagcacgagatgcccttgacaatttagcggttttgcatactgctgaggtgggtgggagggcttataatcacgctctgtcagaactaccggagacactcgaaactcttttactactaacactgttagcaacggttaccggcggtatatttttgttcttaatgagcggcaaagggataggtaaaatgactcttgggatgtgctgtatcattacagcttcaattctattgtggtacgcacaaattcaaccacactggatagcagcatccatcatcttagaatttttcttgatagttctcttgattccagagccagaaaagcaaagaactccacaggacaaccaactaacatatgtagtaatagcaatcttgactgttgtcgcagcaacgatggcgaatgaaatgggctttttggaaaagacaaagaaagatttaggcctaggtagtattacaactcaggagtcagaatctaacatattagatatagatttgcgaccagcttctgcatggacactatacgcggtagcaactacttttgtaacgccgatgttaagacattctatagaaaactcttcggttaacgtaagtttaactgcaatagcaaatcaagcaacagtgctcatgggtcttggtagaggttggccactatcaaagatggatatcggagtacccttattagctataggctgctactcccaagttaacccaataaccttaacagcagcactacttcttttggtagcacattacgcaattatcggtccaggtcttcaagctaaagctacacgagaagcacaaaagcgcacagcagccggcatcatgaagaatcccacggtcgatggaatcacggttattgatctagagccaattccgtacgacccaaagttcgaaaaacagctaggtcaagtcatgttacttgtgctttgcgtaacacaagtactaatgatgagaacaacgtgggctttatgtgaagcgttaaccctagcgacaggcccaattagtacgttatgggaaggaaacccgggacgattctggaatacaacaatagcagtatctatggccaacatattcaggggctcttacctagccggagcgggtttattatttagtataatgaagaatactaccaatacaagacgcggaactggaaacatcggtgaaacgctaggagagaagtggaaatccagacttaacgcactaggcaagtctgaatttcagatttataagaagtcggggatacaagaagttgacaggactctagctaaagagggaataaaacgaggtgaaacagaccatcatgcggtaagcagaggcagtgcaaaactaagatggtttgtagagcgaaatatggtcactccagaaggaaaggtggtagatctagggtgcggacgcggaggatggtcatattattgtggaggactaaagaacgttagggaagttaaaggcttaactaaaggtggaccgggccacgaagaaccaattcctatgtctacgtatggatggaatcttgtaagactacaaagtggtgtggatgtatttttcaccccacccgaaaaatgtgacaccctattatgcgacataggagaatcctcgccaaaccccacaatagaagcaggtagaacactcagggtattgaacctagtcgaaaactggctaaataataacactcaattttgtgtcaaggtgttgaatccatacatgccaagtgtaatcgagaaaatggagacactgcaaagaaagtacggaggggctttagtaagaaatccactatccagaaactcaacccacgagatgtattgggtatccaatgcaacagggaacatcgtatcaagtgtgaatatgatatcaaggatgctaataaatcgattcacaatgaaacataagaaagcaacctatgagcccgatgtagatctgggtagtggaaccaggaacataggaattgaaaacgaaattccaaatttagacataataggaaagcggatagagaagataaaacaagaacacgaaacatcgtggcactatgatcaggaccatccctataaaacctgggcataccatggaagctatgaaacaaaacaaactggaagtgcttccagcatggtaaatggagttgttaagttactaacaaaaccatgggatgttgtaccaatggtcacccaaatggcaatgactgatacgactcctttcggacaacagagggtattcaaagaaaaggtcgacacgcgaacacaagaacctaaagaagggacaaagaaactaatgaggatcactgctgaatggttatggaaagaactcgggaaaaagaaaactccacgtatgtgcactcgagaagagttcacccgcaaagtcagaagcaacgcagcgctaggagcaatatttaccgacgagaacaaatggaaaagtgctcgggaggctgtagaagacagtagattttgggaactcgtggatagagaacggaatttacatcttgaaggcaaatgtgagacatgtgtctacaacatgatgggtaagagagagaagaaattaggagaatttgggaaagcaaagggctctcgagcgatatggtacatgtggttaggagcgcgatttttagaatttgaggctttagggttcttaaatgaagatcactggttctcccgtgggaactccttgtctggcgtagaaggagagggattacacaaattggggtatattttacgtgatgtgagcaaaaaggaagggggagcgatgtatgccgatgatacagcggggtgggacacacgcattaccctagaagacttgaaaaacgaggaaatggtaacgaatcatatgaaaggagaacataagaaattagctgaagcgatttttaaattaacttatcagaataaggttgtgagggtccagagacctacaccgcgcggcacagtaatggatatcatttcaagaaaagatcaaagaggcagcggtcaagttggcacatacggtttaaacacattcactaacatggaggctcaattaatccggcaaatggaaggcgagggcatatttaagtctatccaacggttgactgttacagaagaaatagccgttcaaaattggctggcaagagtaggtagagaaagacttagtcgaatggcgattagtggtgacgattgtgtagtaaagccgctagatgataggttcgcttcggcacttaccgctttaaatgatatggggaaagtaagaaaggacattcagcagtgggagccatcaagaggctggaatgattggacacaagtacccttctgctctcaccattttcatgaattagtcatgaaagatggtagagtacttgtagtaccatgtagaaatcaggatgaactgatcggcagagctagaatatcacagggtgctggttggtcattaaaagaaacggcttgtttaggtaaatcatacgcacagatgtggactttaatgtactttcatcgaagagatctgcgtctagctgcaaatgcgatatgctcggcagtaccctcccattgggttcccacatcgcgcactacatggagtatccatgctaaacacgagtggatgacaacagaagatatgctagcagtttggaacagagtatggatccaggagaatccatggatggaggataaaactcctgtagaatcctgggaagaagtaccatacttaggcaaaagggaagaccagtggtgtgggagcctcatcggactaacatcaagagcaacctgggctaaaaatattcaaacagcaataaaccaagtgagatctttaataggtaatgaggaatatactgattatatgccctctatgaagcgatttaggaaagaagaagaggaagccggtgtactgtggtag

SEQ ID NO: 22602 - RNA, 9876 nt, synthetic construct
  misc_feature 1..9876: note = derived and/or modified CDS sequence (opt6) from DENV-2__EU687236__SS-prME
  source 1..9876: mol_type = other RNA
actgctggtgttataattatgctgataccaactgcaatggcatttcacctaactactcgcaacggagaaccacatatgatagtgggaagacaagaaaaagggaaatctttactatttaaaacagaagatggagtgaatatgtgtacattaatggcaatagatttgggtgaactatgcgaagatacaataacatataaatgtcctctattaaggcaaaacgagcccgaagatatagattgttggtgtaatagcacttcgacatgggtgacgtacgggacgtgtacaacaactggtgaacatagaagagaaaagagatcagtggcacttgtacctcatgtaggaatgggattggaaacaagaactgaaacatggatgtcgtcggaaggcgcttggaaacatgttcagcgtatagagacatggattctgaggcatccaggatttacaattatggcagcaatactagcttatactataggtacgacacactttcagcgtgcacttatatttatattacttacagcagtagctcctagtatgacaatgaggtgtataggtatatctaaccgagattttgttgaaggagtatccggaggatcatgggtagatattgtgcttgagcacggttcttgtgtaaccaccatggctaaaaacaaaccgaccttagattttgaattaattaaaacagaggcaaaacagcctgcaacattgaggaaatattgcatagaagcaaaactcacgaatactactactgaatccaggtgtccaactcaaggcgaaccctctttaaatgaggaacaagataaacgttttatctgcaaacattcaatggttgatagaggatggggtaatggatgcgggctgtttggaaaaggaggcatagtaacatgcgcaatgttcacatgcaagaaaaatatggagggcaaagtcgtattgcccgaaaatttagagtatacaatagttattacgccacattcgggagaagaacatgctgtaggtaacgatacagggaaacacggcaaagaaataaaaataaccccacaaagttcaattacggaggctgaactaactggatacggaaccgtaacaatggagtgcagccctagaacgggactggactttaatgaaatggttttattgcagatggaggataaggcttggctagtacacagacaatggttcttagacctaccactgccttggttgccaggggcggatacccaagggagtaactggattcaaaaagaaaccctagttactttcaaaaatccacatgcaaagaaacaagacgtagtagtactaggttcacaagaaggagcaatgcacacagctcttacgggagcaacagagatccaaatgagttcaggaaatctgctttttacaggacatttaaaatgtcgacttagaatggacaaattgcagttgaaaggaatgagctatagcatgtgcaccggaaaatttaaaatcgtgaaagaaattgccgaaacgcaacacggaacaattgttatacgagtacaatatgaaggcgatggaagcccgtgcaaaataccatttgaaataatggatcttgagaaacgccatgttctaggacgattaatcactgtcaacccaatagtaaccgaaaaagattcacccgtgaatatagaagctgagccacctttcggagactcctatataattattggagtcgagcccggacaacttaaactaaattggtttaagaaaggctcgagcattgggcaaatgtttgaaaccaccatgagaggcgccaaaagaatggctatactaggcgatactgcatgggattttggaagtctaggtggcgtttttacgtctataggaaaggccttacaccaagtctttggagctatctatggggcagcgtttagtggtgtcagttggacgatgaagatactgataggagtcataattacttggataggaatgaactcaagatctacatcattgtccgtcagtcttgtgttagttggagtagtaacactgtaccttggagtgatggtacaagcagatactggatgtgtggtatcttggaaaaacaaggaactaaaatgtgggagcggcatatttataacagataacgtccacacttggacagaacaatacaaatttcagcccgaatcaccctctaaactagcttctgctatccagaaagcccacgaagaaggtatctgcgggattcgatccgtaacaagactcgaaaacctcatgtggaaacaaatcacaccagaacttaatcatatcctatcagagaacgaagtaaaactgacgataatgaccggagatattaagggcattatgcaagctggaaaaagatccctcaggccacaaccaactgaactcaaatacagttggaaaacatggggtaaagctaagatgctgagtacagagtcacacaatcagacattcttgattgatgggccggaaacagcagaatgcccgaacaccaatagggcatggaactcacttgaagttgaggattacggctttggagtattctcgactaacatatggttaaaattaagagagaaacaagacgttttctgtgattcaaagttgatgtcagctgcgataaaggataatcgagcggttcatgctgatatgggttattggattgaatcagcattgaacgatacgtggaaaatggaaaaggcctcattcatcgaaattaaaagctgtcattggccaaaatcgcacacattatggagcaatggcgtactagaatctgaaatgattattcccaaaaatttcgctggtccagtatcgcaacacaattataggccaggctaccatactcaaactgcaggtccgtggcatttagggaaactggagatggactttgacttttgtgaaggcacgacagttgtagtaactgaagactgtggcaacagaggtccatcgcttagaaccacaacggctagcggaaagttaataacggaatggtgctgtaggtcttgtactttgccgccactaaggtacagaggcgaggacggatgttggtatggaatggaaataaggccgttgaaggagaaagaagaaaaccttgttaattcgcttgttacagcgggtcatgggcaaatagacaatttctcattgggtgtccttggaatggcactgtttcttgaggaaatgttaagaacaagagtgggtacgaagcatgcaatactccttgtggctgtctcattcgtaacattgataacaggcaacatgtcgttccgcgatttggggagagtcatggtaatggtgggcgcgactatgacagatgacataggcatgggagtgacatatttagctttactagcggcctttaaggtgcggcctacctttgccgctgggcttttacttagaaagctgacctcaaaagaacttatgatggctaccatcggaattgctttattaagtcagagcactattccagaaactatattagaattaacagatgccttagcactaggtatgatggtgttgaagatcgttcgcaacatggagaagtaccaattggctgtaacaatcatggccataagttgtgtgcctaatgctgttatattacagaatgcttggaaagtcagctgcactatattggcagcagtgtccgtttcacctttattactaacttcatcacagcaaaaggcagactggatcccactcgctctcactataaaaggcctcaaccctacagcgatatttttaacaactttgtcaaggacgtccaagaaacgtagttggccattaaacgaagcagttatggcagtggggatggtctcgattctggcatctagcctactgaaaaacgacattccaatgaccggacccttagtagcaggaggattattgacggtctgctatgtattaacaggacggagtgcagatctagaactagaaaaggctgcagacgttaaatgggaagaccaagcagaaataagcggatcttctccaatattaagtataacaataagtgaagatgggtcgatgtcaatcaaaaatgaggaagaggaacatacattaaccatactaataagaacaggtttgctggtaataagtggggtattccccgtatctataccaataacggcagcagcatggtatctgtgggaagtgaagaaacaaagagcaggagtgttatgggatgtaccatcaccacctccagttggaaaggccgaactagaagatggagcctatcgtattaaacaaagaggaatattcggttattcacaaatcggtgcaggcgtatataaggaaggaacgtttcatacgatgtggcacgttactagaggtgcggtactgatgcacagaggaaaacgtatcgaaccaagttgggctgatgtcaagaaagatttaataagttatggcggtggttggaaacttgaaggagaatggaaagaaggtgaggaagtgcaagttctggctctagaacctggcaaaaatccaagagccgtccagactaagccggggctgttcaaaacaaatacaggaacaataggcgcagtatcattagatttttcaccaggcacatcgggctctccaatagtagaccgtaaaggcaaagttgttggactatatggaaacggtgtggtcacaagatcaggggcatacgtatcagcgatagcacagacggaaaagagtatcgaagataacccggagatcgaagatgacatatttagaaagaaacgtctcactataatggatttgcacccaggagcaggcaaaacaaaacgttatttgccggcgatagttagagaggcaatcaaacgcgggttacgtacactgattttagcacctacacgcgtcgtagctgctgaaatggaagaggcactaaggggcttgccaataaggtaccaaactccggcaattagggcagaacacacaggtcgtgaaattgttgatctaatgtgccatgccactttcacaatgcgactattgtcacccgttagagtacctaattataatttaattattatggatgaggctcacttcacagatccagcgagtattgcagcgaggggatatataagtacacgcgtagaaatgggtgaagctgcgggaatttttatgacggctacgccaccaggtagtcgcgacccctttccacaatcaaatgcccccataatggacgaagaaagagagatacccgaaagaagctggaatagtgggcatgaatgggttacagatttcaaagggaagactgtatggttcgtgccttcgatcaaagcgggcaatgacattgccgcttgtctccggaaaaatggcaaaaaggtaattcaactctcccgaaaaacattcgattccgaatacgtaaaaacgcgagctaatgactgggattttgttgttactactgatatttcggaaatgggtgccaatttcagagccgagagagtcatagatccgagacgttgtatgaaacctgtaattcttacagatggtgaggaacgggtaattttagccggccctatgcctgtaacacacagcagtgctgcacaacgaaggggtcgtatcggcaggaaccctaaaaacgaaaacgaccagtatatctatatgggcgagccactcgaaaatgacgaagactgtgcacactggaaagaggctaaaatgttattagataacataaacacaccagaaggtattatccctagcatgttcgagcccgaaagagaaaaagttgatgccattgacggggaataccggcttagaggagaagcaagaaagactttcgtagatctaatgagaagaggagatttgccagtttggttggcataccgcgtagcagctgaaggaataaactatgccgatcgacgttggtgttttgatggtataaagaacaatcaaatattggaagaaaatgtcgaggttgagatttggacaaaagagggggaaagaaagaaattaaaacccagatggttggacgcacggatctacagcgatccactcgctttaaaagagtttaaagaatttgctgccggtcgtaaatccctaacattaaatctaataactgaaatgggaagacttccaacattcatgacgcaaaaggcacgcgatgctctcgataatttagccgtcctccataccgcagaagtaggaggtagagcctacaaccacgccctgagtgaactacctgaaacattagagaccttactgcttttgacactacttgcaacggtaacaggaggtatatttctgttcttaatgagcggtaaggggattggaaagatgacactaggcatgtgttgtattataactgctagcatactcttatggtatgcccagattcaacctcactggattgctgcatccatcatattggagttctttttaatagtccttttaatcccggaacctgaaaaacaacgaactccacaagacaatcaactcacgtacgtagttatagcaattttaactgtcgtagctgcaaccatggcaaacgaaatgggatttttagagaaaactaagaaagatttgggcctaggctcaattacaactcaggaatctgaatcaaacatactggacatagacctgcgtccagcttccgcttggactttatacgcagtggccacaactttcgtcactccaatgttacgtcattcgattgaaaattcttcagtaaatgtgtccttgacagcaatagctaatcaagcaacagtcttgatgggacttggtagagggtggccgctttcaaaaatggacatcggcgtaccactactcgccattggatgttattctcaggttaatccaatcaccttaacagctgctttacttctcttagttgcacactatgcgataatcgggcctggactacaggcgaaggctaccagagaagcgcaaaaacgcactgcagccggtattatgaaaaaccctacagtcgatggtataactgtaattgacctcgaaccgataccctacgacccaaaatttgaaaaacagctcggacaggtcatgctattagttttatgcgttacacaagtactgatgatgaggacaacatgggctttgtgtgaagcattaactctagccacaggccccatttcgacactatgggaaggaaatcctggacgtttttggaacacaactatagcagtgagtatggcaaatatctttcgagggtcatacctagccggagcaggattactttttagtatcatgaaaaatacgactaatactaggagaggaactgggaatataggcgaaacactaggagagaaatggaagagtaggttaaatgcccttggtaaatcagaatttcaaatttacaaaaagtctggaatacaagaagtggataggaccctggcgaaggaagggataaagagaggagaaacggatcatcatgctgtttcgagaggatctgccaaactacgttggttcgtagaacgtaatatggtcactcctgaaggtaaagtagtagacctaggatgtgggcgcggaggttggagttattattgtggtggcctcaaaaatgtaagagaagtcaagggtcttaccaaagggggaccaggacatgaggaaccaattcctatgtcaacatacggctggaatctagtgagactacagtcaggagttgatgtattctttacacccccggaaaaatgcgatacgttattatgtgatattggagaaagctcaccaaatccaacaatagaggccggacgaacgctccgcgttttaaatttagtagagaattggttaaacaacaatacacaattttgcgtcaaagttctcaacccgtatatgccttctgtaatagaaaagatggaaacactacaaaggaaatatggtggagcattagtccgaaatccattatctcgcaactccacacacgaaatgtattgggtcagcaatgcaacaggaaacattgtgtcatcagttaatatgatctcccgaatgctcatcaaccgtttcacaatgaagcataagaaagcaacctacgaaccagacgttgatcttggaagcggaactagaaacatagggatagagaatgaaatcccaaatttggacattataggaaaacgtatagaaaagattaagcaggagcatgaaacaagttggcactacgaccaagatcatccatataaaacatgggcctatcatggctcatacgaaacaaaacaaacagggtcagcaagttcaatggttaatggagtagtcaaacttttgacgaaaccctgggacgttgtaccaatggtaactcaaatggcaatgaccgatacaacaccattcggacaacaaagggtattcaaagaaaaagtagatacacgcacgcaagagccgaaggaagggactaagaaattaatgagaataaccgctgagtggttatggaaggagttaggtaagaagaagacgccgcgtatgtgtacgcgcgaagaatttacaaagaaggtaagaagtaatgctgcattaggggcaatatttacggacgagaacaaatggaaatcggcacgcgaggcagttgaggatagtagattttgggagctagtagacagggaaagaaacttacatcttgaaggtaaatgcgagacttgtgtatataatatgatggggaaaagagagaagaaacttggagagtttgggaaggctaagggatcaagagcgatatggtatatgtggctaggggccagattcttagagtttgaagcgcttggatttctgaatgaagaccactggttcagtcgggggaatagtttaagtggcgtagagggcgaaggcctgcataaattaggctacattctacgtgacgtatcaaagaaggagggaggcgcgatgtatgcagatgataccgccggatgggatacaaggataactctagaagacctcaagaatgaagaaatggttaccaatcacatgaaaggagaacacaagaaattagccgaggcaatctttaaactcacttaccagaacaaagtagtacgagtgcaaaggccaacaccccgaggaaccgtaatggacattatcagtagaaaagatcaacgtggatcaggacaagtcgggacctatggattaaatacgtttaccaacatggaagcacaattgatacgtcaaatggaaggagaaggaatttttaaatctatacagcgacttaccgtcaccgaggagatagccgtgcaaaattggctagcacgagttggtcgcgaaagactttctcgcatggcgataagtggggatgactgcgtagtcaagcccttagacgaccgatttgcttctgcattgacagctttaaatgatatgggcaaagttaggaaagatatccaacagtgggaaccaagtagaggctggaatgactggacgcaagtacctttttgttctcaccactttcacgaacttgtaatgaaggacggacgcgtcctcgtagtaccatgtagaaaccaagacgaacttataggcagagctagaattagccaaggagctggatggagtttaaaagaaactgcatgtttaggaaaatcatacgcacagatgtggactctgatgtactttcacaggcgagatttacgactcgccgcaaatgcgatatgtagtgctgtgcctagccactgggtacccacaagtcgaacaacatggtcgatacacgcaaaacacgaatggatgacgacagaagatatgctagctgtttggaatcgcgtgtggatacaagaaaatccttggatggaagataaaactccggtcgaatcttgggaagaggttccctatctgggtaaaagagaagatcaatggtgtggatccctaatcggattaacctcgcgagcaacatgggccaaaaatatccaaactgcaataaatcaagttagatcattgataggaaacgaagaatatacagactacatgccatccatgaagcgatttagaaaagaagaggaagaagccggtgtactttggtaa

SEQ ID NO: 22603 - RNA, 9876 nt, synthetic construct
  misc_feature 1..9876: note = derived and/or modified CDS sequence (opt6) from DENV-2__EU687237__SS-prME
  source 1..9876: mol_type = other RNA
acagcaggagtcataatcatgctgataccaactgcaatggctttccacttaacaacacggaacggagaacctcatatgatagttggacgtcaagaaaaaggaaaatctctcctctttaaaactgaagatggagtaaacatgtgtacgttgatggcaattgatctaggagaattgtgtgaagacaccattacatataaatgcccattattacggcaaaatgaacctgaagacatagattgttggtgtaactcgacttctacatgggtgacctatggaacatgtactacgactggagaacatcggagagaaaaacgaagtgtggcactcgttcctcatgttggaatgggattagaaaccagaacagaaacatggatgtcctcggaaggtgcttggaaacatgtacaacgaatcgaaacctggattttaagacaccctggatttacgatcatggcagccatattagcatacacaataggaacaacgcacttccaaagagctctgattttcatcctactaacagctgttgctccatcaatgacgatgcgttgtataggaatatcaaacagggattttgtagaaggagtttccggtggctcatgggtagatattgtacttgaacacggctcctgtgtaacaacaatggcgaaaaataaaccaaccttagattttgaattaataaaaaccgaagcgaaacaaccggctacattaaggaaatattgtatagaagcgaaactcactaacactactactgaatcacgatgcccaacacagggcgagccctcactcaatgaggagcaagataaaagatttatatgcaaacactcaatggttgatcgaggttggggaaatggctgtggacttttcggtaaaggtgggatagtaacttgtgctatgttcacatgtaagaaaaatatggaaggtaaagtggtactaccggaaaaccttgaatatacaatagtcataactccgcatagtggcgaagaacatgccgtcggaaatgatactggcaaacacggaaaggaaattaaaatcacgccgcagagttcgatcaccgaggcggagttaacaggatatggtactgtaacaatggaatgctccccacgaaccgggctagactttaatgagatggtgctgctgcaaatggaggacaaagcatggctggtacatagacaatggttcctggatcttccacttccgtggctgcctggagcggacacgcaaggctcgaattggatacagaaagagactttagtgactttcaaaaatccacacgcgaagaaacaggatgtagtagtcttaggctcacaagaaggggctatgcatacagcattaacaggcgcaactgaaatacagatgtcaagcggaaacctattatttactggccatttaaaatgtaggttacgcatggataaacttcaattaaaaggtatgagttactctatgtgtactggtaaatttaaaatagtgaaggaaatcgccgaaacacagcatggaaccatcgtcataagagtacaatacgagggagatggtagcccatgcaaaataccatttgagataatggatctagaaaaacgacacgtattaggcaggcttataacagtaaacccaatcgtaacagaaaaggattcgcccgtcaatatagaagctgaacctcccttcggagactcctatataataattggggtagaaccaggccaactcaaattaaattggttcaagaagggctcaagtattggccaaatgttcgagaccactatgcgaggtgcaaagagaatggctatactaggagatacagcttgggatttcggatcattgggaggagtattcacatcgataggcaaggcactacatcaagttttcggtgctatctatggagctgctttttcaggtgttagctggacaatgaaaatacttataggcgtgataattacttggattgggatgaactctaggagcacatcattatcagtcagtttagtattagtaggcgtagtaactttgtatctaggggttatggttcaagcagacaccggatgcgtggtgagttggaaaaacaaggagctcaaatgcgggagtggtattttcattacggacaacgtacatacctggacagaacaatacaaattccagccagaatccccaagtaaacttgcgtctgccatccaaaaagcacacgaagaaggaatttgtggtattaggagtgtaactagacttgagaatttaatgtggaagcagattacaccagaattgaatcatatactcagtgagaatgaagtcaagttaaccatcatgactggcgatattaaaggtattatgcaagcggggaagaggtcgctcaggccacaaccaactgaattaaaatatagttggaaaacgtggggaaaagctaagatgctgagcaccgaaagccacaaccaaacattcctaattgatggcccagaaacagcagaatgtccaaacactaaccgtgcgtggaactcgcttgaagtagaggattatggttttggcgtattctccacaaatatatggttgaaacttcgtgaaaaacaagacgttttctgtgatagcaaacttatgtctgctgctattaaagataacagagcagtacatgctgatatggggtactggatagaaagtgcattaaatgatacttggaaaatggaaaaagcgagctttatagagataaaatcctgtcactggccaaagagccacacgctatggtctaatggagtactagaatcagagatgattatccctaagaactttgccggtccagtcagtcagcacaattatcgacctggctaccatacccagacagcaggtccgtggcatctaggcaagctagaaatggacttcgatttttgcgaaggaacaacagtagttgtgacagaagactgcggaaatcgaggaccatcacttagaactaccacagcaagtgggaaactgataacagaatggtgctgcagaagctgtacgctacctcccctaagatacaggggagaggatggttgttggtacggaatggaaatcagaccattgaaggaaaaggaagagaatttagtaaatagtttagttaccgcggggcatggccaaattgataatttttctctcggagtgcttggcatggcgttatttttagaagagatgttaagaacaagggtagggacaaagcacgcgatattgttagtagcagtgtcattcgttaccctaatcacaggaaatatgagttttagagatcttggccgtgtgatggttatggtcggggcaacaatgacggacgacattggaatgggagtaacatacttggcactgctggccgccttcaaagttaggcctacgttcgcagcagggcttcttttaagaaaactcacgtcaaaagaactaatgatggcaactatcggtatagcactactgtcacaatctacgattcccgaaaccatacttgaattaactgacgcactggcactaggaatgatggttttaaaaatagtaagaaatatggaaaaatatcaactagccgttacaataatggcaataagttgtgtgccaaatgcagtaattctgcaaaacgcatggaaagtatcttgtactattttggccgcagtgagcgtttctccactactattaaccagctctcaacagaaagcagattggataccactggctctaacaataaagggtttaaaccccacagcaatattcctaactacattaagtagaactagcaagaaaagatcatggccattaaatgaagcagtgatggctgtcggaatggtgagtatactagcgtcatcactccttaaaaacgacatacccatgaccggaccgttggttgcagggggattattaactgtatgttatgttctaactggtagatccgccgatctggagcttgaacgtgcagctgatgtaaaatgggaagatcaggcggaaatcagtggtagctccccaatcttaagtataacaataagtgaagacggatcaatgtcaattaagaatgaagaagaagaacacacgttaactatattaatcagaacgggattattagtaatatcgggcgtgtttcccgtaagtatcccaattactgccgccgcttggtatctatgggaagttaagaaacaacgtgccggtgtcttatgggatgtgccatccccgccaccagtcgggaaggctgaattagaagacggcgcgtatcgaatcaaacaacgtggaatcttcggatattcccaaatcggcgcaggagtgtataaagaaggcacatttcatacaatgtggcatgttactagaggtgcagtcttaatgcaccgaggcaagagaatagagccctcatgggccgacgtaaagaaggatttgatttcctacgggggcggatggaaattagagggagaatggaaagaaggagaggaagtacaagtgctagctcttgaaccaggcaaaaatccaagggcagtccaaacaaaacccggtcttttcaaaacaaacactggtactataggcgcggtttcactcgatttttctccaggtacctcaggttcccccatagttgacagaaaaggtaaagtcgttgggctatatggaaatggagtcgtgactaggagcggagcctatgtctcagccatagcccaaaccgaaaaatctatcgaagacaatccggagatcgaggacgatatattcaggaaaaagcgattaactataatggacttacacccaggagctggaaaaacgaagaggtacttaccggcaatcgtaagagaggccataaaacgaggattaagaacattaatactcgctccaactcgcgtagtagctgccgaaatggaggaggcactacgcggcttacccatcagatatcaaaccccagcaattagagctgagcataccggacgcgaaattgtagaccttatgtgccacgcaacttttaccatgagactgttaagtccggttcgtgttcctaattacaatctaataataatggatgaagcacattttactgacccagcctcaatagctgcgagaggatacataagtaccagggttgaaatgggagaggcagccggtatcttcatgacagctacgccacctgggagtagagatccttttccacagtcaaacgctccaattatggacgaagagagagaaattcccgaaagaagctggaatagtggacacgaatgggtcaccgacttcaaaggaaaaacagtctggttcgttccctccataaaagcgggtaatgatatagctgcatgtttaaggaaaaatggaaagaaagttatccaactttctcgcaaaactttcgattctgaatatgtgaaaactcgtgccaatgactgggactttgtcgtgacaaccgatattagtgagatgggtgcgaattttagggctgaaagagtcattgatccccgaagatgcatgaagcccgtaatcttgacagacggagaggagagagttatccttgcaggacccatgcctgtaacacatagctcagctgcacaacgacgaggtagaattgggcgcaatcccaaaaatgagaacgatcagtacatatatatgggggaaccgttggaaaacgacgaagattgtgcacattggaaagaagcgaaaatgctattagataatattaatacaccagagggaattatcccaagtatgtttgaaccagaaagagaaaaagtagacgcaattgatggtgaatacaggctcagaggggaagctcgaaagaccttcgtcgatctcatgagaaggggtgatttaccagtttggttagcctacagagtcgcagcggaaggcataaattatgcagatagaagatggtgcttcgatggaatcaagaacaaccaaattctagaagaaaatgtggaagttgagatctggacaaaagagggcgaacggaagaagttaaagccaagatggctagacgcaaggatctattctgatccccttgctttaaaagagttcaaagaatttgcagcaggaaggaaatctctaacattaaacctaataacggagatggggaggttaccaacattcatgacacaaaaagcaagagatgcgttggacaatctagcagttcttcatacagcagaagttgggggcagagcttacaaccatgccctatcggaacttccggaaactttagaaactctcctgctcttgactctcctagcaactgttactggaggcatatttttatttttgatgtccggtaaaggaataggtaaaatgacattaggtatgtgttgcataattacagcgagtatactattatggtatgctcaaattcaaccacattggatagcagcatcaattattttggaatttttccttatagtattactaatccctgagccggagaagcaacgtacccctcaagacaaccaactaacttatgttgtaatcgcaatactgactgtagttgcagcaaccatggcaaatgaaatgggtttcctcgagaaaactaagaaagacttaggattaggcagtataaccactcaagaaagtgaaagtaatattcttgatattgacttacgaccggcttccgcatggacattatatgccgttgcaacgacctttgtgactccgatgttaagacatagtatagaaaactcaagcgtcaacgtctcactaactgctatcgcaaatcaagccacagtacttatgggattgggcagagggtggcctttatcaaaaatggatataggtgttcccctactcgccataggatgttattcccaagtgaaccctataactttgactgctgctttattattactcgttgctcattacgcaatcattggaccaggtttgcaggccaaggcaactagggaagcgcagaaacgtacagcggcgggaataatgaaaaacccgacggtagacggtatcaccgtaatagatttagagcctattccatacgaccctaaatttgaaaagcaattaggacaggtaatgttgctagtattatgcgtcacacaggtattaatgatgaggactacatgggcgttgtgtgaagcactaactttggcaacaggtccaatatcgaccttatgggaaggaaacccgggtaggttttggaacacaaccattgccgtaagtatggctaatatttttagaggctcgtatctcgctggagcaggtttattgttcagtatcatgaagaatacaacaaacacaagaaggggcactggaaatataggagagacccttggcgagaaatggaaatcaaggttaaatgcgttgggaaaatccgaatttcaaatttataagaaatcaggcattcaggaagtagatagaaccctagcaaaggaagggattaaaagaggagaaactgaccatcatgccgtatcgaggggatcagccaaattaagatggttcgtcgaacgaaatatggtcacaccagagggtaaggtggtagatcttggctgtggtcgtggtggatggtcatactattgtggaggactaaagaatgtgagagaggttaaaggattaacaaaaggcggaccaggccacgaggaaccgatacccatgagcacgtatggctggaatttagtgagattgcaatcaggggtggatgtatttttcacccctcctgagaagtgcgacacactcctgtgtgatattggcgaatccagcccaaacccaaccatcgaagcaggaagaactttaagggttttaaatctagtagaaaattggctaaacaacaatacacaattttgcgtgaaagtcctaaatccctatatgccgtcggtaatagagaaaatggagaccctgcaaagaaagtatggaggcgccttagtcaggaaccctctgtctaggaatagcacacatgaaatgtactgggtatcgaatgctactggaaatattgtatcaagcgtaaacatgatctcaagaatgcttattaacaggttcactatgaaacacaagaaagcgacatatgagccagatgtagatctgggttccggtacacgcaacattggcattgaaaatgaaataccgaatttggatatcattggtaaaaggattgagaaaattaaacaagaacatgaaacgtcatggcactatgaccaagaccatccctataaaacttgggcatatcatggctcgtatgaaacaaaacagacgggatcagcatcaagtatggtaaatggagtagtgaaattacttactaaaccatgggatgtggtcccgatggtaacgcaaatggctatgacagatactaccccatttggtcaacagcgggtcttcaaagaaaaagtcgatacgcggacacaagagccaaaggaaggaactaagaaactcatgaggattactgcagaatggctctggaaagaactaggtaaaaagaagaccccacgaatgtgtacacgagaagaatttaccagaaaagtgcgctcgaacgctgctcttggagcaattttcactgatgaaaataaatggaaatcggctagggaagccgtagaagatagcagattctgggaactggttgaccgagaaagaaatcttcatctggaaggaaaatgtgaaacatgtgtttataatatgatgggaaagagagagaagaaattaggggaatttggtaaggctaaaggctcacgagctatttggtacatgtggctaggtgcacgattccttgagttcgaagccttggggttcctaaatgaagaccactggtttagccggggaaatagtttgtcaggcgttgagggagaaggcctacacaaacttggttatatactcagagatgttagtaagaaagaaggcggtgcgatgtatgctgatgataccgctggatgggacacaagaattacattagaggacctgaaaaatgaggaaatggtaacaaaccatatgaaaggtgaacataagaaacttgcagaagccatattcaaacttacataccaaaacaaggttgttagggtgcaaagaccaacaccacgcggaacagtcatggacattattagccggaaagatcaacggggttcgggccaagtaggtacatatgggttaaacactttcacgaatatggaagctcagctaataaggcaaatggagggagaaggaatattcaaaagtattcagagacttactgtaactgaagagatagcagtacaaaactggttagccagggtaggacgtgaacgattgagtaggatggcaatatctggagatgattgtgttgtaaaacctttggacgaccgatttgcaagtgcattaacagctctcaatgatatggggaaggtaagaaaagatatacagcaatgggaaccgtctagaggctggaacgactggacacaagttcctttttgttctcatcacttccacgaattagtaatgaaagacggaagagtactcgtagtgccatgtaggaaccaggacgagttgatcggcagagccagaatatctcaaggcgcaggatggtcactaaaagagactgcgtgcttggggaaaagctacgcacagatgtggaccttaatgtattttcatagacgggacttaagattagcagcaaacgcaatctgttcagcagttccatcacattgggtacctacaagtcgtacaacatggtcaattcatgcgaaacatgaatggatgactaccgaagatatgctggctgtctggaaccgtgtgtggatacaggaaaatccctggatggaagacaaaacacccgtagaaagttgggaagaggttccatacctcggcaaaagagaagaccagtggtgcggatctctaataggactgacaagccgggcaacatgggccaaaaatatacaaacggcaataaatcaagtgagatctttgataggtaacgaagaatatacggattacatgccttcgatgaaaaggttcagaaaagaagaagaggaagcaggagttctatggtga

SEQ ID NO: 22604 - RNA, 9876 nt, synthetic construct
  misc_feature 1..9876: note = derived and/or modified CDS sequence (opt6) from DENV-2__EU687238__SS-prME
  source 1..9876: mol_type = other RNA
accgcaggcgtaattataatgctaataccaaccgctatggcttttcatctaacgacgcgcaacggagaaccccatatgattgtggggagacaagaaaaaggaaaaagtcttttgtttaaaacagaagacggggttaatatgtgtaccttaatggcaattgatctaggggaactatgtgaagatacaataacttataaatgtccgttgttaagacaaaacgaacccgaagatatagattgttggtgcaattcaacaagtacatgggtaacatatggaacgtgtacaaccacaggagaacataggcgtgagaaaagatccgttgcccttgtgccacacgtaggtatgggcttggaaacaagaacggaaacatggatgtcaagtgaaggagcttggaaacacgtacaacggatagaaacgtggatactaagacatcccgggtttacaatcatggcggccattctagcatatactatcggaactacccatttccaaagagcactaatctttatcttgcttactgcagtagcgcctagcatgacaatgcgatgtattggcataagcaatagagattttgtagaaggtgtctctggcgggtcatgggtggatatcgtactagaacatggcagttgtgtaacaacaatggccaaaaataaacctacactagattttgaacttatcaaaaccgaagccaaacaacccgctacacttcgcaaatattgtatagaagcaaaattaactaacactacaacagaatcaaggtgtccaacgcaaggggaaccaagcctaaatgaagaacaagacaaacggttcatttgtaaacatagtatggttgatcgcggatggggtaatggttgtggactttttggaaaaggtggtatagtcacttgtgcgatgtttacctgcaagaaaaatatggagggtaaagttgtgcttccagaaaatttggaatacacaattgtaatcactcctcattcgggcgaagaacacgcagttggcaatgacaccgggaaacatgggaaagaaataaaaattacaccccaaagttcgataactgaagcagaactcactggatatggaacagttactatggaatgttccccgcgaaccggactagattttaacgaaatggttttattgcagatggaagacaaagcatggctggttcacagacaatggtttctcgatcttcctctaccatggttaccgggagccgatactcagggaagtaactggattcaaaaggaaaccttagttacctttaaaaacccacacgccaaaaagcaagatgtcgttgttcttggttcccaggaaggcgccatgcatacagccctaaccggcgcaacagaaatacaaatgtctagcggaaatctgctttttacaggacatttaaagtgcagattgcgaatggataagttacaattaaaaggcatgtcatactccatgtgtacaggcaaattcaaaatagtaaaagaaatagcggaaacacaacatgggacaatagtgattagagtgcaatatgagggagacggatcaccatgcaagataccctttgaaattatggatttagagaaacgacatgtattgggtcgattaataacggtaaaccctatcgtcacggaaaaagattcgcccgtaaatattgaagctgaaccaccctttggcgacagctacataattattggcgttgagcccggacaattaaaactgaactggtttaagaaaggctcatcaatcgggcaaatgtttgaaacgacgatgagaggtgctaaaagaatggcaattcttggtgatacagcatgggattttggatcgctaggtggagtttttacttcaataggaaaagctctgcatcaagtgtttggggcaatatatggtgctgccttctccggagtaagctggactatgaaaatactaataggggttacaataacctggataggcatgaacagtagaagcacttcccttagcgtcagcttagttcttgtaggagttgttactctatatctgggagtcatggttcaggcagatacaggatgtgtagtgagttggaaaaataaggagttgaaatgtgggagtggtattttcataacagacaatgtccacacctggacagagcaatataagttccagcctgagtcaccatcaaagttggcgtctgctatccagaaagcccatgaagaagggatatgtggaataaggtctgtaactcgattagaaaacttaatgtggaaacaaattacccccgagttgaatcatatactatcagagaacgaagtaaagttgacaattatgacgggagatataaaaggcataatgcaagcgggaaaaagaagcctaaggcctcaaccaactgagctaaaatatagttggaaaacctggggcaaagcaaaaatgttaagtacagagtcccataatcagacgttcctgatcgatggtccagaaactgctgagtgcccaaacactaatagagcttggaactcattggaggtagaggactacggatttggggtattcagtactaatatttggttgaaattaagagaaaaacaagatgttttctgtgactccaaactgatgagcgcagcaataaaggacaaccgtgctgtacatgccgatatgggctattggattgaaagcgctttaaatgatacttggaaaatggaaaaagcgagttttatagaaattaaaagttgtcactggccgaagtcacatacgctctggtccaacggggttctggaatctgaaatgataattcccaagaactttgcgggacccgtctcacaacataactaccgccccggataccacactcaaacagccgggccgtggcatttgggcaaattagaaatggactttgatttctgcgagggaacaacggtagttgtcaccgaagactgcggtaatagaggaccatctttgagaacaaccacagccagcggtaaactaataacggaatggtgctgcagatcctgtactcttccaccactaagataccgaggtgaagatggctgttggtacggcatggaaatacgaccattaaaagaaaaggaggagaacctcgtaaattcattggttacagctggccatggtcagatagataactttagcctaggagtgctaggcatggccttatttttagaagaaatgttgaggacgagggtcggaacaaaacatgcaattcttttagtagcagtcagcttcgtgactttaataactggtaacatgtcctttcgggatctaggtcgagtcatggtaatggtaggagcaaccatgacagacgacatcggaatgggagtcacttatctagcccttcttgcggcgtttaaagtgagacctacattcgcagctggactgttactgcgcaagttgacgagtaaggaattaatgatggcaactataggtatagctctattaagccaatcaacaattcccgaaacaattttggaactcacagacgcattagctctagggatgatggtcttgaaaatagtaagaaatatggagaaataccaactcgccgtaactattatggcaatttcatgtgtcccaaacgctgtaattcttcaaaatgcttggaaagtctcatgtaccatcctagcagcggtatcagtgagcccgttgttacttacgagctctcaacagaaagcagactggataccccttgctctgaccatcaaaggactaaatcctacggcgatatttctgacaactctttcgagaactagcaagaaaagatcatggccactcaatgaagccgtcatggctgtcgggatggtctctatcttagcaagttctctcctcaaaaatgacataccaatgacgggtcccctagtagctggaggacttctaacagtatgctatgttttaactggacggagtgctgacttagaattagaaagagcagccgatgtaaagtgggaggaccaggcggaaatctcaggatcgtccccgatacttagtataacaattagcgaggacggatccatgtccatcaaaaacgaagaagaggaacatacattaaccattttaattcgaacgggattgttagtcatctcgggtgtatttcctgtctcaatccccataacagcagccgcttggtatctttgggaggtcaagaaacaacgagcaggagtactttgggatgtaccatcaccaccacccgttggtaaggctgaacttgaggacggagcatataggattaaacagcgaggtatattcggatattctcaaattggtgcaggagtgtacaaagaaggcacattccatactatgtggcacgttacaagaggggcagtgctaatgcaccggggcaaaagaatcgaaccatcatgggctgatgtaaagaaagatctaatttcatatggtggaggatggaaattagagggcgagtggaaagagggtgaagaagtacaagtcttggcactagaaccaggtaagaatcccagagcagtacaaaccaaacccggattgtttaaaaccaatacaggcactataggcgcagttagcctcgacttctctccgggaaccagtggatcccccattgttgatcggaagggaaaagtcgtcggattatacggaaatggtgtggtaactcgctcgggtgcgtatgtcagcgccatagcacaaactgaaaaatcgatcgaggacaatcccgaaattgaagatgacatattcagaaagaaaagattgactatcatggacttacatccaggcgcgggcaaaacaaaaagatatctcccagcaatagtcagagaagcgataaaaagaggattgcgtactttaatactggccccaaccagagtagttgctgcagaaatggaagaagcattacgaggcttgcctataagatatcaaacaccagcaataagagccgaacatacaggccgtgaaatagttgacctaatgtgtcacgccacgtttacaatgagattactttcgccggttcgagttccaaattacaatcttataataatggatgaagcacattttacagacccagcatcgatagccgcacgaggatatatatcaactagagttgaaatgggagaagcagccggaatattcatgactgcaaccccgcctgggtcaagggacccatttcctcaatctaatgctccaattatggacgaggaaagagaaatacccgaaagaagctggaacagtggacatgaatgggtcacagatttcaagggtaaaaccgtttggtttgtaccaagcataaaagctggtaatgatatagcagcgtgcctcaggaaaaacggtaagaaggtaatacagctcagccggaaaacattcgatagtgagtatgttaaaacaagggcaaatgactgggattttgttgtcacaacggacatatcagaaatgggtgcaaactttcgcgcggagagggtaatcgacccgcgcagatgtatgaaacctgtcattcttaccgatggtgaggagcgagtaatacttgcaggcccaatgccggtaacacattcgtcagccgcccaacgaagaggaagaataggaagaaatccaaagaatgagaatgatcagtacatatacatgggcgaacctttagaaaatgatgaagactgcgcacattggaaagaagccaaaatgttgttagataatataaacacgcctgagggaataataccatcaatgttcgaacctgaacgagagaaagtggatgcaatagatggtgaatacaggctacgaggtgaagctcgtaaaacgtttgtagacctgatgagaagaggagacctcccggtttggctagcatatagagtcgcagcagaaggcattaactatgctgatagaagatggtgctttgacggtatcaaaaataatcaaatattggaagagaatgtagaggtcgagatctggactaaggagggagaacgtaagaaattaaaaccacgatggctagatgctaggatatatagtgatcctttagctctgaaagaatttaaagagttcgcagccggaagaaaatcactaacactcaacttaataacggaaatgggtagacttcctacatttatgacacaaaaagccagggacgcgttggataatttagcagttttacatacagcggaagtgggaggacgagcatacaaccatgcgcttagtgagctcccagaaaccttggagactttactattattaaccttactagcaacagtcacaggtgggatttttctgttcttgatgtcagggaaaggtatagggaagatgacgctaggaatgtgctgcattattaccgcatcaatcttattatggtatgcacagatacaaccacactggatagctgcaagtataatccttgagttctttttaattgttctcctgataccagaaccagaaaaacaaagaacccctcaggataaccaacttacctatgtagtaatagcaattctaacagtcgttgcagccaccatggcaaatgagatgggcttcctagagaaaactaagaaagatctgggacttggctctatcacaacccaagaaagtgaatcaaatattctagatattgatttacgccctgcaagtgcatggaccctctacgcggtcgctacaacttttgtaacccctatgttacgccattctatcgaaaattcatcggtaaatgtgagtcttactgcaatagcaaaccaagctacagtattaatggggctaggacgtgggtggccattgtctaagatggacataggcgtcccattgctagcgataggttgctacagccaagtaaacccaataacactgacggcagcgctgttactacttgttgcccactacgctataataggtcctggtttacaggccaaagcaacaagagaggctcagaaaagaactgcagctggaatcatgaaaaatcctactgttgatgggattacagtgatcgacctagagccaataccatatgatcctaaattcgagaaacaactcggtcaagttatgttgctcgttctttgtgttacacaagtgctgatgatgcggacaacatgggcattatgtgaagcgctaacgcttgcaaccgggccaatttcaacgttgtgggaaggtaatccagggagattttggaacacaactattgcggtgtcaatggcaaacatattcaggggaagctatctcgccggggctggactgttattctcaattatgaagaacaccaccaacactagacgcggcacaggaaatattggtgaaaccctaggtgagaagtggaaatcgcgattaaatgctttaggaaagtcggagttccaaatatacaaaaagtctggaatacaagaagttgaccggacgcttgccaaggaaggaattaaacgtggggaaacggaccaccacgcagttagtagaggttcagcaaaactcaggtggttcgttgaaaggaatatggtaactccagaaggcaaggttgtcgacttgggctgtggaagaggaggctggagttactattgtggaggcttaaagaatgtgagagaagtaaagggacttaccaagggtggccctggtcatgaagaaccaataccaatgagcacgtacgggtggaatcttgttaggttacagtccggagtagatgtattcttcacaccccctgaaaaatgtgatacgttattatgcgacataggggagagtagtcccaatccaacaatagaagccggaaggacactaagggtcttaaatcttgtcgagaattggcttaataacaatacccaattctgcgtcaaggtactaaatccatacatgccatccgttatagaaaagatggaaacattacagagaaagtatggcggcgccttggttagaaatccgcttagcagaaactcaacacatgaaatgtattgggtttctaatgcgacaggaaatatagtaagtagtgttaatatgatctccagaatgctgataaaccgcttcacaatgaaacacaagaaagcgacctatgaacctgatgtcgacctggggtctggtacccgaaatatcggaatagagaacgaaatcccaaatctcgatattataggaaaaagaatagaaaagattaaacaagagcacgaaacaagttggcactatgaccaagaccacccatacaaaacatgggcgtaccacggaagttacgagacaaaacaaacggggtcagcctcttcaatggtaaacggagtagtgaaattgttaactaaaccctgggatgtcgttcccatggttacccagatggctatgaccgatacaactccatttggtcaacagcgtgtatttaaggaaaaagtggacactcgaacacaagaaccaaaggaaggaaccaagaaattgatgagaataactgccgaatggttatggaaagaactcggcaagaagaaaacaccacgtatgtgcacaagagaagagttcaccaggaaggtgcgttctaacgcagcactaggagcaatttttactgacgaaaataagtggaagtcagctagagaggcagtggaggattcacgattctgggagttagtagatcgagaaaggaacctacatctcgaaggtaagtgcgaaacttgtgtatataacatgatgggcaaaagagagaagaaattaggggagttcggaaaagcaaaaggctccagagcaatttggtatatgtggctaggagcaagattcctagagttcgaggccctgggttttctaaatgaggatcactggttctctcgaggaaattccctatcgggcgtggagggcgaaggattacataagttgggttatattttgcgagatgtttcaaagaaagagggcggcgctatgtatgcggacgatacggccgggtgggacaccagaataacacttgaagacctcaaaaatgaagaaatggttaccaatcacatgaaaggcgaacacaagaaactggcagaggccatattcaaactgacatatcaaaataaagttgttagagtacaacgtccaacacctagggggactgtaatggacataatctccagaaaggatcaacgaggatcaggccaagtcggcacatacggacttaacacattcacaaatatggaagcacaattgattagacagatggagggcgagggtatattcaaaagtatccaaagattaacagtaaccgaggagatagcagtccaaaattggttggctagggtagggcgagaacgattgtcccgcatggctatttcaggggatgactgcgtagtaaaaccgttagatgatcgttttgcttctgcattaacagcactgaatgatatgggcaaagtaagaaaagatatacagcaatgggaaccgagccgtggttggaatgattggacccaggtaccattttgttctcaccacttccatgagctagttatgaaggacggccgtgtcctagtagtgccatgtcggaatcaagatgagttaatcggtagggcacgaatatcccaaggagcaggatggtctttaaaggaaactgcatgtcttggaaaaagttacgcgcagatgtggacattaatgtattttcaccgaagagatctacggcttgcagcaaatgcaatttgtagtgcagtaccaagtcattgggttccaacaagtcgaacaacgtggagtattcatgcaaaacacgaatggatgaccaccgaagacatgttagcagtatggaacagggtatggatacaagaaaacccttggatggaagacaagaccccagtggaaagttgggaagaagtcccctacctgggtaaacgtgaagaccaatggtgtggtagtctaataggattaacttctcgggcaacatgggcgaaaaatatacaaaccgctataaatcaagtacgctcattgataggaaatgaagagtatacagactacatgccatcaatgaaacgtttccgaaaggaagaagaagaagcgggggtattatggtaa

SEQ ID NO: 22605 - RNA, 9876 nt, synthetic construct
  misc_feature 1..9876: note = derived and/or modified CDS sequence (opt6) from DENV-2__EU687240__SS-prME
  source 1..9876: mol_type = other RNA
actgttggagtaataataatgttgatcccaacagccatggcttttcacctaactactagaaacggagaacctcatatgatagtaggaagacaagaaaagggcaagtcactgcttttcaaaacagaggatggagtcaacatgtgtacacttatggctattgacttaggggaactatgtgaagatacgataacatataagtgtcctttattaagacaaaatgaaccagaagatattgactgctggtgcaattcaacatcgacgtgggtaacatatggtacttgtactacaactggagaacatagaagagagaaacgaagcgtcgcattggtgccacatgtaggaatgggactcgaaacaaggactgaaacttggatgtctagcgaaggagcatggaaacacgtgcaaagaattgaaacttggattttgagacatccaggatttaccatcatggcagccattctggcttatactataggtactacacatttccaacgtgcattaatttttatattactgacggccgtagcaccatccatgacaatgcgatgtattggaatcagtaatcgtgacttcgtggagggtgtctcaggtggttcttgggttgacattgtactagagcatggttcctgtgtaactaccatggcaaaaaacaagccaacactagattttgaactaataaaaactgaagcaaaacagcccgctactttacgcaaatactgcatagaggcgaaattaacaaatacaactacggaaagtcgttgcccaactcaaggagagcctagtctcaatgaggaacaagacaagcgatttatatgcaagcattctatggtagatagaggttgggggaatggttgcggtctattcggaaaaggggggattgtaacatgcgcaatgttcacatgcaagaaaaacatggaggggaaagttgtgttgcccgaaaacctagaatacacaatagttataactccgcatagtggagaggaacacgcagtaggcaatgatacggggaaacatgggaaagaaattaaaataacaccccaatcgagtataacggaagcggagctaaccggctacggaacagtcacaatggagtgttcccctagaacaggactagattttaacgagatggttctactccaaatggaggataaagcctggcttgtgcacagacaatggtttctagatctaccactaccttggcttccaggagcagatacacaaggttccaattggatacaaaaggagaccctagtgacatttaagaatccacatgcaaaaaaacaggacgtcgtagtattaggaagtcaagaaggagctatgcatacagcgcttaccggggctacggagatacaaatgtccagtggtaatttactgttcactggtcacctcaaatgtcgcctaaggatggataagcttcaattaaaggggatgagctactcgatgtgtacaggcaagtttaagatagtaaaagaaatcgcggaaacccaacatgggactatagtcatcagggtccaatatgaaggcgacggctctccatgtaagatccctttcgaaatcatggacctagaaaaaagacacgtattaggtcgactaataacggtaaaccctatagtaacggaaaaagatagtccggttaacatcgaggcggagcccccttttggggacagctacatcattataggagtagaaccaggacagctcaagttaaattggtttaaaaaagggtcgtcgattggacaaatgttcgaaacaacaatgagaggagccaagcgcatggctatactaggtgacacggcgtgggatttcgggagtttgggaggggtctttacgtcgataggtaaagcactacatcaggtatttggcgctatctatggggcagctttttcaggggtgagttggaccatgaagatacttattggagttataattacttggataggtatgaattcaaggtcaacatctttatcagtaagccttgtacttgtaggagtagtgacgctctatttaggtgtaatggtgcaagcagatagtggttgcgtagtttcttggaaaaataaagaattaaagtgcggatccggtatatttataactgacaacgtacatacctggacagaacagtataaattccaacccgaaagtccgagcaaattagccagtgcgatacaaaaagcccatgaggaaggtatatgcgggatcagatccgtcacacgtttagaaaatcttatgtggaaacagattactccagaattaaatcatattctaagtgagaacgaagcaaaattgactattatgacaggtgatatcaaaggaatcatgcaagcaggaaaaagatcattgcgcccccaaccaacagaattaaaatatagctggaaaacgtggggaaaggcgaaaatgctctccactgaaagtcacaaccaaacgtttctaatcgatggacccgaaaccgcagagtgtcccaataccaatagagcctggaactcgctggaggttgaagattacgggttcggagtattttcaactaatatctggctcaaactacgtgaaaaacaggacgttttctgcgactcaaagctcatgtcagcggcaataaaagacaatagagccgtacacgctgatatgggttattggatagagagcgcccttaacgatacatggaaaatggaaaaagcttcttttatagaaataaaatcttgtcattggcctaaatctcatacattatggtctaacggcgtgctagaatctgaaatgataatcccaaaaaactttgcaggcccagttagtcaacacaactaccgaccgggctaccacacacagaccgcgggaccttggcacttggggaaattagaaatggacttcgatttctgcgaaggaacgacagtagtagtaacagaggattgtggaaacagaggacccagtcttagaactacaacagcttctggtaaacttatcaccgaatggtgctgtcgaagttgcacactacctccactacgttacagaggtgaagacggctgctggtacggaatggaaatcagaccattaaaagaaaaggaagaaaatttagtcaatagtctcgtaacggcaggacatggccaaattgacaatttctcactaggtgtactgggaatggcacttttcctcgaggaaatgctccgtacgcgtgtaggcactaagcacgcaatacttttagttgcagtctcattcgtgactttgataaccgggaatatgtcgtttagggatctaggtagagtcatggtgatggtaggagcaacaatgacagatgatataggcatgggtgtaacatatttagctttacttgcagcatttaaagtacgccccacgtttgctgccggactgctactcagaaagttaacatccaaggagttaatgatggcgacaattggaatcgctctattaagtcaaagtacaatacctgaaacgattctcgaattaacagatgcactagcactaggaatgatggtactgaagatcgtaaggaatatggaaaaataccaattagcagtaactataatggcaataagttgtgtacccaatgcagtaatactacagaacgcgtggaaagttagttgcactattctcgcagcagtttccgtttcccccctgttattgacctccagtcagcaaaaggcggactggatacctcttgcgctgacgattaaaggccttaacccaacagcaattttcttgacaacactatcgcgaactagcaaaaagcgaagctggcccttaaacgaagcagtaatggcagttgggatggtaagtattttagcttcaagtttgctcaaaaatgatatcccaatgaccggacctttagtcgcaggcggcctattaaccgtttgctacgtcttgactggtagatcggcagacttggaacttgaaagagcagccgacgtcaaatgggaagaccaagcggaaatatcaggatcatctccaatactaagcataacaatctcggaagatggtagtatgagtataaaaaatgaagaagaagaacatacgcttacaattttaataagaaccggattattagtaataagcggtgtgtttccagtatcgattccaataacagctgcagcttggtatttatgggaagtcaaaaagcaacgagccggagtactatgggatgttcccagccccccccctgtaggaaaagcagaattagaggacggcgcctatcgtattaaacagcgaggcattttcggatattcccaaatcggtgcaggcgtatataaagaaggtacttttcatacgatgtggcatgttacacgaggcgccgttctgatgcaccggggaaaaaggattgaaccttcttgggcggacgttaaaaaggatcttatatcatatgggggcggatggaaattagaaggagaatggaaggagggcgaagaagtgcaagtactagcactagagccggggaaaaatcctcgggcagtacaaaccaagccgggtctctttaaaacaaataccggtacaataggagctgttagtttagatttctcccctggaacttcgggatcgcctatagtagataggaaaggaaaagtagtaggcctctacggtaatggagtggttacgagatcaggagcctatgtatccgcaatagcgcaaacggaaaaatccatagaagacaatcctgagatcgaagacgatatatttagaaagaaacgactgacaatcatggatttacatcctggcgctgggaaaaccaaacgctatttaccagcaatagttagagaagcaattaagagagggctgagaacattgatcctagcacctacaagagtcgtggcagcagaaatggaagaagcgttacgcggactaccgataagatatcagactcccgccataagggcagaacatactggaagagagatagtagacctcatgtgccatgcaactttcactatgcgattattgtcaccagtgcgtgttcctaactataacctaattattatggatgaagcacattttacggacccagcatctatagctgctcgcggatacatatcgacaagagtggaaatgggcgaggccgccggtatattcatgacggcaacccccccaggaagtagagatccttttcctcagtcaaatgcacctattatggatgaagaaagggaaatccctgaacgatcatggaattcaggacatgaatgggtcaccgatttcaagggcaaaacggtgtggtttgttccttccatcaaggctggtaatgatatcgcagcttgtcttcgaaaaaacggcaagaaggttatacaattatcaagaaaaactttcgatagtgagtacgtaaagactcgggcgaacgattgggattttgttgtaactacggatatatcggaaatgggtgcaaactttcgtgcagaacgagtgatagatccgagaagatgcatgaaacccgtaatattaactgatggagaagaacgagttatattagcaggaccaatgccagtcacccacagtagtgcagcacagcggagaggacgaataggacgaaatccaaaaaacgaaaacgatcaatatatctatatgggggagcctttggaaaatgatgaggattgtgcgcattggaaggaagccaagatgttattagataacataaataccccagaaggtataattccttccatgtttgagccagaaagagaaaaagtagatgcaatagacggggaatataggctacgcggcgaagcacgcaaaacatttgttgatcttatgaggcgcggagatctaccagtatggctggcttatcgcgtagccgcagaagggatcaactatgcagaccgtagatggtgttttgatggtattaagaacaatcaaatactagaggaaaacgtagaagttgaaatatggacgaaagaaggcgaacgcaagaaactaaagccaaggtggctcgacgcacgtatatatagcgacccactagctttgaaggaatttaaagaattcgcagcagggaggaagtccctaacgttgaatctaattactgaaatgggaagactacctacattcatgacacaaaaagccagagacgcactagataatttagcagttctacacacggccgaagtagggggaagagcttacaaccatgcgctttccgaattacctgaaacgctagagacactattactactaacactacttgccacagttaccggaggtatcttcctgttccttatgagtggtaagggaataggtaaaatgacgctaggaatgtgctgtataattacagcgtctatattactatggtacgctcaaatacagccacattggatagctgcgagtattatactagagttcttccttatagtattactcatccctgagccggaaaaacaaaggactcctcaagacaaccaattaacgtatgtggtcatcgctattcttactgtagtagccgcaacaatggccaatgaaatgggttttttggaaaagaccaaaaaagacttaggcttaggcagtatcactactcaagaaagcgaaagcaacatactagacatcgatttgcgtccagcatccgcatggactctgtatgcggtagctacaacatttgtcactccaatgttgagacatagcatagaaaatagttcagtaaacgttagcttaacagccatagcaaaccaggcaacggttctcatgggcttagggagaggatggccactttctaaaatggacattggtgtaccgctcctcgccattggctgctattcgcaagttaacccgatcactctaacagccgcgttattattactagtagcccattacgctattataggaccgggccttcaggcgaaagctacaagagaggctcagaagagaacagcagcaggcattatgaagaaccccacagtagatggaatcacagtcattgacctcgaacccatcccatacgaccctaaatttgaaaaacaacttggtcaggtaatgctacttgtactatgtgttacgcaagtcttaatgatgagaaccacttgggcactctgcgaagctttaacattagcaactgggccgatatccacattgtgggaagggaatcccggcagattttggaacaccactattgccgtatctatggcaaacatattccgaggatcctatttggcaggagccggtcttctattctcaattatgaagaacacgactaataccaggcgcggtacgggaaacataggtgaaactttgggagaaaaatggaaatctaggttaaatgcactaggaaagtctgaattccaaatatacaagaaatcaggcattcaagaggttgaccggactttagcaaaagaaggtattaaacgcggagagaccgaccaccatgccgttagccgcggttctgctaaactgagatggtttgtagaacgcaatatggtaacccccgaaggtaaagtggtagatttagggtgtggtagaggtgggtggtcatattattgtggcggattaaaaaacgtaagagaagtcaaaggactaacgaaaggtggccctgggcatgaagaacccattccaatgtctacctatggttggaacttagttcgcctacaatcaggtgtagatgtatttttcactcctcctgaaaaatgcgatacactgctatgtgatataggtgaaagttctcctaatccaactattgaggccgggcgtacacttagggtactgaacctcgttgaaaattggctaaataataatacccagttctgtataaaagttcttaacccatatatgccgagtgtaatagaaaagatggaaacactacaacgaaaatatggaggagccctggtaaggaatcctttgagcagaaattcaacacatgagatgtattgggtgtctaatgcgacgggtaatatagtctctagcgtcaatatgatcagtagaatgctcattaacaggttcacaatgaaacacaaaaaagcgacttatgaaccagacgtagatttaggatcgggaaccagaaacatcggtatagaaaacgaaataccaaatctcgacattatcgggaagagaatagaaaagataaagcaagaacacgagacctcatggcattacgatcaagatcacccatacaagacatgggcatatcacgggagctatgagacaaaacaaaccggtagtgcatcatctatggttaatggcgttgtgaaactcctaacgaaaccatgggatgttgtcccgatggttacccaaatggcaatgacagatacaacaccgttcggacaacagagggtctttaaagaaaaagtggacacgagaacgcaagaacctaaggagggcacaaagaaattgatgagaataacagccgagtggttatggaaggagttaggcaaaaaaaagacgccgaggatgtgtacaagagaggaattcacaagaaaagttcgcagcaacgctgcactaggagctatctttaccgacgagaataagtggaaaagcgcacgtgaggctgttgaagatagccgattttgggaattagtagatcgcgaaaggaatcttcacttagaagggaaatgtgaaacatgcgtctataatatgatgggtaaacgtgaaaaaaaattgggtgagttcggcaaagctaagggaagccgagcgatatggtacatgtggcttggagcccgttttctagaatttgaagccttgggcttcctaaatgaagaccattggttttcgcgaggtaactcgctaagcggtgtagaaggggaggggttacataagcttggttatatcttacgggatgtgtcaaagaaagaagggggggctatgtacgcagacgatacagctgggtgggatactagaattacattagaagaccttaagaacgaagaaatggttacaaatcatatgaagggtgaacataaaaagcttgcggaagcgatctttaagttaacctaccagaacaaagtcgtgcgagtgcaaagaccaacaccgcgtggtaccgtaatggatatcataagtagaaaagaccaaagaggcagcggtcaagtaggaacatacggtctaaacaccttcacaaatatggaagcccaattaattcggcaaatggaaggggaaggaatttttaagagtatacaaaggttgaccgtgaccgaagaaatagctgtgcagaattggttagctcgagtaggccgcgaacgactttcgagaatggcaatatctggcgacgactgtgttgtgaaaccactagacgatcgatttgcatcggcactcacagcacttaatgatatggggaaagtaaggaaagatatccaacaatgggaaccaagtcgagggtggaatgattggacgcaggtcccattttgctctcatcattttcacgaattggtaatgaaagatggacgcgtcttagttgtcccatgtcggaaccaggatgaactgataggccgtgcaagaatctcccaaggcgcgggatggagcttaaaggaaaccgcttgtttaggaaagtcatacgcacaaatgtggacactcatgtactttcatcgaagagacttaagactagctgcgaacgctatatgtagcgccgtaccttcacactgggtaccaacatctaggacaacatggtcaattcatgccaagcacgagtggatgactacagaagacatgcttgcagtatggaatcgtgtatggatacaagaaaatccttggatggaggataagacacctgttgaatcttgggaagaagttccatatttaggaaaaagagaagaccaatggtgcggaagcctaataggactgacatctagggcgacatgggccaaaaacatacaaacagcaattaaccaagttaggtctttaattggtaacgaggaatacaccgattatatgccatcaatgaaaagattccgcaaagaagaggaagaagcgggagtattatggtaa

SEQ ID NO: 22606 - RNA, 9876 nt, synthetic construct
  misc_feature 1..9876: note = derived and/or modified CDS sequence (opt6) from DENV-2__EU687241__SS-prME
  source 1..9876: mol_type = other RNA
acagcgggagttataattatgctcattccaacagcaatggcatttcacctcacaactcgaaatggggaaccacacatgatcgtgggcagacaggaaaaaggtaaaagtcttttgtttaaaacggaagatggagtaaatatgtgcacattaatggcaatagacttaggagagctttgcgaagatacaataacttacaaatgtccactattacgacaaaatgaaccagaggatatcgattgctggtgtaatagcacaagcacatgggttacatatggaacatgcacaacaacaggtgaacacagacgggaaaaacgatcagtagcattagttccacacgtagggatgggattggaaacgagaaccgaaacatggatgtcctcagagggagcgtggaaacacgtacaaagaatcgaaacgtggattttacgacatcccgggtttactataatggcagcgatattagcatactcaatagggactacacattttcaaagggcactaatttttatactactgacagcagtagctccaagcatgactatgcggtgcattggaatctctaatcgagactttgtagaaggcgtaagcggcggcagttgggtagacatagttctcgagcacggaagttgcgttactacaatggcgaaaaacaaacctactttggactttgaactgacaaaaacggaagctaaacaacctgccacattaagaaaatactgtatcgaggctaaactcaccaacacgacaacagaatcaagatgcccaacccaaggagaaccctctttgaacgaagaacaggacaaaaggttcatttgtaaacactctatggtggaccgaggatgggggaatggatgcggattgttcggaaaaggaggaatagtaacctgtgccatgtttacatgtaagaaaaatatggaaggaaaagtggtgttaccagaaaaccttgagtacacaatcgtgataacaccacatagcggtgaagaacacgccgtgggcaacgatacaggcaaacacggtaaagaaatcaaaataacaccacagtccagtataactgaggcagaactaacaggatatggaacagtaactatggaatgtagtccaagaacgggcctggatttcaacgaaatggtattactgcaaatggaggacaaagcatggctagtacatcgtcagtggttcctggatctccccctcccatggctcccaggtgccgatacacaaggatcaaattggattcagaaagaaacattagtaacattcaaaaacccacatgccaagaaacaggacgtagtggttcttggctcgcaagagggagcaatgcatacagctttaacaggtgcaaccgaaatacaaatgtcaagcggaaatcttttattcacaggacatctaaaatgtagactaaggatggataagctacaattgaagggcatgagttattctatgtgcacaggcaagtttaagatagttaaagaaattgcggaaacccaacacgggactattgtcatacgagttcaatatgagggggacggatctccatgtaagatcccttttgaaatcatggatctcgagaagcgccatgtccttggacgtctaataaccgtaaatccaatagtaacggaaaaagattctcctgtcaatatagaagccgaaccacctttcggtgactcgtacataatcataggagttgagccaggtcaactaaagctgaactggttcaagaaaggctcatcaattggacaaatgttcgaaacgaccatgagaggcgctaaaagaatggcaattcttggcgacacagcttgggatttcggaagcctcggcggagtttttacatcaatcggaaaggctttacaccaagttttcggggctatttatggagcagcgttttccggtgtatcttggactatgaagattcttattggtgtaataattacatggataggaatgaactccaggagcaccagcttatcagtaagtcttgtattagttggtgtagtaactttatatctcggagttatggttcaagctgatacaggctgtgtggtgagttggaaaaataaggaacttaagtgtggatcaggtatatttatcacggataatgtccacacttggaccgaacaatataaattccaacccgaaagtccgtccaaactggcgagtgccatacagaaagcgcacgaagaaggaatctgcgggattcgctccgtgactaggttagagaatttaatgtggaaacaaattacgcccgagctgaaccacatactgtcagagaatgaggtaaagctaacgataatgaccggagatataaagggcattatgcaggctggaaaacgttctctacgtcctcagccgactgaacttaaatatagttggaagacatgggggaaagcaaagatgttgagcactgaaagccacaatcaaaccttcttaatagatggacccgaaacagcagaatgccccaatactaacagggcctggaactcacttgaagtggaagattacggttttggtgtattctcaaccaatatctggttaaaattgagagaaaagcaggatgtattttgtgattcgaaattaatgagcgcagcaatcaaagacaatagagcagtacatgctgatatggggtactggatagaatccgccctaaacgatacatggaaaatggaaaaggcatcttttatcgaaattaaatcatgtcactggcctaaatcacacactttgtggtctaatggagtactagagagtgaaatgattatacccaagaactttgcaggaccagtgtcacagcataattaccggccaggctaccatactcagactgcaggcccgtggcatctaggcaaactggagatggatttcgatttctgcgagggtacaactgttgtggtaacggaagattgcggcaatcgcgggccctctctcaggacaacgacagccagcggaaaactgataacagaatggtgttgtcgcagttgtactctcccacctctacgctatagaggagaagatggttgttggtacggaatggaaatccgacctctcaaagagaaagaagagaatttagttaactccttagttaccgccggtcatggacaaatagataattttagcttaggagttttagggatggcattatttttggaagagatgcttagaacacgggtaggcaccaaacatgccatattacttgtcgcagttagctttgttacactcataacaggaaatatgtcttttagggacctgggacgcgtgatggtaatggtaggagcaacaatgaccgacgatatagggatgggcgtcacctatttagcattgttagctgctttcaaagttagacccacctttgcagccggtttgctcctaaggaaattaacaagtaaagaattaatgatggcaacaatcggaatagcacttttatctcagagcacaattccagaaaccatattagagttaaccgacgcacttgcattaggcatgatggtgttgaagattgtcagaacaatggaaaaataccagctagcggtcacaataatggcgataagctgcgtacctaatgcagttattttgcaaaatgcatggaaagtatcatgtacgatcctagcggcggtctcagtaagtcccctactgttaacaagctcacaacaaaaggcagactggataccacttgcattgacaattaaaggtctgaaccccacagctatctttttgacaacgttatctcgtacatctaagaaacgaagttggccactcaatgaagccgtcatggctgtcggtatggtgagtatcctggcttccagcctcttaaagaacgatattccaatgacgggtccgttagtagcaggcggattgttgacggtgtgctacgtactgactggacgatcagcagatttagaattagaaagagctgcagatgtcaagtgggaagaccaggcagaaattagtggctcatccccaattctgagtataacaatatcagaagacgggagcatgtcgataaagaatgaagaggaagaacatacattaacaatacttatacgtactggcttgttggtgatttctggagtattcccagtaagtattccaattactgcagctgcctggtacctctgggaagtcaagaaacaacgtgcaggagttctatgggatgtaccttctccacctcccgtagggaaagccgaattggaagatggggcatataggataaaacaacgaggaatttttggatacagccagataggagcaggagtatataaagagggaacattccacacaatgtggcatgtgactagaggggcggttttaatgcaccggggtaaaagaatagaaccgtcatgggcagatgttaagaaagacttaatatcatacggaggaggttggaagctagaaggagaatggaaagaaggggaggaagttcaggtattggctttagaaccgggcaaaaatccgagagccgtccaaacaaaaccaggattatttaaaactaacacaggcacaataggagcagttagcttggatttcagccccggaacatctggctcgcctatcgtcgatcggaaaggaaaagtggtcggattatacggcaatggagtagtaacaagatcgggtgcttacgtttcggcaattgcacaaacagagaaaagcatagaagacaatccagaaatcgaggatgacatcttcagaaagaaaagattaactatcatggatctgcatccaggagcaggcaaaacaaagcgatacttaccggcaatcgtacgcgaagccatcaaacgcgggctacgaaccctaatacttgcgcctacccgtgtagtagctgcggaaatggaggaagcacttagaggattaccaattcgatatcaaacccctgcaattcgagcagaacatactgggagggaaatagttgacctcatgtgtcatgcaacatttactatgcggctactttcacctgttagagttcctaactacaatctgattataatggacgaggcccatttcactgatcctgcctctattgcggcaagaggatatataagtacacgggttgaaatgggtgaggctgccggcatattcatgaccgccaccccgccagggtctagagacccatttcctcaaagtaacgcacctataatggacgaagaaagagaaatcccagaacgttcgtggaacagcggacatgagtgggtgacggactttaagggaaaaaccgtatggttcgtgccttcaatcaaagcaggaaatgacatagcagcctgtttgaggaaaaatggcaaaaaggtaattcaactatctcgcaagacattcgatagtgagtatgtcaaaaccagggcgaacgactgggactttgtggttaccacggacatctctgaaatgggggcgaactttagagctgaacgtgtaattgatccacggaggtgcatgaaacccgtcatattaactgatggagaggaacgtgtaatacttgcaggacctatgcccgtaacacacagttcggcagctcaaaggcgaggtagaataggtcgcaatcccaaaaatgagaatgatcaatacatatatatgggtgagccactagagaacgacgaagactgtgcacactggaaagaggcgaaaatgctgctggacaacataaatacgcctgaaggaattatcccctcaatgtttgaaccggaaagagagaaagtagatgcgattgatggagaatatagactccgaggagaagcccgtaagacgttcgttgatctcatgcgaaggggcgaccttccagtctggctcgcgtacagagtagcagcagagggtataaactatgcagataggagatggtgctttgacggtattaaaaacaaccaaatcttagaggaaaatgtagaggtagagatctggacaaaagagggtgaaagaaagaaattaaaacctagatggttggacgcaagaatctatagtgacccactagcgctaaaagaatttaaagaatttgcagctggacgtaaaagtcttactctcaacctaatcacagaaatgggacgactacctacgttcatgacccaaaaagcccgagatgctctcgataacctagccgtcctacatactgcagaagttggcggacgagcatataaccatgccctgtccgaactgccggaaacactggaaacattattacttctcacacttcttgcaactgtgacgggcggcatctttttatttctaatgtcgggtaaaggaataggaaaaatgaccttgggcatgtgctgcataattaccgcctcaatattactgtggtatgcacaaatacaaccacattggatagccgcttcaataatcttggagttctttttaatcgtactactcataccagaaccagaaaaacaaagaacaccacaagacaatcaattgacgtatgtagtgatagcaatattaaccgttgttgctgcaacgatggcaaatgaaatgggctttttggagaaaaccaagaaagatctggggcttggctcaataactacgcaggaatcagaatctaacatattggatatcgaccttcggccggcaagtgcgtggacgttatacgcagtagccacaacattcgttacgccaatgctaagacacagtattgaaaattcctcagtaaatgtctcactaacggctatagctaaccaagccaccgtactcatgggcttaggtcgtggttggccattaagtaaaatggatataggagtgccattgctagcaattggatgttactcacaagtaaatcctataactttaaccgcagcactattattattagtagcgcactacgcgattataggacctggtttacaagcaaaagctacgagagaagctcaaaaacgaactgccgcaggaatcatgaaaaatcctaccgtagatggaattacagtcattgatctagaaccaataccttatgacccgaaattcgaaaaacagctagggcaagtgatgttgctcgtactttgtgtcacccaagttctcatgatgagaactacatgggccttatgtgaagcacttactctagcaactgggcctatcagcactctgtgggaaggcaatccaggaagattctggaacacaacaatcgccgtatccatggcaaatatttttcgaggaagttatttagctggagcaggactactattctctataatgaagaacactactaacactaggcggggcactggtaacattggggaaaccctgggtgaaaaatggaagtcgcgactaaacgcactaggtaaaagtgaatttcaaatatataaaaagagcggtattcaggaggtagatagaacattagcgaaggaaggcataaaaaggggtgaaacagatcaccatgcagtctcaaggggctctgctaaattaagatggttcgtggagcgaaacatggtgactccagagggaaaagtagtagacctaggatgtggcagaggtggctggtcttattattgcggcggactaaagaatgttcgagaggttaaaggactcacaaagggaggcccaggccatgaagaacctatacccatgtctacatacggttggaatttggtaagactgcaaagcggcgtagacgtgttctttacaccaccagaaaaatgcgacactttattatgtgacataggagaatcatctccaaatccaactatagaagccgggagaacattaagagtgttaaacttagtagaaaattggctaaacaacaacacccaattttgtgtaaaggttttaaatccttatatgcctagtgtaatagaaaagatggaaactttacagcggaaatacggtggggccctagtgagaaacccgctctcacgaaatagtacacacgagatgtactgggtctcaaacgcgaccggtaatatagtatctagcgtaaacatgattagtcgaatgttaataaatagatttacaatgaaacataagaaagcgacgtatgagccagatgtggatctaggatctggcacaagaaatataggcatcgagaacgagataccgaatcttgacatcatagggaagcgtattgagaaaattaaacaagaacatgaaacatcatggcactacgatcaagatcacccatataagacgtgggcgtatcacggatcttatgaaaccaaacaaactggaagtgcatcctcaatggtgaatggagtagtgaaattactgaccaaaccttgggatgtagtgccgatggtaacacaaatggctatgacagacactactccgttcggacaacaacgggtatttaaagaaaaagtagacacacgaacccaagagccaaaagaaggtaccaagaaattaatgagaataacagctgagtggttatggaaagaactcggtaaaaagaaaacaccacgaatgtgtacaagagaggaatttaccagaaaagtaagatcaaatgcagcactgggagccatttttacagatgagaataaatggaaaagtgctagagaggccgtggaagattcacgattctgggagctagttgatcgtgaacgcaatctccacttggaaggaaaatgcgagacttgtgtgtacaacatgatgggaaaacgtgagaagaaattaggggagtttgggaaggctaagggttccagagctatatggtacatgtggttgggagcacggttcctagaatttgaggctttaggcttcctaaatgaagaccactggttcagtcgtgggaacagtttatcaggagttgaaggggagggattacataaactcggatatatattacgggatgtctcaaagaaagaaggtggtgctatgtatgcggatgatacagctggatgggatacacgcataacactggaagatctgaaaaacgaagaaatggtaacgaatcatatgaaaggagaacataagaaacttgccgaagcaatattcaaattgacataccaaaacaaagtagtacgagtgcaaaggcctacgccaagaggtactgtaatggatattattagcagaaaagaccaaagaggtagcggtcaggtcgtaacttatggtctcaatacctttaccaatatggaagctcaattgatacgtcagatggaaggcgaaggaatattcaagtccatccaaagattaacagtaacagaagagatagcggtccagaattggctcgccagagtcggacgcgaaaggttaagccgtatggctataagtggagatgactgtgtcgtaaagccactagatgacaggttcgcgagcgctctcactgcattaaacgatatggggaaagtgagaaaagacatacagcaatgggaacctagtcgaggatggaatgactggactcaagtacccttttgctcgcatcattttcatgaattggttatgaaagatggtcgggtactcgtagtaccctgtcgtaatcaagatgaattaataggccgagcacgtatatctcagggagcaggatggagcctgaaagaaacagcctgtctaggtaagtcttatgcgcagatgtggactttaatgtactttcacagaagagatttaaggctagccgctaatgcgatatgtagtgcggttccctcccactgggttcctacaagtagaacaacctggagcatccatgctaaacacgaatggatgacaacagaagatatgttagctgtttggaacagagtgtggatacaagagaacccctggatggaagacaaaactccggttgagagttgggaagaagtgccttatttaggaaaaagagaagaccagtggtgtgggtcgttaatcggactaacatcaagagctacttgggcaaagaatatacaaaccgctataaatcaagtgcgatcccttattggaaatgaagaatacactgattatatgcccagtatgaaaaggttccgcaaagaagaggaagaggccggtgtgttgtggtga

SEQ ID NO: 22607 - RNA, 9876 nt, synthetic construct
  misc_feature 1..9876: note = derived and/or modified CDS sequence (opt6) from DENV-2__EU687242__SS-prME
  source 1..9876: mol_type = other RNA
actgcaggggtgataatcatgctaattccaactgctatggctttccatcttacaacaagaaatggggaaccacatatgattgtagggcggcaagaaaaaggtaaatctcttttatttaaaactgaagatggtgtaaatatgtgtaccctgatggctatagatcttggtgaactatgtgaagataccataacatacaaatgtcctctcctaagacaaaatgaaccagaagacattgattgttggtgtaactcaacatcaacttgggtgacctacggaacttgcacaacaactggtgaacacagaagagaaaaacggtctgtcgctttggttccccatgtcggaatgggcctagaaactcggaccgaaacatggatgagttcggaaggtgcatggaaacacgtgcaaagaatcgaaacatggatacttcggcatcctggtttcacaataatggcagctatcctagcatacactataggaactacacactttcaaagagcactcatatttatattgttaacagcagtagcaccctcaatgactatgagatgtatcggcattagcaaccgtgactttgttgaaggtgtatcgggtggatcttgggtggacatcgtactagaacatgggtcatgtgttactacaatggcgaaaaataaacctactctagattttgaacttatcaaaaccgaagcaaaacaaccagcaacgttacgtaaatattgcatagaagcaaaattaacaaataccacgactgagtcgagatgtccgacacaaggagaaccatcgctaaatgaagaacaagataaacgctttatatgtaaacattcgatggttgaccgcggatggggaaatgggtgcggccttttcggtaaaggcggaatcgtgacatgtgccatgttcacgtgtaagaaaaacatggaaggcaaagtagtcttgcctgagaatcttgaatacacaattgtcatcacgccacattctggagaagaacatgcagtaggaaatgatacgggtaaacacggcaaagaaataaaaataacaccacaaagtagcattaccgaagcggaactaacaggatacggaacagtaacgatggaatgcagccctagaacaggattagatttcaacgagatggttctactgcaaatggaagacaaagcgtggctcgtgcataggcaatggtttctagacttgccactaccgtggctaccaggtgccgacacacaaggaagtaactggatccagaaagaaacattagtaacattcaaaaaccctcatgccaagaaacaagacgtagtggtattaggatctcaggaaggcgccatgcatacagcgttaacaggagcaaccgagatacaaatgtcatctggaaatctcttattcacaggccatctaaaatgccgcctaagaatggacaaattacaactaaaaggaatgtcatatagtatgtgtactggaaaattcaaaatcgttaaagaaatagcagaaacccaacatgggactatagttatcagggtgcaatatgagggggatggttcaccttgcaaaattccatttgagataatggacttagagaaaagacacgtcttaggcagactaatcacagtgaatcctattgttacggagaaagacagtcccgtaaatatagaagcagaacccccattcggcgactcatacattatcattggagtagaacctggacaactcaaactgaactggttcaaaaagggaagtagcatcggacaaatgtttgaaacaactatgagaggagctaaacgcatggctatattgggagacaccgcttgggacttcggttcattaggcggtgtgttcaccagcataggaaaagcattacaccaagtgtttggcgctatatatggcgcagcttttagtggcgtcagttggacgatgaaaatcttgattggcgtaataataacctggataggaatgaactctcgatcaacgtccttaagtgtaagcctagttttagtaggtgttgtcacgttgtacctaggagtaatggtacaagcagatacaggatgtgtagtctcatggaaaaataaagaattaaagtgtggaagcggaatcttcataacagacaatgttcacacgtggactgaacaatacaaattccagcccgaatctccgtcaaagttagcatccgctatccaaaaggcacatgaagaaggcatttgcggaatcagatctgtcacaaggttagaaaatcttatgtggaaacagattactccagaattaaatcatatactgagtgaaaacgaggttaaattaactattatgacgggagatataagaggaatcatgcaggcgggaaagagaagcctccgacctcaacctaccgaacttaagtattcatggaagacttggggcaaagccaaaatgttaagcacagaatcccacaatcagacatttcttatcgacggtccagagactgcagaatgtccaaatactaatagagcctggaactcactcgaagttgaagactatggttttggagtattttccacaaacatttggctaaaattacgagaaaagcaagacgtattctgcgattctaaattgatgtcagcagctatcaaagacaaccgggcagtccatgcagatatgggatattggattgaaagtgcactgaatgatacctggaagatggaaaaagcatcatttatcgaaataaaatcttgctactggccgaagagtcatactttatggtcaaatggagttctagaaagcgaaatgattatccccaaaaattttgcagggccagtaagtcagcataattacagacctggttaccatactcaaactgcgggtccatggcacttgggcaaattagaaatggattttgacttttgtgaaggaacaactgttgttgtaacagaagactgcggtaacagaggaccaagtctgagaacaactaccgccagtggaaaactaatcacagagtggtgttgtcgatcatgcactttacctccgttacgatatagaggtgaagatggatgctggtacggaatggaaattcgtccgttaaaagaaaaagaagagaatctcgtaaattcattagtgactgctggtcatggccaaattgataacttttcgttgggtgtcctaggaatggctctatttttggaagaaatgctacgaacgcgtgtcggtacaaaacatgctattctgttagtagccgtttcctttgtgacccttattacaggaaatatgagttttcgtgatctcggcagagtcatggttatggtgggtgcaacaatgactgatgatatcggtatgggcgtaacataccttgcacttttagctgcttttaaagtaagaccgaccttcgcagcaggacttctcctcaggaaattaacttctaaagaactcatgatggcgacgatcggcatagctttactaagccagtccactatacccgaaacaatcctagaattaacagatgcgttggctctcggaatgatggtattaaaaatcgtcagaaacatggaaaaataccaactggccgtaacaattatggcgataagttgtgtgccgaatgcagtaatactgcaaaacgcatggaaggtttcgtgtacaattttagctgccgtatccgtatctccacttctattaacaagtagccaacaaaaagccgattggatcccgctagccctaacaataaaaggactaaatcctactgcgatatttttaacaactttgtcccgcacgtctaagaaaagatcatggccgcttaacgaggcggttatggctgtgggcatggtctcaattttggcatcctccttgttgaaaaatgacattcctatgactggacccctagttgctggaggactgcttacagtatgctatgtactcacgggacgttcagcagatctagaacttgaacgtgctgcagatgtaaagtgggaagatcaggcagaaataagcggaagttcgccaattctcagtattactatttccgaagatggatcaatgagtatcaaaaatgaagaagaagaacatactttgacgattctcattcgcactggtctattagttataagtggagtttttcctgtttcaataccaattaccgccgctgcttggtacttatgggaagtaaagaaacaaagagcgggagtattatgggacgttccctccccgccaccagttgggaaagctgaactcgaagatggtgcgtatagaataaaacaaagaggtatattcggatatagccagataggtgcaggagtatacaaagaaggaacgtttcatacaatgtggcatgtgacaagaggcgcagtcctgatgcatcgcgggaaaagaattgaaccgagttgggccgatgtcaagaaagatctaatttcgtatggtggcggatggaaactagaaggtgaatggaaagagggagaagaagttcaagttcttgcgctggaaccaggtaaaaatcccagagcggtccagaccaagcctggactatttaaaaccaatacaggaacaatcggagcagtttcattagatttttcacctgggacatctgggtcaccaattgtagatagaaaaggtaaagtggtaggtttgtatgggaatggagtcgtaacgcggagcggtgcatatgttagtgcaatagcacaaacagaaaaatctatcgaagataaccctgaaatcgaagatgatatcttcaggaagaaacgattaactataatggatttacaccctggagctggaaagacgaagagatacctacctgcaatagtacgagaggcaattaagcgagggctgagaacccttatcctcgccccaacacgtgtcgtagcagcagagatggaagaagcgctcagaggacttccgattagatatcaaacgccagcaattagagcagaacacaccgggagggaaattgttgatctaatgtgccatgctacgttcacaatgagattactaagcccagtacgggtacctaactacaatttaataataatggacgaagcacactttacggatccggcatcaatagcagccagaggttatatctcgactagagttgaaatgggtgaagcagcaggtatattcatgacggctacgccacctggatctcgagacccattccctcagtccaacgccccaataatggatgaagaaagagagatacctgaacgcagttggaactctggacacgaatgggttacagatttcaaaggaaaaacggtgtggttcgttcctagcattaaagccggaaatgatatagctgcatgcttaagaaagaatggtaaaaaggtcatacaactctcaagaaagacgtttgattcggaatatgtaaaaactcgagcaaacgactgggattttgtcgtgactaccgacatatcagaaatgggcgcgaatttccgtgcagagcgcgtaatagacccccgtcgatgtatgaaacctgtcatattaactgacggtgaggaacgagttatactagctggcccaatgccggtgacgcacagctccgctgcacaaagaagaggccgtattggcagaaatcccaaaaatgaaaatgatcaatacatctatatgggagaacctctggagaatgacgaagattgtgctcactggaaggaggcaaaaatgttacttgataacatcaacacaccagagggcattattcccagcatgtttgaacccgaacgagaaaaagttgatgcaatagatggtgaataccgactacgaggtgaagcacggaaaacttttgttgatttaatgaggagaggtgatttaccggtctggttggcctatcgagtagccgcagagggtataaattacgcagatagaagatggtgtttcgatggtatcaaaaataaccaaatactggaagaaaacgtcgaagttgaaatctggactaaagaaggcgaaaggaagaaacttaaacctagatggttagatgctagaatatatagtgatcctcttgctttaaaagaatttaaagaatttgccgcagggagaaaaagtttaaccttgaatctcatcacagaaatgggcaggctaccaacgtttatgactcaaaaggcacgagatgccctcgataacttagctgttctccatactgccgaagtgggtggacgagcttataatcatgcactaaatgaactcccagagactcttgaaactttattattattaacacttctcgcaaccgtcactggaggaatattcctgttcttgatgtcaggtaaaggtataggaaagatgactcttggcatgtgttgtataataacagcttcaattttgctctggtatgcacagatccaaccacactggatagcagcgagtataattctggaatttttcttgatagttctactaataccagaacctgaaaagcagagaacacctcaagataatcagttaacttatgtagttatagctatcctcacagtagtagccgccacgatggcaaatgaaatgggatttttggaaaagactaagaaagatttaggattaggatcaatcacaacgcaagaaagtgagagtaatattttagatatagatctgcgacctgcatccgcctggacattatatgcagtggcgactactttcgtaacaccaatgttacgacattctatcgaaaactctagtgttaatgtatcacttactgcaattgccaaccaagctactgtgttaatgggtctgggaagaggatggcccttatccaaaatggatataggagttccactgttagcaattggatgttacagtcaagtaaatcctataacgttaacagcagcacttttactcttggttgcccattatgcgattataggtcccggtttgcaggctaaagccacacgtgaggctcagaaaagaacagctgcaggaattatgaagaatcctaccgtggacggtattactgtcattgacctagaaccaattccctatgaccctaagtttgaaaaacagctcggtcaagtcatgttacttgtactgtgtgtaacccaagtgctaatgatgcgtacaacatgggctttatgcgaagcactaacactcgcgacgggaccaataagtaccctttgggaaggtaatccaggacgattttggaataccaccatagcagtatcaatggccaatatttttcgcggttcttatctagcaggggctggtctgttattctccattatgaaaaacacaactaatacacgtcgtggcacaggtaatatcggggaaactttgggtgagaaatggaaatcaagactcaatgcacttgggaagagtgagttccagatctataaaaagagtggcatccaagaagtggatcgtaccctcgcaaaggaagggattaaacgtggggagacggatcaccatgctgtgagtcgaggatctgctaagctgcggtggtttgtagaacggaatatggtcacgcccgaaggaaaagtagtagacttggggtgcggccgcggaggttggtcatattactgcgggggtctcaaaaatgtaagagaagtcaaaggtttgactaaagggggtccaggccacgaggagccaatacctatgtcaacatatgggtggaatttagttcgcctacagtcgggtgtcgatgtcttctttactccaccagagaagtgcgatactttgctctgtgacattggggagagtagccccaacccaacaatcgaagcaggaagaacgttaagagttttgaacctggtagagaattggttaaacaataacacacaattttgtgtaaaagtcctcaatccatatatgccgtctgtaatcgagaaaatggaaacgttacaaagaaaatacggaggagccctagtaagaaatccactatctagaaattcgactcatgagatgtattgggtatcgaacgcaacaggcaatattgtatctagcgttaacatgatatcaaggatgcttataaatcgattcacgatgaaacacaaaaaggctacatacgagcccgacgtagacctcggatcaggaaccagaaacatcggaatcgaaaatgaaattcccaatttggacatcatcgggaaaagaatcgagaaaataaaacaagaacatgaaacatcatggcactatgatcaagatcacccatacaaaacgtgggcgtatcacggatcgtacgaaaccaagcaaacgggctcagctagcagtatggttaatggtgtagttaaactcttaaccaaaccatgggatgtggttccaatggttacccaaatggcgatgacggacacaacgcccttcggacaacagagagttttcaaagaaaaagtagacactaggacgcaagaaccaaaagaggggactaagaaattaatgcgaataactgctgaatggctttggaaagaattggggaagaagaaaacgccaagaatgtgtacacgtgaagagttcacacgaaaagtcaggagtaatgcggcattaggagcaatatttactgatgagaataaatggaagtcggcaagggaagcagtagaggacagtaggttttgggagctagtggacagagagagaaacctacatttagagggcaaatgcgagacatgcgtctacaacatgatgggtaaaagagagaagaaacttggagaatttggtaaagccaaaggttctagagccatttggtatatgtggcttggagctcgctttctcgagtttgaggctttaggatttttaaacgaagaccattggttttctagaggaaattctctaagtggagtcgaaggtgaaggccttcataaattaggatatatactaagagatgttagcaagaaagaaggtggtgctatgtacgcagatgatacagcgggatgggacactagaattacgttagaggatctcaaaaacgaggagatggtcaccaaccatatgaaaggagaacataaaaagttagcggaagcgatctttaaattaacgtatcaaaacaaggtcgtgagggtacagaggcccacccccagaggaacagtaatggatatcatctcgcggaaagaccagaggggcagcggacaggttggtacttacggattaaacactttcactaatatggaagcgcaactaatccgccaaatggaaggtgaaggcatctttaaatccatacaacgtttgacagtaactgaagaaattgcagtacagaactggttagccagggtagggagggaacgtctaagcagaatggccataagtggtgacgactgtgtagtaaaaccactggacgacagattcgcaagcgccctgacagcactaaatgatatgggaaaagttaggaaggatattcaacagtgggaaccaagccgcgggtggaatgactggacccaagtccccttctgctcacaccacttccacgaattagtaatgaaggatggtagggtacttgttgtcccatgtcgaaaccaggatgaattgattggtagggctcgtataagccaaggcgccgggtggtctcttaaagaaacggcgtgcttgggcaagtcttacgctcaaatgtggacgttaatgtatttccaccggcgcgatctaagactcgctgcaaatgctatttgctcggcagtaccaagtcactgggtgccaacttcgcggacaacgtggtcaattcacgcaaaacatgaatggatgaccacagaagatatgttggcagtatggaatcgagtatggattcaggaaaacccctggatggaagacaaaacaccggttgaaagctgggaagaggtaccgtacttgggtaaaagagaagaccaatggtgcggatcgcttataggattaacctctagagcgacctgggccaaaaatatacaaactgcgattaatcaagtcaggagcctgataggcaacgaggaatacactgattatatgccttccatgaaaagatttagaaaggaagaagaagaagcgggtgtattatggtga

SEQ ID NO: 22608 - RNA, 9876 nt, synthetic construct
  misc_feature 1..9876: note = derived and/or modified CDS sequence (opt6) from DENV-2__EU687243__SS-prME
  source 1..9876: mol_type = other RNA
actgcaggagtaataataatgttaataccaacggcgatggcatttcacttgacaaccagaaacggtgaaccgcacatgatagtcggtagacaggaaaaaggtaaatccttgctatttaaaactgaagatggagtaaacatgtgtactctaatggcaatagatttaggagaattgtgtgaagacaccataacttacaaatgccctctgctacgacaaaacgaaccagaagatattgattgttggtgtaattcaacaagtacatgggtgacatatggtacttgcacgactaccggtgaacaccgaagagaaaaacgcagcgtcgctcttgtgcctcatgtaggtatgggacttgaaacccgaacagaaacatggatgagttctgaaggcgcgtggaaacacgttcagcgtatagagacatggatactgagacatcctggatttactataatggcggcaatattggcttacactataggcaccacacattttcaaagagctctgattttcatattattgacggcagttgctccatctatgacaatgagatgtattggtatatcgaaccgagattttgtagaaggcgtctctggaggctcttgggtagatatcgtactggaacatggttcctgcgtcactaccatggcgaaaaacaaacccacattagacttcgagctaatcaaaaccgaggcaaaacagccggcaactctacggaaatactgtatagaggcgaaactgactaacacaacaactgagtccagatgtccaacccaaggtgaaccttcccttaatgaagaacaagataaaagatttatatgtaaacactcaatggtagatcgcggttggggtaatggttgtggtctctttggaaaaggaggaatagtcacatgtgcaatgttcacctgtaagaaaaacatggaaggaaaagtagttctccccgagaatttagaatacaccatagtaataactcctcacagtggagaagaacacgctgttggtaatgatacgggtaaacatggcaaagagataaaaattacaccgcaatcctccataacagaggcggaactcacaggctacggaacagtaacaatggaatgtagtcctcgaaccggcctagatttcaatgaaatggtcttgctgcagatggaagataaagcatggctagtacacagacaatggtttttagacttaccactaccttggcttcctggtgccgatacgcaaggatcaaattggatacaaaaagaaacattagtaacatttaaaaatccacacgctaagaaacaagatgtagtggtactgggcagtcaagagggggctatgcacactgctttaacaggagccacagagatacagatgagttcaggtaacttattatttactggacacttaaaatgccgccttaggatggataaactacaactaaaaggtatgtcatactcgatgtgcacagggaaattcaaaatagtgaaagaaattgctgaaacacagcatggtacgatagtaatccgggtacaatatgaaggggatggttctccatgcaaaataccatttgagattatggatttagagaaaagacatgtgttaggaagactaatcacagtcaaccccatagtgactgaaaaagactcgcctgtaaatatagaggcagaacccccattcggggacagctacattataataggagtggaaccggggcagctgaaattaaattggttcaagaaaggaagtagtataggtcaaatgtttgaaactacaatgaggggtgcgaaacggatggcaatcctcggtgacacagcttgggactttgggtcgttaggtggagtatttacttccatcggaaaggcactacaccaagtatttggagcgatatatggagctgcatttagcggagtatcttggactatgaaaattcttataggtgtgattataacatggataggaatgaatagtcgatcaacctcactatccgtatctcttgtattagtaggtgtcgttactctctatttgggtgtcatggtacaggcagatacaggttgcgttgtcagttggaagaataaggaattaaaatgtggaagtggtatattcataaccgacaacgttcacacatggaccgagcaatacaaattccaacccgaatcaccgtcaaaattagcttccgctatacaaaaagcacacgaggaaggcatttgtggaattagatcagtcacgagattagaaaacttgatgtggaaacagataacacctgagttaaatcatatactctcagaaaatgaggttaagttaacaattatgacaggcgacataagaggaataatgcaagctggaaaaaggtcgctacgtccccaacctaccgaattgaagtattcatggaaaacatggggtaaagcgaagatgttatctactgagtcacacaatcagacatttctaatcgatggtccagaaactgccgagtgccctaataccaaccgagcctggaatagtcttgaagttgaagactatggatttggtgtattttcaactaatatatggttaaaattaagagagaaacaagacgtattttgtgactctaaattaatgagcgcagctataaaagataaccgggctgtacatgcagatatgggctactggatcgaatctgccctaaatgatacttggaagatggaaaaagcgtcattcattgaaattaagagttgtcattggccgaaatcacacaccctatggtcaaatggtgttctagaaagtgaaatgattataccaaagaactttgccgggccggttagtcaacacaattataggccaggttaccacacgcaaactgcaggaccatggcatttaggtaaattggaaatggattttgacttttgcgaaggaacaaccgtagtagttacagaggattgtgggaatcgaggcccaagcctcaggacaacaacagcaagcggaaaattaatcacagaatggtgttgcagaagttgtacattacccccacttcgatacagaggagaggacggttgctggtatgggatggaaatcagacctttaaaagaaaaagaggaaaatctagtaaacagtttagtcacagcgggacacggtcaaatcgacaatttttcccttggagttttagggatggccttatttttggaagagatgctgagaacacgtgtagggaccaaacatgcgatattgttggtggcagtgtcatttgtaacactcattacagggaatatgtcatttagggatctaggaagagtcatggtgatggtgggagcaactatgactgatgacattggtatgggagtcacataccttgcgctcttagcggcttttaaggtcaggccaacctttgcagcaggcttgttactgcgaaaacttacctcaaaggaattaatgatggcaacaataggtatcgcacttttaagtcaatccacaataccagaaactatacttgaactaacagatgcattagcactcggaatgatggttttaaaaatagttagaaacatggaaaaatatcagctagctgtaactataatggctataagctgtgtccccaacgcagtgatcttacagaatgcatggaaagtcagttgtacgattctagctgccgtaagcgtttctccccttctactaacatcttctcaacaaaaagctgattggatcccactagcgctaaccataaaaggattgaatcctactgctattttcctcactacattatctagaactagcaagaaacgttcatggccgcttaatgaggcagtaatggcggtaggaatggtgagcattctggcctcttcactgcttaaaaatgacattccgatgactggaccgctcgtagcaggaggtttattaacagtatgttacgtgctaacaggtagatcagcggacctagaattagagagagcagcagatgttaagtgggaagaccaggcagaaatatccggaagctcaccaatattgagcatcacaatatcagaagacgggagtatgtcaatcaaaaatgaagaggaggagcatacgttaacaattttaatccgtaccggtttactggttatttccggagtattccccgtttccataccaataacagcggcagcatggtatttgtgggaggtcaagaaacaacgagctggagtgctatgggatgtgccaagtcctccacctgtaggaaaagccgaattggaagatggggcatatagaataaagcagagaggtatctttggatatagtcagattggcgccggtgtgtataaagaaggaacatttcatacaatgtggcacgtaacaagaggtgcagtattaatgcaccgtggtaagcgaattgagccgtcttgggctgatgtcaagaaagatttaatcagttatggtggaggatggaaattagaaggcgagtggaaagaaggagaagaagtacaagtcctggcactggaaccgggcaaaaacccaagggctgttcaaactaaaccaggattatttaaaacgaatacgggcacaataggggctgtttccttagacttcagtccagggacgtcgggatcaccaattgtagaccgaaaaggcaaagtagtaggcctgtacggaaacggtgtagttacacgaagcggagcatatgtcagtgccatcgcacagacggaaaaatcaatagaagataaccccgaaatagaagatgatatttttaggaagaaacgtctaactataatggacttacatccaggagcaggtaaaacgaaacgatatctcccagcaatagtgcgtgaagctataaaaagagggttacgaacactcattttagcgcccactcgcgtggtcgcggccgaaatggaagaggcactcagaggactaccgatacgataccagactcctgcaattagagcggagcatacagggcgcgaaatcgtagacctaatgtgccatgctacatttacaatgcgactactcagtcctgtacgcgtacccaattacaaccttatcatcatggatgaagcacacttcacggatcccgcaagcatagctgctaggggttatatatcaacaagagtagagatgggagaagctgccggtatctttatgacagctacacctccaggctcacgagatccttttccccaaagtaatgcgccaatcatggatgaagaaagggaaatacctgaaagatcgtggaactcaggtcacgaatgggtcactgatttcaaagggaaaacagtatggtttgtacccagtatcaaggcgggaaatgacatagcagcttgcctaaggaaaaatggtaaaaaggtaatacagctcagccgtaagacctttgattcagagtacgtgaaaacaagagctaatgattgggatttcgtagtaacgacagacatttccgaaatgggagctaatttcagagctgaaagagttatagatccaaggcggtgcatgaagccagttatacttaccgacggagaggaaagagtgatcctcgcaggccccatgccagtcacacattcaagtgcagcgcaaaggcgtggtcggataggacgaaatcctaaaaatgaaaatgaccaatatatttacatgggagaacctctagaaaacgatgaagattgtgcccactggaaagaagcaaaaatgttattggacaatataaatacccccgagggcataataccaagtatgttcgaaccagaaagagaaaaagttgatgctatcgatggtgaatatagactaagaggcgaagcgcgtaaaacatttgttgatttaatgagacgaggagatttaccagtatggttagcgtaccgggtcgcagcagaggggattaattatgcagatagacgttggtgtttcgacgggatcaaaaataatcaaatacttgaagaaaatgtagaagtggaaatttggactaaagagggagaacgaaagaaactaaaaccaagatggttagacgctagaatttacagtgatccactagccttaaaagaatttaaagagttcgccgccggccgaaaatcattaacacttaacttaataaccgagatgggtaggctaccgacttttatgacgcagaaagctagggacgcacttgataatttagcagtacttcatacagcagaagtcggaggcagagcatataatcatgctcttaatgagttgcctgaaacactggaaacgctactcttattaactcttcttgctacggtgactggcggtatattcttattcctaatgtcaggaaagggaataggaaagatgactcttggaatgtgttgcataatcacggcatcgattttactctggtatgcacaaatccaaccacattggatagctgcgtcgattatacttgaatttttcctaatagttctactgataccagagccagagaaacaacgaaccccacaagataatcaattgacatatgtggtcatagcaattttaaccgttgtcgcagcaacaatggcaaatgaaatggggtttctagagaaaactaagaaagatctaggcttaggtagcataacaacacaagaaagtgaaagcaacatacttgacatagatttacgacctgcctctgcatggacattatacgccgtggcgactaccttcgtcacgccaatgttaagacatagcatagaaaacagttcagtgaacgtaagtctaaccgcaattgcaaatcaagcgacggtcttaatgggccttggaagaggatggcccctaagcaaaatggacataggagtaccgctactagcaataggttgttattcacaggtaaatcccattacattaacagctgcattactcttacttgtggctcattacgcaataataggtccagggttgcaggccaaagctactcgtgaagcccaaaaacgcacagcagcgggtattatgaaaaaccccacagtagatgggataaccgtaatcgacttagaaccgattccatatgacccaaaatttgaaaaacaactcggtcaggtgatgctcttagttctgtgtgttacacaggttctcatgatgagaacaacgtgggccctatgcgaagcattaacactagcaaccggacccatatcaactctctgggaaggtaaccctggtcgattttggaatactaccatagctgtcagtatggctaacattttcagaggttcgtatttagccggtgcaggactattattttcaattatgaaaaatacaactaacacgagaagaggcaccggaaacataggagaaacacttggcgagaaatggaagtctaggcttaatgcactcggaaaatctgagttccaaatatacaagaaatccggaatacaagaagtagacagaactctggcaaaagaagggataaaacggggagaaaccgaccatcatgcggtctcgaggggcagtgccaaattacgctggttcgttgaacgcaatatggttaccccagaaggaaaagtagtggatttaggatgcggacgaggcggatggtcatactactgcggtggtcttaaaaacgtaagggaagtcaaaggcttaacgaaagggggacccggacatgaggaaccaatacccatgagtacctacgggtggaatctagtgcgtttacaaagcggggttgacgtctttttcacaccacctgaaaaatgcgataccctgttatgtgacataggagagtcttctcctaacccaacaatagaagctggtcggaccttacgcgtattaaacctcgttgagaattggctaaataataacacccaattctgtgtaaaagttcttaatccgtatatgcctagtgtgatagagaaaatggagacactacaacgaaagtatggaggagctttagtcaggaatccgttaagtcgtaattccacccatgagatgtactgggtatcaaacgcgactggcaacatcgtctctagtgtgaacatgatttctagaatgttgataaatcgctttacgatgaaacacaaaaaggcaacttatgaaccagatgtagatttaggatccggtacgcgtaatataggtatcgaaaacgagattccgaatctggatattatcggaaaaagaattgaaaagatcaagcaagaacacgaaacatcttggcattacgatcaagatcacccctataaaacatgggcttatcatggtagttatgagacaaaacaaacgggatcagcatcgagtatggtaaacggagtggttaaattactcacaaagccctgggacgtagttcctatggtgacacagatggctatgactgacaccacaccgtttggtcaacaacgagtgtttaaagagaaagtagatacccgtactcaagaaccaaaagaaggtaccaagaaactgatgagaataacagctgaatggttatggaaggaactggggaagaagaaaactccaagaatgtgtacccgggaggagtttacccgcaaagttagatccaacgctgctcttggggctattttcacagatgagaataaatggaaaagcgcgcgagaagctgtggaggactcacgattttgggagcttgttgacagagaaaggaatttacatctagaaggtaagtgcgaaacatgtgtatataatatgatgggaaaaagagagaagaaattaggtgaatttgggaaagcgaaagggtcacgtgcaatttggtacatgtggttaggtgcacgctttcttgaatttgaagcgctaggattcttaaacgaggaccattggttttcccggggaaacagcctaagtggcgtagaaggagagggtctgcacaaattaggatacatcctacgggacgttagtaagaaagaaggaggagcaatgtatgccgatgatactgctggctgggacactagaattacactagaagatctcaaaaacgaagagatggtgacaaatcacatgaagggcgaacataagaaactagcggaagccatttttaaacttacctaccagaacaaagtggttagagtacagcgaccaacacccagaggcacagtaatggacataatatctcgaaaagaccaacgtgggtctggccaagtgggcacctatggattaaataccttcacgaacatggaagctcaactcatacgtcaaatggaaggcgaaggtatattcaaatctatacaaagactcacagttactgaagaaattgccgtgcagaattggcttgcacgggtcggacgagagcgcctatctaggatggctatatcaggtgatgattgcgtcgtaaagccactagatgatagatttgcttccgctcttacagcactcaatgatatggggaaggtaagaaaagatatacaacagtgggaaccttctaggggatggaatgattggactcaagttcctttctgtagtcatcacttccatgaacttgttatgaaagatgggagagtacttgtagtcccatgtaggaatcaagatgaattaattggtagagcaagaatcagccaaggagctgggtggtctctaaaagaaactgcttgtctcggcaagtcatacgctcaaatgtggactctaatgtactttcatcgcagagaccttagattagcagcaaatgcgatatgtagtgcagtcccaagtcattgggttcctacgtcaagaacaacatggtcaattcatgcaaaacatgagtggatgacaacagaagatatgctagcagtgtggaaccgcgtctggatccaagagaatccgtggatggaagataagacgccagttgaaagttgggaagaggttccttacttgggaaagagagaagaccaatggtgtggttcactaattggattaacgtcccgggcaacatgggctaagaacatacaaacagcgataaatcaggttcgatcgttaatcggaaacgaggaatatacagattatatgccgagcatgaagcgatttagaaaagaagaagaagaagcaggggtcctatggtaa

SEQ ID NO: 22609 - RNA, 9876 nt, synthetic construct
  misc_feature 1..9876: note = derived and/or modified CDS sequence (opt6) from DENV-2__EU687245__SS-prME
  source 1..9876: mol_type = other RNA
actgcaggagtgataattatgcttattccaacagcgatggccttccacttaactacaagaaacggtgaaccacatatgattgttggtagacaagaaaaaggaaaaagtctactatttaaaaccgaagatggcgttaatatgtgcacccttatggcgatagatctaggggaattgtgtgaagacactataacctataaatgcccactactccggcaaaacgaaccagaggatatagattgctggtgcaactcaacatcgacttgggtgacgtatggcacatgtacaacaactggtgaacaccgcagagagaaaagatcagtagcacttgttcctcatgtcggtatgggactagaaacacgtaccgaaacgtggatgtcatcagaaggtgcctggaaacatgtacaaagaatagaaacatggattcttcgtcatcctggctttactattatggctgctatattagcttacactataggcacgacgcacttccaaagggcgttaatattcatattgctcaccgcagtcgcaccctcaatgacaatgcgatgcataggcatatcaaatagagatttcgtggaaggtgttagcggtggttcgtgggtggatatagtgttagagcacggcagctgcgtcacaacgatggctaaaaataaacccacactcgactttgaattaattaaaactgaagcaaaacagccggcaactctaagaaaatattgcatagaagctaaactaacaaatacaacaacagagtcacgctgcccaacacaaggagaacctagcttgaacgaagaacaagataaacgttttatctgtaaacactcaatggtcgatagaggatgggggaatggatgcggactattcgggaaaggaggaattgtcacttgtgcaatgttcacatgcaagaaaaatatggaaggtaaagttgtcctccccgagaacctcgaatatacgatcgtcataacaccacactcgggagaggaacatgcggtcggcaatgacacaggtaaacatggtaaagaaataaaaattacgccacaatcttcaataactgaagctgaattaactggttatgggacagtaacaatggaatgttcacccaggaccggattagattttaacgaaatggtattattacaaatggaggataaagcatggttagtccatagacagtggtttttagaccttccactaccgtggttacccggagctgatacgcagggatcaaactggatacaaaaagaaacactcgtaacattcaaaaatccccatgctaagaaacaagatgtagttgttctcggttcacaggaaggtgcgatgcacacagcactcacaggagctaccgaaatacaaatgagtagcggaaatttattgttcacaggtcatttaaaatgtagactccgaatggacaaattacaacttaaagggatgagctattcgatgtgcactggcaaatttaaaatagttaaagaaatagcagagacacaacatggaacaatagtaattcgcgtacaatacgaaggtgacggatctccatgcaaaataccgttcgaaatcatggacttagagaaaagacacgtattaggtcgattgatcactgtcaacccaatagtaactgaaaaagacagccctgtcaacatagaagccgaaccaccctttggggacagttatatcattataggagtcgaacccggccaactaaaactaaattggttcaagaaaggtagtagtattggacaaatgtttgaaacaacaatgcgaggcgctaagaggatggccatactaggagatacagcatgggactttgggtccctaggtggtgttttcacatcaatcgggaaagcattgcatcaagtcttcggagcgatatacggagcagcatttagcggcgtgagttggactatgaaaatattaataggagttataataacgtggatagggatgaatagtaggtcaacttcattatcggtttcattagttttagtaggtgttgtaacactgtacttaggggtaatggtacaagcggacacaggatgtgtggtatcttggaaaaataaagaactgaaatgcggaagtggcatattcataacagataacgtacacacatggacagaacagtataaattccaaccagaaagcccttcaaaattagcatcagcgatccaaaaagctcatgaagaaggaatttgtggtatcaggagcgtcacaaggttagaaaatcttatgtggaagcagataacaccagaactcaatcatatattatcagaaaacgaagtcaagttaactatcatgactggtgatatcaaggggattatgcaggccggaaagcgatcgttaagacctcaaccaactgaattaaaatattcctggaaaacatggggtaaagcaaaaatgctcagcactgaaagtcataaccaaaccttcctaatagatggtcccgaaacagctgaatgccccaacaccaatcgggcgtggaactccctagaggtagaagattatggatttggggtattttcaactaatatatggcttaaacttcgtgaaaaacaggatgtattttgcgactcaaaattgatgtcagcagcaattaaggataatagggcagtccatgcagatatgggatattggattgaatccgcgttaaatgacacatggaaaatggaaaaggcttcttttatagaaatcaagtcatgtcactggccgaaatcacacacgctatggtctaacggtgttttagaatcggaaatgattatacccaaaaacttcgctggacctgtatctcaacataattatcgtccaggttaccacacccaaactgccggaccttggcatctaggcaaactcgaaatggattttgatttttgtgaaggtaccaccgttgttgtaactgaagattgcgggaacaggggtccctcactaagaaccacgacggcgagcggcaagctaataacagaatggtgctgccgttcgtgtactcttcctccactacggtatagaggggaggacggctgctggtatggtatggaaatacgcccattaaaagagaaggaggagaatctagtcaactcccttgttactgcaggccatggccaaattgataatttttcacttggtgttctagggatggcattatttctagaggaaatgctacgcacaagagtcggtactaaacacgctatactgctagttgcggtaagttttgtaactttgataaccggaaatatgagctttagagatcttggtagagtaatggtgatggtgggcgcaacaatgacggatgatataggaatgggtgtaacatatctagccttgctcgccgctttcaaagtaaggcctacgtttgctgctggactacttcttcgaaagttaacgtcaaaggagctaatgatggcgacaataggaattgctttattatctcagtcaacgataccagaaaccatcttggaactaaccgatgcccttgctttagggatgatggtcctcaaaatagttcgaaatatggagaaatatcagctagcggtaacaattatggcaatttcctgtgtaccaaacgcagtcattttacaaaacgcatggaaggtaagctgtaccatcctagccgcagtctccgtgagccctctattacttacctccagccaacagaaagccgattggattccgctagcgctgacaattaaaggcttgaatcctacagcaatatttctaacaacattaagtaggacgagcaagaaaagatcatggccattaaacgaggctgtcatggccgttggaatggttagtattcttgcaagtagtctgttgaagaatgatatccctatgaccggaccactcgttgcaggaggcttgctaactgtttgttatgtcttaaccgggcgttcggcagatcttgaactagagagagctgcagatgtaaaatgggaggaccaagcagagatatcaggcagctcaccgatactaagcataacgatatcagaggatggatcaatgtcaatcaaaaatgaggaagaagaacatacgctcactatactgattcgaaccggtcttctggttataagtggtgtcttccctgtaagtatcccgatcactgcagccgcgtggtacctttgggaagttaagaaacaaagagctggagtcctatgggacgttccgagtccacctcccgttggaaaggcagaactagaagatggagcatatcgtatcaaacaaagaggaatatttgggtactcccaaattggagcaggagtgtacaaagaaggtacatttcatactatgtggcacgtgacaagaggagcggtactcatgcatcgcggaaaaagaatagaaccatcttgggccgatgttaagaaagaccttatcagctatggaggcgggtggaaattggagggagagtggaaggaaggagaagaggtacaagtactggcgctagaacctggtaaaaatcctcgagccgttcaaacaaaaccaggattatttaagactaacacaggtactattggcgccgtctcattagatttttcaccaggtacgtcgggatcgcctatagtagatagaaaaggtaaagtagtaggcttgtatggcaatggggttgtaactagaagtggtgcgtatgttagcgcaatcgcccaaacggaaaagtcaatagaagacaaccctgagatcgaggacgacattttcaggaagaaaagattaacgatcatggatttacacccgggagcgggtaagacaaaaagatatcttcccgcaatagttagggaagcgataaagagaggccttcggacattaatattggctccaactcgtgtagtagctgccgaaatggaagaggctttacgaggattacctattcgctatcaaactcctgctatcagagctgaacacaccggacgagaaatcgtcgatctaatgtgtcacgcaacgtttacaatgagactacttagccctgtcagagtaccaaactataatctcattatcatggatgaagcacattttacagatccagcgtcaatagcggcccgcggctacatatcaacgagagtagagatgggtgaagccgcaggaatctttatgacagcgacacctccgggttcgagagacccatttcctcaatcaaacgcccccatcatggacgaagaacgagaaattcctgaacgttcttggaactcaggccatgaatgggtaacggattttaaaggaaaaacggtctggtttgtacctagcattaaggctgggaatgatatcgcagcatgtctcaggaaaaatgggaagaaagtaatacaactcagcagaaagacatttgattccgaatacgtaaagacaagagcaaatgactgggactttgttgtgacaacggacatatcagaaatgggagcgaattttagagcagaacgagtaatcgacccaagacgatgtatgaaaccagtcatactaactgacggagaagaacgcgttatactggctggaccgatgcccgtaacgcacagcagtgccgctcagcgaagaggaagaattgggcgaaatcctaaaaacgaaaacgaccaatacatctacatgggggaaccactagaaaatgacgaagactgtgcgcattggaaagaggcgaaaatgttacttgataatattaatactccagaaggcattatcccatctatgttcgaacctgaaagagaaaaagtcgacgcgattgacggcgaatacagactgagaggtgaagcaagaaagacatttgtggatcttatgcgtcgtggagacctcccggtgtggctagcctatagagtagccgccgaaggaatcaactatgctgacagacggtggtgctttgatggcataaagaataatcaaatcctagaggaaaatgtagaggtcgaaatttggaccaaggagggagaacggaagaaactaaaaccccgttggctcgatgctagaatatattcagaccctttagcactaaaggaatttaaagaatttgcagcgggaaggaagtcacttacattaaatctgattacagagatgggtagactgccgacattcatgacccaaaaggctcgcgatgctctcgacaatcttgcggtattacatactgcagaagttggcggcagagcctacaatcatgcattaaatgaattacccgaaacgctagaaacattattattattaacacttctggcgactgtaactggtgggatatttctatttctcatgtcaggtaaaggaataggaaaaatgactctcggcatgtgctgtattatcacagcaagcatattattgtggtatgcacagatacaacctcattggatagccgcatcaattatattagagttctttctaatagtactactgattcctgaaccagaaaaacaacgaacaccacaggataatcaattaacttatgttgttatagcaattttaacagttgtagcagctacgatggcaaatgaaatgggatttttggaaaagaccaagaaagatcttggtttaggaagtataacaacacaggaaagtgaaagtaatatcctggatattgatctacgccctgctagcgcttggacactatacgcggtggcaactacctttgtaacgccaatgctgaggcattcaatagaaaattcgtcagtcaatgtatccttaacagctatcgcgaatcaggcgacagtgttaatgggactaggccggggatggccgctatccaaaatggatatcggagtaccactattagcaataggttgttactctcaagttaatcccatcactttaaccgcagctctactactgctagtggctcactatgctataatcggccctggactgcaagcgaaagctactagagaagcgcaaaaacgaactgcggcaggaataatgaaaaatcccactgtcgacggaatcacagtcattgatttggaaccaatcccgtacgatcccaaatttgaaaaacaacttggtcaggtaatgctcttagttctttgcgtgacacaagtgttgatgatgcgaacaacatgggctctatgtgaagcattaacccttgcgacgggaccaataagcactttgtgggaaggcaatcctgggagattttggaatactaccatagctgtttcgatggctaatatattccgaggttcatacctggctggtgccggactattatttagcataatgaagaatactacaaacgctcgtcgcgggactggcaacataggtgaaactcttggagaaaaatggaaaagtaggctaaacgcattagggaaatcggagtttcagatatataaaaagtcaggaatacaagaagtagacagaacgctggcaaaggaaggtataaaaaggggtgaaaccgatcaccatgcagtatcgagaggatcggccaagctccgttggtttgtcgaacggaatatggtaacaccggaagggaaggtagtagacctaggttgcggtcgtggagggtggagctattattgtggaggcctcaagaatgtgcgtgaggtaaagggattgacaaagggtggaccgggacacgaagaaccaataccaatgagcacatacggttggaacttagtaagactacaatccggagtagatgtattcttcacgccacccgaaaaatgcgatacactactttgtgacataggagaaagttctcctaatcctacgatagaagcaggacgaacgctgagggtcttgaatcttgttgagaattggttgaataataatacccagttttgcgtaaaagtcttaaatccttacatgccgtctgtgattgagaaaatggaaactctacaaagaaaatatggaggcgccttagtgcgaaatcccttaagccgtaacagcacccacgagatgtactgggtttccaatgctacagggaacatagtgtcaagcgtaaatatgatttcgcgtatgctaataaatcgattcacaatgaagcataagaaagcgacttatgagccggacgtagatttaggttctggaaccagaaacataggaatcgaaaatgaaataccaaatctagatataatcggaaaacgaatcgagaaaataaaacaagaacatgaaacgagctggcattatgaccaagaccatccttacaagacatgggcgtaccatggaagctatgaaacaaaacaaacgggtagtgcatcttccatggttaatggggtagtaaagttactgactaaaccatgggatgtagtaccaatggtgacccaaatggctatgacagacacaacgccatttggccaacaacgcgtatttaaagaaaaagtcgacactcgaacgcaagagccgaaagaaggtactaagaaattgatgcgaataactgccgaatggctgtggaaagagctcgggaaaaagaaaaccccgagaatgtgcacccgagaggaatttacgcgaaaagtgcggtctaacgccgcactcggcgcgatatttacggacgagaacaaatggaaatctgcacgagaagctgtagaagattctaggttctgggagctagtcgatcgagagcgcaacctacatcttgaggggaaatgtgagacatgtgtatacaatatgatgggaaagagggagaagaaattgggggagttcggcaaagcgaaaggttcaagagcaatatggtacatgtggctaggtgcaagatttttagaatttgaagcactcggcttcctgaatgaggaccattggttcagtagaggcaattcgctttccggggtagaaggcgaaggattacataaactaggttacattcttcgagatgtttcaaagaaagaaggaggagcaatgtacgccgacgatacagccggctgggatactagaataaccttagaagatctaaagaacgaagaaatggtaacaaatcatatgaaaggagaacataagaaattagcagaagcaatttttaagctgacctatcagaacaaagtagttcgggtacaaagaccgacgagcagaggaaccgttatggatatcataagtcgtaaagatcaaaggggttccgggcaagtaggaacttacgggctaaatacattcacaaatatggaggcacaattaatacgtcaaatggaaggagaaggaatattcaaaagtattcagagactaactgtaacagaggaaattgccgtacaaaattggctcgcacgtgtaggcagagagcgtcttagtaggatggcgatttccggtgatgattgtgtagtaaaacctcttgacgatagatttgcaagcgctttaacagctttaaatgatatgggcaaagtgcgaaaggacatacaacaatgggagccatctaggggatggaatgactggacccaggtgccattttgttcacatcatttccatgaattagtaatgaaggacggacgtgtcttagtagtgccttgccggaatcaagatgaactaattggaagggctaggatttcacagggggcgggctggagtttaaaggaaacagcctgccttggaaaatcgtacgctcaaatgtggactctcatgtatttccatagacgagatttaagattggcggcgaacgccatatgctccgccgtcccctcacattgggtgcccacttctcgcacaacctggtccattcacgccaaacatgaatggatgacgactgaagatatgttagctgtctggaatagggtatggattcaagaaaatccttggatggaagacaaaacccctgtagagagttgggaagaagtaccctacttaggtaagagagaagatcaatggtgcgggtcactaataggattaacctctcgagctacttgggctaaaaatattcaaacagcggtaaatcaggtaaggtctttgataggtaacgaagaatacactgactatatgccatctatgaaacggttcagaaaagaagaagaagaagcaggagtcctttggtaa

SEQ ID NO: 22610 - RNA, 9873 nt, synthetic construct
  misc_feature 1..9873: note = derived and/or modified CDS sequence (opt6) from DENV-2__HQ541798__SS-prME
  source 1..9873: mol_type = other RNA
acagcaggcatgatatttatgctaatcccaactgtaatggccttccacctgactaccaggaacggagaaccacatatgattgtaagtagacaagaaaaagggaaatccttactctttaaaacaggagatggtgtgaatatgtgcacgctaatggcgatggatcttggggaactatgtgaagacacaataacatacaaatgtcccctccttagacaaaacgaaccggaggacattgattgttggtgtaatagtacgagcacgtgggtcacatacgggacgtgtaccacaacaggagagcaccgacgcgaaaaaagatcagttgccttagtcccgcatgttggtatggggcttgaaacacgtacggaaacttggatgtcctcagagggggcttggaagcacgcgcaaaggattgaaacgtggatattgagacacccaggtttcactatcatggcagcaatcttagcttacactattggaacaactcatttccagcgagctcttatattcatactactaacagcagttgctccgtcaatgacaatgaggtgtataggtattagtaatagagattttgtagagggagtatccggtggtagttgggtagatatcgtattggagcacggatcatgtgttactacaatggcaaagaataaacctactctcgattttgaattaataaagaccgaggccaaacaatctgcaacattgagaaaatattgtatagaagctaaattaactaatactactacggaaagtagatgtcctacacagggagaaccctctttaaacgaagagcaagacaaaaggttcgtttgtaaacactcgatggtcgatcgcggttgggggaatggatgtgggttgtttggcaaaggcggaatcgtaacatgtgctatgttcacctgcaaaaaagatatgaaaggggaagtcgtacaaccggaaaatttagaatatactattgttattacgccacactctggcgaggaacatgcagtaggtaacgacaccggtaagcatggtaaagaaataaaaataactcctcagtcgtcaatcactgaagcagagctaacggggtatggcactgtaacaatggaatgttctccgcgaacaggcctagacttcaacgaaatggtcttattgcaaatggaaaataaagcttggttggtccatcgacaatggtttttggatctaccgttaccatggttaccaggggccgatacacagggatctaattggatccaaaaggagacattagtaacatttaagaaccctcacgctaagaaacaagacgttgtcgttttaggaagccaggaaggcgcaatgcatacagctctaaccggcgcaaccgaaatacagatgtcttcaggaaatttgctatttactggacatttgaaatgcagattaaggatggataaactacaattaaaaggcatgagttactcaatgtgtaccgggaaattcaaagtagttaaagagatagcagagacacaacacggaactatagtaattcgggtccaatatgaaggagatgggtctccttgtaaaataccgtttgaaattatggacctagagaaacgtcacgtactaggaagactaatcacagtaaatccaatagttacggaaaaagattcaccagtaaatattgaggctgaaccaccctttggagactcctacataatcattggagtggagccaggacagctaaaattaaactggtttaagaaaggctcatcaattgggcaaatgttggagactactatgaggggagccaaacgaatggcgatacttggagatacagcctgggattttggtagcctaggaggagtatttacttcaattggaaaagcattacatcaagtgttcggtgctatctatggggcagctttttcaggagtttcatggacaatgaaaattttaataggtgttatcataacatggataggaatgaatagccgaagtacatcactatctgtttccttagtgctagtaggagttgtaaccctctacttgggagtcatggtccaggcagactctggctgtgtagtctcgtggaagaacaaagagttgaagtgcggctcaggcatcttcattacggataacgtccatacatggacggaacaatataaattccagccagaatcgccgagtaaattggcgtcagcaatacaaaaggctcatgaagaggggatctgcggtatacgatcggtcacaagactggagaacttaatgtggaaacagatcactccagaactaaaccatatactgtcagaaaacgaagtaaaattgaccattatgactggtgacataaaaggaataatgcaagcaggaaaacgatcgttaagaccgcagccgactgaactaaaatactcttggaaaacatggggaaaagctaaaatgctatcaacagaatcacataaccaaacctttctaatagacggtccagaaacagcagaatgcccaaatacgaatagagcctggaattcactagaagtcgaagactacgggtttggtgtatttacaaccaatatatggttaaagctacgtgagaaacaagacgtgttttgcgattcaaagctgatgagtgcggctattaaagacaacagagctgtacacgcggacatgggatattggatagaaagtgccttaaacgatacatggaagatagagaaagcgagctttatagaagtgaaaagttgtcactggcctaaacctcacacattatggtcaaatgaagtattagagtccgaaatgatcattccaaaaaattttgcaggtccagtaagccaacataactatcgtccaggttatcatacacaaacggctggcccatggcatctgggtaaactggaaatggactttgacttctgcgagggcacaactgttgtagtaacggaggattgtgggaataggggcccttcattaagaacaacgacagcctcaggtaaactgattacagaatggtgctgtcggtcatgtactctaccgccactaagatatcgcggagaggacggctgttggtatggcatggagattagacccttgaaagaaaaagaagaaaacttagtcaattccctagtgacagcggggcatggtcaaattgacaatttcagtctaggtgtcttaggaatggcactctttttagaggaaatgttaaggactagggtagggacgaaacatgccattctactggtcgcggtaagcttcgtaactttaataaccggtaatatgtcgtttagagatctaggccgcgtaatggtgatggttggagcaaccatgacggatgatattggaatgggagtaacgtacttggcgctcctcgctgcgtttaaagtaagaccgacatttgcggcgggcttattactaagaaagctaacatcgaaagagttaatgatgacaacaattgggatagtactcctctcccaatcaactattcctgagacaattttggaacttaccgacgctctagccctgggtatgatggtattaaaaatggtaagaaagatggaaaaatatcagttagctgtaacaataatggcgatcctctgcgtcccaaacgcggttatactacagaatgcttggaaggtgtcgtgcacaatattagcagttgtaagtgtttcaccccttttcctgacgtcttcacaacaaaaagcagattggataccacttgccctcaccataaaaggattaaaccctaccgctatatttttgactactctatccagaacaaacaagaaacgatcgtggcctctcaatgaagctataatggcagttggcatggttagtatattagcgagttcattactcaaaaatgatattcccatgactgggccattagtggcaggtggactattgaccgtgtgctacgtcttaacgggaagatccgcagacctagagctagaacgcgcggctgacgttaaatgggaggaccaagcagaaatttccgggagcagtccaattctttccatcaccattagcgaagacggaagtatgagtatcaaaaatgaagaggaagaacaaaccttgactatcttaataagaacaggtctacttgtcatatcaggtctgttccccgtatcactacctataacggccgctgcatggtatctatgggaagtcaagaaacaaagagcaggagtcctttgggatgtcccgtcacctcctcccgtagggaaagcagaactagaagacggagcatatcgaataaagcagaaaggaatactgggctactctcaaattggggccggtgtttataaagagggtacatttcacaccatgtggcacgttacaagaggagcagttctgatgcacaaaggtaagagaattgaaccaagttgggccgacgttaaaaaagaccttatatcctatggcggaggatggaaattagaaggagaatggaaagaaggagaagaagtccaggtactagcacttgagcctggaaagaatcctagagccgtccaaactaaaccagggctctttaagaccaacgcaggaactattggagcagtaagtctggatttctctcctggaacttctggctcaccgataatagataaaaaaggaaaagtagtgggcttatatggcaacggagtagtaactcgatcgggcgcttatgttagtgcaatagcacaaacagaaaaaagtatagaagataatccagaaattgaagatgacatattccgaaaaaggaaattaactattatggatcttcaccccggagcaggaaaaacaaaaagatatctgcctgccatcgttcgagaagctataaaaagaggcctacgaacgttaatactcgcacccacaagggtcgttgcagcagaaatggaggaagccttacgaggtttaccaattcgatatcaaacacccgcaattcgagctgaacacaccggaagggagatagtagacttaatgtgccatgcgaccttcactatgcgtctactaagcccagtgcgagtcccaaattataatttgataatcatggatgaagcacattttacggatcccgcttcaatagccgcacgtggttacatttcaacacgagttgaaatgggtgaggccgctggaatatttatgaccgctacccctccaggcagcagggatccatttccccaatcgaacgctcccataatggacgaggaaagagaaatccccgaaagatcatggtcaagtggacatgagtgggtaacagattttaaaggaaagacagtatggttcgtaccgagtattaaagcgggtaacgacattgcagcatgcctgagaaaaaatgggaaaaaagtaattcaattatctcgaaaaacatttgactcggagtacgtaaaaactcgaacaaatgattgggattttgtagttacaacggacatcagcgaaatgggagctaactttaaagcagaacgcgtcatcgaccccagacgttgcatgaaaccagtaatcttgacagacggagaagagagggtcatacttgcgggcccaatgccagtaacacacagtagcgcagctcaaagacggggtagaataggtcgtaatccaaaaaacgagaatgatcaatacatatacatgggagagccgcttgaaaatgatgaggattgtgcacattggaaagaggcaaaaatgctactggataatatcaacacacctgagggcattataccctcaatgttcgagcctgaaagagagaaagttgatgcaatagacggcgaatatcggctccgaggtgaagcgcgaaaaacgttcgtagacctcatgagaaggggcgacctaccagtttggcttgcatatagagtagccgctgaagggattaactacgctgatcgacgttggtgttttgatggaataaaaaataatcaaatacttgaagaaaatgtagaagttgaaatatggactaaagaaggcgaacgtaaaaagctcaagcctagatggttggatgccagaatatattcagatcctttagctctgaaagaatttaaagaatttgcagcgggcagaaaatcattaacgctctcccttatcaccgagatgggccggcttccgaccttcatgacacaaaaggcccgagatgcactagataatctagcggtattacatacggcagaggctggaggtagagcctataatcacgccttaagcgaactacccgaaacgctagaaacccttctgttactaacactcttggcgaccgttacaggaggtattttcctgtttttgatgtcaggcagaggtataggtaaaatgacactcggtatgtgctgtattatcactgcaagtatcttactatggtacgcccaaatccaaccgcattggattgcagcaagtataattctagagttcttcttgatcgttttactaataccagaacccgaaaaacagcgaactccacaggataatcagctaacctacgtagtaatcgctatactaactgtagtagcagcgacaatggcaaatgagatggggtttttagaaaaaaccaaaaaagatctaggacttggttcgataacaacacaacaacccgaatctaacatattagatatagacctccgaccagccagtgcttggacactatacgctgtagctacaacattcgtaacgccaatgcttcgccacagtatagaaaactcaagcgtaaatgtgagtcttaccgctatagctaatcaggcaacggtattaatgggtttaggcaaaggttggcctctatctaaaatggacataggcgttccactgttggcaataggatgctattcacaagtaaatcctattacattgacagcagcactctttctattagtggcacattacgctattataggaccaggtttacaagcaaaagccaccagggaggctcagaaaagagctgctgcgggaataatgaaaaacccaacagtagatggaataacagtgatagatttggacccgataccttatgatcctaaattcgaaaaacagttaggacaagtgatgcttctcgtattatgcgtcacacaggtcttaatgatgaggacgacttgggccttatgtgaggctctgaccctagccaccggcccgatatcaacactatgggaagggaaccctggcagattttggaatacgacaatagcggtctctatggctaacatattccgaggaagttatttggcaggagcaggtcttcttttttctattatgaaaaataccacaaacactcgtcgcggaacgggaaacataggcgaaacgttaggcgaaaagtggaaatccagacttaatgcacttggaaagagtgaatttcaaatttataaaaaatcgggaattcaagaagtggataggactttagcgaaagaaggcataaaacggggtgagactgatcatcacgctgtgtcacgaggttccgcgaaattgaggtggtttgtggagagaaatatggtcacacctgaaggtaaagtcgttgatctgggatgtggaagaggaggatggagctattactgtggaggcctaaaaaacgtccgcgaggtaaaaggcttgacgaagggagggcccggacacgaagaacccatcccgatgagtacatatggttggaatctagtcagactacaaagtggtgttgatgttttttttaccccaccagagaagtgcgataccctactatgcgatattggtgaaagcagtccgaacccgacagtagaagctggtaggacgctccgagttctaaatttggtcgaaaattggctaaacaataatacccaattctgtattaaagtactcaatccatacatgccttccgtcattgagaagatggaagcactccagaggaaatacggaggagcgttagtcagaaatcccctaagtcgaaattcaacacatgaaatgtactgggtttcgaatgcgtctggaaatattgttagctctgtcaatatgataagtcgtatgctcataaatagattcactatgaggcataaaaaagcgacttatgagccggatgtagacttaggttctggtacaagaaatataggcatagagtctgagatacccaatttagacatcattggtaaaagaataaaaatcaaacaagaacatgaaacctcctggcattacgaccaggaccatccgtacaaaacgtgggcttaccacggttcgtacgaaacaaaacaaactggaagcgcaagtagtatggtaaacggcgtagttagactactgacaaagccctgggatgtcgtgccgatggttacccaaatggcaatgacagatacgacgccttttgggcaacagcgagttttcaaagaaaaagtagataccagaacacaagaaccaaaggaaggtactaagaaactaatgaaaattacagccgaatggttatggaaagaattgggtaaaaaaaagaccccacggatgtgcacgcgagaagaattcactcgtaaagtaagaagtaacgctgcgttaggagcaattttcacagatgaaaataaatggaaaagtgcaagggaagcagttgaggatagcagattctgggaattagtggataaggagagaaatttacatttagaaggaaaatgcgaaacttgtgtttataatatgatgggtaaaagagaaaagaagctaggggagttcggtaaagcaaaaggttcgcgagctatctggtatatgtggttaggtgcgcgcttccttgaattcgaagctctaggtttcctaaacgaagatcactggtttagtcgggagaacagtttgagtggtgtcgaaggagagggtctccataaattaggatatatattaagagacgtttctaaaaaggaaggcggggcgatgtacgccgacgacacagcaggctgggacactagaatcacattagaagacttaaaaaatgaagaaatggtaacaaatcacatggagggagagcacaaaaaattagccgaagcgattttcaaattgacctaccaaaataaagtagtgagagttcaacgacccactcccagaggaaccgttatggacataattagtcggcgtgatcaacgaggatctgggcaagtggggacttacggattaaatactttcacaaatatggaagctcaattaatacggcagatggaaggcgaaggcgtatttaaatcaattcaacacctaactgtcacagaagaaattgccgttcagaattggttagctagggttggacgtgagagactctcacgaatggcaatttcaggagatgattgtgttgtaaaaccattggatgatagatttgcatcagcattaactgcacttaatgacatggggaaagtccgtaaagatatacaacaatgggaaccttcgagaggttggaatgattggactcaggtaccattttgctcacatcatttccatgagcttattatgaaggatggtagggtattggtcgtaccttgtagaaatcaagacgagttgattgggcgcgcaaggatatcacaaggagctggttggtccttaagagaaacagcttgtcttggcaaatcttatgcgcaaatgtggtctctaatgtatttccaccgaagagatcttagattagccgccaacgcgatctgttcggctgtaccttcacattgggtcccaactagccgtactacctggagcatacacgccaaacatgagtggatgactgctgaggatatgctaaccgtctggaacagagtctggatacaagaaaatccgtggatggaagacaaaactcctgttgaaagctgggaagaaatcccttacttgggcaagcgggaagaccagtggtgcgggagcttaattggccttacttcacgtgcaacttgggcaaaaaatatacaaaccgcaataaatcaagtaagatccttgatcggcaacgaagaatacacagactacatgcccagcatgaaacgatttcgaagagaagaggaagaagcaggcgtactatggtaa

SEQ ID NO: 22611 - RNA, 9876 nt, synthetic construct
  misc_feature 1..9876: note = derived and/or modified CDS sequence (opt6) from DENV-2__JF730053__SS-prME
  source 1..9876: mol_type = other RNA
acagctgggatgataattatgcttattccgactgtaatggcattccatttaacaacacgaaacggagaaccgcatatgatagtatccagacaagaaaaaggcaaaagtttgttattcaaaacgggagacggagtaaacatgtgtacgttgatggctatggacttgggcgaattatgtgaagatacaattacttataaatgtccactgttgcgtcaaaacgaaccagaagacatagattgttggtgcaattctacatcaacatgggtaacctatggtacatgcactacaacaggagaacatagaagagagaaaagatctgtagcgctcgtaccgcatgttggaatgggtcttgaaacacgtacagaaacttggatgtcttctgaaggtgcgtggaaacacgcacaaagaatcgaaacatggatattacgacacccagggttcaccattatggcagctatcttggcatacactattggaaccacccacttccagagagcattaatattcattttgctaactgcagtcgcaccttctatgactatgcggtgtatagggatatctaacagagattttgtcgaaggggtaagcggaggatcctgggtagatatagtactggaacatggtagttgcgtcacaactatggccaaaaacaaacctactctagattttgaattaataaaaacagaggccaaacaaagtgctaccctacgaaaatattgcattgaagccaaattaaccaatacaactactgaatccagatgcccaacacaaggtgaaccatcactcaatgaagaacaggacaaaagatttgtctgcaaacacagcatggttgacagaggctggggaaatggatgtggcctgtttggtaaaggagggattgttacttgcgcgatgtttacttgcaagaaaaacatgaaaggaaaggttgtccaacctgagaatttggagtacaccatagtaataacaccacactcgggcgaggagcacgctgtaggaaatgacactggcaaacatggaaaagaaattaaaatcacgcctcagtcctctataactgaagcagaactaactgggtatggaactgtaactatggagtgcagtccaaggacaggattagattttaatgagatggtgttacttcaaatggaaaataaggcttggctcgtacatagacagtggttccttgatttgccactaccatggttgcctggtgccgatactcagggatccaattggatccaaaaggaaacattagtaacgtttaaaaacccacacgctaagaaacaggacgttgtagttcttggctctcaagaaggagctatgcataccgcactaacgggggctacggaaattcaaatgtcaagcggtaacttattatttacagggcacttaaagtgtaggttaagaatggataaattacaactaaaaggaatgtcctattcaatgtgcacgggtaaattcaaagtggttaaggagattgccgagacacagcacggtacaattgtaatcagagttcaatacgaaggtgatggtagtccgtgcaagatcccattcgaaatcatggacctagagaaaagacacgttttaggtagattgatcacagtaaacccaatcgtaacggaaaaagattctccagtgaatatagaagcggagccaccgttcggtgattcttacataataattggagtcgaacctggccagctaaagttaaactggttcaagaagggttcatcgattggacaaatgttggagacgaccatgaggggagccaaacggatggctatattgggtgatactgcatgggatttcggttcactagggggcgtattcacgagcataggaaaagcactgcatcaagtattcggtgcaatttatggggcagcatttagcggcgtctcttggacaatgaaaattttaatcggagttataataacttggatagggatgaatagtcgatctacctccttgtcagtcagcttagtcttagttggggtagtaaccctatatttgggtgtcatggtgcaagcggattcgggttgtgttgtaagttggaagaataaagaactcaaatgcggatcaggtatatttattacggataatgttcatacttggacagaacaatataaattccagccagaatctcctagcaaactagcaagcgctattcaaaaggctcatgaagaaggtatatgtggtatcagatcagtaacccgtttagaaaacttaatgtggaaacagataactccagaattaaatcatattttaagtgaaaatgaagtcaaactaaccattatgacaggtgatattaaagggataatgcaagccgggaagagatccttaaggccacagccaacggagcttaagtatagttggaaaacatgggggaaagcaaaaatgctatcgacagaatcccataaccaaacattcctaattgacgggcccgaaacggctgaatgtcccaatactaatcgagcatggaacagtttagaagttgaggattacggatttggtgtatttacgacaaacatctggctcaaactacgagaaaaacaagacgtgttctgtgacagcaaacttatgtctgcggctatcaaggataacagagcagtccacgccgacatgggttattggatcgaatcggcattaaatgacacatggaaaattgaaaaagcgagctttatagaagtaaaatcatgtcattggccaaagtctcatactttgtggagtaatgaagtccttgaaagtgaaatgataatacccaaaaatttcgcaggtccggtttcccaacacaactacagaccggggtatcatacgcagacggcagggccctggcatcttggtaaattggaaatggactttgatttttgtgaaggtacgacagttgtagtcaccgaagattgtggtaatagaggacccagcttgcggaccacaactgcgtccggcaaactgataactgaatggtgttgtagatcatgtacattgccaccattgcgatatcgaggcgaggacggctgttggtacggtatggaaatccgaccactgaaggagaaagaagaaaacttagttaattcccttgttacagctggtcacggccaaatagataatttctcgttaggtgtgctaggaatggctttatttttggaagaaatgctacggacgcgtgtgggtacaaaacacgccatacttctcgtagcggtaagttttgtaactttaataactggcaacatgtcattccgagatttgggaagagtaatggttatggtaggtgctacaatgacagatgacattgggatgggagtaacatacctggcactattagcagcttttaaagtccgcccaacatttgccgcaggtctactccttcgaaaacttactagcaaagagctgatgatgacgactataggtatagtgttattgtcacaaagtacgataccagaaacgatacttgagttaacagacgctcttgctcttgggatgatggttctcaaaatggtacgtaaaatggagaaataccaactcgctgtgacaatcatggcaattctttgcgtacccaacgctgtaatactgcagaatgcctggaaagtaagttgcacaatcctggcggttgtatcggtgtcgcctcttttcctgacaagctcccaacagaaagcagattggataccgttggctctgactataaaaggcttaaacccaactgctatatttctgacaacgcttagcagaaccaataaaaagagatcttggccattaaatgaagcaattatggcagtaggcatggtgtccattttagcgagttcacttcttaaaaacgatataccaatgactggtcctctagtcgcgggtgggttacttacagtctgctatgtgcttacagggcgaagtgcagacctagaattagaaagagcagccgatgtaaaatgggaagatcaagctgagatatcaggcagcagtccgattctgagtataacaatatccgaggatggaagcatgagtattaaaaacgaagaagaagaacaaacacttacaatattaataaggacgggtttattagtaatatcaggactcttcccagtaagtcttccaattaccgcggcggcatggtacctatgggaagttaagaaacagcgagcgggcgttttatgggacgtaccttcacctcccccagtaggaaaagctgaacttgaggatggcgcataccgaataaaacaaaaaggaatactaggatactcacagatcggagcgggtgtatacaaagagggtacatttcacaccatgtggcacgtaacaagaggagccgtattaatgcataaaggaaaaagaatagaacccagttgggccgacgtcaagaaagatttgattagttatgggggaggttggaaactcgaaggtgaatggaaagaaggagaagaagtgcaagttttagctcttgaacctggcaagaatccacgcgcagttcaaacgaagccaggcttgtttaaaacaaacgcgggtacaataggcgcagtaagcctagatttttcacctggcacatcagggtcccccatcatagataagaaaggtaaggtagtcggtttatatggtaatggtgtagttacacggagcggcgcttatgtatcagccattgctcagaccgagaaaagtatcgaagataatcccgaaatcgaagatgatatttttaggaaaagaaaattaacgataatggacttgcacccaggagccggaaaaacaaaacgttatctacctgcaatagtaagggaagcaatcaaaagaggtctaaggacactaattcttgcacctacaagggtcgtagcggctgagatggaagaggcacttcgaggactcccaatccgttatcagactccggcgatccgagcagaacacacaggccgcgaaattgtcgatctaatgtgtcatgcgacatttactatgagacttttaagccctgtgagagtaccaaattataatctaattataatggacgaagcacattttacagatccagcatctatcgcggcccgagggtacatttcaacacgcgtcgaaatgggagaagccgctggaatattcatgacggcaacgcctccaggctccagggatccctttccccaatcgaatgcaccgataatggacgaggaacgtgaaataccagaaagatcttggtccagtgggcatgagtgggtaaccgatttcaagggcaaaacagtttggtttgttcctagtataaaagccgggaatgatatagccgcatgcctacgcaaaaatggaaagaaggtaattcaattatcacgaaaaacattcgacagcgaatacgtgaaaacacgaactaacgactgggacttcgtcgtaactactgacatctcggaaatgggagccaactttaaggcagagcgagtaatagacccccggagatgtatgaaaccagtaatactcactgacggagaggaaagagtaattctagcaggtccaatgcccgtcactcatagcagcgctgcacaaagacgaggacggattggacgaaatcccaaaaatgaaaatgatcaatatatatacatgggggaaccgctggaaaacgacgaggattgtgcccattggaaagaggccaaaatgctactggacaatataaatacacctgaagggataatacccagtatgttcgagccggaaagagaaaaagtcgacgccatagacggagagtaccgactacgaggggaggctagaaaaacctttgtggaccttatgagaagaggcgatcttccagtatggctagcttacagagtggcagctgagggcatcaactatgcggacaggcgttggtgctttgatggtattaaaaacaatcagatattggaggaaaatgtggaggtagaaatttggacgaaagagggtgagaggaagaaactaaaacctcgatggttagatgctagaatatacagtgaccctttagcgctaaaagaatttaaagaatttgcggcgggcagaaaaagtctgaccctaagtttaataaccgaaatgggtcgattgcctacattcatgacgcaaaaagcgagagatgcattagataatttagcagttctacatacagcagaagcgggtggacgagcctataaccatgccttatctgagctaccagaaacattagaaacgctattactactaacgctacttgcaacagtaactggtggtatattcctgtttctcatgtccggtcgtggtataggcaaaatgacattaggcatgtgctgtattataacagcatcaatacttttatggtatgcccaaattcaaccccactggattgccgcaagtatcatattagagttctttttaatcgtgctactcattccagaaccagagaaacaacggactcctcaggataaccagttaacatacgtcgtaatagctatattaacagtagttgcagcgactatggcaaatgagatgggatttctagagaaaactaaaaaggatcttggactaggaagtatcacgactcagcaaccggagagtaatatactcgatattgacctgcgcccggcttccgcttggacactgtatgcagtggcgacgacgtttgttacgccaatgctccggcatagtatagaaaattcctcggtaaatgtatctttgactgcgatagcgaaccaagcaactgtattaatgggattaggaaagggctggccgctatcgaaaatggacataggtgtccctcttttggcaattggttgttatagtcaagtgaatccaataacactcacagccgcactatttttgttagttgcacactatgctataattggacctggtctacaagcaaaagcgactagagaagcacaaaaacgtgctgccgcaggtataatgaaaaatccaacagtcgatggaataacagttatagacctagatcccattccttatgacccgaagtttgaaaaacaactaggacaagtaatgttacttgttttatgtgttacacaggtactaatgatgagaactacatgggctctctgtgaagcgctgacactggccacagggccgatctcgacactctgggaagggaacccgggtcgattctggaacactacaatagcagtctccatggccaatatattccggggttcatacctcgcgggtgctggcctcctctttagcataatgaaaaatacaacgaacacgcgacggggaactggaaatataggagaaacgttgggagaaaaatggaaaagtagattgaatgctctaggaaagtctgaatttcaaatctacaagaaatctggtatccaagaggtggaccgtacactagcaaaagagggaataaaacgaggagagacagatcaccacgcggtaagccgtggatcagctaaactacggtggttcgtagaacgtaacatggtaacacccgaagggaaggttgtagatttaggttgcggaagaggcggatggagttattactgcggaggtcttaaaaatgtgagagaggtaaaaggattaacaaaaggtggtccaggacatgaagaaccaatacctatgtcaacctacggatggaatttagtacgtcttcaaagcggtgtagatgtgttcttcacacctccagaaaagtgcgacaccttattgtgtgatataggagaaagttccccgaatcctactgttgaagccggtagaacactccgagttctgaatttggtagagaactggctgaacaataacacacaattctgtataaaagtcttaaatccttatatgccctccgtaattgagaaaatggaagccttacaacgaaagtacggcggcgccctagtacgaaatccactttcaaggaatagcacccatgagatgtactgggtcagtaatgcctcaggcaatattgtttcatcagttaatatgatcagccgcatgctgataaacagatttactatgcgacacaagaaagcaacttatgagccggatgtagatttaggatctgggacaagaaacataggcatagaatcagagatacctaacctggatataataggcaaaagaattgagaagattaaacaagaacacgaaacaagctggcactacgatcaagatcacccttataaaacatgggcgtatcatggttcatacgagactaaacagaccggctcagcttcgtctatggtcaacggcgtagttaggttgctcaccaaaccttgggacgtagtaccaatggtgacacaaatggccatgaccgacaccaccccattcggccaacagcgcgtattcaaagaaaaggtagatacgcgaacccaagaacctaaagaagggactaagaaattaatgaagattaccgctgaatggttatggaaagaactggggaagaaaaagacaccaagaatgtgcacgagagaggaatttactagaaaggttcgatccaatgctgctctcggagccatatttacagacgaaaataaatggaagagtgcgagggaagctgttgaagactcgcgtttctgggaattagttgataaagaacgaaatttacacttggaaggtaaatgtgaaacatgtgtttataacatgatgggaaaaagagagaagaaattaggggagttcggtaaagcaaaagggtctcgagctatatggtatatgtggctaggagcgcgatttctcgagttcgaggcgttgggctttttaaacgaggaccattggtttagccgtgaaaactcattatcgggcgttgaaggcgagggattgcataaacttggatacattcttcgcgatgtaagtaagaaagaaggcggtgccatgtacgcagatgataccgctggttgggacacacgaattactctagaagaccttaaaaatgaagagatggtcaccaatcatatggagggcgagcataagaaattagcggaggccatcttcaaattaacttatcaaaataaagtagttcgagtccaaagacccactccgaggggtacagttatggacattatatctcgcagagatcaaagaggaagtggccaagtgggaacttatggtttaaatacatttactaatatggaagcgcaattaatccggcaaatggagggagaaggcgtatttaaatcaatacaacatcttactgtaactgaagaaattgctgtacaaaactggctagccagagtaggccgagaaagattatcacgaatggcgataagtggggatgattgtgttgtgaagccattagatgaccgatttgcgtcagccttaactgctttaaatgatatgggtaaagtcaggaaagacatccaacagtgggaacccagcagaggatggaatgattggacccaagttccattctgcagccaccacttccatgagctcataatgaaagacggaagagtacttgtcgtaccttgcagaaatcaagatgaactaataggacgcgccaggattagtcagggagccggttggtcattaagagagacagcttgcttaggaaaatcatatgcgcaaatgtggagtttaatgtattttcacaggagggaccttaggcttgcggctaacgcgatatgttcagcggtaccaagccattgggtaccaacaagccgaactacatggagtatccatgcaaaacacgaatggatgaccgctgaagatatgcttacagtatggaaccgagtatggatccaagaaaatccatggatggaagataaaacacctgtagaatcttgggaagaaattccttacctgggtaaaagagaagatcaatggtgtggctcactcatcggattaacttcaagagctacgtgggcgaaaaacattcaaacggcaataaatcaggttagaagcctaattgggaacgaggagtatactgattacatgccaagtatgaaacgctttaggcgagaggaggaagaggcaggagttctatggtaa

SEQ ID NO: 22612 - RNA, 9876 nt, synthetic construct
  misc_feature 1..9876: note = derived and/or modified CDS sequence (opt6) from DENV-2__EU529706__SS-prME
  source 1..9876: mol_type = other RNA
accgccggagtcatcataatgttaatacccacggcaatggcttttcatctaacaacacgaaatggagagccgcatatgattgtaggaaggcaagaaaaaggaaagtcattactatttaagacggaggatggtgtaaatatgtgtacgcttatggccatcgatctaggggaactttgcgaggatacgattacatataaatgtccattacttagacaaaacgaaccagaggatattgactgctggtgcaattcgacaagcacttgggtgacgtacggcacctgtactactacaggggaacaccgtcgagaaaaaagatcagtagccctagtaccccatgttggtatgggattagaaacaaggacggaaacttggatgtcctcagaaggggcgtggaaacacgtacaaagaatagagacttggatattaagacatccaggatttacaataatggcagctatactagcctatacgattggtacaacacatttccagagggctttaatctttattctacttacagctgtggcaccctcgatgacaatgagatgcattggaataagcaatcgagattttgtagagggggtcagcggtggatcatgggttgacatagtacttgaacacggttcctgtgtgacgacaatggcaaaaaataaacccacgttagattttgagctgatcaagaccgaagcaaaacaacctgccacattacggaaatactgcatcgaagcaaaattaacgaatacaactacagaaagccgttgcccaacccagggtgaaccgagcttaaatgaagaacaagacaaaagatttatttgcaaacactcaatggttgatcgaggatggggtaacggatgtggcttatttgggaaaggcggcattgttacgtgcgcaatgttcacctgcaagaaaaacatggaagggaaagtagtacaaccggaaaatctggagtacacaattgtaattacaccacacagtggtgaagagcatgcggttggaaatgacactggcaaacacggaaaagaaatcaagatcacaccgcaatcctcaattacggaggcagaattaacgggatacggaacagtcacaatggaatgctcacccagaacaggcttagacttcaacgaaatggttctattacaaatggaagataaggcatggttggttcatcgacaatggtttttagatttaccactgccctggctaccaggcgcggacactcaagggagcaactggatacagaaagagacattagtaacatttaaaaatccacatgcaaaaaaacaagatgtggtagttctgggatcacaagaaggagcaatgcacacagcactaacaggagcaacagaaatacagatgtcgagcggtaatctcttatttactggacatctgaaatgcagattacgcatggacaaattacagttaaaaggcatgagttattccatgtgcacagggaagttcaaaatcgtcaaagagatagctgagactcaacacggcacgatagtgatccgagtacagtacgaaggagatggctctccatgtaaaatccccttcgagattatggatctagaaaaacgtcatgttctaggcaggttaataacagttaacccaatcgttactgaaaaggattctcctgtaaacatagaagccgagccaccgttcggtgacagttacataataataggcgtagaacctggacaacttaaattgaactggttcaagaaagggagttcaataggtcagatgtttgaaacaacaatgcgaggagctaaacgaatggcaattttgggcgatacagcgtgggattttggctctttgggtggggttttcacctctatagggaaagccttgcaccaagtatttggcgcaatctacggagcagctttttcaggtgtgtcgtggacaatgaaaatattgatcggggttataatcacatggatcggtatgaatagcagatcgacctcactctcagtgtccttagtgctcgtcggtgtagtaacactatatttaggagtaatggttcaagcggataccggatgtgtagtatcttggaagaataaagaactaaaatgcggttccggaatattcataactgataatgtgcatacctggacagaacaatacaaattccagcccgaaagcccatcgaaattggcctcggctatccaaaaagcgcacgaggagggtatatgtggtattcgatcagtaaccagactagagaacctaatgtggaaacaaatcactccggaattaaaccatattttatctgaaaacgaggttaaactaactatcatgacaggagatataaaaggaataatgcaggccggtaaaaggtcacttaggccacaacctacggaattgaaatacagctggaagacatggggaaaagctaaaatgctctccacggaatcgcacaaccaaactttcctaatagatggtccagagacagccgagtgcccaaacacaaacagggcctggaattcattagaagttgaggattacggttttggagtcttttcaactaatatatggctaaaacttcgtgaaaaacaagatgtattctgcgacagtaagttaatgagcgcagccataaaagataatcgagctgtccacgcagacatgggatactggatcgaatctgccttgaatgacacgtggaaaatggaaaaggcaagtttcatcgaaataaaatcatgtcattggccaaaaagtcacacattatggtcgaacggagtcctagaaagtgaaatgataattccaaagaatttcgcaggtccggtttcccaacataactatcgacccgggtatcatacacagactgcgggcccgtggcatcttgggaaattagaaatggactttgacttatgcgaagggacaacagttgtagtaacggaagattgcggtaaccgggggccaagccttcgcacaacaacggcaagtggcaaactcattaccgaatggtgctgtagaagctgcacattaccgccattacgatatagaggcgaagacggatgttggtatggaatggaaattagaccattaaaagaaaaagaagaaaacttagtaaattcactagtaacagccggtcatggacaaatagataacttcagtctaggcgtactcggcatggccttatttttagaagaaatgctgcgaacaaggattggtacgaaacacgcaattctattggttgccgtgagctttgtaacgttaattacaggcaatatgtcatttcgggatttaggtcgtgtaatggtaatggttggggcaaccatgacggatgatataggtatgggtgtaacataccttgcattacttgcggctttcaaagtgaggccaacatttgcggcaggactcttactacgtaaactgacatcaaaagaactgatgatggcaacaattggtatagcactattatcccaatctacgataccagaaacaattttggagttaacggacgcactagcattaggaatgatggtattgaaaatagtaagaaatatggagaaatatcaactagctgtaactatcatggcaataagttgcgtacctaacgcagtgatactgcaaaacgcctggaaagtaagctgcacgatactagctgcggtatcagtatctccgctcctgctaacatcatcccagcaaaaagctgactggataccgctggccctaacaataaaaggcttgaacccaactgcaatatttcttacaacgctatctagaacatcaaaaaaaagaagttggcctcttaatgaagcagtcatggcggttggaatggtgagcattctagcaagcagtttacttaaaaatgacataccaatgaccggaccactagtcgctggaggccttttgacagtctgctacgtactgactggacgcagcgccgacttagaattagaaagagctgccgatgttaagtgggaggaccaagcagagatatcaggctcatcgccgattctctctattactatttcagaagatggaagcatgtcaataaagaatgaagaggaagaacacacgctcactattttaataagaacagggctgttggtaatatcaggtgtcttccctgtctcgatccccatcaccgcagccgcatggtacctatgggaagtaaaaaaacagagagctggtgtgttgtgggatgtcccgtcgcctccgccagtaggtaaagccgaactagaggacggagcatatagaattaaacaacggggcatatttggctacagtcaaattggtgccggggtctacaaggaaggaacatttcatacgatgtggcacgtaacacgaggagctgtgctcatgcatagaggtaaacgaatcgagccgtcttgggcagatgtgaaaaaagacttaatatcatacggaggagggtggaaacttgaaggagaatggaaggagggggaagaagtccaagttctagctttagaacccggaaagaacccgcgggctgttcagaccaaaccaggattatttaagacaaataccggtactatcggcgctgtaagtcttgatttcagtcctggcaccagtgggagtccgattgtagacaggaaaggaaaggtcgtaggactctacggaaacggtgtagttaccaggagtggagcttatgtcagtgcaatagcacagacagaaaaaagtatagaagataatccagaaattgaagatgatatttttcgaaaaaagcgattaacaataatggacctccaccctggtgcaggaaaaacaaaaaggtatttgccagcgattgttagagaagcaattaaaagaggtctaaggaccttaatattagctccgacccgagttgtagcagcagaaatggaagaagcgttgcgaggacttcctataagatatcagaccccggcgataagggcagaacatacaggacgagagattgtagatttaatgtgccacgcgacattcactatgaggttactcagccctgtaagagtaccgaattacaacctgataataatggacgaagcacactttacggaccccgcatctattgccgcgagaggatatattagcactagagtggaaatgggagaagccgccggaatattcatgacagcgacgcctccggggtctcgtgatccattcccacaatcgaacgctccaataatggatgaagagcgagagatccccgaacgaagttggaatagcggtcacgaatgggtcacagattttaaaggtaaaacagtatggttcgtaccatcgataaaagcaggaaatgacatagcagcctgcctaagaaaaaacggaaagaaagttatacaactctctcggaaaacattcgacagtgagtacgttaagactagagccaatgactgggactttgtcgtaactactgatatatctgaaatgggagcaaacttccgtgccgagagggtcatagatccgcgcagatgtatgaaacccgtaattctaacagatggagaagaaagggtgatattagcgggccccatgcccgtcactcactcaagcgctgcacaaagacgtggtagaataggaagaaatccaaaaaacgaaaatgatcaatatatctatatgggcgaacctttagaaaatgatgaagattgcgctcattggaaggaggctaaaatgctattagataacataaatacacccgaaggaatcatccccagcatgtttgaaccggaaagagaaaaagtagacgccattgatggagaatatagactaagaggtgaggccaggaaaacgtttgttgatcttatgagaaggggcgatttgccagtatggttggcatatagggttgcagcagagggaataaattatgcggatcgtagatggtgtttcgacggaataaaaaacaatcaaatcttagaagagaacgttgaagttgaaatctggactaaagaaggcgaaagaaaaaaattgaaaccaaggtggctagatgcccgaatctactcagatccgcttgcgttgaaagaattcaaggaatttgcagcaggacgcaaatcattaacactaaatctgattactgaaatgggcaggcttcctacgtttatgactcaaaaagcacgtgatgcattggacaatctggccgttctgcatactgcggaagttggaggccgagcctataatcacgcactaagtgaacttccagagacgctcgaaacgttattactacttacacttttagccacggttactggaggtatcttcctttttctaatgtctggaaaagggatcggaaaaatgacactaggaatgtgctgcataataacagcgtcaattcttttatggtacgcacaaatacagccccactggatcgcagcatcaattatcttggaattttttctaattgtattactgatacccgaaccagaaaaacagcgaacgccacaagataaccagctgacctatgtggtaatagcaattttaacagtagtcgcggctaccatggccaacgaaatgggatttttagaaaaaactaagaaagaccttggcttaggctcaatcacgactcaagaatccgaatctaacatattggatatagatttgagacctgcgtctgcgtggacgctttacgcagttgcaacaacgtttgttacacctatgttgagacattccattgagaatagctctgtcaatgtctctcttactgccattgcaaatcaggcaacggtgcttatgggcctaggaagaggatggccattatctaaaatggacataggagtaccactgttagccataggttgttattcgcaggtaaatccaattaccctaactgctgcactgctcttactagttgctcattacgctataatcggtccaggactacaggccaaggcaacaagagaggcacaaaaaaggaccgctgcgggcataatgaaaaaccctacagtggacggaataactgttattgatttagaacctataccatatgaccccaaattcgaaaaacaactagggcaagtaatgttactagtattgtgcgtgacacaagtattaatgatgcggacaacttgggcactgtgcgaagcattaactcttgccactggtcccatatcgacactgtgggaaggaaacccaggtcggttttggaatacgactattgcggtgtccatggccaacatattcagaggatcatacctagcgggcgctggcttattgttttcaataatgaaaaatacgacaaacacaagacgaggaacgggcaatataggggaaactcttggagagaaatggaaaagccggcttaatgctcttggaaagtctgagttccaaatatataaaaaatccggaatacaagaagtcgacagaactctagcaaaagaaggtataaaacgaggcgaaactgaccatcatgcggtaagtagagggtctgcgaagttaagatggttcgttgaaagaaatatggtaacaccagaaggtaaagtagtagatctgggatgcgggagaggaggatggtcgtactattgtggggggctaaaaaatgtaagggaggtaaaaggattaaccaagggcggtccaggtcacgaagaacctattcccatgagtacctatggctggaacttggtcaggcttcaatcaggggtggatgtctttttcacgccaccagaaaagtgtgatactttgctttgcgatattggggaaagctcgcctaatccgactgtagaggcaggtagaacgctaagagtccttaatttggtggaaaactggctaaacaataatacccaattttgtgtcaaagtcttaaatccgtatatgccgtcagtcatcgaaaagatggaagcactacaaaggaagtacgggggagcactagtaaggaatcccctgtcacgaaactcaacacatgagatgtactgggtgtccaacgcgaccgggaatatcgtttcatcggtaaatatgataagcagaatgctaataaatcgatttaccatgaagcataagaaggcgacctacgaacccgacgtagatttgggttccggaaccagaaatattggaatcgagtccgaaattcccaatcttgatattataggtaaacgaatcgagaaaataaaacaggagcatgagacgagctggcactacgatcaagaccacccttataaaacgtgggcttaccatggctcgtatgaaacgaaacagactggatcggcgagttctatggtgaacggggtagtcaaacttctcacaaaaccatgggatgtagtacctatggtgactcaaatggcaatgactgatacaactccattcggtcaacaaagagtgttcaaagaaaaagtcgatactagaacccaagagccaaaagaaggaaccaagaaactcatgaggatcactgcagaatggttatggaaagagcttggccgaaagaaaactcccagaatgtgtacaagagaagagttcacaaggaaagtcaggtcaaatgctgcactgggtgcaatctttaccgatgaaaacaaatggaaatccgcgagagaagcggttgaggattcaaggttttgggagcttgttgatagagaacggaacttacatttggaaggcaagtgcgaaacttgtgtatacaacatgatgggcaaacgagaaaagaaacttggtgagtttggaaaagcaaaaggcagtcgcgcaatttggtatatgtggttaggcgcaaggtttctagaatttgaagcgttgggctttttaaacgaagatcactggttttcccgaggtaattccttatccggagtcgaaggagagggcttacataaactaggttacatactaagggatgtaagtaaaaaagaagggggggctatgtatgcggacgacacggcaggatgggatacgcgaataactctagaagacttaaaaaacgaagaaatggttacaaatcatatgaaaggagaacataaaaaattagcagaagctattttcaaactgacataccagaataaagttgtacgggtacaaagacctacaccacgcggaacggtgatggacatcatcagcaggaaagaccaaagaggctcaggccaagttgggacttatggattaaacacctttacaaatatggaagctcaattaatacgacaaatggaaggtgagggtatatttaaaagtattcaacgactgacggtaaccgaggaaatagccgtacaaaactggttggccagagtagggcgagaaagattatcaagaatggccattagtggcgatgactgtgttgtaaaacctctagatgaccgatttgcaagtgctttaactgcgctgaatgatatgggtaaagtaagaaaagacatacaacaatgggagccaagcaggggctggaatgactggactcaagttcccttctgttcacaccattttcatgaactagtcatgaaagacggccgagtattggtcgtgccatgtagaaatcaggatgagttaataggtagagcgagaatatctcaaggagcaggctggtcgctaaaagagacagcctgtcttggaaagtcttacgcacaaatgtggacgttaatgtattttcatagacgtgatttacgacttgccgcaaatgcaatatgttctgcggtcccatcgcactgggtgccaacatcacgaacaacttggagtatccatgcgaaacatgaatggatgacaacagaggatatgttggcagtttggaatcgcgtttggatacaagaaaacccatggatggaagataaaacaccagtggagagttgggaagaagtgccgtatctcgggaaaagggaagatcaatggtgcggttcccttataggactaacgagtagagcaacatgggctaaaaatatacaaaccgcaataaatcaagttagatcacttataggaaacgaggaatatacggactatatgccatcaatgaagaggttcagaaaagaagaggaggaagcaggtgttttatggtaa

SEQ ID NO: 22613 - RNA, 9876 nt, synthetic construct
  misc_feature 1..9876: note = derived and/or modified CDS sequence (opt6) from DENV-2__EU482720__SS-prME
  source 1..9876: mol_type = other RNA
accgcgggtgtgattattatgttaattccaacagcaatggcatttcacttaactacacgtaacggagaaccccatatgatagtcggaagacaagaaaaagggaaatcactactttttaaaacagaagacggagttaacatgtgtacactaatggcaatagatttaggtgaattatgtgaagataccataacatacaaatgtccattattgcgtcaaaatgaacctgaagatatagattgctggtgtaacagcacatccacttgggtgacatacggaacttgtactacaaccggagaacacagacgagagaaaagatcggtagcgcttgtaccacacgttgggatggggctagaaactcgaactgaaacttggatgtcaagtgaaggtgcgtggaaacatgtacaaaggattgaaacgtggatattacgtcatcctggtttcactacaatggcagcaattctcgcctataccattggtacgacccactttcaaagggccttaatattcatattattaacagcggtagcaccaagcatgactatgagatgcataggtataagtaacagggacttcgtagaaggagtaagtgggggatcctgggtggacatagttctagaacacggaagctgcgtgacgactatggccaaaaataaacctacactagattttgaactgataaaaacagaagcgaaacaaccagcgactcttagaaaatactgcatagaagcaaaactgacaaacactacaacagaaagccgatgtcctacgcagggtgaaccttcacttaacgaagaacaagacaaacgattcatatgtaaacatagtatggtcgatagaggttggggcaatggatgtggactctttggcaaaggaggaatcgtaacatgtgcaatgtttacatgcaagaaaaacatggaaggaaaagtcgttttgcccgagaacttggaatacacaattgtaataactccccattcgggtgaagaacacgccgtgggaaacgataccggtaaacatggaaaagaaatcaaaattacacctcaatcttcgattaccgaagctgaattgacaggctatggtactgtaacgatggaatgctcgccccgaacgggacttgatttcaatgaaatggttcttctccagatggaagataaagcctggctggttcatcgacagtggtttctagatttgccgctcccctggctacctggggctgacacccaaggttctaattggatacaaaaagaaactctagtaacattcaaaaaccctcatgcgaagaaacaggatgtagtggttctcggaagtcaagaaggggcaatgcatacagcgttaacaggcgctaccgagattcaaatgtcaagtggtaacttactgttcaccggacatctaaaatgcagacttagaatggataagctgcaactaaaaggtatgagttatagtatgtgcactggaaaatttaagatagttaaagagattgcagaaactcagcacggcactatagttatccgagtacaatatgaaggagatggatctccgtgcaaaatcccatttgagataatggatctagaaaaacggcacgtattaggaaggctaatcacagtcaatccaatagcaacggaaaaagattcaccagttaacattgaagccgaacctccatttggagacagctatataattatcggtgtagagccaggccagttaaaattaaactggtttaagaaagggtcgtcaattggtcaaatgtttgaaactacaatgagaggagctaaaagaatggccatactcggtgacactgcctgggattttggatcgcttggaggggtcttcacaagtataggtaaggccctacatcaggtattcggagccatatatggtgctgcttttagcggagtatcctggaccatgaagattttaatcggtgtaattattacttggataggaatgaatagtcgctccacatcgctatcagtgagcctggtattagtcggtattgttactctttacttaggcgtaatggtgcaagcagatacaggatgcgtcgtatcatggaaaaataaagaacttaagtgcggctcagggatatttattactgacaatgttcatacctggactgaacaatataaatttcaaccagagtctccctcaaagttagcaagtgcaattcagaaggctcatgaggaaggcatttgcggaattagatcagtaacaagactagaaaatctaatgtggaaacaaattacacccgaactgaatcacatcttgtcggaaaatgaggttaaattaacaataatgacaggcgacataaagggaattatgcaagcgggaaaaagaagtctacgaccacagccgacagaattgaaatacagttggaaaacgtggggtaaagccaaaatgttgtctacagaatctcataaccaaacttttctaatcgacggacctgaaactgcggagtgccctaacactaatagagcttggaactcactagaagtagaggactacggattcggagtattttctaccaatatttggctgaaattaagagaaaaacaagatgtgttttgtgacagtaaattaatgtcagcagctataaaagataatagagctgttcacgcggatatgggatattggattgaatccgcgctcaacgatacctggaagatggaaaaggcgagcttcattgaaatcaagtcatgtcactggccgaagtctcatactttatggtccaatggtgtactagaaagcgaaatgataataccgaaaaacttcgctggacctgtaagtcaacataattacagacctggatatcatacgcaaactgccggaccatggcatttaggaaagctagagatggatttcgacttttgcgaaggaactaccgtggtggttactgaagactgtggtaacagaggccctagtctaagaacgacgacagcgtctggtaagttgattacggagtggtgctgccgctcatgtaccttgccaccgttaaggtataggggcgaagatggctgttggtacggcatggagattagaccgctcaaagagaaagaggaaaacctggtaaatagcttagtcaccgctgggcatggtcaaatagacaatttcagcctaggagtattaggaatggccttattcttagaagaaatgttgagaactagagtgggcacaaaacatgcaattttactggtggctgtgagttttgtaaccctgattactggaaatatgtcattcagggatctaggcagagtaatggtaatggtgggagctactatgaccgatgatattggcatgggagtaacctatttagctcttttagccgcattcaaggttcgaccaacctttgctgcaggcctgctactacgtaaactcacaagtaaagaattgatgatggctaccattggaatagcattgttgtctcaatccacgatcccggaaacgatacttgagctaactgacgccctagcgcttggaatgatggtactaaaaattgtacgtaatatggaaaaatatcaacttgccgtaacaatcatggcaatatcgtgcgttccgaatgccgtaatactacaaaacgcatggaaagtatcatgtacaatcctagcagcggttagtgtatctccattattactaacatcttcacagcaaaaagctgattggattccgctagcgctaactataaaggggctaaacccaacggctatatttcttacaaccttatcccgtacatcgaagaaaagatcttggccactaaatgaagccgtaatggcagtaggcatggtttcaattctcgcctcgtcgttacttaaaaatgacataccaatgaccgggccactggtagcgggaggcttactcacggtatgttacgttttgacaggaaggagtgcagatctagagctagagaaagcagctgacgtgaagtgggaagaccaagcagaaataagcggctcatcacccatcctgagtatcactataagcgaagatggtagcatgagtatcaaaaatgaagaagaagaacatacactcacgatcttgatacggactggtttgctcgtaatatccggtgtttttccagtatcaattccaataacagcggcagcgtggtatctctgggaagtgaagaaacaacgagctggggttctatgggatgtacccagcccacccccggtcgggaaagcagaactagaagatggcgcctatcgaattaaacaaagaggaatctttggatacagtcaaataggggcaggagtttataaagagggtacattccacactatgtggcatgtcacaaggggcgcggttttgatgcatagggggaaacggatagagcctagttgggcagatgtgaagaaagacttgataagctatggaggcggatggaagctagaaggcgaatggaaagaaggagaagaagtacaagtgctggcactagaaccagggaagaacccacgtgctgtacaaacaaaaccgggtttatttaaaactaatacaggaaccatcggagcagtctcgctcgatttctcaccaggaacaagcggatcacccattgtagacaggaaaggaaaagttgtgggtctatacggtaatggagttgtcactagatcaggtgcgtacgttagtgcaatagcacaaacagagaaatcaatcgaagacaatcccgaaatagaagacgatatttttcggaagaagcgtttaacgataatggacctccacccaggagcaggaaaaacaaaaagatatttgccggcaatcgtccgggaggcaataaaaagaggattacgaacattaatattagcaccaacccgtgtagttgctgcagaaatggaggaggctttaagaggattaccgatacgttatcagaccccggcaattagagctgaacacactggtagagaaatagtagacttgatgtgtcatgccacatttacaatgagactactcagtccagtgagagtacctaattataacttgataataatggacgaagcccattttacagatcctgcttcaatcgcagctcggggatacatatcaacacgagtggaaatgggagaggcagctggaatcttcatgacagcgacacctccaggatcacgcgatccatttccacaatctaacgccccaataatggatgaagagagagagatacccgaacgatcatggaactcaggacacgaatgggtgacagacttcaaggggaagacagtatggtttgtaccatcaattaaggcaggcaatgatattgctgcttgcttgaggaaaaatggtaagaaagtaatacagctgtcgaggaaaacattcgactctgaatatgtgaagacacgtgcaaacgattgggatttcgtagttacaactgacataagtgagatgggagcaaattttagagccgaacgagtaatagaccctagacgatgcatgaaaccagtaatattgacagatggagaagaaagagtcatactggcaggaccaatgccagttacccactccagtgctgctcaaagacgaggcagaattggtagaaaccctaagaacgaaaatgatcaatatatatatatgggtgaaccactagagaacgatgaagattgcgctcactggaaagaagcaaagatgctattagataacatcaataccccagagggaataatccccagtatgtttgaacctgaaagagaaaaagtagacgcaatcgatggtgagtatcgacttaggggagaggcgcgtaaaacatttgtggacctaatgagacgaggggatctaccagtatggttggcgtaccgtgtagcagccgaggggattaattatgcagaccgccgttggtgttttgatggtatcaaaaataatcagatactagaagagaacgttgaagtagaaatctggacaaaagaaggcgaaagaaagaaattaaaaccgcgatggctagatgcaagaacatatagtgacccacttgcactgaaagaatttaaagaatttgcagcagggcgaaaaagtttaacactaaatctaataacagagatgggacgcttgcccactttcatgactcaaaaagctcgggatgcgttggataatttagctgtattacatacggcagaagtagggggtagggcttacaaccatgcgctaagcgaattgccagaaactctagagacattgctactcttaacacttttagcgaccgtcactggaggcatattcttatttctgatgtcaggaaaaggtataggcaaaatgacattgggtatgtgctgcatcattaccgcatcgattctgttatggtatgcacaaattcaaccacattggattgccgcttcgataatcctggagttctttctgattgtattgttaatcccagagcctgagaaacaacggacaccacaagataaccaattgacatatgtggttatagcaattttaacagttgtggcggcaacaatggcaaacgaaatggggttcctagaaaagaccaagaaagacctaggtctaggatcaataaccacccaagaatctgaaagcaatatactagatatagatctaaggccagcatccgcatggacactttacgcagtagccacaacgtttgtgacacctatgttaagacactcaatagagaactcctcggttaatgtatcattaactgcgatcgcgaaccaagcgacagtactaatgggcctaggaagaggttggcccctatctaagatggacatcggagttcctctactagcaattggttgctactcacaggtaaatcctataacattaacggctgctctcttattgttagtagcgcactatgccataataggtcccggactacaggctaaagcaactagagaagctcagaaaagaacagcagccggaataatgaaaaatccaaccgtagacggcataactgttatagacctggaaccgattccctatgaccctaagttcgaaaaacaattaggacaagtcatgttgctagtactctgcgtaacacaggtattaatgatgaggacaacatgggcactctgtgaggcactgactttagctactggcccaatatcaacattatgggaagggaaccctggccgcttctggaatacaacgatagccgtctcaatggcaaatattttcagaggcagctacttagcaggcgccggcttattattcagtataatgaaaaatacaaccaatacaagacgaggtaccggcaatattggagaaactcttggggaaaagtggaaaagccgattgaatgcactaggtaaatcggaatttcaaatatacaagaagagtgggatacaagaggtagatagaacgttagcaaaagaaggtattaaacgaggggagacagaccaccacgcagtcagcaggggaagtgctaaactaagatggttcgttgaaaggaatatggtgacacccgaagggaaggtagtggatctgggatgcggccgaggagggtggtcatactactgtgggggcctaaagaatgtacgagaggtaaaaggcttaaccaagggaggcccaggacatgaagaacccataccaatgtcaacctatggctggaacttggtaaggttacaaagcggtgttgatgtgttctttacgccgccagaaaaatgtgatacgttattgtgtgatattggtgaatcatcaccgaacccaacaatcgaagcgggcagaaccctcagagtactaaatttggtcgaaaattggctgaataataatacacaattttgcgttaaagtcctgaacccttacatgccaagtgtaattgagaaaatggagactttacaacgtaaatatggtggtgcgctagtcagaaatcctttatcaagaaactcaacacacgaaatgtattgggtaagtaacgcgacaggtaacattgtttcatcagtaaacatgatatcaagaatgctaataaacagattcactatgaagcataagaaagctacatacgaaccagatgtagatttaggctcaggaactcggaatataggaatagaaaatgaaattccaaacctagatataattggaaagagaattgagaaaataaaacaggaacatgaaacttcatggcattatgaccaagatcacccatacaagacatgggcttaccacggtagttacgaaacgaagcaaactggcagtgcttcaagtatggtaaatggtgttgtgaagttactaacaaaaccgtgggacgttgttcccatggtaacgcaaatggccatgactgacacgaccccgttcggccaacaaagagtattcaaagagaaagtcgataccaggactcaagaaccaaaagaagggacgaaaaagttaatgcgtattaccgcggaatggttatggaaagagttaggcaagaagaaaacccccagaatgtgtacaagagaagagttcacgagaaaagttcgcagtaacgctgcgctaggtgcgatatttacggatgaaaataagtggaaaagtgctagagaagcagtcgaagacagtcgattctgggaattggttgatcgagaaagaaatttacatttggaaggaaaatgtgagacctgcgtatacaatatgatgggtaaaagggagaagaaacttggagagttcggtaaagcaaaaggctcaagggctatttggtacatgtggcttggtgcgcgatttttagagttcgaagcactaggctttttgaatgaggatcattggttctcccgaggaaattctttgagcggggtagaaggagaaggcctccacaaattaggatatatactaagagatgtttccaagaaggaagggggcgcgatgtatgcagacgacactgccggatgggatacacgtattaccctcgaggatctcaaaaacgaagaaatggtaaccaaccatatgaaaggagagcataagaaacttgcagaggccatctttaaattgacctatcaaaataaagtcgtcagggtacaaaggcctacgccaaggggaacagtgatggacattatcagcagaaaggaccaaagaggaagcggacaagttgggacgtatgggctaaatacgttcacgaatatggaggcacagcttatccggcagatggaaggggaggggattttcaaaagcatacaaagattaacagttaccgaagagatagccgttcaaaattggttagccagagtgggccgggaacgactaagtagaatggctataagtggtgatgactgtgtagttaaaccattagacgatagattcgcctcagccttaactgccctaaatgatatgggaaaagtaagaaaggatattcaacaatgggaaccctcaagaggatggaatgattggacacaggtacctttttgcagccatcattttcacgagctagtcatgaaggacggaaggatgttagttgttccctgtagaaaccaggatgaattgataggcagagcgcgtattagtcaaggtgctggttggagcttaaaagaaaccgcctgccttggtaagtcgtatgctcaaatgtggaccctaatgtacttccatagaagagatctaagactggccgctaatgccatatgctctgccgtgccatcacattgggttcccacatctcgaaccacatggagtatacatgcaaaacatgaatggatgactacagaggatatgctcgcagtgtggaatagggtctggatccaggaaaacccttggatggaagataaaacacccgtagaatcatgggaagaagtcccatatctgggtaagagggaggaccaatggtgcggttccttgattggattgacttcccgagccacatgggctaaaaacatacaaacagccattaatcaagttcgatccctaattggtaatgaggagtacacggattatatgccgagtatgaagcgttttaggaaagaagaggaggaagcaggagtcttatggtaa

SEQ ID NO: 22614 - RNA, 9876 nt, synthetic construct
  misc_feature 1..9876: note = derived and/or modified CDS sequence (opt6) from DENV-2__EU482721__SS-prME
  source 1..9876: mol_type = other RNA
acagctggtgtaatcataatgctaatcccaacagcaatggcatttcatttaacaacgagaaacggagaaccacatatgattgtaggcagacaagaaaaaggaaaaagcctactatttaaaactgaagacggtgtgaatatgtgtactttgatggcaatagacctaggagaattatgcgaagacactataacgtacaaatgccctctgttgagacaaaatgaacctgaagatatagactgctggtgtaactcgacttcaacatgggtaacgtatggtacgtgtactacaacaggagaacacagaagagaaaaacgctcagtagctcttgttccccatgtgggtatgggattagaaactcgaacggaaacatggatgtcaagcgagggagcttggaaacacgtacaacggatagagacttggatcctcagacacccaggttttacgacaatggcagcgatccttgcttatactattggaacaactcactttcaaagagcattaatatttatactgctaacagcagtagcaccaagcatgactatgcggtgcatcggcattagtaatcgagatttcgttgagggtgtaagtggtggcagctgggtcgatatcgtactcgaacacggatcctgcgtaacaaccatggccaaaaataaaccgactttagatttcgaactaattaaaacggaggcaaaacaacccgcaacactgcgcaaatattgtatagaagcaaaacttactaacaccaccacagagtcccgttgcccaacacaaggagaacctagtttgaatgaagaacaagacaaaagattcatctgtaaacattctatggtagatagggggtggggaaacggatgcggtttatttggaaaaggagggattgtaacatgtgcgatgttcacgtgtaagaaaaacatggaaggaaaagtagtacaacctgaaaacctggaatacacaatcgttataacgccccatagcggagaagaacatgctgttgggaacgatacaggtaaacatgggaaagagataaaaataacaccacaatcgtctatcaccgaagcggaattaacggggtatggaacggtaacaatggaatgttcaccaagaacagggttagatttcaatgaaatggttctgctacaaatggaagataaggcatggctagttcatcgacaatggtttcttgatcttccgctaccgtggctccccggcgcagatacacaaggtagcaattggatacagaaagaaactcttgttactttcaaaaacccacatgccaagaaacaggatgtagtggttcttggatcacaagaaggggcaatgcataccgcacttacgggtgctacggaaatacaaatgtcctcgggaaatttattatttactggtcatttaaaatgtagacttagaatggacaaactacaattaaaaggtatgtcatactcgatgtgtactggcaaatttaagatagtaaaagaaatcgctgaaacacagcacggaactatcgtaattagagtccaatatgaaggcgacgggagtccatgcaaaatccccttcgagatcatggatttagagaaaagacatgtactcggtcgtttaataacagtgaaccctatagttacggagaaagactctcctgtaaacatagaagcagaacctcccttcggcgattcctatattattataggcgtcgagcctggtcagctcaaattaaactggtttaagaaaggcagttctattggtcaaatgttcgaaaccacaatgcgcggggctaaacggatggctatactaggcgacaccgcttgggattttgggtcattgggcggagtctttacgtcaattggaaaggcattacaccaggtcttcggagctatttatggagcagcgttcagtggggtaagctggactatgaaaatattgataggtgtgataataacatggattggtatgaatagcagaagtacgagcctttcagtttccctagtattggttggaatcgtaacactatatcttggagtcatggttcaagctgatacaggttgtgtagtatcatggaagaacaaagaattgaaatgtgggagtggcatttttattacagataacgtacacacctggacagaacaatataaatttcaaccagaatccccaagtaaattagctagtgctattcagaaagcacatgaagaaggaatatgtggcattaggtcagtaaccaggcttgaaaatttgatgtggaaacaaataacacctgaacttaatcatattctgtcagaaaacgaagttaaattgacaataatgaccggggatattaagggaataatgcaggcgggcaaaaggtctcttcgaccccagcctactgaattaaaatattcttggaaaacatgggggaaggcaaaaatgctaagcactgagtcccacaatcaaaccttcctcattgatggtcccgaaactgcagagtgtccaaatacaaaccgagcatggaactcattagaagttgaagattacgggttcggtgtattcagcacaaatatctggttaaagttgagggaaaaacaagatgtattttgcgactcaaaactcatgtcagctgcaatcaaagacaatcgtgcggttcacgcggacatgggctactggatagaatctgcgttaaatgatacgtggaaaatggaaaaagcatcatttatcgagatcaagagttgtcactggccaaaatctcacacattatggagcaacggtgtcctagaatcagaaatgattattcccaagaacttcgcaggtcccgtaagtcaacataactacaggcccggttatcatacacaaactgccgggccttggcacctcggtaaattagagatggatttcgatttctgtgagggaacaacagtggtcgtcaccgaggattgcggtaatcgaggtccgagccttcgaaccacaactgcgtctggtaagctaataacagaatggtgctgtcgttcctgcacattgccacctttgcgatacaggggcgaagacggctgctggtatggaatggagataagacctctaaaggagaaggaagaaaatttggtgaactcattagtcacagctggtcatgggcaaatagataatttttccttgggggtgttaggaatggcattgttcctcgaggaaatgttaagaaccagaatcggtacaaaacatgccatactcttagtggcggtaagtttcgtcacactcataactggtaacatgagttttagggatctgggaagggtcatggtaatggtgggcgctaccatgacggatgatatcggaatgggagtaacgtacctagcattattagctgcctttaaagtcagaccgacttttgccgccggtctacttctccgtaagttaacatctaaggaactgatgatggcaacaatagggatagcgctattatcacaatctaccattcccgagactatcttagaactaacagatgcccttgccttaggcatgatggttctaaaaatagtaagaaacatggaaaaataccaactggctgttacaataatggcgatttcgtgtgtgcccaatgcagtaatattacaaaatgcgtggaaagtctcttgcaccatactagcagcagtttctgtgagccctctattacttacctcatctcaacaaaaagcagactggatacctttagcattgacaattaaaggcctgaaccccaccgccatatttctaaccactttatcccgaacgtcaaagaaaagatcctggcctttaaatgaagccatcatggcagtaggtatggtgagcatattagcaagcagtctgcttaaaaacgatattcctatgaccgggccattggtggcaggaggtctattaacagtatgctacgtattaacagggaggtctgcagatctggaattagaacgagctgcggacgtaaaatgggaagatcaagccgaaatttctgggagtagtccgatattgtcaattactatatcagaggatgggagtatgtcgatcaaaaacgaggaggaagaacacactctaacaatacttatacgtaccggactattagtaataagcggcgtgtttcccgtaagcatcccaattacggcagctgcttggtacctgtgggaagtcaagaaacaacgagcaggggtattatgggatgtcccgtcaccaccaccagtcggtaaagcagaattagaagacggagcttatagaataaaacagagaggcatttttggatattcccaaataggcgcaggggtatataaagagggaacatttcatactatgtggcacgtaacacgcggagcggttctaatgcatcgagggaaaagaattgaaccgagctgggcagacgtcaagaaagacctaatatcatacggcggcggttggaaactagaaggcgaatggaaagagggtgaagaggtacaagtattagctctcgagcccgggaaaaatcctagggcagtacaaactaaaccgggattgttcaaaacaaatactggaacgataggtgctgtgtcacttgatttctcgccgggaacatcaggctcgccaatagtagataggaaaggaaaagtggtaggattatacggaaacggtgtggttacacgctctggggcctacgtatcagcaatcgcacaaactgaaaagagtatagaagataacccagaaattgaagacgacatatttaggaagaaaaggttaacgataatggatttacacccgggagccggaaaaactaaacgctacctaccggctatagtaagagaagcaataaaaagaggattaagaactttgatcttagccccgacgcgcgtagttgcagctgaaatggaggaggcattaaggggattgcctattcgatatcaaacgccagcgattagggccgagcataccggcagggagatcgttgatctgatgtgccacgcaactttcaccatgcggttgttatcaccagtcagggtacccaactacaaccttattattatggatgaggctcatttcacagatccagcctcaattgcggctcgcggctatatttcaacacgtgttgagatgggagaggctgctggaatatttatgaccgcaaccccaccgggaagtagggatcctttcccccaatccaacgcaccaattatggatgaagaaagagagatacctgaaaggtcatggaatagtgggcacgaatgggtaacggacttcaaaggcaaaacagtgtggtttgtaccgagcatcaaagctgggaacgacatagcggcatgccttaggaaaaacggtaagaaagtgatacaattatcaagaaaaacgttcgattccgaatatgtcaaaactcgcgcgaatgactgggatttcgtagtgacaacagacataagtgaaatgggcgcaaattttcgggcagaacgagttatagaccccagacgatgcatgaaaccggtcatactaacagacggcgaggaaagggttatcttggcagggccaatgccagtgacccattcatcagccgcacagcgtcgggggagaatcggtagaaatcccaaaaatgaaaacgatcaatatatatatatgggagaaccattggaaaacgacgaagactgcgctcattggaaggaagccaagatgttacttgataacattaacacgccagagggaataattccaagtatgtttgaaccggaaagggaaaaagttgacgcaatagatggggagtaccggctgcgaggcgaagcaagaaaaactttcgtcgacttaatgagaagaggtgacttacccgtctggttggcatatagagtagcagcggaaggtataaactatgcggatagaagatggtgttttgatggaatcaagaacaatcaaatactagaggaaaacgttgaggtagaaatttggacaaaggagggagaaagaaagaaacttaaacctagatggcttgacgcgcgtatttactcagacccgctcgctctaaaagagttcaaggaatttgcagctggtcgtaaaagtctaacacttaacctaataacggaaatgggaaggctaccaacattcatgacccaaaaggcacgagacgccctagacaaccttgcggttttgcacacggcagaagctgggggtcgagcttataaccacgctttgtccgagctacctgaaaccttagaaacactgttattattaacattactagctacagtaactggcggtatttttctattcctgatgtcaggaaaagggataggtaaaatgacgctcggaatgtgttgcataataacagcaagtattttactgtggtatgctcaaatacagccgcactggatagccgcatcgattatattagagttctttttaatagtacttctaatacctgagccggaaaaacagagaacaccacaagacaaccaattgacctatgtcgtgatagcgatactcactgtagtagcagcaacaatggcgaatgaaatgggattcttagagaaaacaaagaaagatttaggtttaggcagcataaccacgcaagaatcagaatccaatatattagatatagatttacgaccagcaagtgcatggaccctatatgctgtagcaaccacttttgtaactccgatgctaaggcatagtatcgaaaattcctcagttaatgttagccttacagcaattgcgaaccaagccacagtactaatgggactagggaaaggatggcccttgagtaaaatggacataggtgttcccttgctggctataggttgctatagtcaagtaaatccaattacgctaacggctgctctattactgctagtcgcacactatgcaatcataggtcctggactacaagctaaagcaaccagggaggcacagaaacgtgcagcggcgggaataatgaaaaaccctacggtagatgggataacagttatagacttagaacctataccctatgatccaaaattcgaaaagcaactgggacaggtaatgttacttatcttatgcgtaacacaagttctaatgatgagaacgacttgggcattatgtgaagccctgacactagcaactgggccgatatcgactttatgggaaggtaatcctgggcgattttggaacactactatagctgtgtctatggctaatatatttcggggaagttatctagcgggcgctggactattattttcgataatgaaaaatacaacgaatacaagacgcggcacgggcaacataggtgaaacactgggagagaaatggaaaagtaggcttaacgccttaggcaagagtgaatttcaaatatacaagaaatcaggtatacaagaagttgacagaaccttggcaaaggaaggaatcaaaagaggagaaactgatcaccatgcggtatctcgaggatcagctaaactaagatggtttgtggagcgaaatatggtaacgccagaggggaaggtcgtagatttaggatgtggaaggggagggtggtcatactactgtggaggactcaaaaacgttagggaagtaaaaggcctaaccaagggcggtccaggtcatgaagaaccgataccaatgagcacatatggatggaatctagtgcggctccaaagtggtgtagatgtattctttactccgccggaaaaatgtgatacgttgctttgtgacataggagaaagcagccctaatcctactatagaagcaggcagaacactaagagtccttaatctagtagaaaactggcttaataataatacccaattttgcataaaagtattaaatccctatatgccatctgtaatagagaaaatggaagctctccagcgaaaatatggtggggcacttgtaagaaatccactcagtagaaattcaacacacgaaatgtactgggtttccaatgcaaccggaaatattgtgtcaagcgttaacatgatctccagaatgcttattaataggtttaccatgaaacataagaaagcgacatatgagccggatgtagatcttggatctggaactcgaaatataggaatagaatcagaaataccaaatctagatattattggaaaacggatcgaaaagatcaagcaagaacatgaaacgagctggcattacgaccaagaccatccatataaaacatgggcttatcatggatcatatgagaccaaacaaacgggaagtgcatcctcaatggtgaacggggttgtaagattattgacaaagccctgggacgttgtacctatggttacccagatggctatgaccgacacaacccctttcgggcaacagagggtatttaaagaaaaggttgacacaagaacacaagaacccaaagaaggaacaaagaaactaatgaaaataacagctgaatggttatggaaagagctaggaaagaagaaaacgccaagaatgtgcacccgagaagagttcacaaggaaagtaagaagtaacgcagctcttggtgcgatattcacagatgagaataaatggaagtcagctcgagaagcagtcgaagacggacggttttgggaactggttgatagggaaaggaatttacacctagaaggtaaatgcgaaacttgtgtttacaatatgatgggtaaacgagagaagaaactgggagaatttgggaaagctaaaggaagcagggcaatatggtacatgtggctaggcgcgagatttttagagttcgaagcgttaggatttttaaatgaagaccattggttttcgcgaggtaactcattatctggcgtcgagggcgaaggattacataggctaggatacatccttagagacgtgtcaaagaaagagggaggcgccatgtatgcggatgacacggcaggatgggatactagaattacattagaggatcttaaaaatgaagagatggttacgaaccacatgaaaggcgaacacaaaaagttggcagaggcaatctttaaattaacctatcagaataaggttgtaagggtacaaagaccgacaccaaggggaactgtaatggacattatatcacgcaaagatcagagagggagtggtcaggtcggaacgtatggattaaatacattcacgaatatggaggcgcagttaattaggcagatggaaggagaaggtattttcaaatcgatacaacgtttgaccgttactgaggagatagcagtgcagaattggttagcgagagtaggaagagaacggctttcacgtatggcaataagtggtgatgattgtgttgttaaacctttagatgatagatttgcaagtgctttgaccgcactaaatgatatgggaaaagtgcgaaaggacattcagcaatgggaaccaagccgtggttggaatgattggacacaggtgcccttttgctcgcatcactttcacgaactggtaatgaaggatggaagaatgttagtagttccttgccgaaaccaagatgaattaatcggcagagctcgaataagccaaggcgcagggtggtccttaaaggaaacagcttgcttgggaaaaagctatgcacaaatgtggaccttaatgtattttcatagacgtgatcttcgtttagccgcaaatgcaatctgttcagcggtcccgtcccactgggttccaacaagcagaacaacctggtccattcatgcaaagcatgaatggatgacgacagaagatatgttggcagtatggaatagagtatggatacaagagaacccctggatggaagataaaacaccggtcgaatcctgggaggaagttccatatcttggaaagagagaggaccaatggtgcggcagtttaattggacttacatcacgggcgacatgggcaaagaatatacaaaccgcaataaaccaagtaagatctcttataggtaatgaagaatatacggattatatgccgtccatgaaaagattcagaaaagaagaagaagaggccggggttctttggtga

SEQ ID NO: 22615 - RNA, 9876 nt, synthetic construct
  misc_feature 1..9876: note = derived and/or modified CDS sequence (opt6) from DENV-2__EU482722__SS-prME
  source 1..9876: mol_type = other RNA
acagcgggtgtaatcatcatgcttataccaacagcaatggcatttcacctgacgacacgtaatggagaacctcacatgattgttggtagacaagaaaaaggaaaatccctgttatttaaaacggaggacggtgtaaatatgtgtacactaatggccatagacttaggtgagctatgtgaagatacaataacatacaaatgtccactcctgagacaaaatgaacctgaggatatagattgctggtgtaatagtacctcaacgtgggtgacgtatggaacctgtacgacaaccggagagcatcgtagagagaaaaggagtgtggcactcgtaccacacgtaggaatgggactagagacgcgaacggaaacatggatgagttcagaaggtgcttggaaacatgtacagagaatagaaacttggattttacggcaccctggattcaccataatggcagcaatactcgcatatactataggtacaacccatttccagagagcactaatatttattctattaacagcagtggcgcctagtatgaccatgaggtgcatagggatatcaaatcgagacttcgtagaaggtgttagtggtggaagctgggtggatatagttttagagcatggttcctgtgtgacgacaatggcgaaaaataaaccaacactcgacttcgaactaataaaaacagaagctaaacaaccagctaccttaagaaaatactgtattgaagcaaaactgacaaacaccacaacagaatctaggtgccctacacaaggtgaacctagtcttaatgaagaacaggacaaaagatttatatgtaaacattcaatggtggatcgaggatggggtaacggttgcggtctctttggtaaaggtggtattgttacatgcgcaatgttcacctgtaagaaaaatatggaaggtaaagtggttctaccggaaaatttagaatatacaatagttatcacacctcattcgggagaagaacatgcagtggggaacgacactggtaaacacggtaaagaaatcaaaattacgccgcaaagctcaattacagaggcagaattgactggttatggaacagttacaatggagtgttctcctcgcactggactcgatttcaatgaaatggttcttctacaaatggaagataaagcatggttagttcacaggcaatggtttcttgacttgccactcccatggctcccaggagccgatacacagggatcaaattggatacaaaaagagaccctggttacatttaaaaatccgcatgcaaagaaacaggacgttgtggtactagggtctcaggaaggcgcgatgcatacggccttaactggagcaaccgagatacagatgagctcagggaatctactatttactggtcatttgaaatgccgattaagaatggataaactacagttgaaaggaatgtcttacagtatgtgtactggaaaattcaaaatagtaaaagaaatagctgaaacgcaacacggaaccattgtaattcgagtacagtatgagggagatggaagcccatgcaaaatcccctttgaaataatggatttagagaaaagacatgttttaggacgattgattaccgtaaacccaattgtaacagaaaaagattcaccggtgaacattgaagctgaaccgccatttggagattcctacatcattataggagtggaacccggccaactcaaacttaattggttcaagaaaggtagttcaataggacaaatgtttgaaacaactatgcgtggtgctaaaaggatggcaatattaggcgacactgcttgggattttggttcactaggaggagtctttacgtccataggcaaggctttacatcaagtcttcggtgcaatttatggagcagctttcagcggggtaagttggacaatgaaaatcctaattggtgttataattacctggataggcatgaacagcaggtcaacctcactttctgtctcattagtacttgtaggggtagtcacattatatctaggagtcatggtacaagcagattcaggatgtgtggttagttggaaaaacaaagaactgaaatgcggctcaggaatatttataacagacaacgtgcatacatggacagaacaatataaatttcaaccggaatccccgtctaaattggcctcagcaatacagaaagcacacgaggagggcatttgtggaataaggtctgtaactaggctggaaaatttgatgtggaaacagatcaccccggaattgaaccacattctaagtgaaaacgaagttaagttgaccataatgactggcgacataaaaggcataatgcaggcgggtaaaagatcattaagaccacaaccgacagaactcaaatacagttggaaaacatggggaaaagccaaaatgttatcaacagaaagtcataaccaaacctttctcattgacgggccagagacagcggaatgcccaaacacgaacagagcctggaactctttagaagttgaagattacggatttggtgtattttctacaaacatctggcttaaactaagggaaaaacaagatgtattttgtgactcgaaactcatgagcgccgcaataaaagataaccgcgcggtccacgcagatatgggttattggatagagtcggctctaaacgacacgtggaagatggagaaagcgtcatttatagagataaaaagttgtcattggccgaaaagccatactttatggagcaatggagtgctggaatctgaaatgatcatacccaaaaattttgccggacccgtttcgcaacataattaccgtccaggttaccacacgcaaacagcagggccttggcatctcggtaaactggaaatggacttcgatttctgcgaaggcacaaccgttgtggtaacagaagattgcggaaaccgagggccaagtctcagaacgactactgctagtggaaaactcataacagagtggtgctgtcgatcatgtacattgccaccactaagatatcgcggggaggatggttgttggtatgggatggagattcgccccctaaaagaaaaagaggaaaacttggtaaactcgttagttactgctggacatggccagatcgacaatttctctttaggtgttctaggcatggcattgtttttagaggaaatgctacgaaccagagtaggtaccaaacacgccatcttattggttgctgtcagttttgtgacattaattacgggtaatatgtcttttcgagatttagggcgagtaatggttatggtaggtgcgactatgacggacgacatcggaatgggcgtaacctacctagccttgctagcagcatttaaggtaagacccacattcgctgctgggctgttactaagaaagctgacctccaaagagttaatgatggcaacaattggaatagctttacttagtcagtctacgattccggaaacaatattggagttaacagacgcactagctctagggatgatggttttaaagatagtacgaaatatggaaaaataccaattggcagttacaattatggcaatcagttgtgtaccgaatgcagtaatccttcaaaacgcatggaaagtgtcatgtaccatactagcagcagtatccgtaagcccactactcctaacatcttcacaacaaaaagcagactggataccgctagccctaacgataaaaggactaaatcctaccgctatcttcttaacaacactaagtcgaacgagcaagaaaagatcttggcctctcaatgaggcggtcatggcagtcggaatggttagtatattagcgagttctttactcaaaaatgatataccaatgacagggccattagtagcaggaggattgttaactgtgtgttatgtattaacaggtcgttctgccgacctggaattagagagagtagcagacgtaaagtgggaggatcaagctgaaattagcgggagttcgccaatattaagcataactataagcgaggatggctcaatgtccatcaaaaacgaagaggaagaacacacattaacaatattaattagaactgggctgcttgtcattagcggggtatttcctgttagcatacccattacggctgcagcatggtatctttgggaagtgaaaaagcagcgcgcaggcgtgttatgggatgtcccgagtccacctccagtaggaaaagcagaactagaagacggcgcgtacaggataaaacaaagaggaatcttcggatattcacaaatcggagcaggggtatataaagaagggacctttcataccatgtggcacgtcacaagaggtgcagttttgatgcaccgtggtaaacgtatagaaccttcctgggctgatgtgaaaaaggatctaataagttacggcggtggctggaagctagaaggtgaatggaaggaaggggaagaagtgcaagttctggctttggagccgggcaaaaacccgcgtgcagttcaaacaaaaccagggctttttaaaactaatacaggcacaataggagcggtttcactggacttctctccggggacgtcaggaagtcccatcgtcgacagaaagggtaaggttgtaggactatacggaaacggtgtcgtcacgagatcaggggcatatgtatctgctatagcacaaaccgaaaaatccatagaagataacccagagatagaagatgatatttttagaaagaaaaggttgaccataatggatctccacccaggtgcgggtaaaacaaagcgatacctaccagcaatcgtaagagaagctataaaacgaggtctgaggaccctcattctagctccgacgcgtgtagttgctgccgagatggaagaggcattaagaggcctccctattagatatcaaactccagctataagagcagagcatacaggacgagaaatagtagatcttatgtgccatgcaacattcacgatgcgtttattatcccctgtacgggttccaaactacaacttaataataatggatgaagcacattttacagacccagcttcaattgccgctcgaggctacatatccacccgagtagagatgggtgaagcggcagggatattcatgactgcaacacccccaggctcacgcgacccgttcccacaatctaatgcacccattatggacgaagaacgtgaaataccagaaagaagttggaactctggacacgaatgggtgacagactttaaaggcaaaactgtctggtttgtcccaagcatcaaggctgggaatgacatagctgcatgcttgagaaagaacgggaagaaagtaattcaactcagccgaaaaacgttcgactcagaatatgtgaagactcgagcaaatgactgggattttgttgttactaccgatataagcgaaatgggtgctaatttcagagctgaaagggtaatagatccgcgtcgttgcatgaaaccggtaatactaacagatggtgaagaacgtgtaatattagctggaccaatgcctgtaacacattcttcggctgcccaaaggagaggtcgcattggcagaaaccccaaaaacgagaacgatcaatatatttacatgggggaaccactagaaaatgacgaagattgtgcgcattggaaagaggcgaaaatgctattagataatataaatacgcccgaaggtattatcccttcaatgtttgaacctgagcgtgaaaaagtggacgcaattgatggggagtatcgtttaagaggagaagccagaaagacctttgtcgacctaatgcgtagaggtgatttgccggtatggttagcatatagagtggcagccgaagggattaactacgccgatcggagatggtgttttgatggtatcaaaaacaatcagatactagaagaaaatgttgaggttgagatatggacaaaggagggcgagaggaagaaacttaaaccaagatggttagatgcccgaatatactctgacccactagctttaaaagaatttaaagagttcgcggcaggaagaaaaacccttaccttgaatttaattacagaaatgggtagattaccaacatttatgacccagaaggcaagagatgcattagacaatctagcagtattgcatacagctgaggtaggaggtagagcctacaatcacgccttatcggaactaccagagactctagagacgttattgctcttaaccctattggccactgttacgggaggaatatttttgttcctaatgtcaggtaaaggtatcggaaagatgacgctggggatgtgttgtattataacagcatctatactgttatggtatgcacaaattcaaccacactggatcgctgcgtccatcattcttgagttctttcttattgtccttttaatacccgagcctgaaaaacaacgcacgcctcaagataaccaactaacatacgtcgtaatagctatattaacggttgtcgcggctacaatggcgaatgaaatgggattcttggagaaaaccaagaaagatttaggtttagggtcgattactacacaagagagtgaatcgaacatactggatatagatctgcgacccgcaagcgcgtggaccctgtacgcggtagccaccacattcgtcacacctatgttacgtcatagcatcgaaaattcatcagtcaacgtcagcctgaccgcaatcgcgaaccaggctaccgtccttatgggcctaggcagggggtggccactttcgaaaatggatattggagtaccacttttagcgatagggtgttatagtcaagttaatcccattacattaacagccgcgcttctactattggtcgcccactacgctattattgggcccggactacaagcaaaagcaactagagaagcacaaaaacgaacagcagctgggataatgaaaaaccccactgtagacggtatcacagttattgacttagagccgattccatacgatcctaaattcgagaaacaattgggtcaagtaatgctcctagtactatgcgtaacacaggtgttaatgatgaggacaacttgggcattgtgtgaagcgctcacactggctacgggaccaatatcaacactctgggaaggaaaccctggacgtttttggaataccactatcgcagtctcaatggcaaatatatttaggggatcctacctagcaggggctggtcttttgttctctattatgaaaaatactacaaataccagaagaggaactggaaatatcggagaaacactaggagagaagtggaaaagcagattaaacgcgttaggaaaatcggaatttcaaatatacaagaaaagtggtattcaggaggtagaccgtacgttagccaaagaaggaataaaaagaggtgaaacggaccatcacgcagtaagtaggggctcagctaaattacgctggtttgtggaaagaaatatggtaacgcctgagggtaaagttgtagatttgggttgcggacgaggtggttggtcatactactgtgggggattgaaaaatgtgcgcgaggtaaaaggattgacgaaaggaggcccaggtcacgaggaacctataccgatgagtacgtacggttggaacctggtaagactccagtctggtgttgatgtgttctttactcccccggaaaaatgcgatacattactatgtgatatcggtgaatccagtccgaaccccacgatagaagcgggaaggacgctcagagtactaaatctggttgaaaactggctaaataacaatacacagttttgtgtcaaggtcctcaatccttacatgccatcagtaatagagaaaatggaaacccttcaacgtaagtacggtggggccctagttagaaatccactatcgcgtaactcaacacacgaaatgtactgggtttcaaacgcaaccggaaatatagtaagttcagtaaacatgataagtcggatgttaattaatcgttttaccatgaagcataagaaagctacttatgagcctgatgtcgatctaggaagcggaactcgaaatataggaattgaaaatgaaattcccaatttagatatcataggaaaacgtatagagaagattaaacaagaacacgaaacaagctggcactatgaccaagaccatccgtacaaaacatgggcatatcacggtagttatgaaaccaaacaaactggatcagcgagcagcatggtgaatggtgtggtaaaattactaacaaaaccttgggacgtgataccaatggtaacacagatggccatgacagacacaacgcccttcggccaacaaagagtattcaaagaaaaagtagacacccgcacacaagagccaaaggaaggaacgaagaaattaatgagaataactgcagaatggttatggaaagaactggggaaaaagaaaacaccaagaatgtgcacgagagaggaatttaccagaaaagttagatcaaatgcggcactgggggcgatctttacagatgaaaacaaatggaaatcagcgcgcgaggcagtcgaagacagtcgattttgggagctagtagatagggaacgtaatctgcacctggagggtaaatgcgaaacatgcgtatataatatgatgggtaagcgggagaagaaactaggagagttcggaaaggctaaggggagccgggcaatatggtatatgtggttaggtgcacgatttctcgaatttgaagcactaggctttctaaatgaagatcattggtttagtcgtggtaactcattgtccggcgtggaaggagagggattacataagttaggatatatcttaagagacgtgagcaagaaagaagggggagcgatgtatgctgatgatacagcaggatgggatacaaggattaccttggaagaccttaaaaatgaagagatggtcacgaatcatatgaaaggagaacacaagaaacttgcggaagccattttcaaattaacatatcaaaataaagtggtacgagtacaaagacccaccccgagaggaacagtaatggatatcattagtcgaaaagaccaacgaggaagcggtcaagttggcacatacggactaaatacattcacaaatatggaagcacaactgattaggcaaatggaaggagaaggcattttcaaaagtattcagcgactcacagttaccgaagagatagctgtacaaaattggttagcgcgagttggtagagaaagattgtctaggatggctatatcaggagatgactgtgtggtcaaacctctagatgatcgttttgcttccgcattgacagcactgaatgatatggggaaagtacgcaaggacattcaacaatgggaaccttccagaggatggaacgactggacgcaagtgccattttgcagtcatcattttcatgagctagtaatgaaagacggacgagtgttagttgtgccgtgcaggaatcaagacgaactaataggccgagcccgtataagtcaaggggcaggttggtcgttgaaggaaacagcgtgtttaggaaaatcttatgcccaaatgtggacactaatgtattttcatcgaagagatctaagactcgcagccaacgctatttgcagtgctgtaccgtcccactgggttcctacctcacgtaccacgtggagtattcatgcgaaacacgaatggatgactactgaggacatgctggcagtgtggaatcgagtatggatccaagaaaatccttggatggaagataaaactccggtcgagtcctgggaagaagtaccatacttaggaaagcgagaggatcagtggtgcggatctctaataggcttgacttcgcgagctacttgggcgaaaaatatccagaccgcaataaatcaagtaaggagtctcataggaaacgaagaatatacggactatatgccaagtatgaaaaggtttagaaaggaagaagaagaggcaggggttctgtggtaa

SEQ ID NO: 22616 - RNA, 9876 nt, synthetic construct
  misc_feature 1..9876: note = derived and/or modified CDS sequence (opt6) from DENV-2__EU482723__SS-prME
  source 1..9876: mol_type = other RNA
actgcgggtgtaatcattatgctgataccaacagcgatggcattccatttaactacaaggaacggagaacctcatatgatagttggacgccaagaaaaaggaaaaagtctcctatttaaaactgaagacggagtaaatatgtgcacattaatggctatagatctaggagaattatgtgaagatacaatcacatataaatgtccactactcagacaaaatgaaccggaagatatagattgttggtgtaacagtacatctacgtgggtgacatatggaacatgtacaactactggtgaacatcgccgagaaaaacggtctgtggcattagttcctcacgtaggcatgggactagaaacaaggacagaaacttggatgagctctgaaagagcatggaaacatgtacaaagaattgaaacctggatattgagacatccaggatttacaataatggcagctatattagcatacaccataggaaccacacattttcaaagagcattgatctttatattactcacagcagtagctccttcaatgactatgaggtgtataggaatcagtaatagagactttgtagaaggagtgtctggtggatcatgggtggacattgtactagaacatggttcttgcgtaactactatggccaaaaacaaaccgacccttgattttgaattaataaaaaccgaggctaaacaacctgctactctaagaaaatactgcattgaagctaaattaactaatacgaccacagagagccgctgtccaacccaaggagagccatcactaaacgaagaacaagataaaagatttatatgcaaacattcaatggttgatagaggatggggaaacggttgtggcttattcggtaaaggaggtatagtcacatgtgcaatgtttacatgtaagaaaaatatggagggaaaagtcgttttaccggaaaacctggaatatacaattgttattacgccgcactcaggcgaggaacatgcggtaggaaacgatactggtaaacatgggaaagaaattaaaataactcctcaaagttcaatcacagaggcggaattaacaggttatgggaccgtaacgatggaatgcagcccccgaacaggactagactttaacgaaatggtcctcttacaaatggaggataaagcctggttagtccaccgtcagtggtttctagatctccccctcccatggttacccggcgccgatactcagggttcaaattggattcagaaagaaacactcgtgacatttaaaaatccacatgccaagaaacaagacgtagtcgtattaggaagccaagaaggggcaatgcacaccgcactaactggcgccactgagatacaaatgagcagcggcaatttattatttacgggacatttaaaatgtaggctcagaatggataaattacaactgaaagggatgtcgtactctatgtgcacaggtaaatttaaaatcgtgaaagagatagccgaaacccaacacggcacgatagttatccgggtacaatacgaaggagacggctcgccctgcaaaataccttttgaaattatggatctagagaaaaggcatgtactcggtagattgatcacagtcaatccaattgtaacagaaaaggatagcccagtaaacatagaagcagagcctccatttggtgattcgtacataataataggggttgaaccaggccaactaaaattgaattggtttaagaaaggatcgagtataggacagatgtttgaaacgacaatgagaggagccaaaagaatggctatacttggtgatactgcttgggactttgggtctctaggaggcgtcttcacatcaataggtaaagcattgcaccaagtgtttggagcgatatatggtgccgcattcagtggagtgtcgtggacaatgaaaattctaatcggtgtaattataacatggataggaatgaatagtcggtcaacttctcttagtgtaagtctagtattagtgggagtagtaacgttgtatttaggcgtgatggtacaggctgatagtggatgcgtagtctcatggaagaataaagaattaaaatgtggaagtggaatatttattactgataacgtccacacctggaccgagcaatataagttccaaccagaatcaccaagtaaattagcatctgcaatccaaaaagcccatgaagaaggtatatgcggcatccgatcagtaacaagacttgaaaatctcatgtggaaacaaattactccggaattaaatcacattctctccgaaaacgaagtaaaattaactatcatgacgggcgatatcaaaggcataatgcaagcaggaaaaagatcactaagaccccaacctactgaactaaagtactcatggaaaacctggggtaaggctaaaatgttaagtacagagagccataatcaaactttccttattgacggtcccgaaacggcagaatgtccaaacacgaaccgagcatggaactcattagaggtagaggattacggcttcggagtgttcagtacgaacatatggttaaaactgagggaaaaacaggacgtattttgtgattccaaattaatgagcgcagcaataaaagacaatagagcagttcacgcagacatgggttattggatagaatccgcgctaaatgatacctggaaaatggaaaaagcatccttcattgaaataaagagctgccattggcccaaatcccacactctatggagcaatggtgtgcttgagtctgagatgataataccgaaaaattttgcgggtccggtcagtcaacataattaccgacccggttatcacactcaaactgctggaccatggcatttaggcaaactggaaatggattttgatttctgcgaggggactaccgttgtagttactgaagattgcggtaaccgaggaccatctcttaggactaccactgcttccggcaagctaattaccgaatggtgttgtagatcttgcactctaccaccattacgatacaggggagaggatgggtgttggtatggaatggaaattagaccactaaaagaaaaagaggaaaatttagtaaactcacttgtaacagcgggacacgggcagatagataatttcagcctaggcgtcctaggaatggcgctctttcttgaagagatgttgcgtacgcgagtaggtacaaaacatgccatactattagtcgcagtatcattcgtaacactgatcaccgggaatatgtcatttcgtgatttaggtcgggtaatggtcatggttggagcaactatgactgacgatataggaatgggggtaacctatcttgcactattagctgcatttaaagtaagaccaacatttgcagctggattacttctcagaaaacttacctccaaggaacttatgatggccaccatcggcatcgcactgttaagtcaatcaactatccctgaaaccattttagaactgacagatgcattggcgcttggcatgatggtgctcaagatagttcgtaatatggaaaaataccaactcgccgtcacaattatggcaataagttgtgttcccaacgcagtgatcctacagaatgcttggaaagtctcttgtactatcttagcggccgtttcagtcagtccactattgctaaccagtagccagcaaaaggcggattggatacccttagctttaacgattaaaggtcttaacccgaccgcgattttcctaactacactaagcagaacatcaaagaaaagaagttggcctttaaatgaagccgtaatggccgtaggtatggtgtcgatccttgcttcctcactactaaagaatgacattcctatgactggtcctttagtagccggcggacttttaacggtatgttatgtgctcacgggacgaagtgcagatcttgaattagagagggctgcagacgtaaaatgggaagatcaggcagagatatcaggttctagtccaatattatcgataacaatctcagaagacggaagtatgagtattaaaaacgaagaagaagaacataccttaactatcctgatcaggactggtctcctggttatatctggagtatttccagtaagtataccgatcacagctgcagcctggtacttatgggaagtcaagaaacaacgtgcaggagttctctgggacgtgcctagtccacccccagtaggaaaagcagagttggaagatggagcataccgtattaaacaacgaggtatatttgggtactcacagattggtgcaggagtatataaagaaggcacctttcacacaatgtggcatgtcactcgaggagctgtattaatgcatcgagggaaaaggattgagccatcctgggctgatgttaaaaaggatttgatttcttacggcgggggctggaaattagaaggagagtggaaagagggagaggaggtacaagtactagctcttgaacccgggaagaacccaagagcagttcaaacaaagcccggtttatttaagaccaatacggggacaatcggagcagtttctcttgatttctccccgggaacttccggttcaccaatagtggatcgcaagggaaaagtagtaggactttacggaaacggagtagtgactagatcaggagcgtacgttagcgccatcgctcaaacagaaaaatcaatagaagataatccagagatagaggatgatatcttcaggaagaaacgcttaacaataatggatctccatccaggtgcagggaaaactaaacgctacctgccagcaattgtacgagaagcaataaaacgtggactaagaacactaatactagctccaactcgtgtcgtagcagctgagatggaggaagcacttcgcggtctaccaataagataccaaacaccagcaattagggcggagcatacaggaagggaaatagtagacctgatgtgccacgctactttcacgatgcgattgctttccccagtacgggtgcctaactataatctaattataatggatgaggctcatttcacagatccagctagcatagcagcacgcggttatatttcgactcgagttgaaatgggtgaagctgccggaatatttatgaccgccacacctcccggttcccgagatccttttccacaaagcaatgcaccaataatggacgaagaaagagaaattccagaaaggtcgtggaactctggtcatgaatgggtaacagattttaaaggaaaaactgtttggttcgtaccaagcattaaagcaggaaatgatatcgcggcatgcctacgaaagaacgggaagaaagtaattcaactatctagaaaaacatttgatagcgaatatgtaaaaacaagagccaatgactgggattttgtagtcactactgatataagtgaaatgggggccaatttcagagcagaacgcgttatagatccaaggcggtgcatgaagcctgtgattttgacagacggagaagaaagagtgatacttgcaggccctatgccagttacgcacagtagtgcagcacaaagaaggggaagaattggaagaaatcccaaaaacgaaaacgatcaatatatttatatgggagaaccactagagaacgatgaagattgcgcacactggaaagaagcgaaaatgctactagacaatataaatactcctgagggtatcatcccttcgatgtttgaaccggagagagagaaagtagacgcaattgatggagagtatcgacttcgaggtgaagcgcgtaaaacttttgtagatctaatgagaagaggagatttaccggtatggttagcctacagagttgctgcagagggtattaactacgctgatagaagatggtgtttcgacggaatcaaaaataaccaaatcttggaagaaaacgttgaagtcgagatatggaccaaagaaggtgaacgaaagaaattaaaaccgcgatggttagatgctagaatctatagcgatccacttgcactgaaagaatttaaagagtttgctgcaggccgcaaatcattgacattaaacttgataacggagatgggtcgactgccaactttcatgactcagaaagccagagacgcacttgacaacttggcagttttacacaccgcagaggtgggaggccgcgcctataatcatgcactctctgagctgcctgagaccttggagactttgctactgctaacgttgctagctacagtaactggtggcattttcttatttcttatgagcggaaaaggcattggaaagatgactttagggatgtgctgtataatcacagcttcaatattattatggtacgctcaaatccaaccgcactggattgcagcaagtatcatactggagttctttctaatagttttgctaatcccagaacccgaaaagcagaggactccccaagacaatcaattaacttacgtggtaatagccatccttacggttgttgcagctacaatggctaacgaaatgggatttttagaaaagaccaagaaagatctcgggctgggaagtataaccactcaagaatctgagagcaatatactggatatagaccttcgcccagcgagtgcatggaccctgtatgctgtagctacaactttcgtaaccccgatgttgcgtcattcaatagaaaatagcagtgttaatgtcagcttaacagccatagctaaccaagcaacggtgttaatgggattaggtagaggatggccactcagtaaaatggacataggagtaccgctccttgctataggttgttactcacaggtgaatcctattacgctgacggcggctctcttattacttgttgcacattacgcaattatagggccaggactacaagctaaggcaacacgcgaggcacagaaaaggacggcggcgggcataatgaagaacccaacggttgatggtattactgtaatagacctcgaacctattccttacgacccaaaattcgaaaaacaacttggacaagttatgctacttgtgctatgcgtgacccaagtactgatgatgagaactacatgggctttatgcgaagccctgacgttggcaacgggtccaatatcaacactctgggaaggaaaccccggccgattttggaatactacaattgccgtatcaatggctaatatttttcgaggttcgtacctagctggagcaggattactcttctcaataatgaaaaatacaacaaataccagacgcggtaccggaaatatgggggaaaccctaggcgaaaaatggaagtctcgcttaaatgcacttgggaaaagcgaatttcaaatttacaagaaaagtggaatacaggaagttgacaggaccttagcaaaagaagggataaaacggggagaaactgatcatcatgctgtgtcgcgtggatccgccaaactgaggtggtttgtggagaggaacatggtcacgccggagggcaaggttgttgatttggggtgcggtcgtggaggttggtcatattattgcggaggcctcaaaaatgtcagagaagtgaaggggctaactaagggaggcccaggacatgaggaaccaatacccatgtcaacttatggatggaacttagtacggttacaatctggagttgacgtgtttttcactcctccggaaaaatgcgacacactactctgtgatataggtgagagttcgccaaatccgacaatagaagctggacgtacactacgagtcctaaatcttgtagagaattggttaaataataacacacaattctgcataaaagtgttgaacccgtacatgcctagtgtcatagagaaaatggagactctccaacgcaagtatggcggagctcttgttcgaaatccacttagcagaaattccactcacgaaatgtactgggtaagcaatgccacagggaatattgtatcctcagttaatatgatctctcgtatgctaatcaacaggtttacgatgaaacataagaaagcaacttacgaacctgatgtagacctaggctccgggacaagaaatattggtatagaaaacgaaatacccaatttagatataattggcaaacgaattgagaaaataaaacaagaacatgaaacaagttggcattatgaccaggaccatccttacaaaacatgggcatatcatgggtcgtacgaaacaaaacaaacagggtccgcaagttcaatggtcaatggggtagtaaaactattaacgaagccatgggacgtggtaccaatggtaactcaaatggcaatgacagacacaacaccattcggacaacaacgagtttttaaagaaaaagtagacactaggactcaggagcctaaagagggcactaaaaagctgatgagaataacggctgaatggttatggaaagaactaggtaagaagaaaacaccacgtatgtgcacccgagaagagtttacccgtaaagttaggtccaacgcggcgctgggagcaattttcacggacgaaaataaatggaaaagcgcaagagaggccgtagaagattcaaggttttgggagttagttgacagagaacgtaatttacatttggaaggcaaatgtgaaacgtgtgtgtataatatgatggggaaacgagagaagaaattaggagagttcggcaaagctaaggggagtagagcaatatggtacatgtggttgggcgcaagatttttagagttcgaagcattaggttttctgaatgaagatcactggttctcgcgcggaaattcactgtccggcgtcgagggtgagggactacacaagttaggttacattttgagagatgtaagcaagaaagaagggggtgctatgtacgcagacgatacggcagggtgggacacgcggataacgctagaagatcttaaaaatgaagaaatggtcactaatcacatgaaaggggagcacaagaaactagctgaggccatctttaaactaacgtatcaaaataaagtggtgagggttcagagaccgacaccgaggggaactgtaatggacattatatccagaaaagatcaacgaggatctggtcaagtaggaacctatggattgaatacattcaccaatatggaagcacaacttatacgacagatggaaggagaaggtatttttaaaagcatacaacgactaaccgtaactgaagagatagcggttcagaattggctcgctagagtgggaagagaacgcctatcgcgaatggccattagcggcgatgattgcgtggtaaaacctctagatgatcgatttgcatcagcattaaccgctcttaacgatatgggcaaggtcagaaaagacatacaacaatgggagcctagcagaggctggaatgattggacacaagtccctttttgcagtcatcactttcatgaactggtaatgaaagacggtcgtgtattagtggtaccgtgccgcaatcaggacgaactaataggaagggcaagaatctcccaaggagctgggtggtcattgaaggagacggcctgtctaggcaaatcatatgcacaaatgtggactttaatgtattttcatcgacgcgatttacgtttggcagctaacgctatttgcagcgccgtcccaagtcattgggtacccaccagtagaacgacttggagtatacacgctaagcacgaatggatgaccacggaagacatgctcgccgtgtggaatcgagtatggattcaagagaatccatggatggaagacaaaaccccagtagaaagttgggaggaagtcccttatctcgggaagagggaagatcaatggtgtgggtctttaatcggattaacaagtagggcaacgtgggctaaaaatatccaaacagcaatcaaccaagttcgttccttaattggcaacgaagaatacactgactacatgccatcaatgaaaagattccgaaaagaagaagaggaagctggcgttttatggtag

SEQ ID NO: 22617 - RNA, 9876 nt, synthetic construct
  misc_feature 1..9876: note = derived and/or modified CDS sequence (opt6) from DENV-2__EU482724__SS-prME
  source 1..9876: mol_type = other RNA
acggccggagtgattataatgctaatacccactgcaatggcttttcatcttactactaggaatggcgagccacacatgatagtaggaagacaagaaaaaggcaaaagtctattattcaaaactgaagacggcgtgaacatgtgtaccctaatggcaatagacttaggtgaattatgcgaagacaccataacctataagtgtccactattacgacaaaacgagccagaagatatcgattgttggtgcaatagtacatcaacatgggttacctatggaacatgcacaacaacaggagaacacaggagagagaaaagatctgtcgcacttgttccccatgtgggtatggggctagagacacggacggaaacatggatgtcatcagagggggcctggaaacacgtacaaagaattgagacatggattcttcggcacccaggatttacaatcatggccgcgatcttggcctacacaattggcacgacacatttccaaagagctctaatctttattttattaacggccgttgctccaagcatgacaatgcggtgtatcgggatttctaatagggattttgtagaaggtgtgagtggaggttcatgggttgatatagtcttagagcatggatcatgtgttaccacaatggcgaaaaacaagccaactcttgattttgaacttattaaaacggaggcaaaacaacctgcaacactaagaaaatattgtatcgaggcaaaattaacaaatacgactactgagagtcgatgccccacccaaggggagcccagcttaaatgaggaacaagacaagaggttcatatgcaagcatagtatggtagatcgaggttgggggaatgggtgcggactgtttggaaaaggcggtatagtgacttgtgcaatgttcacgtgcaagaagaatatggagggcaaggtcgtgttacccgaaaatctcgagtacacaattgttataacacctcatagcggagaagaacacgcagtaggcaatgatactgggaaacacggaaaagaaatcaaaataactccccaaagctctataacagaggcggaattaacaggatatgggacagtaacgatggaatgctccccaagaacagggttagattttaacgaaatggtattattacaaatggaagataaagcctggttggtacatcgacaatggtttttagatctaccgttaccgtggctacccggagcagatacacaaggctcaaattggattcagaaggagaccttggtaacgtttaaaaatccccatgctaaaaagcaggacgtagttgttctaggttcacaggaaggagcaatgcatacagccttaacaggggccaccgagatacaaatgagttctggcaatctgctatttacaggacacctaaagtgtagattaaggatggacaaactgcagttaaaaggcatgtcatacagcatgtgcacaggcaagtttaaaatagtcaaagagatagccgaaacacaacacggaaccatcgtaattcgagtacagtacgaaggagacggaagtccctgtaaaataccgttcgaaattatggacttagaaaaaagacatgtcctagggagattaattacggtaaatcccattgtaacggaaaaagattcaccagttaatattgaagcagagccaccttttggagattcctacatcatcataggagtagaaccaggacaacttaaactcaattggtttaaaaaaggatcaagtataggacaaatgttcgaaacaactatgcgaggagcgaagagaatggcgatactaggtgataccgcatgggactttggaagtctaggaggagtatttacttcaatcggaaaagcattacatcaggtatttggtgcgatctatggtgcagcttttagcggagtaagttggacaatgaaaatcttaataggggtaataataacttggataggaatgaactcacgctctacaagcttgtctgtatcgttggtattagttggagtcgttaccctatacctaggtgtaatggtacaagcggatactggctgcgtggtgagctggaaaaataaggaactaaagtgtgggtcaggtatttttattactgataatgtgcacacatggacggagcaatacaagttccaaccagagagcccatcaaagctagcaagcgcaattcagaaagcgcacgaggaagggatctgcggaatacgatccgtaactcgcttagaaaatttaatgtggaagcaaataactcctgaactaaaccacatattatctgaaaatgaagtgaagctaacaataatgactggtgatatcaaaggtataatgcaagctggtaagcgttcattacgaccacaacccactgaattgaaatactcatggaagacttggggcaaagctaagatgttgtcaactgaatcacacaaccaaacgttcttaattgatggaccagagacagctgaatgtccaaacacctccagagcctggaattcactagaagtggaggattacggattcggcgtctttagcactaatatttggctaaaactgcgtgaaaaacaggatgttttctgtgattcgaagctgatgagcgcagcgataaaagacaacagggcagtacacgcggacatgggatattggatagaatcagctcttaatgacacctggaaaatggagaaagcgtcatttatcgaaataaaaagttgtcattggcctaaaagtcatacgttgtggagtaacggagtattggaatcagaaatgataatacctaaaaattttgcaggccccgtgagtcagcataactacaggcctggctaccacactcaaaccgcaggaccgtggcacctaggaaaactcgaaatggactttgatttctgcgaagggactacggtagtagtaacagaagattgcggtaaccgggggccttcactacgaacaacaacagctagtggaaaattgataactgaatggtgttgtaggtcatgcacattaccaccgcttcggtaccgcggagaggatgggtgttggtacggtatggaaattcgaccactaaaagaaaaagaagagaacctagtgaattcgttagtaacagctgggcatgggcaaatcgacaattttagcttgggcgtcttaggcatggcgctctttctagaagaaatgctaagaacacgtgttggaactaaacatgcgatattgctagtggctgttagtttcgtaacactcattactggtaatatgtcttttcgagacttaggaagagttatggtgatggttggcgcaacgatgactgacgatattggaatgggagtaacatatttggctttactcgcagcattcaaagtgcgaccaacttttgcagcggggctcctcttaaggaaactgactagtaaagaactgatgatggcaacaataggaatcgcgttactcagtcaaagcactataccagaaacgatccttgaactaactgatgctctcgcattagggatgatggtgctcaaaatagttagaaatatggaaaaatatcagctagcggttaccataatggctatcagttgtgtgccaaatgcagttatcttacaaaacgcctggaaggtatcttgcacaatcctcgcagcggtatcggtgtcaccattacttttaacttcaagtcaacagaaagctgattggattcccctggctctcacaattaagggcttaaaccctaccgctatatttcttacaacattatcacggacatcaaagaagagatcttggccactaaatgaagcggtaatggcggttggcatggtatccatactggcgtccagccttctaaaaaacgatatacctatgaccggcccacttgtcgctggtggattacttaccgtctgctatgtactcacgggaagaagtgcagatctagagcttgaacgcgctgcagatgtaaaatgggaagatcaagcagaaataagcggaagttcacccattctaagtataactataagtgaagacggatcgatgagtataaaaaacgaagaagaagagcacaccttgacgatattaatccgtacaggactgttagtgatatctggtgtatttccagtgtccattccaataacagctgcagcatggtatctttgggaggttaaaaaacagcgcgcgggtgttctttgggacgtaccttcacccccgcctgtcggtaaagcggaattagaagatggagcatatagaatcaaacaaagaggaatatttggctactcacaaataggcgccggtgtgtataaggaaggaacgtttcataccatgtggcacgtaacaagaggagcagtacttatgcatcgggggaaacgtatcgaaccgtcttgggcagatgtgaaaaaagatttgataagttatggaggtggatggaagctcgaaggagaatggaaagaaggtgaggaggtccaagtgttggccctagaaccgggaaaaaatccacgtgcagtccaaacaaagcccggtctattcaagacaaatactggaactatcggtgctgtgtcattagattttagtccaggaacatccggaagtcctattgtagatagaaagggaaaggtcgttggcttatacggcaacggggtcgtaaccagatcgggtgcatacgtttctgctatagcgcaaacggaaaaatcgatagaagacaatcctgaaatagaagacgatatatttcgaaagaagagacttacgataatggatttacacccaggtgccggaaagacgaaaaggtaccttcccgcaattgtgagggaagcaattaagaggggacttcggacgcttatacttgcccccactagagtagttgcagcagaaatggaggaagccctgaggggcttgcccataagataccaaactccagcaataagagcggaacataccggacgagaaatcgtagacttgatgtgtcatgcaacgttcacaatgaggttactttcaccagtaagagtcccaaattacaatctaataataatggacgaagctcattttacagatcccgcaagtatagcagcaagaggatatatatcaacacgtgtggaaatgggggaagcagctggaatatttatgaccgcaactccaccgggcagtcgtgacccatttcctcagtcaaacgcacctataatggacgaagaacgagaaatcccagagcgttcatggaattcaggccatgaatgggttacggatttcaaaggaaaaacggtatggttcgttcccagtattaaagcggggaatgatatagcggcttgtctacggaaaaatgggaaaaaagtgattcaactttcccgaaagacgttcgattccgagtatgtaaaaacccgcgcaaatgactgggactttgtggtcacaactgacatatctgaaatgggtgccaattttagagcggagcgagtcatagatccccgccgttgcatgaaaccagtaattttgacggatggagaggaacgagtgatattagctggacctatgccagttacccatagtagtgcagcgcaaagacgaggacgcatagggagaaatcctaaaaacgaaaatgatcaatacatttacatgggagaacccctcgaaaatgatgaagattgtgcacactggaaagaggcgaaaatgttattagacaatattaacacgccggagggaataatacctagcatgttcgagcctgaacgagagaaagtggatgccatagatggggagtatcgattacgaggggaagcaagaaaaactttcgttgacttgatgcgtaggggagacctacctgtgtggctagcttatagagtagctgcagagggcataaactatgcagatagacgttggtgttttgatggaataaaaaataatcaaattcttgaagaaaacgtagaagtagagatttggacaaaagaaggcgaacgaaaaaaattaaaacccagatggcttgatgcacgaatctattcagatcctctagcactcaaagaatttaaggaatttgccgctgggcgaaagagcctgactctcaacttgattacagaaatggggcgattaccaactttcatgacccaaaaagcgagggatgcactggacaacttggcagttcttcacactgcagaagttggtgggcgtgcatacaatcatgcgttatcagaactacctgaaacactggaaacccttttattactgacattattagcaactgtaacgggcggaatatttttattcctaatgtcaggaaaaggaattggtaagatgacattgggcatgtgctgcataataacagcctccatcctcttgtggtacgcccaaatacaacctcattggatagcagctagtattatactagaattctttctaatagtcttattaatacctgagcccgaaaaacaaagaacgccacaagacaaccaattaacgtatgtggtaatagcaattcttacggtggttgcagcgactatggcaaacgaaatgggatttttagaaaaaaccaaaaaggacctaggattaggatcaattacaactcaggaatcagaaagtaacattttagacattgaccttcgaccagcgtctgcatggactttatatgcagtagcgactacctttgtaacaccaatgttacgacattctattgaaaatagcagcgttaacgtcagtctaactgccatagcaaaccaagcaacagtattgatgggattaggtaggggatggccactaagtaaaatggatattggtgtgcctcttttagctataggatgctattcacaagtcaaccccatcactctaaccgccgctttactattattagtagcgcattatgccattatagggccgggattacaagctaaagccactagagaggcccagaaacgtactgctgcggggatcatgaaaaacccaactgtagacggtattacagtgattgatctagaacccattccctatgatccaaagttcgaaaagcaattggggcaagtcatgctactcgtactatgcgtcacgcaagtactgatgatgaggacaacttgggccctttgtgaagcgctgactctagcaactggcccaattagcactttgtgggagggaaatccggggcgcttttggaatacgactatagctgtctctatggctaatatattccgtggaagttatcttgcaggagcagggctattattttccataatgaagaatacaacgaacacgcggcgaggaacgggaaacattggagaaacgttaggagaaaaatggaaaagtagactaaatgcgctgggtaagtcagaattccaaatttataaaaaaagtggtatccaagaagtagacagaacattggcaaaagagggtattaagcgaggagagacagatcaccacgcagtctcacggggttcagcaaaattacgctggtttgttgaaaggaatatggtgactcctgaggggaaggtggtcgatctagggtgtgggagaggaggatggagttactactgtggcggattaaagaatgttcgggaagttaaaggccttacaaaaggagggccaggtcacgaagaaccgatcccgatgtctacctacggatggaacctagtccggcttcaatcaggggtagatgtgtttttcacacctccggaaaaatgtgacacacttttgtgcgacataggtgaatcgtctcccaaccccacaattgaagcaggaaggactttgcgagtactgaatttagtggagaattggctgaataacaatactcaattctgcgttaaagtactaaatccatatatgccgtcagtaatagagaagatggagacattgcagcggaaatacgggggggcgttggtacgtaaccccctaagtagaaattcgactcatgagatgtactgggtctcaaacgccacagggaatattgtcagcagtgtcaatatgatctcaagaatgttaataaacaggttcactatgaaacataaaaaagccacatacgaaccagatgtagacttaggaagcggaacaagaaatataggaattgagaatgagatacccaatttggacattatcggaaaaaggatagaaaaaataaaacaagagcacgaaacatcatggcattatgatcaagatcatccatacaaaacatgggcatatcacggcagttatgagaccaaacaaactggaagtgcatcaagtatggtgaatggtgtggtgaaattattaacgaaaccgtgggatgtagtgcctatggttactcaaatggcaatgaccgatactacccccttcggacagcagcgggtctttaaagagaaagtagacacccgaacccaagaacctaaagaaggcaccaaaaaactaatgcggataacggccgaatggttgtggaaggaactaggtaaaaaaaaaacaccacgcatgtgcacaagagaagagtttactagaaaagtaagaagtaacgcagcgttgggagccattttcacggatgaaaacaaatggaaaagtgctagagaagcagtggaagactcacgtttctgggagttagttgaccgtgaaagaaatctacacttagaaggaaaatgcgagacctgcgtttacaacatgatgggcaagagagagaagaaactcggggagttcggtaaagccaaaggttcgagggcaatctggtatatgtggttaggtgctcgttttctggaatttgaggcactaggcttcctaaacgaagatcattggttctcaagaggtaattcgctcagtggagttgaaggagaaggccttcataaactgggatatatactaagggatgtgtcaaaaaaagaagggggagcaatgtacgctgatgacacagcaggatgggacacacggatcacgttggaagatttaaaaaacgaagagatggtgacaaaccatatgaaaggtgaacacaaaaagttagcagaagcgatattcaaattaacttaccagaataaagtagtaagagttcaaagaccaaccccaagaggcacagtaatggatataatatcacgtaaagaccaaaggggttcagggcaggtaggaacatatggattaaacacgtttacaaatatggaagcacagctaatacgacaaatggaaggcgaaggaatttttaaaagtatacagagattgacagtgaccgaagaaatagctgtacagaactggttagcgagagttggtcgcgaacgtctaagtagaatggcaataagtggggatgactgcgtagtaaaacctctagacgatagattcgcgagcgcactaactgcactgaatgacatgggaaaagtacggaaagacatccaacaatgggaacccagtagaggatggaatgactggacgcaagttcctttttgcagtcaccatttccatgaactagtaatgaaagatggccgagtactagtagtaccgtgtcgcaaccaagatgaactaataggcagagcgcgtatatcacagggagcggggtggagtctaaaagaaaccgcatgtcttggaaaaagctatgctcaaatgtggactctaatgtactttcataggagagatctaaggcttgcagctaacgctatatgttctgcagtcccgtcccattgggtaccgacatcacgaactacatggagtatacatgcgaaacacgaatggatgacgacggaagacatgttagctgtgtggaaccgggtatggatacaagaaaatccctggatggaagataaaacaccggtagagtcttgggaagaagtgccttatttaggcaaaagagaggatcagtggtgtggaagtctaatcggcctaacttcaagggcaacgtgggctaagaacatccaaactgcgattaaccaagttagatctctaattggcaatgaggaatacacagactacatgccatcgatgaagagattccgaaaagaagaggaagaagcgggtgtcctatggtga

SEQ ID NO: 22618 - RNA, 9876 nt, synthetic construct
  misc_feature 1..9876: note = derived and/or modified CDS sequence (opt6) from DENV-2__EU482725__SS-prME
  source 1..9876: mol_type = other RNA
actgctggtgttatcataatgctcatccctacagcaatggcattccatttaaccactcgcaatggcgaaccccacatgattgtaggacgtcaagaaaagggaaagtcgctgcttttcaaaacagaagatggcgtcaacatgtgtactctcatggctattgatctcggggaactttgcgaggatacgatcacttataagtgcccactactgagacagaacgaacccgaggatattgactgttggtgcaactcaacatcgacatgggttacttacggaacgtgcactacaactggtgagcaccgccgtgaaaaaagatctgtggctttggtacctcatgtggggatgggcttagaaacaaggactgaaacatggatgtctagtgaaggagcctggaaacatgtccaacgaattgaaacgtggatactgaggcaccccggattcacaataatggcggctattttagcatatacgatagggacaactcatttccaaagagcactaattttcatactcttaaccgccgttgctccaagcatgaccatgagatgcataggcattagcaacagagattttgtagagggtgtttcaggagggtcttgggttgatatcgtattggaacacggaagctgtgtgaccaccatggcaaaaaacaaaccaacattagatttcgagctgattaaaacagaagctaaacaaccggctacactcagaaaatattgtattgaagccaaactcacaaatacaacaacagaatcaagatgtccaacacaaggggaaccatcattaaatgaagagcaagataaacgtttcatttgtaagcacagtatggtggatagaggatggggaaatggttgcggattatttggaaagggaggaatagttacttgtgcgatgtttacttgtaaaaaaaacatggaaggaaaagtagtactcccagaaaacttggagtacacaatagttataactccacacagtggcgaggaacatgctgtgggaaatgatacagggaagcacggcaaagagataaaaataacacctcaatctagtataacggaagccgaactaaccggttatggaacagttacgatggaatgctcaccacgaacgggattagatttcaatgagatggtgctgcttcaaatggaggacaaggcctggttagtccacagacaatggtttttagacttgcctctaccttggttacccggtgcagacactcagggctctaactggattcaaaaagaaactcttgtgacttttaaaaatccacacgcaaagaaacaagatgttgttgtcctaggatcacaagagggagctatgcatacagcattgacaggagcaactgaaatacaaatgtcgtctggaaacttattgtttacggggcacctaaaatgtagactgagaatggataaacttcaattaaaaggaatgagttatagtatgtgtactggtaagtttaagatagtaaaagagatagcagaaacgcaacacggaacaattgtaataagagtccaatatgaaggagatggctctccatgcaaaatcccctttgaaataatggatctagaaaaaaggcatgtattgggaagactgattacggtaaaccctatagttacagagaaagactctcccgtaaacattgaagctgaacccccattcggcgacagttatattataatcggagtagagccaggccaattaaaattgaattggttcaagaagggatcatcaattggacaaatgtttgaaacaacgatgaggggtgcaaagaggatggcaatactgggtgatacagcctgggacttcggaagtctaggaggtgtttttacttctataggcaaagcattacaccaagtatttggtgccatatacggagcagcatttagtggcgtttcatggacaatgaaaatacttattggagttataattacgtggatcggtatgaactctagaagcacttccttaagcgtatctttggtacttgtaggggtagtaacgttatacttaggagttatggtgcaagcagacacaggatgcgtggtatcctggaaaaataaagaactcaaatgcgggagtggtatctttataacagataatgtacatacatggacagaacaatataaattccaaccagagagccctagtaaattagcatcggccattcaaaaagctcatgaagagggtatatgcggaatacgaagtgttacaagattagaaaaccttatgtggaagcaaataactccggaacttaatcacatactcagtgagaacgaagtcaaactgactataatgacaggagatataaaaggtatcatgcaagccgggaaaagaagtttacgaccccaacccaccgaacttaaatactcctggaaaacgtggggtaaagcaaagatgctaagtacggagtcacataaccaaacttttttaatcgatggaccagagacagcagaatgtcctaatactaaccgtgcttggaactcattggaagtcgaagactacggatttggcgtatttagcacaaatatttggttaaagctcagggaaaaacaggacgtattctgtgatagcaaattaatgtccgctgctataaaggataacagagcggtccacgcggacatgggttactggatagaatcggcattaaacgacacctggaaaatggaaaaagcctcatttatcgagattaaatcatgccattggccaaagagtcataccctatggtcaaatggcgtactcgaatcagaaatgataatccctaagaattttgcgggaccagtatcacaacataattacagacccggttatcatactcaaactgccggcccttggcatctaggtaaacttgaaatggatttcgacttctgtgaaggaactacagttgtggtcacagaagactgtggaaaccggggcccgtcgttacgtaccacgaccgcaagcggaaaactcattaccgagtggtgctgtagatcatgtacacttccaccactaagatatagaggggaggatggctgttggtatgggatggaaatccgccccttaaaagaaaaagaagaaaatttggtgaattcgctagtaacagccggtcatggacaaattgacaattttagtttaggagttttgggaatggcactatttttggaagaaatgttaaggactcgagtaggaacaaaacatgcaatactacttgttgccgtttccttcgtaacactaattacaggaaacatgagtttccgagatctcggtcgagttatggtaatggtaggagctacgatgactgatgacattggtatgggagtcacatatttagcacttcttgcagcttttaaagttcgaccaacgttcgctgcaggattactgttacgtaagctaacctcaaaggagctaatgatggctacaataggaatcgcattacttagccaatcaacaattccagaaactatattagaattaactgatgcgttggcattaggcatgatggtattgaaaatagtgaggaacatggagaagtaccagctcgcagtaaccatcatggctataagctgtgtacctaacgcggtaatcctgcagaacgcttggaaggtttcatgcaccatcttagcggctgtcagcgttagtccgctactgttgacgtcttcacaacaaaaagccgattggataccgttagcactgaccataaaaggactaaatccgacagctatatttttaacaaccttgagtcgcacctcgaaaaaaaggagctggcctttaaacgaagctgtaatggcagtagggatggtgagtattctagctagctccctcttgaaaaacgatatacctatgacgggacctttggttgccggagggttacttacagtttgttacgttctgacaggtagaagcgcagaccttgaattagaacgggcagcagacgtcaaatgggaagatcaagctgaaatatctggaagtagtccaatactctcgattactatatcagaagatggaagtatgtccatcaagaacgaagaagaagagcatactctaaccattttgatacggactggattgttggtgatatcaggggtatttcctgtgtcaataccaataaccgcggcagcttggtatctctgggaggtcagaaaacaacgagctggtgtattatgggatgtcccttcaccaccgccagtcgggaaagccgaattggaggacggtgcctatcggataaagcaacgtggtatatttggctattcccagattggagctggagtatataaggaagggacctttcatacaatgtggcacgtcactagaggcgcagttctgatgcacagagggaaaagaattgaaccttcatgggcggatgttaagaaagacctaatatcttacgggggaggttggaaactagaaggagaatggaaagaaggagaagaagtacaagttctagcattggagcccggaaagaatccgagagccgtacaaactaagcctggattgtttaaaactaacaccggaaccatcggcgctgtatcgcttgattttagtcccggaacatctggtagtcctattgtcgatagaaaagggaaagttgtaggcctatacggaaacggtgtagtaacgaggtcgggcgcctatgtgagtgcaattgcgcaaacagaaaaatcaatcgaagataatccggaaattgaggacgatatatttagaaaaaagagactcactataatggacctgcacccgggcgctggtaaaacaaagagatacttaccagcaattgtgcgtgaggcaataaaaagaggcttacgaacgctcatattggctcctacacgagtggttgcggccgaaatggaagaggccctacgaggcctccctatacgttatcaaacgcctgctataagggccgagcacaccgggagggaaatagtagatttaatgtgtcatgcaacatttacgatgcgcctcttgagcccagtaagagttccgaactacaacttgattattatggacgaagcacactttactgatccggccagtatagcggccaggggttatataagtactcgagtcgagatgggcgaagctgccgggatttttatgactgcaacaccgccaggtagtagggaccctttcccacaatcaaacgcgccgattatggacgaagaacgggaaattccggagagaagttggaattcaggacatgagtgggtaacagactttaaaggaaaaacggtgtggtttgttccatctattaaggcaggaaacgatatcgctgcttgtttgaggaagaatggaaaaaaagtgatacaactgtctagaaaaacttttgacagtgaatatgtaaaaactcgtgcgaacgactgggacttcgtggtcactacagatatctccgagatgggggctaattttcgtgcggagagggttatagacccgagaagatgtatgaaaccagtcattctgacagacggagaagagagggtgatccttgcgggtccaatgccagtgacgcattcgtcagcggctcaaagaagaggacgaataggacgaaatcccaaaaacgaaaacgatcaatatatatatatgggcgaacccttagaaaatgatgaggattgcgcccattggaaagaagcaaaaatgctcttagataacataaatacgccagaaggaataattccttctatgtttgaaccggaacgagagaaggtggacgcaattgacggagagtacagattacgtggagaagcaagaaaaacatttgtcgacttaatgagaagaggcgacttgccagtctggttagcgtacagggtggctgctgaaggaataaattatgcagaccgacgatggtgtttcgatggaataaagaacaatcaaatattagaggaaaatgttgaagtcgagatctggacaaaagaaggggagaggaagaaactaaaacctagatggttagatgctcgaatatactcggatcctttggcccttaaagaattcaaggagtttgccgctggtcgcaaaagtttgacactaaacctgataactgaaatggggcgattacctacatttatgacccaaaaggccagggatgcattggacaacttagcggtactgcatacagcggaagtaggaggtagggcttacaatcatgcactatcggaacttcccgaaaccttagaaacgttgcttttgttaactctattagctaccgtcactggaggaatatttttatttcttatgtcaggaaagggtatcggaaaaatgacgttagggatgtgttgcataatcacggcctcaatattattatggtatgcgcaaatacaaccacactggattgcagcttcaataatattggagttttttcttatagtcctattgatccccgagccggaaaagcaacgtacaccacaagacaatcaattaacatacgtggtgattgcaatactaacagtagtggccgccacgatggccaacgaaatgggtttcctcgagaaaactaaaaaagatttagggttagggtccataactacgcaagaaagtgagagtaatatacttgacatagatctccgccccgcaagcgcatggactctatacgcagtggctaccacgtttgtcacaccaatgttacgacattcaattgaaaacagttcagtaaacgtatcgctaacagcgatagcaaaccaggctaccgtattaatgggattgggtagaggatggccgttatctaaaatggacatcggagtcccacttttggctataggatgttactcgcaagtgaaccctataacacttacagcagcactattattacttgtagcccactatgcgataataggtccgggtcttcaagcaaaggcaacacgagaggctcaaaaaaggaccgcagcaggtataatgaagaatccaaccgttgatggaattaccgtgatagacctagaacctatcccatacgatcccaaattcgaaaagcaattaggccaagtaatgctattagtcctatgtgttactcaagtcctaatgatgcgaacgacttgggccttgtgtgaagcactaacactagcaactggaccgatatctaccttatgggaaggaaatcctggaaggttctggaatactactatagccgtaagcatggcaaatatatttcgcgggtcatatcttgccggagctggattgctattttcgatcatgaaaaacactaccaatacgagacgcggtactggaaatataggggagacactaggtgagaagtggaaatcacaacttaatgcgcttggcaagagtgaattccagatctataaaaagagcgggatccaagaagtggacagaacgttggccaaagaaggaataaaaagaggcgagaccgatcatcatgctgtaagcagaggctccgcaaaactcagatggttcgtagaaagaaatatggtcacacccgaaggtaaagtagtagatctaggttgcggaaggggaggatggagctattactgtgggggcctaaaaaacgtacgagaagtgaaaggattaactaaaggcggaccaggccatgaagaacccataccgatgagcacctacggatggaatttagttcggctacaaagtggggtagacgtcttttttactcctcccgaaaaatgcgatacccttctatgcgacataggagaatctagtccaaatccaactatcgaagctggaagaaccctaagagtactgaatctagtagagaactggctaaacaataacacgcaattttgcgtgaaagtattaaacccatacatgccatcagtaatagaaaaaatggaaaccttacaaagaaaatatgggggagcactagtacgtaatccattaagcagaaacagcacacatgaaatgtattgggtttcaaacgcaacaggaaacatagtatcgtccgtgaacatgatttcccgaatgcttatcaacagattcacaatgaaacacaaaaaggcaacctatgaaccagatgtagacctcggttcaggcacacgaaatattggaatagaaaatgaaataccaaatttagatataataggaaaaaggatagaaaaaatcaaacaagagcatgaaacctcatggcattatgaccaggaccacccttataaaacctgggcctatcacgggagctatgaaacaaagcaaaccggctcggcatcgtccatggtaaatggagtagtaaaattacttacaaaaccatgggatgtcgtcccaatggtaactcaaatggccatgacagacacgacaccattcggacaacagagagtattcaaggaaaaagtcgacacacgaacccaagaacccaaagaaggaacgaaaaagcttatgaggatcacggctgagtggctatggaaagaattaggaaagaagaagactccacgaatgtgtacacgtgaggaatttactcggaaagtcaggtccaatgcagctttgggagctatatttaccgatgaaaataaatggaagagtgcgagagaagcggttgaggattcccgattttgggaattagtcgatcgcgagcgaaacctacaccttgaaggtaagtgtgaaacttgcgtgtacaacatgatgggaaaacgtgagaaaaagttaggagaatttggaaaagctaaagggagtagagccatatggtatatgtggctaggagctagattcttagagtttgaggcccttggcttccttaatgaagaccattggtttagcaggggtaatagtctatccggagtagaaggggaaggtctacataagttgggttatattttgcgagatgtgagtaaaaaagagggaggggcgatgtacgcggacgacactgccggatgggatacccgcataacattagaggacttaaaaaacgaggagatggtgacaaaccatatgaaaggggagcataaaaaattagcggaagctattttcaaattaacataccaaaataaagttgtaagagtccaaaggcctacacctcgtggcacagttatggacattatttcaagaaaagatcaaagaggaagtggacaagttggaacatatggtcttaacacttttactaatatggaagcacaattaattcgtcaaatggagggggaaggaatatttaaatcaattcaaagactcacagtaaccgaggaaatcgcagtccaaaattggttggcccgggtagggcgagaaagattatcccgcatggctattagtggcgacgattgcgtagtgaagcccttggatgatcggttcgcatctgcgttaaccgcactaaacgatatgggcaaagtacgtaaagacatacaacaatgggagcccagtcgaggatggaatgattggacacaagttccattttgttcacatcatttccatgagctagtaatgaaagacggtagggtcttagttgtaccatgtcgaaatcaagacgaattgataggtagagcacgaatttcccagggtgcaggatggagcctaaaagaaaccgcgtgtttaggtaaaagctatgcacaaatgtggacattaatgtattttcataggagagacctacgactcgccgctaatgcgatatgtagtgcagtaccaagtcattgggtaccgacttcaagaacaacttggagcattcacgctaagcacgagtggatgactacagaagatatgcttgctgtatggaatagagtatggatacaagaaaatccatggatggaggacaaaactccggttgaaagttgggaggaagttccatacttaggtaaacgagaagatcaatggtgtggtagtttgatcggattgacaagtagagccacatgggcaaaaaatatacaaacagccattaaccaagtaagatcacttataggtaatgaagaatatactgactacatgccgagtatgaagcggtttaggaaggaggaagaggaagctggcgtattatggtaa

SEQ ID NO: 22619 - RNA, 9876 nt, synthetic construct
  misc_feature 1..9876: note = derived and/or modified CDS sequence (opt6) from DENV-2__EU482726__SS-prME
  source 1..9876: mol_type = other RNA
acagctggtgtaattgtaatgttaatccctacggtcatggcgttccacctcacaacaaggaacggagaaccacatatgatagtagggcgccaagaaaaaggaaaatcactactctttaaaacagaagatggcgtgaacatgtgcacacttatggctattgacctcggtgaactttgcgaagatactattacatataaatgtccgttattgcgacaaaacgaacctgaagacatagactgttggtgcaattcaacaagtacgtgggttacatacggaacttgtacaacaacaggggaacataggagggaaaaacggtctgtagcacttgtaccgcacgtaggaatgggactcgaaacacgcacagaaacttggatgtcatcggaaggtgcttggaaacacgtacaacgtatcgaaacatggattttacgacaccccggtttcacaataatggcagcaatacttgcttatacaataggtacaactcacttccagcgtgcactcatattcatacttcttacggcagtagctccatcaatgacaatgcgctgcataggtatttcaaatcgtgacttcgtcgaaggagtaagtggagggagctgggtcgacatagttttagaacatggatcttgcgtgactacgatggcgaaaaacaaaccaactctcgactttgagttgatcaaaactgaggctaagcaacctgcaaccctgcggaaatactgcatagaagcgaaattaacaaacaccactacagaatctagatgtccaacgcaaggcgagccgtcattaaatgaagaacaagataaacgcttcatatgcaaacatagtatggtagaccgagggtggggaaacggatgcggactattcggtaaaggcggcattgtaacctgcgcaatgtttacttgcaagaagaatatggagggaaaaatagttcaacctgagaacttggaatatacaatagtaattactccgcattcaggtgaagaacatgcagtcggaaacgatacaggtaaacatggcaaggaaattaaaattacaccacaaagctctactaccgaagcagaactcacaggatatggaactgtcacgatggagtgttcaccacgaacaggtctagacttcaacgaaatggtactgctccagatggaagataaagcatggttggtgcacagacaatggtttctagacctgccattaccttggctacccggagcggatacgcaaggatctaactggattcagaaagagactttagtcactttcaaaaacccacatgcgaaaaagcaagacgtggtcgtgctagggtcacaggaaggcgcaatgcatacagcgttaacaggagcaacagaaatacagatgagctccggaaacttactatttactgggcatttgaaatgcagattacgcatggacaaactacagttaaaaggaatgtcctacagtatgtgcattggaaaatttaagatagtaaaggaaatagccgaaacgcagcacgggacgatagtaatccgtgtacagtatgagggtgatgggtccccttgtaagattcctttcgaaataacagatctagagaagaggcacgtcttgggaaggctgataaccgtaaatcccattgtaacagagaaggatgccccagtcaatattgaggcagagcctccctttggtgactcgtatatcatcgtaggagtggaaccaggacaattaaaattgaattggttcaagaaagggagttcaatcggtcagatgtttgaaacaacaatgagaggagccaaaagaatggcgattttaggggatacagcctgggattttggtagcctgggaggtgtatttactagcataggtaaagctctgcatcaggtattcggcgcaatatatggggcagcattttcaggagtgagttggacgatgaagatcttaataggtgttataattacctggataggaatgaacagtagaagtaccagtttatcagtaagcctagttctagtcggagtagtaactctatatttaggcgctgtggtccaggccgatagtggctgcgtggtaagttggaaaaacaaagaactcaaatgtggctcaggaatctttataacagacaacgttcacacctggacagagcaatacaagtttcaaccggaatcacctagcaaattggctagcgcaatacaaaaagcacatgaagagggtatatgtgggataagatcagtaacccgtttggaaaatttgatgtggaagcaaataacaccggagttaaaccatattctctcagaaaacgaagtgaagttaaccataatgacaggtgatataaaaggcataatgcaagcaggtaaaagatcactcagaccacaaccaacggaactcaagtacagttggaaaacctggggaaaggccaaaatgcttagtaccgaaagccacaatcaaacatttctcattgacggaccagaaactgcggagtgtccaaatactaatagggcttggaactcgctcgaggtagaagactacggttttggcgtctttacgaccaacatatggcttaaactaagggaaaaacaagatgttttctgtgatagcaaattaatgagtgcagcgattaaggataatagagcagttcatgcggatatgggatattggatagaatctgcattaaacgatacatggaaaatggaaaaggcaagtttcatagaggtgaaatcatgtcactggcccaaaagtcatactctttggtctaacggagtattagagagcgaaatgataattcccaagaatttcgccggacccgtgagccagcacaattacagaccagggtaccatacacagacagcaggcccctggcacctcggaaaattagaaatggactttgacttctgtgaaggtacaacagtagtggtgacagaagactgtggtaatcgtggacctagtttacgaacaacaacggcatctggtaagttgatcacagaatggtgttgtaggagctgcacacttcctccgttgagatatagaggagaggatggttgctggtatgggatggaaatacgaccccttaaagagaaagaagaaaacttagtaaacagtcttgtaactgccggacatggacagattgataattttagcttaggagtactcggaatggccttattccttgaagagatgttacgaaccagagtgggaactaaacatgcaacattacttgtagcattatcatttgtgacactaataacaggaaacatgtcctttcgcgatctaggtcgagtcatggtaatggtgggcgcaaccatgacagacgatataggaatgggcgtcacatatttagccttgttagctgctttcaaagtaagaccaaccttcgcagcgggactattgcttcgaaagctaacatctaaagaactaatgatggcaacaataggtatagcattattatctcagtcaacactgcccgaaacgattttggaactgacagatgccctagctctcggaatgatggtcctcaaaattgtgagaaacatggaaaaatatcaacttgcggtgacgataatggcgattagctgcgtaccgaacgcagttattctacaaaatgcttggaaagtatcttgtacaatactagcagctgtttccgtatcgccccttctgttgacttcatcccaacagaaagcggactggataccgctcgcccttacaataaaaggtctcaatccaacggctatattcctaacgaccttatcccgaacatccaaaaagagaagctggccattgaacgaagctattatggcagtcggtatggtcagtatactagcaagctctttacttaaaaacgacatacctatgacagggcctctagtagctggtggactcctcaccgtgtgttacgtcttgacgggaaggtcagcagatttagaacttgaacgtgcagcagacgtcaagtgggaagatcaggcagagatatcaggatcgagcccaattctcagtatcactatatctgaagatggctctatgtcaattaagaatgaagaagaagaacagacacttactattttaatacgtacagggctgttggtaatatcaggcgtattcccggtatccattccaataacggcggcggcttggtacctatgggaggtaaagaaacaacgtgcgggggtactatgggatgtcccaagccctccaccagtgggaaaagccgaattagaggacggtgcatacaggattaaacagagagggatacttggttattcccagatcggagcaggagtctacaaagagggaacatttcatacaatgtggcatgtgacgagaggagctgtcttaatgcataggggtaaaagaatcgaaccaagctgggcagatgtcaagaaagatctaatctcttatggtggtgggtggaaacttgagggggaatggaaagagggggaagaagtgcaagtgctagctctagaacctggcaaaaatccgagagcagtacaaacaaaaccaggaatatttaaaactaacactggaacaataggagcagtttcattggacttttcgccagggacttcaggctctccaatagtagatagaaaaggcaaagttgtaggattgtatggtaatggagtggtaacaaggagtggagcatatgtatcagcaatagctcagacggaaaaatccattgaagacaatcctgaaatagaagacgacattttcaggaaaaagagactgacaataatggacttacacccaggtgcaggaaaaactaaacggtaccttccagcgatagtacgagaagccattaagaggggcctcagaacattaatacttgcacccacacgcgtggtcgctgccgaaatggaagaagcgctaagaggtcttcctattagataccagacccctgcgataagagctgagcacaccggtagagaaattgtagatttaatgtgccatgcgacgttcacaatgcgattactctccccagttagagtgccaaattataacctcataataatggatgaagcacattttactgatcctgcgagtatagcggcacggggatatatatctacacgtgtagaaatgggagaagcagcagggatttttatgactgccactcctcctggttccagagatccatttcctcaatcgaacgcgccaattatggatgaagaaagagaaatccccgagagatcatggaactccgggcatgaatgggttacagatttcaaagggaaaacagtatggttcgttcctagtattaaagcaggtaatgatatcgcagcctgtctaaggaaaaatgggaagaaagttattcaactgagcagaaaaacgttcgactcagaatatgtaaaaactagagcaaacgattgggattttgtagtaacaactgatatatccgaaatgggggcaaattttcgtgccgaacgagtaattgatcccagaaggtgcatgaaaccagttattttgactgatggagaagaacgagtaatccttgcgggacctatgccggtaactcattcctctgcagcacaaaggagaggacgaattggacgaaatcctaagaatgaaaacgatcagtatatatacatgggggaaccattagagaacgacgaagactgtgcacactggaaagaagctaaaatgcttctagacaatattaatactccggaaggaattataccatcaatgtttgaacctgaacgtgaaaaagtagacgctattgatggtgagtacagattacgaggtgaggcccgaaaaacattcgttgacttaatgcgtagaggagatttgcctgtgtggttagcatacagagtcgctgcagagggaattaattatgcagacagaagatggtgcttcgacggaatcaaaaacaatcaaatattagaagaaaatgttgaggtcgaaatttggactaaagaaggagagcgaaagaaactaaaaccccgttggctagatgcacgtatctatagtgacccattagcacttaaagaatttaaggaatttgcggcagggagaaagtctttaacattaaatttgattactgaaatggggagactcccaacttttatgacacaaaaagcacgcgacgcattagacaacctggcagttctacacacggctgaagttggcggtcgggcatataatcacgctctttctgaacttccagaaacgctagaaacattactattactaacgctattagcaactgttacaggaggaatcttcctatttttgatgtcaggaaaaggtataggcaaaatgacgctgggcatgtgttgcataattactgcaagcattctcttgtggtacgcgcaaattcaaccccactggatagctgcatctatcattctagagttcttcctaattgtcttactcattcctgaacccgagaaacagagaacaccacaggacaatcaacttacttatgtagtaatagctatattaactgtcgtcgcagctacgatggccaatgaaatgggctttttggagaaaactaagaaagacttaggattaggcagtattaccacacaagagagtgagtcgaatattttagacattgatctgcgaccagcatcggcatggacactctatgcagtggcgacaactttcgtaacccccatgcttagacacagcatcgagaatagtagtgttaatgtttcactcaccgcaatcgctaatcaggcaactgtcttaatgggactaggccgtggatggccgttgtctaaaatggacatcggtgtaccattacttgctataggctgttactcgcaagtgaatccaataacattaaccgcagcacttctcctattagtggctcattatgcgataattgggccagggttgcaggccaaagctacacgtgaggcgcagaaaagaacagcagcgggtataatgaaaaacccaacagtggacggaattacagtaatagacttagagcctataccctatgacccgaaatttgaaaaacaacttggccaagtgatgctactggtattgtgcgtcacacaagtattaatgatgcgaacaacatgggcactatgcgaggctttgactttagccaccgggccaatctcaacattgtgggaaggaaacccgggacgattctggaacacaaccattgccgtttctatggctaacatattcagaggatcatacttagcaggggctggtctcctattctcaataatgaaaaacaccacaaacacacggcgaggaaccgggaacataggagagacattaggtgaaaaatggaagtctagactaaatgcattaggaaagagtgaatttcaaatttataagaaatcaggaatacaggaagtagatcgaacactcgcaaaagagggtatcaaaagaggagagacagaccatcatgctgtttccaggggctcagccaaactccgctggtttgttgaaagaaacatggtcacgcctgagggaaaagtagttgacctgggttgcggccggggtggctggtcatattattgcggtggactaaagaatgttagagaggttaaagggttaaccaagggtggtcccgggcatgaggaacccattcccatgtcaacatacggatggaacctcgtacgattacaaagcggggtggatgttttctttaccccaccggaaaaatgtgataccttactgtgcgacataggagaaagtagtcctaacccaaccatagaagctggaagaacactacgcgtactaaatctggtggaaaattggttaaataataacacgcaattttgtataaaagtactaaatccctatatgccatcagtaattgagaaaatggaaactttacaaagaaaatatggtggcgcattagttcgaaatcctttgtccagaaattcaacacatgagatgtactgggtatcaaatgccactggtaatatagtgagttctgttaatatgatatcaagaatgctaattaatagatttactatgaaacataagaaggcaacttatgaacccgatgtagatctgggaagtgggacccgtaacataggaatagaatcagaaatcccaaatctagatataataggaaaaagaatagagaaaattaaacaggagcatgagacaagttggcattacgatcaagatcacccatacaaaacatgggcatatcacggttcttacgagaccaagcaaactggttcggcaagttcaatggtgaacggcgttgtaaaactattaacaaaaccatgggacgtggtaccgatggtcacacaaatggcaatgacagacaccacaccatttggacaacagagggtattcaaagagaaggttgacactagaacacaggagcccaaagaaggtaccaagaaactgatgcgaataacagctgaatggttatggaaagaacttggcaagaagaaaacaccgcgtatgtgcacacgtgaagagttcactaggaaagttcgatcgaatgctgcattgggggcaatcttcacagatgagaataagtggaaaagcgcacgagaggcagtggaagatagtagattctgggaactcgtcgaccgggaaaggaacctacacttggaaggaaaatgcgagacatgtgtatacaatatgatgggaaaaagggagaagaaactaggagagttcggaaaagctaaaggcagtagagctatttggtatatgtggcttggtgctaggtttcttgagttcgaagcgctgggatttttgaatgaagatcattggttttctagaggtaactcactgtcgggggttgaaggagaagggttacataggctgggctatatattaagagaagtaggtaagaaagaagggggtgcaatgtatgcagacgacacggcagggtgggacacaagaatcacactggaagatttgaaaaacgaggaaatggtgactaatcatatgaaaggagagcataaaaagttggcagaagcaatttttaaattaacgtatcaaaataaagtcgttcgagtacaaagacctacgcccagaggcactgttatggatataatttccaggaaggatcaaagaggctcaggtcaagtcggaacctatgggttaaacacattcactaatatggaagcccaattaataaggcaaatggaaggagaaggtatctttaaatcaatacagcatctgactgcaacagaggagatcgctgtacaaaattggctagcaagggtaggtagagagagattaagtagaatggcaatttctggcgatgattgtgttgtaaagcccatcgatgataggtttgcatcagcattaacagccttaaatgatatgggtaaagtacgcaaggatattcaacaatgggagcccagtagaggctggaacgactggactcaagtaccattctgctcacaccattttcacgaactcgtgatgaaagacgggagggtcctagtagttccatgccgaaaccaagatgaacttataggcagggcaagaatttcgcagggtgcggggtggagtctaaaagaaacggcttgcctaggcaaatcctatgctcaaatgtggactttaatgtatttccatcgaagggatttacgattagctgcgaatgcaatatgttcagctgtgccaagtcactgggtacctactagcagaactacgtggtccatacatgcgaagcatgaatggatgacaacagaagacatgcttgccgtatggaacagagtgtggatacaagaaaacccttggatggaagataaaacacctgtcgagtcatgggaagaagttccctatctaggtaaacgggaagatcaatggtgcggctcactaatcgggctaacaagtcgcgcaacgtgggctaagaatattcagacggccattaatcaagtacgatcattgattgggaatgaagaatacactgattatatgccatcaatgaaacggttccgacgggaagaagaagaagcaggcgtcttatggtaa

SEQ ID NO: 22620 - RNA, 9876 nt, synthetic construct
  misc_feature 1..9876: note = derived and/or modified CDS sequence (opt6) from DENV-2__EU482727__SS-prME
  source 1..9876: mol_type = other RNA
acagctggtgtaattatcatgctcataccaacggcgatggcattccatctgactacaagaaatggagaaccacatatgattgttggacgtcaagaaaaaggaaaaagtctcctatttaaaaccgaagatggtgttaacatgtgtactttaatggctattgatctcggagaactctgtgaagataccataacatataaatgccctttattgagacaaaacgaaccagaagatatagactgctggtgtaatagtacgtcgacctgggttacgtatggaacctgcactacaactggtgaacataggcgcgagaaaagatctgtagccctagtacctcatgtaggtatgggtctagaaacaaggacagaaacctggatgagttcggaaggtgcttggaaacatgtgcaaaggatagaaacatggatacttagacatcctggatttacgatcatggctgcgatactagcctatacaatcgggactacacatttccagagagcattgatcttcattctcttaacggccgtggctccgtcaatgactatgcggtgtataggaatttccaatagggattttgtagagggcgtttcaggaggttcctgggttgatatcgtgttagaacatggttcctgtgttacgactatggcgaaaaataaaccgactctagacttcgaactgataaaaactgaggccaaacaaccagcaaccctaagaaaatactgtatcgaagcaaaattaacaaacacaaccacagaatcaaggtgtccaacccagggcgagccatcattaaatgaagaacaagataaaagattcatctgcaaacactcaatggtagatagaggatggggcaatggatgcggtctctttggaaaaggaggtatagtaacgtgtgcaatgttcacatgtaagaagaacatggaaggaaaagtcgtattaccggaaaacctagaatatacgatagtgataacacctcactccggtgaggaacacgccgtcggcaatgatacaggaaaacatggaaaagaaattaaaattactccgcaatcatcaataacagaagcagaactcacaggttacgggacagtcacaatggaatgttcaccaaggacaggtttagatttcaacgaaatggttttgttgcaaatggaagataaagcatggttggttcatcgccaatggttcctagatttacctcttccgtggttaccgggcgccgatacacagggatcaaactggatccaaaaagaaaccctagtcacattcaaaaatccgcacgcgaagaaacaggacgtggtagttctagggtcacaagaaggtgcaatgcacaccgcgttgacaggagcgactgaaattcaaatgtcgagcggtaacctactatttactggacatttaaaatgccgactacgtatggataaactacaattaaaaggaatgtcatattcaatgtgtacggggaaatttaaaatagtcaaagagatagcggaaacacaacatgggacgatcgttatcagagtacaatatgagggtgatgggtcaccgtgcaaaataccattcgagataatggatttggagaaacgacacgtactcggaaggttaattactgtgaatcctatcgtaaccgaaaaagattcaccagtcaacatagaagcagagccacctttcggcgattcatatatcataataggggtcgagccaggccaattaaaactaaattggttcaagaaaggctcgagtatagggcaaatgtttgaaacaacaatgagaggagcaaaacgaatggcaatattaggtgacacagcctgggactttggatcgctgggaggagttttcacatcaatcggtaaagcactccaccaagtgtttggggcaatatatggtgcagcttttagcggcgtatcgtggacaatgaaaatattaataggagtaatcataacctggatcggtatgaactcgcgaagtacatcactatcagtcagcctagttctcgtaggagttgtaacactatacctaggagtgatggttcaggcggatagtggttgtgtagtttcctggaaaaataaagagttaaaatgcggcagtggaatttttataaccgacaatgttcacacatggacggaacaatataaatttcagcctgaaagtcccagtaaactcgcatcagcaattcagaaagcgcatgaagaaggaatatgtggcataagatccgtaactagacttgaaaatctaatgtggaaacaaatcacacctgaactcaaccatattctatcagaaaatgaagtcaaactaactataatgactggagatatcaaaggaattatgcaagctggtaaaagatcattaagaccccaaccgaccgagttaaaatatagctggaaaacctggggaaaagcaaaaatgctgagtacggaatcacacaaccaaactttcttaatagatggaccagagactgcagaatgcccaaacactaatagggcttggaactccctagaggtcgaggactatggtttcggcgtttttagtacaaatatttggctaaaattacgagaaaaacaagatgtcttctgcgattccaaattgatgtccgcagcgataaaggataatcgcgcagtacatgcagacatgggttactggatcgaatcagcgctaaacgatacctggaaaatggaaaaggcctccttcattgaagtgaagtcatgccattggccaaaatctcatacactatggtcgaatggcgttctcgaaagcgaaatgataattccgaaaaactttgcagggcccgtatcccaacacaattatcggcctggatatcatacacaaactgcgggtccttggcacttaggcaagctcgaaatggatttcgatttttgcgaaggtacaacagttgttgtaacagaagattgcggaaatagagggccatcccttcggacaacgacagcaagtggaaaattaataacagagtggtgctgtaggtcatgtacactaccaccactaagataccgaggtgaagacggatgctggtacgggatggaaatccgtccattaaaagaaaaagaagaaaatttagttaattccttggttacagcgggtcatggtcagattgacaatttttcactaggcgtgctagggatggcactattccttgaagaaatgcttcgtacgcgtgtaggcacgaagcatgcaattcttcttgtcgccgtgtcattcgtaactttaataactggtaacatgtccttcagagatcttggacgcgtgatggtaatggtaggtgcaacaatgactgatgacattggaatgggtgttacctaccttgcacttctcgcagcatttaaagtgaggcccactttcgcagctggtcttttgctaagaaagctaacaagtaaagagctgatgatggctacgattggtattgcattactaagccaaagtacaataccagaaacaattctcgaattaaccgacgcgttggccctgggaatgatggtgctgaaaatagtgcgaaacatggaaaaatatcagctagccgtaaccatcatggctatcagctgtgtccctaacgcagtaatacttcaaaatgcttggaaagtttcatgtacgattctcgcagcagtatcggtaagtcctttgttgttaacaagtagccagcaaaaagccgattggataccattagcactgactataaaaggcttaaatccaactgccatatttctaaccacactaagtcgaacttccaagaaaaggagctggccgttaaacgaggcagttatggccgtcggcatggtatctatattagctagctcactactaaagaatgacatacctatgacggggccgctagtcgctggtgggttattaacagtctgctatgtattgacaggcagatcagctgatttagaattggagagagcagctgatgtcaaatgggaggatcaagctgaaatcagcgggagttcgcctattttaagtattacgataagtgaggacggaagtatgtcaattaagaatgaagaagaagaacaaacactcacaattttaatcagaaccggcttgctggtaatatctggagtcttcccagttagtatacccataactgcagcggcatggtacttatgggaagtcaagaaacagagagcgggagttctctgggatgtaccgtcaccaccacctgttggaaaagctgaactcgaagatggtgcttacagaattaaacagcgtggaatttttggttattctcagataggagcaggagtatataaggaaggaacatttcacacaatgtggcacgtaactcgcggagccgtgcttatgcatagaggcaaacgaatcgagccatcgtgggcggacgttaagaaagatcttataagttacgggggcggctggaaactggaaggcgaatggaaggagggtgaggaagtacaggtactagcactcgagccaggcaaaaatccgagagcagtgcaaactaagcccgggctatttaaaacgaatacgggcactataggggcagtaagtttagatttcagtcccggaaccagcggatcgccgattgtcgatcgtaaaggtaaggtagtaggactatatggaaatggggtagttactcgaagcggagcttacgtatcagctatagcacaaactgaaaaatcaatcgaggataacccagagattgaagatgacatttttaggaagaaaagattgactattatggacctgcatcctggagctgggaaaacaaagagatatttacctgcaattgtacgtgaagccatcaaaaggggcctaagaacattaattttggcccccacgagagtagtagcagcagaaatggaagaagcactaaggggtttacctatcagataccagacgcctgcaatcagagcagagcatactggcagagaaatagttgatttaatgtgtcatgcgacatttacgatgcgactattaagtccggttcgagttcctaattataatttaatcataatggacgaagcacattttacagacccagctagcatcgctgcaagaggctatatatccacacgtgttgaaatgggagaagctgcaggtattttcatgacagctacaccgccaggtagcagggaccctttccctcaaagtaatgctcctataatggatgaggaaagagaaataccagagagaagctggaactcggggcacgaatgggtaacagatttcaaaggcaagactgtctggtttgtaccttcaataaaagcgggaaatgatatagcagcctgtttaaggaaaaatggtaagaaagttatacaattaagccgcaaaacatttgatagtgagtacgtaaaaacacgggccaacgactgggacttcgtggtcacaactgatatcagcgaaatgggagcaaactttagagcggaacgagttattgacccacgaagatgtatgaaacctgtaatattaactgacggcgaagaacgcgtaatattggcaggtccgatgcccgtaacccattcttccgctgcgcaaaggcgaggaaggataggacgaaaccccaaaaatgaaaacgatcaatacatctacatgggagaaccattagaaaacgacgaagactgtgcctattggaaagaagcgaagatgctcttggacaacataaacacaccagaggggataatcccgtcaatgtttgaaccagaacgagagaaagttgatgccattgatggtgaatacagactaaggggtgaagctcgtaaaacattcgttgacttaatgcgaagaggtgacctccccgtgtggctagcatatagggttgcagcagaagggataaattacgcagatagaaggtggtgttttgacggaataaagaataaccaaatcttggaagaaaacgtcgaagtagaaatatggacaaaggaaggcgaaagaaagaaattgaaacctaggtggctggacgccagaatctattctgatccactagcattaaaagaatttaaagaatttgctgcaggacgaaaaagcctaacgttaaacttaataactgaaatggggaggttaccaacgttcatgacccaaaaggccagagatgccctcgacaacttagctgtgcttcatacagccgaagtaggtgggagggcatataaccacgcattaagcgaattacctgaaacgttggaaacattgttattgttaaccttactagccactgtaactggcggaatcttcttatttcttatgtctgggaaaggaattggtaaaatgacgcttggcatgtgctgcatcattacagcatctatattattgtggtatgcgcagattcaaccccactggatcgctgcatctataatactcgagttcttcttaatcgtgctgttaattccagaaccagaaaagcagcgaacgcctcaagataatcaactgacttatgtagtgattgcaatactaacagttgttgcagcaactatggccaacgagatgggattccttgagaaaactaagaaagacctaggtctaggatcaataacaacacaagaatccgaatccaatatattagatatagacctaaggccggcctcagcatggaccctctacgcagtagcaacgaccttcgttacacctatgctgagacattctatcgaaaatagcagtgtcaatgttagtttgactgcaattgctaaccaagccactgtgttaatgggactaggacgaggttggccactgtccaagatggatataggagtgccacttctcgcaattggatgttactcccaggttaacccaataaccttaaccgccgccctgttactattggtagctcattacgcaataatcggtccaggtctgcaagcaaaagcaacacgcgaggcccagaagagagcagcagctggtattatgaagaacccaacagtcgatggaatcactgttatcgatctcgaaccaataccgtacgatcctaaatttgagaaacagcttggtcaggttatgctgttagtactctgtgtaacacaagtgctaatgatgagaactacatgggccctttgtgaggcactgacattagcaactggtccgattagcacattatgggaagggaatcctgggcgtttctggaacacgacaatcgcagtaagtatggcgaatatatttaggggttcttatcttgcaggcgcggggcttctgttttcaattatgaaaaatacaacaaacaccagacgagggactggaaatattggagaaacgttgggtgaaaaatggaaaagtagactaaatgcgttaggtaaaagcgaatttcagatttacaagaagtccggaatacaagaggtagatagaacattagctaaagaaggaattaaaagaggcgagaccgatcatcatgcagtgagtcgcggatctgcaaaattacggtggtttgtggaacgaaatatggtgacgccggaaggaaaagtagtagacttaggttgtggaagaggaggttggagttattattgcggaggtttaaagaatgtacgagaagtaaagggtttgacgaaaggagggccaggccacgaagaacctatccctatgagcacatatggatggaacttagtgaggttacaatctggagtagacgtatttttcactcctccagaaaagtgcgacaccctcctatgtgacatcggtgaaagttcccctaatccaacaattgaagctggtagaacattaagagtattgaatctagtagaaaattggctaaacaacaacactcaattctgtataaaggtattaaatccgtatatgcctagtgttatagagaaaatggaaacgttacaacgtaaatacggaggggccctagtaaggaatccattaagtcgaaattcgacacatgaaatgtactgggtttctaatgcaacagggaatattgtctcaagtgtgaacatgattagtaggatgctaattaaccgattcactatgaaacataagaaagccacctacgagccagatgtcgatctgggctctggtacaagaaatataggcatagaaaatgaaattcccaatttggacataataggtaaaagaattgagaagattaaacaagaacatgaaacttcatggcattacgaccaggatcatccatataaaacatgggcttatcacggatcttacgagacaaaacaaacgggatctgcatcatcaatggttaatggagttgttcgattgcttacaaaaccatgggacgttgtgccaatggttacccagatggcgatgactgacactacgcctttcggacaacaaagggtatttaaagagaaagttgacacaaggacccaggaacccaaagaagggaccaagaaacttatgaggattacagccgaatggttatggaaagagctcggcaagaagaaaactccgcgaatgtgcacgagggaagaatttacgagaaaagtgagatcaaatgctgctttaggagctatatttacggatgaaaacaagtggaaatccgcccgagaagctgtcgaagactcgcgattttgggaattagttgatagagaacgcaacctccatttagaaggaaaatgcgagacctgtgtgtataatatgatgggaaaaagagagaaaaagctaggagagttcggaaaagctaaaggatcaagagctatttggtacatgtggttaggagcacgtttcctagagttcgaagcgttaggttttctaaacgaagaccactggttttctcgaagaaatagtctgtcaggagtggagggtgaagggttgcataaattggggtacattctgcgcgatgtaagcaagaaagaaggaggtgctatgtacgcagatgatacggccggttgggacacaaggattacattggaagatcttaaaaacgaagaaatggttacgaaccacatgaaaggcgagcataagaaactagcggaagcaatatttaagctaacctatcaaaacaaggtcgtacgtgttcaaaggccaacacccagaggtaccgtgatggacataatatcaaggaaagatcagagaggaagtggacaggtgggtacatatggacttaacacatttactaacatggaagcgcagctcattcgacagatggagggtgagggaatttttaagtcaatccagagactaacagttacagaagaaattgccgtccaaaattggttggcgagggtaggaagagaaagattatcccgaatggctatttcaggcgacgattgtgtggtgaaaccccttgatgatcgttttgccagtgcacttactgcactaaatgacatgggaaaagtacgtaaagatatacaacaatgggaaccgtcaaggggttggaatgattggacacaagtaccattctgttcacatcattttcacgaattagttatgaaagacggaagagtactggtcgttccatgccgtaaccaagatgagctaattggacgtgccagaatttcccaaggagctgggtggagcttgaaagaaacagcttgtctggggaaatcatatgcgcaaatgtggacattaatgtatttccacagacgtgatctgagactagcggcaaatgctatatgttcagctgtgccatcgcactgggttcccacaagtaggacaacatggagcatacatgctaaacatgaatggatgacgacagaagacatgcttgcggtatggaaccgtgtctggatacaagaaaacccttggatggaagataagactccagttgaaagctgggaagaagtgccttatttgggaaagcgcgaagaccaatggtgcggttctttgatcggactcacaagcagggcgacctgggctaaaaatatccaaactgcgataaaccaggttagaagtctaattggtaatgaggaatataccgattatatgcctagtatgaaaaggtttagaaaagaagaagaagaggcgggtgtattatggtaa

SEQ ID NO: 22621 - RNA, 9876 nt, synthetic construct
  misc_feature 1..9876: note = derived and/or modified CDS sequence (opt6) from DENV-2__EU482728__SS-prME
  source 1..9876: mol_type = other RNA
actgctggtgtaattataatgctaataccaactgcaatggcattccacttaacgacacgaaatggagaaccacatatgatagttggaagacaagaaaaaggtaaaagcctgctattcaaaacagaagatggggtaaatatgtgtacattgatggccatcgacctaggcgaactgtgcgaagatacaataacttataaatgtccactactaaggcaaaatgaacctgaagatatagactgctggtgcaactcaacatccacatgggttacatacggaacatgcacaacaacgggtgaacatcgtcgcgagaaaagaagcgttgcgctagtgccacacgttggaatggggttggaaactcgaactgaaacatggatgtcttcagaaggcgcttggaaacatgtccaaaggattgagacatggattcttcgtcatccaggattcacaatcatggccgcgatactggcttacacaatcggtaccacacacttccaaagggcattaattttcattttactaacagctgtggctccgagcatgacaatgagatgtattggtatctcaaacagagacttcgttgagggagttagcggaggttcttgggttgacattgtgctggagcatgggtcatgtgtaacaacaatggctaaaaataaaccgactctagattttgaactcataaaaacggaagcgaaacaaccagctacattgagaaaatattgtatcgaagccaagctgacgaatacgacgacagaatctcgttgtccaacacaaggggaacctagtttaaacgaggaacaggacaaaaggtttatctgtaaacactctttggtagacagaggttggggtaacggctgcggattgttcggcaaaggcggaatagttacatgcgcaatgttcacatgtaaaaagaacatggagggaaaggtcgtgctccccgagaacttagaatatactattgtgataacaccccattcaggtgaggaacatgctgtaggaaatgacactggaaaacatggaaaagaaataaaaataacaccacagtcatcaataacagaagcagaattgactggatatggtacagtaaccatggaatgtagccctcgaactggccttgacttcaacgaaatggtactactacagatggaggataaagcgtggctggtgcatcgccaatggtttctagaccttccccttccgtggttgccaggtgcagacacacaaggatctaactggatacaaaaggaaacattagtaacctttaaaaatccccacgcaaagaaacaagacgtagtagtattgggtagtcaggaaggtgctatgcacactgctttaaccggagctacagaaattcaaatgtcaagcggtaatttactctttactggacatctaaagtgtcgactgaggatggataaattacaattaaagggcatgagctatagcatgtgtactggcaaattcaaaattgtaaaagaaattgctgaaacacaacatggaacaatagtcataagagtacagtacgagggcgacggatcaccttgcaaaataccttttgaaataatggatctagagaaaaggcacgtattaggaagattaataactgttaatcctatagtcacggagaaagatagccccgtaaacatagaagctgagccaccattcggtgattcgtatatcatcattggcgtagaaccgggacaattgaaattaaattggttcaaaaagggctcaagcattggccaaatgtttgaaacgactatgaggggtgcaaaaagaatggctatcttgggggatacagcatgggattttggatccctaggtggtgtgtttaccagcataggaaaagcactacatcaagtttttggcgccatatatggagcagctttttctggagtgtcgtggactatgaaaatcctaattggggtcataatcacgtggataggaatgaacagtcgatcaacatcattaagtgtttctctagtacttgttggagttgtcactttgtatttaggagtaatggtgcaagctgattctgggtgtgtggtatcctggaaaaacaaagaattaaaatgtggcagtggaatctttatcaccgataacgtacatacttggactgaacaatacaagttccaaccggaaagcccctcaaaactagcaagtgcgattcagaaagcacatgaggagggcatatgtggaataagatctgtaaccagactggaaaatcttatgtggaaacaaatcacgccagaattaaatcatattttatccgaaaatgaagtgaagttgactataatgacaggcgacataaagggtataatgcaagctggaaaacggagtctacgaccacagccaaccgagctaaaatatagttggaaaacatggggtaaggcaaaaatgctatcgacagaatcacataaccaaacgtttttaattgatgggcccgaaacagcggaatgtccaaacacgaatcgtgcatggaatagcctggaagtagaggactatggatttggggtattttcgaccaatatatggctgaaactcagagaaaaacaggatgtcttctgtgattcgaaacttatgtcagctgctataaaagataatagagctgttcatgctgatatgggatattggatagagtcagccttaaatgatacgtggaaaatggaaaaagctagttttatagaagtgaaatcatgtcactggccaaaatcacatacactgtggagtaacggagtactagaatcagaaatgattattcccaaaaacttcgcaggaccggtgagccagcataactacagacccgggtaccatacccaaacagccgggccctggcatctggggaaattagaaatggactttgatttttgtgaaggcactacagtcgttgttacagaagattgtggtaatcgtggtcctagtttaagaacaacgacagcaagtggaaaactaatcactgaatggtgttgcagatcttgtacactacctccattacgttacagaggagaggacggatgttggtacggtatggaaattaggcctttaaaagagaaggaagaaaatttagtgaactcgctagtaactgcgggacatggacaaatagataacttttcgctaggtgttttaggtatggccctatttctagaagaaatgctgcggacaagagtaggaacaaaacacgcaattttacttgtagctgtatctttcgtgacattgataacggggaatatgtcctttcgcgacctcggaagggtaatggtcatggttggcgccaccatgacagatgatatcgggatgggagtaacgtatctagcattactcgcagccttcaaagtaagaccaactttcgcagcaggcctattgttgaggaaacttacatctaaggagctcatgatggccaccattggtatagcattactgtcacagtctaccatacccgaaaccattctagaactgacggatgccttagccttaggtatgatggtattaaaaattgttcgtaatatggagaaatatcagttagccgttaccattatggcaataagctgtgtgcctaacgctgttatcctacagaatgcgtggaaagtctcatgtacaatactggcggcagtttccgtatcacctctacttctcacatctagccagcaaaaggccgactggattccgctggctttgaccatcaaaggattaaatccaacagcaattttcctcaccactttaagtcgaactagcaagaaaagatcatggcccttaaatgaggccgtaatggctgtcggaatggtgtcaatattagcttcctcactgttgaaaaatgacatacctatgaccggtccattagttgcaggaggactactcacagtttgttatgtcttaactggccgtagtgccgatcttgaattagaaagagcggcagatgttaaatgggaggaccaagcagaaatatctgggtcgagtccaatattatccataacaattagtgaggacggatcaatgtcaatcaaaaacgaagaggaagaacaaaccttaaccatactaatacggacaggattgcttgtaatcagtggtgttttccccgtaagcatccctataacggcagctgcctggtacttgtgggaagtcaagaaacaaagggcaggcgtgctgtgggatgtacctagtccaccacctgttggcaaagccgaattagaggacggggcttatagaataaaacaacgtggcattttcgggtacagccaaattggcgcaggagtttataaggagggcactttccatacaatgtggcacgttactagaggggccgtgctcatgcacaggggcaaacgcatagaaccttcatgggcagacgtcaagaaagatttaatttcgtatggtggtggctggaaactagagggtgaatggaaagaaggagaagaggtacaagttttagccctagaacctggcaaaaatcccagggccgttcaaacgaaaccaggactatttaaaaccaatactggaacaatcggggctgtttcgttagactttagtccaggaacttcaggttcaccgattgttgatagaaaaggcaaagttgttggactctacggtaatggggtggtaacgagatctggtgcgtacgttagtgcgattgcccaaaccgaaaagagtatagaagataacccagaaattgaagacgacatattccgaaagaaaaggctgacaattatggatctgcatcccggtgcgggaaaaacaaagagatatttaccagccatagtcagggaagctattaaacgaggactcagaacactaatactcgccccaacccgggttgtggcggcagaaatggaagaagcattgcggggtctgccaataagataccagacgccggcaataagggcagaacacactggccgggaaattgtcgatttaatgtgccatgccacattcacaatgagacttttatcaccggtaagggttccaaactacaatttaataataatggacgaagctcatttcacagatccagcaagtatagccgcacgtggttatatttcaacaagggttgaaatgggggaagcagcaggaatctttatgacagcaaccccgcccggttctagagatccattcccacaatcgaatgcgcccattatggacgaagaaagagaaattccagaaagaagttggaactcagggcatgagtgggtgacggacttcaaaggaaaaactgtctggttcgtaccctcgatcaaggcaggaaatgacatagccgcgtgtttacgcaaaaatggaaagaaggtaatacaactgtcacgaaaaacgttcgactctgaatatgtcaaaacacgcgccaatgattgggactttgtagtgaccacagacatctcggaaatgggtgctaactttagagcagaacgtgtcattgacccgagacgatgcatgaagccggttatattgacggatggtgaagaaagggtgatacttgctggaccaatgcctgttacacactcgtccgcagctcaacgaaggggtagaataggacggaacccaaagaatgaaaatgaccagtacatttatatgggagagcctctagaaaatgacgaagactgcgcacactggaaagaagcaaaaatgttactcgataacataaatacaccagaaggcatcataccgagtatgtttgaacctgagagggaaaaagtagacgctattgacggcgaatataggttacggggtgaagctagaaaaacttttgtagacttgatgcggcgaggcgatttacccgtttggctagcgtacagagtggccgcagaaggaataaactatgctgatcgtcgctggtgttttgatggaatcaaaaacaaccagatcctagaggagaatgttgaagtagaaatttggaccaaagaaggtgagaggaaaaagctcaaaccacgttggttagacgcgcgcatttattctgatccattggcactgaaagagtttaaggaatttgcagctggtcgcaaaagccttactttaaacttaataaccgaaatgggaagactgccaacatttatgactcaaaaggcccgcgacgctctagacaatctggcagttttacacacggcagaagtaggagggagagcctataatcatgcattgtcggagttaccagaaaccctagaaacattactgctattaactttacttgcaaccgttaccggagggatatttttattcctgatgtccggaaagggcattggtaaaatgacacttggtatgtgttgcataataaccgcatcaattctactatggtatgcacagattcagcctcactggattgccgcaagcataatcctagagtttttcctaatagtgttattaatacccgaaccagaaaagcaacggactcctcaagacaaccaacttacgtacgttgtaattgcaatacttacagttgttgccgcaactatggctaacgaaatgggatttttggaaaagactaagaaagatctcggacttggttcgataacaacccaagaatctgaatcaaatatactcgatatagacctacggccagcatcagcctggaccctttatgcagttgcgacaaccttcgtgactccgatgcttcgacactccatagaaaactcctctgttaacgtgagccttaccgcaatagcaaatcaagcaaccgtgttgatgggtctcgggcggggttggccgttaagcaaaatggacataggtgtacctttactagctatcggatgttacagtcaggtgaatccaataacattaacagcagcattactgttgttggtagcacattacgctataataggaccggggctgcaagcgaaggccacacgcgaagcccagaaaagagccgctgctggaattatgaaaaatccaacagtggacggcataacagtgatagatttagaaccgataccttacgatcctaaatttgagaagcaacttggccaagtcatgttattagtcctttgtgtgactcaagttttgatgatgaggacaacatgggcactatgcgaagcactaacactagcgacaggaccaatttcaaccttgtgggaaggaaatccaggcagattttggaacacaactattgcggtttctatggcaaatatctttcgaggatcctatctagccggagctggattattattcagtataatgaaaaataccacgaacacaagacgaggaacgggcaacataggagagactttaggagaaaaatggaaaagcaggcttaatgcgctaggaaaaagtgagttccagatctataagaaatcaggtatccaagaagtagacagaacattggcaaaagaaggaataaaaaggggtgagacggaccatcatgcagtgagtcggggtagtgcaaaacttcgatggtttgtggaacgtaatatggtcacgccagagggcaaagtagtagatctagggtgtggaagaggtggatggagctactattgcggaggccttaaaaacgtaagagaagtaaaaggcctaacaaaaggtggtcctggacatgaggaacctataccaatgtcaacgtatggatggaatttagtaagattacaatcaggggtcgatgtatttttcaccccaccggagaaatgtgacacgctcttatgcgacattggagagtcgagcccaaaccctacaatagaagccggacgtacactgcgtgtgctcaatctcgtagaaaattggttaaataataatactcaattttgtattaaagtattaaacccatacatgccaagtgtcattgaaaagatggaaaccctacaacgaaaatacggaggagcattggtaagaaaccctttaagtagaaattctactcacgagatgtattgggtatccaatgctactggaaatatcgtctctagtgtaaacatgatctccagaatgcttatcaatagatttaccatgaagcacaagaaagccacttacgaaccggatgtcgatttgggatcaggcacccgaaatattggaatagaaaatgagattccaaatttagacattataggaaagagaattgagaaaataaaacaagaacatgaaacatcctggcattatgaccaggaccatccgtataaaacgtgggcgtatcacgggagctacgaaacaaaacagacggggtctgcttcaagtatggtaaacggtgtagtaagactcctaaccaaaccgtgggatgttgttccaatggtaactcagatggcaatgactgatactactccatttggtcaacaacgagtatttaaagagaaggtcgacactcgtacacaggagcccaaggaaggaaccaagaaattaatgaggataacagcggaatggttgtggaaagaacttgggaaaaagaaaaccccaagaatgtgcacaagagaggaatttacacgaaaagtaagaagcaatgcagcactaggggcaatcttcacggatgaaaataagtggaagtctgcaagagaagctgtagaagatagccggttctgggaacttgttgatagagaacgcaatctacatttggaaggcaagtgtgaaacttgtgtatacaatatgatgggaaaaagggaaaagaagctaggagagttcggcaaagcaaagggaagcagagcaatatggtatatgtggcttggtgccagatttctagaatttgaagcattaggttttctaaatgaggatcactggttctcaaggggtaattctttgagcggggtggagggagaaggacttcataaacttggctatattcttagagatgtgtctaagaaagagggaggtgccatgtacgcagacgatactgcaggatgggatacccgcattacattagaagatctcaaaaatgaggagatggttacaaatcatatgaaaggagaacataagaaacttgcagaagcgatatttaagttaacataccaaaataaagttgtaagggtacagcgcccaacaccacgaggaacagtgatggatattatttcccgaaaagatcaacgaggctcaggacaagtggggacctatggtttgaacacgtttaccaacatggaagcacagttaataaggcaaatggaaggagaagggattttcaagagcatccaaagactcaccgtgacagaggaaatcgcagtgcaaaattggctagcaagggtcggacgagaaagattgtcaagaatggcaatttctggtgacgattgtgtagtcaaacccttggatgaccgttttgcttctgccttaaccgccttaaatgacatgggaaaagtaagaaaagacatacaacaatgggaaccctctagaggatggaacgactggactcaggtaccattctgcagccatcattttcatgaattagtaatgaaggatggtcgagtgctagttgtaccgtgtcgaaatcaggatgagcttatagggcgcgccagaattagtcagggtgccggatggtcgttaaaagaaacagcgtgtcttgggaaatcttacgcgcaaatgtggaccttaatgtactttcacagaagagacttaagacttgcagcgaatgccatttgcagtgcagtcccaagccattgggtcccaacctccaggactacatggtcaatacacgccaagcatgagtggatgacaactgaagatatgctagcagtatggaaccgggtatggatacaagaaaatccgtggatggaagataaaactccggtagaatcctgggaagaagtgccttatttaggcaaacgtgaagatcaatggtgtggatctctaattggattaacgagccgagctacttgggctaaaaatatacagacagcgatcaatcaagtacgatctctgattggcaacgaagaatatacagactatatgccctcaatgaagcgatttagaaaggaggaagaagaggctggtgtattgtggtag

SEQ ID NO: 22622 - RNA, 9876 nt, synthetic construct
  misc_feature 1..9876: note = derived and/or modified CDS sequence (opt6) from DENV-2__EU482729__SS-prME
  source 1..9876: mol_type = other RNA
acagctggagtaatcattatgttaattccaacagcgatggcatttcatttaactactcgaaatggtgaaccgcatatgatagttggaagacaagaaaaaggaaaatcgctactctttaaaacagaagacggtgtaaatatgtgtacactaatggcgatcgacttgggagaattatgtgaagacacaatcacatataaatgtcccttgctacgtcaaaacgaacccgaagacatagattgctggtgtaatagcacaagtacatgggtaacatatggcacatgtacaaccacaggggaacaccgccgtgagaaaagaagtgtagcattagtaccacatgtaggaatgggattagaaacgaggaccgaaacgtggatgtcatcagaaggcgcatggaaacatgtacaacgaattgaaacctggatactaagacaccccggatttacgataatggctgctatactagcatacacgattggaacaactcattttcagcgtgcactaattttcatcttgttaacagccgtagctccctcaatgacaatgagatgtataggaatctcaaaccgcgattttgtagaaggcgtgtcgggaggaagttgggtagatatagtacttgaacacggatcatgcgttacaactatggcgaaaaataaaccaactctagactttgaattaataaaaactgaggccaaacagccagccacattaagaaaatattgcatagaagcgaaactaactaatactactaccgaatccagatgtccaacacagggagaaccgtcattaaacgaagaacaagacaaacggttcatatgtaaacacagcatggttgatagggggtggggcaacggatgtggattatttggtaaaggaggaatcgtaacatgtgcaatgttcacgtgtaagaaaaatatggagggaaaagtagtattaccggagaaccttgaatatactatagtgattacacctcactcaggagaagaacacgcagtagggaacgacacaggaaaacatggcaaagaaataaaaattacaccccagtcatctataaccgaagctgagttaactggttacggaaccgttactatggaatgctcacccaggacgggactagatttcaatgaaatggtccttttacaaatggaggataaagcctggttagtacaccgacagtggttcctagaccttccacttccgtggttaccaggagccgatactcaaggctcaaattggatccaaaaagaaactctagtaacctttaaaaatccgcacgctaagaaacaagacgtcgttgtgctcggaagtcaagaaggagctatgcacacggcactgacaggagccactgaaatccaaatgtcgtcgggtaacctattatttactggacacctcaaatgtagattgagaatggataaactacaattaaaagggatgtcttatagtatgtgtaccggaaaatttaaaatagttaaagagatagccgaaacacaacacggtacaatagtaatacgagtacagtacgagggagatgggtcaccttgtaaaatcccattcgaaataatggatctcgaaaaacggcatgttttaggaagattgataacggtgaatccaattgtaacagagaaagattcacccgttaatatagaagctgaaccaccctttggtgactcgtacataatcattggagtagagccaggccagctcaaactaaactggtttaagaaaggcagcagcatcggtcaaatgtttgaaacaactatgagaggcgccaaaaggatggcgatattaggtgatacagcatgggacttcggtagtctgggtggagtatttacatcaataggtaaagctctacatcaagtcttcggtgctatatatggagccgctttttcaggggtcagttggacaatgaaaatattgattggagtaattattacctggatagggatgaactcacgctcaacatcgctctcggtcagtttagtgttagtaggagtggttacattgtatcttggtgtgatggtacaagctgactctggatgcgtagtttcatggaaaaataaagaattaaaatgcggaagtgggatttttataactgataacgttcatacgtggactgaacaatacaaatttcaacccgaatcaccgagcaaattagctagcgcaatacaaaaagcacatgaggagggaatttgtggaattagatcggtaacaagacttgagaatctgatgtggaaacagattacgccagaattaaaccatatattgagtgagaatgaagtcaaattaacaatcatgacaggagaaataaaaggaataatgcaggcgggcaaaaggagcttacgtccacaaccaactgaattaaaatattcatggaaaacttggggcaaagcgaaaatgctcagtacagaatcgcacaatcaaacattcttgatagatgggccagagaccgcggaatgcccaaacaccaatagagcgtggaactcgctagaagtagaggattacggctttggtgtattttcaacgaacatatggctaaagctaagagaaaaacaagatgtattttgtgatagtaagctgatgagtgccgcaattaaagataatagagctgtacatgcggatatgggttactggatagagagcgcgctaaatgatacatggaaaatggaaaaggcgtcattcatcgaagtaaaaagttgtcattggcccaagtcccatacactttggtcaaacggagtattagaatctgaaatgattataccgaaaaacttcgctgggcctgtaagccaacataattatcgacctggctatcatactcaaattgcgggcccatggcatttaggcaaacttgaaatggattttgatttttgcgaagggaccacagtagtcgtaactgaagattgtggcaatagaggtccatcactgaggaccacaacggcctcaggtaagttgattacagaatggtgttgccgaagctgtactctgccacccttaagatatcgtggcgaggatgggtgttggtatgggatggaaatacgccccttaaaagagaaagaggaaaaccttgttaattcattagtaactgccggacatggacaaatagacaatttctctctaggggttctcggaatggcattattcctcgaagaaatgttgcgaacgagggtcggaacaaaacacgctatactactgatagctgtcagttttgtaaccttaatcacgggtaatatgagttttcgggatctaggaagagtaatggtaatggtaggagcaacaatgactgatgatattggaatgggagtaacctacttagccctactcgccgcattcaaagttcgtccaacattcgccgcaggacttttacttcgtaaactaacatctaaagagctgatgatggctacgattggaatagccttgctttcacagtctacaattcctgaaaccatattagaattaacagatgcactcgccctcggcatgatggtcttaaaaatagtaagaaatatggagaagtaccaactagcagtgaccatcatggcaatctcgtgtgtaccgaatgcagtgatactacaaaatgcttggaaagtctcatgcacaatattagcggcagttagtgtgagtccattattattaactagctcacagcagaaggctgattggatccccctggctctcacgataaaaggactaaatcccaccgctatatttctcacaacattgagtcgtacatccaagaaaagatcatggccgctaaacgaagctgtaatggcggtgggcatggtaagcatattggcttcgtcattactcaaaaatgatatccctatgactggtccactggtagcaggaggtttattaacagtatgttatgtgctcacgggtaggagcgctgatctagaattagaaagagcagccgatgtcaaatgggaagaccaagcagaaatctcaggtagtagtcccattctaagcataacaatatcggaggatggatcaatgagtatcaaaaatgaagaagaagaacaaacactgacaatactgatacgtacaggtctcctagttatcagtggcgtatttccggtatcaattccaatcactgcggcagcatggtatctctgggaagttaagaaacaaagagctggtgtgctctgggatgtcccgagcccacctcctgtaggtaaagcagaattagaggatggcgcatatagaatcaaacagcggggtatatttgggtattcacaaataggagctggtgtatacaaggaaggcacatttcatacaatgtggcatgtgacacgtggcgcagtcttaatgcatagaggtaagcgtatagagccaagttgggcagacgtcaagaaagatttaataagttacggaggtggatggaaactcgaaggagaatggaaggaaggagaagaagtacaagtcttagctttagaaccaggaaagaacccaagagctgtacaaaccaaaccgggactattcaaaacaaacacagggacgataggagcagtatccttggacttttcacctgggacatcggggtcgcccatcgttgacagaaaaggaaaagtggtaggtttgtatgggaacggggttgtaaccagatcaggcgcatatgtatcagcaatcgcacaaacagagaaaagtattgaagacaatcctgagatagaggatgatatctttagaaagaaacgcctaacaataatggacctacaccctggagcaggcaaaactaaacgatacttacccgcgatagtgcgagaggcaataaaaagaggtcttagaacattgattttagcgccaacaagagtagtagccgccgaaatggaggaagcgttaagagggctccctatcaggtatcaaacccctgcgatcagagctgaacatacaggacgagaaatagtggacttaatgtgtcatgcaacttttacaatgcggctcctctcaccagttagagtccctaattataacttaataataatggacgaagcacattttaccgatcctgcatctattgcggctcgaggatacatatcaacacgggttgagatgggtgaagctgctgggattttcatgacagcaactcctccaggatctagggatccctttccacagtcgaacgcacctattatggacgaggagagagaaatcccagagcgcagttggaactcagggcatgagtgggttaccgatttcaaaggaaaaacggtctggttcgtacccagtattaaagctggcaatgatatagccgcatgcttaagaaagaatggtaagaaagtcatccaattatcgagaaaaacatttgacagcgaatatgtgaaaacaagggcaaatgattgggactttgtagtaacaacagatatatcagaaatgggtgccaatttcagagctgaaagagtgatagaccctcgaagatgcatgaagcccgtaattttaacggatggagaagaaagagtaattctggcaggaccaatgcctgttacacactcatctgcggcccaaaggcggggaagaataggacgcaatcccaaaaatgaaaatgaccagtacatatacatgggagaacccctagaaaacgacgaagactgcgcttattggaaagaggctaaaatgttattagacaatataaataccccagagggtataatacccagtatgttcgagccagaaagggagaaggtggatgcgatagatggtgaatatagactacgtggcgaggcaaggaagacatttgtcgacttgatgagaagaggagacttaccagtatggttagcctacagagttgctgcggaaggtataaactacgccgatcgtcgctggtgtttcgatggtataaagaacaaccaaattttggaggagaacgttgaagttgaaatttggacaaaagaaggtgaacgtaagaaactaaaaccccggtggttagacgcaagaatttattcagacccattagctcttaaagaatttaaggagttcgccgcgggacgaaaaagtctcactttaaatctgataacagaaatgggcagactgccaacttttatgacacaaaaggcaagggatgccctggacaatctagctgtcttacacacggcggaagtcggtggacgcgcatataatcatgcgttaagtgaactcccagaaacgttagagacacttctcttactaactttactagctacggtaacgggcgggatcttcttgttcttaatgagtggcaagggaattgggaaaatgaccctaggtatgtgctgtataatcacagccagtatactattatggtatgcacaaatacagccacattggatagctgcatctataattctagaatttttcttaatagttttgttaatccctgagccagaaaaacaaaggactcctcaagataaccaattaacatatgtagtaattgctattctaaccgtggtagcggctacgatggcaaacgaaatgggatttctagagaaaaccaagaaagatctcgggttaggttcaattactacacaagaatccgaatcaaatatacttgatatcgacctaagacctgcaagtgcctggactttatacgccgtcgcaaccacctttgtcacaccaatgctgcgtcactccatagaaaattcctctgttaatgtcagtttaacggctatagcaaaccaagctacagtactaatgggactaggaagggggtggccattgtctaagatggacataggcgtacctctgttagctataggatgctatagtcaagttaatccgataacattaactgccgcattactactcctagtagctcactatgcgataataggtcctggcttacaagctaaggccactcgagaagcccaaaagcgagctgcggctgggataatgaaaaatcccactgttgacgggattacagtcattgatctagaacctataccctacgacccaaaattcgaaaaacaattagggcaagtgatgctacttgttctatgcgtcacgcaagttttaatgatgcgcaccacctgggctctctgtgaagcgctgacattagcaaccggaccaatttctaccctttgggaaggaaacccgggccgcttttggaatactaccatagcagttagtatggcaaatatttttagaggcagctaccttgctggcgctggacttttattttcaataatgaagaacacaacaaatacccggaggggtacaggcaatacgggcgagacattaggagaaaaatggaaatccagattaaacgcactaggcaaaagcgaatttcagatatacaaaaagtctggtatccaagaagttgatagaacgcttgcaaaggagggtataaaaagaggcgagacggaccaccacgcagtatcacgaggatctgcaaaactaagatggtttgtcgagaggaacatggtgacgccggaggggaaagtcgttgatttagggtgcggtagaggtggatggagctactattgcggaggtcttaaaaatgttagggaagtaaaaggtttgactaaaggcgggcccgggcacgaagaacctatacctatgagcacgtacggatggaatctagtacgtctgcaatcaggtgtagacgtcttctttacaccacccgaaaagtgtgacacattgttgtgtgacattggcgagtcgtcaccaaatcccacaatagaagcaggcagaacactacgtgtattaaatttggtagaaaactggctaaacaacaatacccaattttgcataaaagtcttaaacccgtatatgccttcagttatagaaaagatggagaccctacagagaaaatatggaggggcgcttgtgcggaatccattatctagaaattcaacacatgagatgtattgggtcagcaatgcgacaggaaacatcgtatcctccgtcaacatgatcagtcgaatgctaataaatagattcacaatgaagcataaaaaggcaacatacgaaccagatgttgacctgggaagtgggacaaggaacataggcattgaaaatgagatcccaaatcttgacataatcggaaaaaggatagaaaagataaaacaagaacatgagacgtcctggcattatgaccaagaccatccctacaagacttgggcgtatcacggaagttatgaaactaaacaaacgggaagtgcatcttcaatggttaatggagtggttcgattgcttactaagccatgggatgtcgtaccaatggtcactcaaatggctatgacagatacaacaccttttggacaacaacgtgtatttaaagaaaaagtggatacacgaacgcaagaaccaaaggaagggaccaagaaactgatgcgcattaccgcagaatggctctggaaagagctaggcaagaagaaaacaccaagaatgtgtacacgagaagagtttactagaaaagtaagatcgaatgcggcactaggagcaatatttaccgatgaaaacaaatggaaaagcgctagggaggcagtagaagattctaggttctgggagctagttgacagagagagaaatcttcacttggaaggtaaatgcgaaacgtgtgtatataatatgatgggaaaacgagagaagaaactgggagagttcggaaaagcaaaaggctcacgagccatatggtatatgtggcttggcgcacgatttttagaatttgaagcactaggatttctaaacgaagatcactggtttagtagacgaaactccctttccggcgttgaaggagaaggactccacaaactcggctacatacttagagatgtatcgaagaaagaaggtggtgctatgtatgcagacgatacagcggggtgggacactagaatcacactagaagatcttaaaaatgaggaaatggtcacaaatcacatgaagggggaacataagaaactcgcagaagctatttttaaactaacgtatcaaaacaaggtggtaagagtacaacgaccaacacctaggggaactgtcatggatataataagccggaaagatcaaagagggagcggccaagtaggtacttatgggctcaatacatttaccaacatggaagcgcaactgatacgccaaatggaaggtgaagggatattcaaaagcattcagagattaacggtgaccgaagagatagctgtacagaattggcttgccagagtcggacgagaacgacttagtagaatggcgatatcgggggatgattgtgttgtcaaacctttagacgatcgtttcgcttctgctcttacagcattaaacgacatgggaaaagtgaggaaagatattcagcagtgggagcctagccgaggctggaatgattggactcaggttcccttctgtagtcatcatttccacgagctagttatgaaggacggaagggtcctagtggtaccatgtagaaatcaggatgaactgatcggtagagcacgaataagtcaaggagcgggttggtctttaaaggaaacagcctgtctcggtaagagctacgcacaaatgtggacactaatgtatttccatcgtcgagacttacgactcgcagccaatgcaatctgttcagccgtaccctcacattgggtgcccacaagcagaactacgtggtcgatccatgctaaacatgaatggatgacaactgaggacatgctcgctgtctggaatcgtgtgtggatacaggagaatccatggatggaagataaaacccccgtagaaagttgggaagaagttccctacttaggaaaacgagaggaccaatggtgtggctcactgatcggattaacatcgagggcgacttgggcgaaaaatattcaaacagctataaatcaagtcagatcactcataggaaatgaggaatatacagattacatgccatcgatgaaaagattccgaaaagaggaggaagaagcaggggttttatggtaa

SEQ ID NO: 22623 - RNA, 9876 nt, synthetic construct
  misc_feature 1..9876: note = derived and/or modified CDS sequence (opt6) from DENV-2__EU482731__SS-prME
  source 1..9876: mol_type = other RNA
acggcaggggtaattgtgatgctaataccgactgttatggctttccatttaactactaggaatggtgagccacacatgatagtagggagacaggaaaaaggaaaatcactgttattcaaaactgaggacggagtaaacatgtgtacactaatggcaatcgatttaggagagctatgcgaggatacaataacgtataaatgtccgctacttagacaaaatgagcctgaagacatagactgttggtgcaattcgacaagtacatgggtaacgtatggtacttgcacaacgaccggagaacataggagagagaaacgatctgtagccttagttcctcacgtaggtatgggattagaaacgaggacagaaacatggatgagctctgaaggtgcttggaaacatgtacaaagaatagagacttggatcttacgtcatccgggattcacgattatggctgctatattagcttatactatcgggacaacccattttcagagagctttaattttcatcctgttgacagctgtagctccgtccatgacaatgagatgtataggaatatctaaccgcgacttcgtcgaaggtgtaagtgggggcagttgggttgacattgttttagaacatggaagttgtgtaacaactatggccaaaaataaaccaaccttagactttgaactaattaaaactgaagcaaaacaaccggcaacgcttaggaaatattgcatagaagcaaaacttaccaatacgacaactgaaagccgatgtccaactcaaggggaacctagcttgaacgaagaacaagacaaaagatttatttgcaaacattctatggtagacaggggatggggaaatgggtgcggcctatttgggaaaggaggtatagtgacgtgtgcaatgtttacatgcaaaaagaatatggaaggcaaaattgttcagccggagaatttagagtataccatagttataacacctcattcgggagaagaacatgcggtgggaaatgacacaggcaaacatggtaaagaaataaaaattactcctcaaagcagcacaactgaagctgagcttacgggatatggaactgttactatggaatgcagccctcgaacggggttggattttaatgagatggttcttctacaaatggaggataaagcatggctggtgcacagacaatggttcttagatttaccgctaccatggctaccaggagcagatactcagggctccaactggatacaaaaagaaaccttggtaacatttaaaaatcctcatgcgaagaaacaagatgttgtggtactaggtagtcaagaaggtgcaatgcatacagctcttacaggagctacagagatacaaatgtcgagtggtaaccttttatttaccggtcatctaaaatgtcgccttcgaatggacaaactgcaactgaaaggcatgagctattcaatgtgcaccggtaaatttaaaatagtcaaagagatagcagaaacccaacatggtacgattgtaatacgagtacaatacgagggagacggtagcccgtgtaaaattcctttcgaaataaccgacctagagaaaagacatgtgttaggtagattaataacggttaaccctatagtgacggaaaaagatgcacctgttaatatagaagcagaaccgccattcggggattcatatatcattgtaggagtggaacctggccaattaaaactaaactggtttaaaaagggatcatcgattggacaaatgtttgaaacaacaatgcgaggcgcaaaacggatggcaatacttggcgatactgcttgggacttcggtagcttaggaggagtctttacatcaatcggaaaagctctgcatcaagtattcggagctatttatggtgcagcatttagtggagtaagctggacaatgaagatcctaatcggcgtcattataacctggataggtatgaactcgagaagcacatctttgtcagtctcgttggttctagtcggcgtagtaaccttataccttggcgcaatggtacaggcagattctggttgtgtagtaagttggaaaaataaagaactaaagtgtggcagcggaatttttattacagataacgtccatacctggacggaacaatataagtttcaaccggaatcaccaagtaagctagcgagtgcaatccaaaaagcacatgaagaaggaatctgtggaatccggtccgtgacacgactggaaaacctaatgtggaagcaaataacccctgaattgaatcatatactatccgaaaacgaggttaaactgacgataatgacgggtgatatcaaaggcataatgcaggctggcaaaaggagtctccgaccgcagcctacggaactgaaatattcatggaaaacttggggtaaggcaaaaatgttgtcaacggagtcccacaatcaaacatttttaatagatggaccagaaactgcagaatgtccaaatacgaacagagcctggaactcgctggaggtggaggattatgggttcggtgtctttactaccaatatctggctaaaactacgagaaaagcaagacgtattttgcgattcaaaacttatgagtgccgctataaaggataatagggcagtgcatgcggacatgggatactggatagagtctgctcttaacgacacatggaagatggaaaaggccagctttattgaagttaaaagctgccactggccaaagtcacataccctatggagtaatggagttctcgagtcggaaatgataattcccaaaaactttgcaggcccagtatcccagcataattataggccaggataccatacccaaacagccggaccatggcaccttggaaaattagaaatggactttgacttttgcgagggtactacggtagtagtcacagaagactgcgggaatagaggacccagcttaagaacaaccactgcaagtgggaagttaattacggaatggtgctgtagatcatgtactctgcctcctctaaggtatagaggcgaggacgggtgttggtatggaatggaaattcggcccctaaaagaaaaggaggaaaacctggtgaacagcctcgtgacagctggtcatggccaaattgataacttctcactaggagtgttgggaatggcattatttttagaggaaatgttacgcacccgagttggcacaaaacatgcaacgttattagtagccctctctttcgtaacactgattactgggaatatgtcatttagagacttaggaagagtgatggtaatggttggggccacaatgactgatgatatcggtatgggtgtaacttacctagctcttttagcagcattcaaagtaagacccacgttcgccgccgggcttcttctacggaaattgacatcaaaagaactaatgatggcaaccattggtatcgcacttctaagccagtccacgctaccggaaacaattttagagttaaccgatgctctcgcgttaggtatgatggtattaaaaatagtaagaaatatggagaaataccaactagccgtgacgatcatggcgattagttgtgttcccaacgctgtcatcttgcaaaacgcatggaaagtcagttgtacaattttagcagccgttagcgtgagtccacttctattaacgtcgtcacaacaaaaagcagattggattccactagcactcaccataaaagggctaaatcctactgccatctttcttaccacgttatcgagaacaagtaagaaacgtagttggccattgaatgaagccattatggcagtcggaatggtttcaatcttagcctcatccttattgaaaaatgatatacctatgactggccccctagtagccggaggtctattgacagtatgttatgtattaacaggacgtagcgcggacctcgaacttgaacgcgccgccgatgttaaatgggaagaccaagctgaaatttcgggttccagccccatactgtcaataacaatttcggaagacggtagcatgtctatcaaaaatgaagaagaagaacaaacgttgacgatattaattcgtacaggtttactcgtaataagcggggtcttccccgtaagtataccaattactgcagcagcatggtatctgtgggaggtcaagaaacagcgtgcaggggttttatgggatgtgccgagtccaccacctgtcggaaaagcggaattggaagacggggcatataggataaaacagagaggaatacttggatacagtcaaattggcgccggtgtatataaagaaggaacatttcatacaatgtggcacgttactagaggcgcagtactcatgcatcgaggaaaaagaatagaaccttcatgggcggacgtcaagaaagacctaatctcctacggtggtggttggaaattggaaggggagtggaaagaaggagaagaagtacaagtattagccttagaaccgggtaaaaatccaagagccgttcaaacaaaaccaggtatcttcaagacaaatacgggaacaatcggcgcagtctccctagacttctcccctggaacaagcggaagcccaatagtcgacagaaaaggaaaagttgtaggcttatatggaaatggagtagtaacacgttctggcgcgtatgtatctgctatcgcacaaactgaaaaatcaatcgaggataatcctgaaattgaagatgatatatttagaaagaaacgattaactataatggatttgcatcctggggctggcaaaactaaacgttacttaccagcgatcgtaagagaggccatcaaaagagggctacgaacattgatattggcaccaacacgagttgtagcggccgagatggaagaagcattaagagggttgccaattagatatcaaactcctgcgataagggcagagcacacaggaagagaaatcgttgatctcatgtgtcatgctacgttcacaatgaggttgttgagcccagtaagagttcctaactataacctaattatcatggacgaggcgcattttactgacccggcatcaatagccgcaagagggtatataagtacgcgagtagaaatgggagaagcagcaggaattttcatgacggccacgccgccaggttctcgagacccttttcctcagagtaatgctccgatcatagatgaagaacgtgaaatcccagaacgatcatggaactcgggtcatgagtgggtaaccgactttaaaggcaagacagtatggttcgtaccatcaataaaagccggcaacgacatagcagcttgcttaaggaaaaatggcaagaaagtcattcagctatccagaaaaacattcgactccgaatatgtgaaaaccagagcaaatgattgggattttgtagtcactacggatattagcgaaatgggtgcaaattttaaagcggaaagagtaatcgacccgagaagatgtatgaaaccggttatattgacagatggagaagaaagagttattcttgcaggcccaatgccagtgacacatagcagcgcggcacaaagaagaggacgtattggacgcaatcccaaaaacgaaaacgatcaatacatatacatgggcgaaccactagaaaatgacgaagactgtgcacattggaaggaagcaaaaatgttactggataatattaacacgccggaaggaataataccttcaatgtttgaacctgaaagagagaaagttgacgctatagatggagaatatagattaagaggagaagcaagaaaaacattcgtcgatctaatgagacgcggagatcttccggtctggttagcatataaggtcgccgctgaagggattaattacgctgatcgcaaatggtgctttgatggcataaagaacaaccaaattcttgaggaaaacgttgaggtagaaatttggacaaaagagggggaaagaaagaaattgaaaccaagatggctagatgcccgaatatactcagacccacttgcacttaaagagtttaaagaatttgccgcaggtagaaagtcattaacattaaacttaataaccgaaatgggacgcctaccaacctttatgacccaaaaagcccgaaatgccctggataacctagctgtacttcacacagccgaagtcgggggaagggctcacaatcacgctttatcagaactcccagaaacattggagacactcctattactaacactccttgcaactgtgactggtgggatatttctgtttttaatgtcaggcaaaggtataggaaaaatgaccttagggatgtgttgtattataacagccagtatattgttatggtatgcacaaatccaaccacattggatcgcagcaagcatcatacttgaatttttcctaatagtattattaatcccagaaccagaaaagcaaagaacaccacaggacaatcagttgacttacgttgtcatagcaattctaacagttgtggctgcgactatggcgaacgaaatgggatttttggagaaaactaagaaggatttaggttttggatcgattacgactcaggaaagtgaaagtaatatcctggatattgatttgcgtccagcttcggcatggactttatatgcggttgcaacaacatttgtaactccgatgcttcgacatagtattgagaacagttcggttaatgtttctttaaccgcgatcgctaaccaagcgacggttctaatgggtctaggcaaaggatggcccttaagtaagatggacattggagtaccgctattagccataggctgctactcgcaggtaaatcccataacacttacagcagctctattgctcttagttgcacactatgcgattataggcccgggtttacaggcaaaggcaactagagaagcacaaaaacgtgcggcggcaggaattatgaaaaacccaactgtagatggaattacggttattgatctagaacctataccctatgacccaaaatttgaaaaacaattgggacaagtaatgttgttaatattgtgtgtaactcaagttttaatgatgcgaaccacgtgggctttatgcgaagcattaactttagctacgggtcccataagcacattatgggaaggcaaccccggcagattctggaatactacaatagccgtaagcatggcaaacatatttaggggatcataccttgccggagcaggcttattattcagcataatgaaaaataccacaaacacaagacgcggcacgggcaacgtaggtgagacgttaggagagaaatggaaatcaagattaaatgcactagggaagagtgagttccagatctataagaaatcagggatccaagaagttgatcgaactctagcaaaagaaggcataaaacggggagaaacagaccatcacgccgtaagcagaggatcagcaaaattaagatggtttgtcgaacgaaacatggtaacacccgaaggtaaagtagtggacctaggctgcggaaggggcggttggtcgtattactgtggtggtcttaaaaacgtaagagaggttaaaggcctaacgaaaggtgggcctggacatgaagaacccatacctatgtctacttatggatggaatctcgtccgcttacaaagtggcgtagacgtgttctttactccacccgaaaaatgtgatacacttttatgtgatattggtgaaagtagtcccaaccctactattgaagccggccgcacattgagagtcttaaacctcgtcgaaaactggttgaataataacacacaattttgcatcaaagtactaaatccctatatgcccagtgttatagagaaaatggaaacccttcaacgaaaatacggaggtgcgctcgtcaggaaccccttatctagaaactctactcacgaaatgtactgggttagtaacgctacaggaaacatagtctcatctgtgaatatgatatcccgcatgctgataaataggtttacaatgaaacacaagaaagcaacatacgaacctgacgtagacctgggaagtggcacgagaaatattggtatcgaaagtgaaattccaaaccttgatataataggaaagcgaatagagaaaattaaacaagaacatgaaacgagctggcactacgatcaagatcacccatataaaacttgggcttaccatggatcctacgaaacaaaacagaccggtagtgcgtcatcgatggtaaacggagtcgtacgtttgttgacaaaaccctgggatgtagtacctatggtaacacagatggccatgacagatactactcccttcggacagcaacgggtatttaaagaaaaggtagacactagaactcaagagccaaaagaaggaactaagaaattgatgaagataacagccgagtggttatggaaagagttaggaaagaagaagacacctcgaatgtgtacaagagaggaatttacacgaaaagtgagaagtaacgcagcccttggagctatatttactgatgaaaataaatggaaaagcgccagagaggctgtggaagacggaagattctgggaattggtcgatagagaacgtaatttacacttagaaggaaaatgtgaaacatgtgtttacaatatgatgggcaagagagagaagaaattaggtgagtttggaaaagccaaaggttcccgggctatctggtatatgtggctaggggcacgcttcttagaatttgaagctcttggatttctaaatgaagatcactggttttcgagaggaaatagtctatcgggagttgagggcgaaggtcttcataggctcggatacatattaagggaagtcggcaagaaagagggaggagcaatgtatgcagatgacactgctggctgggatacaagaataacattagaagacctgaaaaatgaagaaatggtaacgaatcatatgaaaggggagcataagaaactagccgaagcaatcttcaaattaacctatcagaataaggtagttagggttcaaagacctacgccacgcggaacggtcatggatatcatatcgcgcaaggatcaacgtgggagtggacaagtaggtacatatggtcttaacaccttcacaaatatggaagcccaattgatccgtcaaatggagggggagggtatttttaaatcgatacaacatttaacagctacggaagagatagctgtacagaactggttagcaagggtaggtagagaaagattatcaaggatggcaatatccggagatgactgcgtggtgaaacccattgatgataggtttgcgtcggccttaaccgctttaaatgacatgggaaaagtaagaaaggatatccaacagtgggaaccttctagaggatggaatgattggacccaagtgccattttgttctcatcattttcatgagctagtcatgaaagatggcagggtacttgttgtcccttgcaggaaccaagatgagctcattggacgagcacgtataagtcaaggcgctggttggtccttaaaagaaacggcctgtctcggaaagagttacgcccaaatgtggactctcatgtattttcatagaagggacttaagattagcggcaaatgcgatatgcagcgccgttcccagtcactgggtcccgacatcaagaacaacatggtccatacatgcaaaacacgaatggatgacaacagaagatatgctggcagtatggaatagagtttggatacaagagaatccgtggatggaggataaaacaccagtagaatcatgggaagaggtgccatacttaggaaaacgggaagatcagtggtgtggttcactaataggacttacgtcccgagcaacttgggccaaaaatattcaaacggctataaaccaagtccgcagcttgataggaaacgaagagtacactgactatatgccaagtatgaaacgatttcgaagagaagaagaagaagcgggagtcttatggtga

SEQ ID NO: 22624 - RNA, 9876 nt, synthetic construct
  misc_feature 1..9876: note = derived and/or modified CDS sequence (opt6) from DENV-2__EU482732__SS-prME
  source 1..9876: mol_type = other RNA
actgttggagtcataataatgttaattcccaccgctatggcattccatcttactactcgcaatggggaaccccatatgatagtaggtagacaagaaaaagggaaatcactgctctttaaaacagaagatggagttaatatgtgcacattaatggcaatagatttaggagaactttgtgaagacactataacgtacaaatgtcccttattacgacaaaacgaaccagaagatatcgattgctggtgtaatagtacaagtacttgggtaacatacggaacatgtactactaccggtgaacatagaagagagaaaaggtcagtagctcttgtacctcatgtaggcatgggactagaaacacgaacagaaacatggatgagttcagaaggggcttggaaacacgttcaacgaatcgaaacatggattttaagacatccaggttttactatcatggctgctatacttgcatatacgataggaacaacccactttcaacgagcgctaatctttattctgttgacggcagtagctccaagtatgaccatgagatgtattggtataagtaatagagattttgttgaaggggtatcaggaggaagttgggtcgacatagtgttggaacatggctcatgtgtgactactatggcgaaaaataaaccaacgcttgacttcgaattaataaaaaccgaagcaaaacaacctgcaacactgagaaaatactgtatcgaagcaaaacttacaaataccactacagaatcaagatgtcctactcaaggtgaaccgtcactaaacgaagaacaagataaacgatttatttgtaaacatagtatggtagataggggatggggcaatggttgtggactatttggaaaaggtggaatagttacttgcgcaatgttcacatgcaagaaaaatatggagggcaaagtagtcctgccagaaaatctcgaatatacaatagtaataactccacatagtggtgaagaacacgcagtaggaaatgatactggcaaacatggaaaagaaattaaaataacaccacaatcatcaatcacagaagctgaattaaccggttatggcactgtaactatggaatgctccccgagaaccggacttgactttaatgaaatggttcttctacaaatggaagacaaagcgtggttggttcatcgtcaatggttcttagatctccctctaccctggttacctggcgccgatacccaaggttctaattggattcaaaaagaaacactggtcaccttcaaaaatccgcatgctaagaaacaggatgtggtggttttaggtagtcaagaaggggctatgcacacagccctgacaggcgcaacagaaatccaaatgtcatcaggaaatctactgtttactgggcacctaaaatgcaggttgaggatggacaaattacaactaaaaggtatgtcatattctatgtgcacaggtaaattcaaaattgtaaaagaaattgctgaaactcaacatggaactatagtaataagagttcaatacgaaggtgatggcagtccctgtaaaatcccctttgaaataatggaccttgaaaaacgacacgttttaggccgactgattacagttaatcccatagtgactgaaaaagactcaccagtgaatatagaggcagaaccaccatttggagatagctatataataatcggagtggagccgggccaattaaaattgaactggtttaagaaaggtagctccatcggtcagatgtttgaaaccacgatgcgcggagccaaaagaatggcaatcctaggtgatacagcatgggactttggttcgcttggcggagcatttacgtctataggtaaagcattacatcaagtattcggtgcgatatatggcgcggctttcagcggagtctcatggactatgaaaatcttaataggtgtgattatcacttggattggtatgaactcaagaagtacatcacttagtgtaagtctagtgctggttggtgtggtaaccctctatttaggagttatggtccaggcagatagcgggtgtgtagtatcatggaaaaacaaagaattaaaatgtggttccggcatattcattactgataacgtccacacgtggacagaacagtataaattccaacctgaatcaccttcgaaactagcctccgccattcaaaaagcacatgaggaaggcatatgtggaataagatctgttacgcgcctcgaaaatctaatgtggaaacagattacaccagaacttaatcacatattatcagaaaatgaagttaaattaaccattatgaccggagatattaaaggaatcatgcaagccggtaaaaggagtctccgaccacaaccaactgaactgaaatatagctggaaaacatggggcaaagctaaaatgctatcaacggaaagtcataatcagaccttcttaattgatggcccagagacagccgaatgccctaataccaacagggcttggaactccttggaggtggaggactatggatttggtgtattctcaaccaacatctggcttaaattaagagaaaaacaagatgtattttgtgactctaaattgatgagcgctgcaataaaagataaccgagcagtacatgctgacatgggctattggattgaatctgccctaaacgacacttggaagatggaaaaggcgagttttatcgaagtaaagagctgccattggccgaaaagtcataccttatggtcaaatggagtacttgaaagcgaaatgatcatccctaagaattttgctggtcctgttagtcaacataattaccgacctggttaccacactcaaacagccggaccgtggcatctgggtaagctagaaatggattttgacttttgcgaggggactacagttgtggtaacagaagattgtgggaatagaggaccttccttacggacaacaacggcgtccggaaagttgataacagaatggtgctgtcgatcgtgtacattacctccactcagataccgaggcgaggatggttgttggtacggcatggaaattagaccgttgaaagaaaaggaagaaaacctggtgaacagcctagtaacggctggacacggacaaatagacaatttcagtttgggagttttagggatggctctatttttagaagaaatgttacgcacaagggtaggtaccaagcatgcaatactattggtagcggtttcttttgtaactcttattacaggtaacatgtcatttagagatctgggtcgcgttatggtcatggttggtgctacaatgaccgatgatatcgggatgggggtaacatatctagctctactcgcagctttcaaggtgagacctacatttgcagccgggttacttctaagaaagttgacttcaaaggaattaatgatggcaacgataggaatagccctattgagtcaatctacaattcccgaaactatattagaactaaccgacgcattagcgttaggcatgatggtactgaaaattgtaaggaacatggaaaagtatcaactagccgttactattatggcaattagttgtgtacctaatgcagtcattttacaaaacgcttggaaagtatcatgcactatattggcggcagtttcggtcagtcccctcttgttaacatcgtcacaacaaaaagccgattggataccactggcattaaccataaaaggattaaatccaacagctattttcttaactactttatcaagaacctccaaaaagcggtcatggcccctcaacgaagctgttatggcagtcggcatggtaagtatactagcatcctcgcttctcaaaaacgatatacccatgacgggtccgttggtcgcgggtggattacttaccgtctgttatgtactaacaggacgaagcgcagatttagagttggaacgagcagctgacgtaaaatgggaagatcaagctgagatatccggcagcagcccgatactatcgataactataagcgaagacggatcgatgagtataaagaatgaagaggaagaacatacattaaccatcttgatcagaacgggactattggtgataagtggagtattccctgtctcaattccaatcactgcagcagcatggtacttatgggaagtgaagaaacagcgagctggtgtactatgggacgttccatcacctccgccggtaggcaaagcagaattagaagacggagcttacaggataaaacaaagaggtatatttggatacagtcaaataggagcaggagtttataaagaaggtacttttcacactatgtggcatgtcactagaggagcagtcctaatgcataggggtaaacgtatcgaaccctcttgggctgacgtcaagaaagatctcatatcatacggcggaggatggaagttagaaggcgaatggaaggagggagaagaagttcaagtattggcactagaaccgggcaaaaatccacgagccgtacaaactaaaccaggtctattcaaaacgaacactggcactatcggtgcagtatcactagacttctcaccaggaactagcggttcacccatagtagatcgaaaaggaaaagtggttggtctttacggaaatggagtagtgacacgatcaggagcatacgtttcggcgattgctcaaacagagaagtccattgaggacaatccggaaatagaagatgatatattcaggaagaaaagactaactataatggacctccacccaggagcgggcaaaacaaaacgttatctaccagccattgtaagagaggccatcaagaggggtctgagaaccttaatcctagcccccactcgcgtcgtcgcagcagaaatggaagaagcacttcgtggtttgcctattaggtatcaaacaccagctataagagcagagcatacaggtagggagattgtagacctgatgtgccatgcaacgtttacaatgagactgttatcacccgttcgcgtgccaaattataatctaattattatggacgaagcccattttactgacccagcgagtattgcagctcgtggttacatttcaacccgggtggaaatgggtgaagccgcaggaatattcatgactgccacaccaccgggaagtagagacccatttccacagagtaatgcacccatcatggatgaggaacgagaaatacctgagcggtcatggaacagtgggcacgaatgggtcactgactttaaaggaaaaacggtctggttcgttccaagtatcaaggccggaaacgacatagcagcgtgtctaaggaaaaatggtaagaaggttattcaactatcaagaaaaacatttgattcggaatatgttaagactcgggctaatgactgggattttgtggtaactacagatattagcgaaatgggagcaaatttccgggcagaaagagtgattgaccctaggcgttgcatgaagcctgtaatactgacagatggcgaagaacgggttatcttagcaggtcctatgcctgtcactcatagtagtgcagcacaacgtaggggcagaataggcaggaatccgaagaacgaaaacgaccagtatatctatatgggagaaccgcttgaaaacgacgaagactgtgcccattggaaagaagcaaaaatgcttttggacaatattaacactcccgaaggaataataccctctatgtttgaaccagagcgggaaaaagtggatgccattgatggcgagtatagattacgtggcgaagcaaggaaaacttttgtggatctgatgagaagaggtgacttacctgtatggctagcctatagagtagctgcagagggaattaactacgctgatagacgatggtgctttgatggaatcaaaaacaaccaaatattagaagagaatgttgaagtagaaatatggacaaaggaaggagaaaggaagaaattaaaaccacgttggttggatgcacgaatttatagcgacccactagccctcaaagaatttaaagagttcgcagcgggccgcaagagtctaactttaaacttgatcacagaaatgggaagactccccacattcatgacacaaaaagctagagatgcattagataatctagcagtcttgcatacagcggaggtgggaggcagagcttataatcacgcactcagtgagctaccagaaactcttgaaactctacttttactgaccttattggcgacagtaacaggtggcatcttcctcttcctcatgagtgggaaaggcatagggaagatgactttagggatgtgctgtataatcactgctagtattctattatggtatgcacaaatccaaccacactggatagcagcatcaataatcttagagttctttttgatagttctattaataccagaacctgaaaaacagcggactccccaagataatcaactaacttacgtcgttattgctattttaacagtagttgcggcaacaatggctaatgaaatgggattcttagaaaagaccaagaaagatcttggcctgggtagtataaccacacaagaaagcgaatcaaacatactagacattgatcttcggccagcatcagcctggacactatatgcagtagcaactactttcgtgacaccaatgctgcggcatagcattgaaaactcaagtgttaatgtatcattaacagccattgccaatcaagctacagtcttgatgggattaggaagaggatggccactaagcaaaatggatataggcgtacctttactggctatagggtgctacagccaagttaatcccatcacattaacagccgcgctacttctattggtggcacattatgcgataatagggccaggactacaagcgaaagctaccagagaggctcagaaacgagcggcagcaggtattatgaaaaatcctactgtggacggaattactgtcatagatctagagcctataccatatgatccaaagtttgaaaaacaattgggtcaggtaatgctattagttttatgcgtaactcaagtactcatgatgcggacaacctgggccctctgtgaagcactaacattagccaccggccccataagtacgctatgggagggaaacccgggcagattttggaatacaacaatcgctgtatcgatggcgaatatttttagaggatcatatctcgcgggagccggccttctgttctcaattatgaagaacacaacaaatacacgaagaggtactggcaacattggcgaaacattaggggaaaaatggaaaagcagattaaacgcacttggcaaatcagagtttcaaatatacaagaaatctggcattcaagaagtcgacagaacgttagcaaaagagggaattaaaagaggcgaaacagatcatcacgcagtttcacgaggatcggcaaaacttaggtggttcgttgagaggaatatggttacccccgaggggaaagtagtagaccttggatgcggaagaggaggttggagttactactgtggaggtttgaaaaacgtcagggaagttaaagggttaacaaagggcggaccaggacacgaagaacctatcccgatgagtacatatggttggaatttagttcggttacaaagcggtgttgatgtgttctttacaccacccgaaaagtgtgatacattgctttgcgatataggggaatctagccccaatcctactattgaagcgggaaggacactaagagtactcaacctggttgaaaactggttaaataataatactcagttttgtataaaggtattaaatccctatatgccaagtgttattgagaaaatggaaactctccaaagaaaatatggtggagcacttgttagaaatccattgtcccgaaatagcacgcatgaaatgtactgggtttcgaatgcaaccggtaatatagtttcaagtgtaaatatgataagcagaatgctaatcaaccgatttacaatgaaacataaaaaggcaacgtatgaaccagatgttgatctcggatcgggaacaaggaatataggtatagaaaatgaaattcctaacctagacataatcggaaaaagaatagagaaaataaaacaagaacatgagacaagctggcactatgatcaggatcatccttataaaacatgggcatatcatggatcatatgagacaaagcagactgggtcggcgtcgagtatggtcaacggtgtcgtaaaattactgactaaaccctgggatgtcgtgcccatggtcacacaaatggctatgactgatacaacgccattcggacaacaaagagtatttaaagaaaaagttgatactagaacccaggagcccaaagaaggtactaagaaactaatgagaataacagctgaatggctgtggaaagaattaggaaagaagaaaactccacgcatgtgtactagggaagaatttacccgaaaggttcggtcgaatgccgccttgggcgctatttttacagacgaaaacaagtggaagtctgcacgtgaagccgtggaggacagcagattctgggagttagtggatcgagaacgcaatctccacctagagggaaagtgtgagacgtgtgtatataatatgatgggcaaacgcgagaagaaacttggcgaatttggaaaagctaaaggatccagggctatctggtacatgtggttaggagcacgatttcttgagttcgaggctttgggattcttgaatgaggatcactggtttagtagaggcaactctttatcaggagtagaaggggaaggccttcacaaattaggatatatcttacgtgacgtcagtaagaaagagggcggtgcaatgtatgctgatgatactgcaggatgggatacacgtatcactctagaagatctcaaaaacgaagagatggttacaaaccacatgaaaggagaacataagaaactggcagaagctatatttaaactcacataccaaaataaagtagtgagagtacaaagacccacacctagaggaaccgtaatggacattatatccagaaaagaccaacggggaagtggacaggtgggcacatatgggctaaatacattcacaaatatggaagcacaactaataagacaaatggaaggagaaggaatttttaagtccattcagaggttgactgttacagaggaaatcgcagtgcaaaattggttggcaagggtaggacgtgagaggttgtctagaatggccatatccggagacgactgtgtagtcaaacctttagatgatcgcttcgctagtgctctaacagcattaaacgacatgggtaaagttagaaaggatattcaacaatgggaaccttctaggggttggaacgattggacccaagtacccttttgctctcatcattttcatgagttggtaatgaaggatgggagagttttagtggtaccatgtcgaaatcaagatgaattaataggaagggcaagaatatctcaaggtgctggttggtccttaaaagaaacagcatgcctcggcaagtcctatgcacaaatgtggactctaatgtatttccacagaagagacttacgcctagctgccaacgcaatctgcagcgcagttcccagccattgggtaccaacatctaggacaacatggagtatacatgcgaaacacgagtggatgaccacagaagacatgctcgcggtgtggaatagagtttggatacaagaaaatccatggatggaggacaagaccccggttgaaagttgggaggaagttccgtatttgggaaaaagggaagatcaatggtgcggttcgctcatcggattaacatccagagcaacatgggccaaaaatatacaaactgccattaatcaggttcgcagccttatagggaacgaagaatataccgattatatgccgtctatgaagcgtttccgtaaagaagaagaagaggcaggggttttatggtaa

SEQ ID NO: 22625 - RNA, 9876 nt, synthetic construct
  misc_feature 1..9876: note = derived and/or modified CDS sequence (opt6) from DENV-2__EU482733__SS-prME
  source 1..9876: mol_type = other RNA
acagcaggagttataataatgttaataccaactgcgatggcttttcacctaacaactcgcaatggggaaccacatatgatagttgggcgacaagaaaaaggtaaatctctattatttaaaacagaagatggagttaacatgtgcacattaatggcaattgacctaggcgaactctgtgaggatactataacttacaaatgtccacttcttagacaaaacgagcctgaagatatagactgttggtgcaattcaactagcacctgggtgacctatggaacgtgcacaacgaccggagaacatagacgagagaaaagatcagtcgcattagtgccacatgttggcatgggtttagaaacacgtacagaaacctggatgtcttcagagggcgcgtggaaacacgtgcaaagaatcgaaacttggatattgcgtcatcctggcttcaccataatggctgcaattctcgcttacactatcggcactacccatttccaacgagcactaatctttattctattaaccgctgtggcgccctctatgacgatgagatgtataggaattagtaacagggactttgtggagggagtttcaggtggaagttgggtggatattgtcctagaacacggatcctgtgtaacaaccatggctaaaaataaaccaacgctagattttgaactaataaaaacagaagctaaacaacccgcaacactaaggaaatattgtatagaagcgaaactcactaatactaccaccgaatcacgatgcccaactcaaggagaaccatcccttaatgaagaacaagataaacgtttcatatgcaaacattcgatggttgatagaggatggggaaacggctgtgggcttttcggtaaaggtggaatcgtaacctgtgccatgtttacatgcaaaaagaacatggaaggcaaagtagtactaccagaaaacttggaatacactatcgtaattaccccacattctggagaagaacacgccgtcggaaacgacacaggtaaacacggtaaagaaataaaaattacacctcagtcttcaataacagaggctgagctaacagggtacggtaccgtcacgatggaatgtagccccaggactggactggactttaacgagatggtattactgcaaatggaagacaaagcatggttagttcatcgtcagtggttcttagacttaccattgccatggttgcccggagcggatactcaaggatcgaattggatccagaaagaaactcttgtaaccttcaaaaatcctcacgctaagaaacaagatgtagttgtattaggttcacaagaaggggctatgcacacagcattaacaggcgccacagaaatacaaatgtcttcgggcaatctattattcactggacacttaaaatgtcgtctccgaatggacaaattacaactgaaagggatgtcttatagtatgtgtactggtaaattcaaaatagtaaaagaaatagcggagacacaacatggcaccattgtgataagagtacagtatgaaggagatggttctccttgtaaaatccccttcgaaattatggatctcgaaaaacggcatgttctaggaagactaatcacagtaaatccgatcgttacggaaaaggatagtcccgtcaacatagaggccgaaccaccgttcggcgacagttatattatcattggggtcgaacctggtcaattgaaattaaactggtttaagaaagggtcttcaatagggcaaatgttcgaaacgacaatgaggggtgctaaacgtatggctatactgggtgacactgcatgggattttggatctttaggtggcgttttcaccagtataggaaaagcgctacatcaagtcttcggtgcgatctatggtgccgctttttcgggagtatcatggactatgaaaatactaatcggggttattatcacctggatcgggatgaatagtagatctacatctttgtccgtatcactcgtattagtaggagtcgtaactttatacttaggcgtaatggttcaagccgattctggctgtgttgtatcatggaagaacaaagaactcaaatgcgggtcgggcatattcatcacagacaacgtgcacacgtggacagaacagtataaattccagcccgagagtccctcaaagctagcaagcgcaatacaaaaggctcatgaagaaggtatatgcggtatacgatcggtaacaagattggaaaatctaatgtggaaacaaattacacccgaattaaatcatatattatcagaaaatgaggttaaattgaccatcatgacgggagacataaaaggtataatgcaagccggaaaaagatccttgcgacctcagccgacagagttaaagtattcatggaaaacctggggtaaggcaaagatgctatccactgagtcccataatcaaacattcctaatagatggacccgaaactgcagaatgtcccaacacaaacagagcatggaactcattagaggtagaagattacggattcggtgtattttcaaccaatatctggcttaaattaagagaaaaacaagatgtattttgcgacagtaaacttatgtcggcggcaattaaagataatagagcagtacatgcagatatgggctattggatagaatctgctttaaatgatacgtggaaaatggagaaagcctcttttattgaagttaagtcctgtcattggccgaagtcacacactctgtggtcaaatggagtgttagaaagtgagatgattatcccaaagaattttgctggaccagtaagccagcataattatagaccaggataccacacacaaacagctggcccttggcacctgggtaagctcgaaatggactttgatttctgtgagggtacaactgttgtggtaactgaagattgtggaaaccgggggccgtcactccgaaccaccacagcgtcagggaaactaattacagaatggtgttgtcgctcttgcaccctacctcccctaagatatcgaggagaggatggttgctggtatgggatggaaataaggccacttaaagaaaaagaggaaaatttagttaatagtcttgtgacagctggccatggacaaatagataacttttcattgggagtattagggatggcgttatttctagaagaaatgttacgcacgagggtcggaacaaaacacgctatactattagttgctgtatccttcgtaacattaataactggtaacatgagctttagagatctgggtcgtgtcatggtgatggtaggggcaacaatgactgatgacataggtatgggcgtaacatatctagcattactagcagccttcaaagtacgacccaccttcgctgcaggtttactattgcgaaaactaaccagcaaagaactaatgatggcaacaatagggatagcattattatcgcagtccactataccggagactatactggaacttactgatgcactagcgctcggtatgatggtgttaaaaattgttagaaacatggaaaaatatcaactagcagtaacgataatggctattagttgtgtgcccaacgctgtcatcttacagaatgcttggaaggtaagctgtaccatacttgcagccgtctccgtgagcccacttttactaacaagcagccaacaaaaagctgactggattccgctagcgttaacgataaagggattgaatcctactgcgatattcttaactaccctgtcaagaacaagcaagaaacgcagctggccacttaatgaagcggtgatggctgtaggtatggtaagcattctagcaagcagtttgttaaagaatgacatcccaatgacaggtccattggtagcaggaggattgcttacagtatgttacgtcctgacaggacgcagtgctgatctagaattggaacgcgcagctgatgtgaaatgggaagaccaggcggaaatttctggatcgagtcctatactgagtataacgattagcgaagacggaagtatgtcaattaaaaatgaagaagaggaacagactctaacaatcctgataaggacagggttattagtaatttcaggagttttccctgtatcaatcccgataacggcggctgcatggtacttatgggaggtaaagaaacaacgtgcaggcgttttatgggatgtcccttctccgcccccagttggaaaagcggaactcgaggatggagcctataggataaaacaacgtggaatattcggttatagccaaattggggctggagtatacaaggaaggcacgtttcatacaatgtggcatgtaacaagaggagcagttctaatgcaccgagggaaacgaattgaaccttcttgggcggatgtcaagaaggacttaatcagttacggaggtggctggaaactcgaaggtgagtggaaggaaggtgaagaagtccaagtgttagcattagaacccggcaaaaatcctcgagccgttcaaacgaaaccaggtctttttaaaacgaacacgggaacaataggggcagtatctcttgatttctcgccaggaacatccgggagccctatcgtagatagaaaaggtaaagtggtaggattatatggaaatggagtcgtgactcgaagcggagcatacgtgtccgcaatagcacaaactgagaaatctatagaggataatccagaaatagaagatgatattttccgtaaaaagcggcttactataatggacctacacccaggagcaggtaaaactaaaaggtaccttcccgcaatcgttagagaagctattaaaagaggactgagaacgttaatactagcgccgacgcgagtggtagcagcagaaatggaagaagcactacgaggattaccaataaggtaccaaacgcctgcaatcagagcagaacacacaggcagggaaattgtggatctaatgtgtcacgctacattcactatgcgactgctatcaccagttcgagtccctaactacaaccttattataatggacgaggcacattttacagatcctgcgagtattgccgcaaggggttatatttccacaagagttgaaatgggtgaagcagcaggtatatttatgaccgctactccgcccggttctagagacccctttccacaaagcaatgcccccattatggatgaggagagagagattccagaaaggagttggaacagtggacatgaatgggtaacagattttaaaggaaaaacggtatggtttgtaccaagtatcaaagctgggaacgatatcgccgcttgtttaaggaaaaacggcaagaaagttattcagttaagtcgtaaaacattcgattcagaatatgtgaagacgagagcaaatgactgggacttcgtagttacaaccgatatttcagaaatgggggccaactttagagcagagcgtgtcatcgatccgcgacgctgcatgaaaccggtgatactaacggatggtgaggagagggttatcttggccggacctatgcccgtcacacattcaagtgcagctcaaagacgcggacgtatcggtagaaatcccaaaaatgaaaatgatcagtatatatacatgggggaacccctggaaaacgacgaagactgtgctcattggaaggaagcaaaaatgctacttgataatattaacacaccagaaggaatcataccgtcaatgtttgagccagaaagggaaaaagtagacgcaatcgatggagaatataggttaagaggggaggcccgcaagacatttgtagatttgatgaggaggggagacctcccggtatggctcgcgtaccgcgttgctgcagaaggcataaattacgctgacagacggtggtgttttgacggaatcaaaaataaccaaattcttgaagaaaatgttgaagttgagatttggacgaaagaaggagagaggaagaaactgaaacccagatggctagatgcacgaatctactcggatcctttagcgttaaaagaatttaaggagtttgcagctggacgaaaaagtttgacccttaaccttataacggaaatgggtcgattgccaacattcatgactcaaaaagccagagatgcgctcgacaacttggcagtattacacaccgccgaagtgggtggcagagcgtacaaccatgctttatctgaactaccagaaactctggaaacgttattgttactgacattacttgcaacagtcacagggggaatcttcttgtttttaatgagtggaaagggtattggaaagatgactctgggtatgtgctgtatcataacggcgtctatcctactgtggtatgctcaaattcaaccacactggattgcagctagcattatattagagttctttcttattgttcttttgatcccagaaccagaaaaacagaggacaccccaggacaaccagttaacttatgttgttattgcgattctaacagtcgtagcagcaacaatggcaaacgagatgggattcttagaaaagactaagaaagacttaggcttgggttcaattacgacacaagaatcagaatccaatatccttgacattgatttgagaccagcctcagcatggactttatatgctgttgccacgacatttgtaacacccatgctccggcacagtattgaaaattcatctgttaacgtttctctaactgctattgcaaatcaggcaacagtactaatgggtctaggtcgtgggtggccattgtcaaaaatggatataggagtaccactacttgcaatagggtgttattctcaagtgaatcctataacgttaacagctgctttactgcttttagttgctcactatgcgatcattgggccaggacttcaagctaaagcaactcgagaggctcagaaaagagcggccgctggaataatgaaaaaccctactgtagacggtataacagttatagatctagaaccaattccgtacgacccgaaatttgaaaaacaattaggtcaagtgatgctattggtcctatgcgtcacacaggttttaatgatgaggacgacatgggctctttgcgaggcattaacattagcgacaggtccaatatcgactctatgggaaggtaacccaggaagattttggaatactacaatagcagtatcgatggcaaatatatttagaggcagttatttggcgggagctggtctgctattcagtattatgaaaaacacaactaatacaagaaggggtacgggaaatataggagaaacacttggcgaaaaatggaaatctcgattgaacgcactcggtaaaagcgaatttcaaatatacaagaaaagtggtatccaagaagtcgaccgcactctggctaaagagggcattaaaagaggcgagactgatcatcatgctgtttcgcgaggatcagctaaactacgttggtttgttgaaagaaatatggtcactcctgaaggaaaggttgtggatttaggatgcgggagaggagggtggagttattactgtggaggtctcaaaaatgtcagggaggtaaaagggttaacaaagggtggcccaggtcatgaggaaccaatccctatgagtacgtatggatggaatttagttagactacagtccggcgtagatgtgttcttcaccccacccgaaaaatgtgataccctactttgcgacataggagagagttcaccaaaccccacgatagaagccggtagaacattaagggtacttaatctagtcgagaactggttaaacaacaatacccagttttgtatcaaagttttaaatccgtatatgccatcagtaatcgaaaagatggaaacattgcaacgaaagtacggaggtgccttagtcagaaacccattatctagaaactcaacgcatgagatgtactgggtttccaacgcaacaggaaacatcgtatctagtgtaaacatgatatctagaatgctaatcaatcgctttacaatgaaacacaaaaaggcaacgtatgaacctgatgttgatttgggaagtggaactagaaacataggaatcgaaaatgaaattcccaatctggatataatcggcaagagaatagagaaaataaaacaagaacatgaaacgagctggcactatgatcaagatcatccatataaaacctgggcatatcacggttcatacgaaacaaaacaaactggatcggctagttcaatggtaaatggagtcgtacgattattaacgaaaccttgggatgtcgtacccatggtgactcaaatggctatgacagatacgaccccgttcggccaacagagagtattcaaggaaaaagttgatactcgaacacaagaaccaaaagaaggaaccaagaaacttatgcggataacagcagagtggttatggaaagaattagggaagaagaaaacaccacgaatgtgcaccagagaggagtttactagaaaagttagatcaaacgcagcgttaggagcaattttcacagacgagaataaatggaaatctgcacgagaagcagtggaagattcaagattttgggaacttgtagatagagaaagaaaccttcatcttgaaggaaagtgtgagacgtgtgtctataatatgatggggaagcgtgagaagaaacttggagagttcggaaaagccaaaggatcaagagcgatatggtatatgtggttaggcgccagatttttagagttcgaagccttaggatttctaaatgaagaccactggttttcaagaggtaattcactatcgggtgtcgaaggcgagggtttacacaaactggggtatattctcagagatgttagcaagaaagaaggtggggctatgtatgccgatgatactgctggttgggacacacgtatcacactagaggatcttaaaaatgaagagatggtaactaatcatatgaaaggggaacacaagaaactagcagaggcaattttcaaactcacatatcaaaacaaagtcgtgagggtgcaaagaccaacaccaagaggtacggtaatggatatcatatcaagaaaagatcaacggggatcaggacaagtgggcacgtacggattgaatacattcacaaacatggaagctcaactcatcagacaaatggaaggagaagggatatttaaatctatccaacgcttgaccgttacggaagaaattgcggtacaaaattggttagcgcgtgtgggaagggaacgtctatcaagaatggcgattagtggtgacgactgtgtagttaaaccacttgatgatcgttttgcaagcgctcttacagccctaaatgatatgggcaaagtgcgaaaagatatacaacaatgggaacccagtagggggtggaatgattggacccaagtaccattttgttcgcatcatttccacgaactggtaatgaaagatggaagagtattggttgtgccatgtcggaaccaagacgaattaattgggagggcaagaatatcacagggagctggctggagccttaaagagactgcatgtttgggcaaaagttacgcacaaatgtggaccttaatgtacttccacagaagggatctcagactcgctgcaaacgctatatgttctgcagtcccttcccactgggtcccaacatctaggacaacttggagtatacacgccaaacacgaatggatgactacagaagacatgttggcagtgtggaatagggtgtggatacaagaaaatccttggatggaggacaaaacgcctgtagaatcatgggaagaagtgccttatcttggaaaaagagaagatcaatggtgtgggagcctcattgggttaacatctagagctacctgggctaaaaatattcaaacggctataaatcaagtacgatctttaatcgggaatgaagaatatacagattacatgccttctatgaagcgattcaggaaagaagaagaggaggctggagtgttatggtaa

SEQ ID NO: 22626 - RNA, 9876 nt, synthetic construct
  misc_feature 1..9876: note = derived and/or modified CDS sequence (opt6) from DENV-2__EU482734__SS-prME
  source 1..9876: mol_type = other RNA
acagctggtgttatagttatgctaatccctactgcaatggcatttcatttgaccacgcgaaatggagagccgcatatgatagttggaaggcaagagaaaggaaaatctttattattcaaaaccgaagacggagtaaacatgtgtacccttatggcgatcgacttaggagaactttgcgaagacactataacctataaatgcccgttattgaggcagaacgaacctgaagatatagactgttggtgcaattcaacgagtacctgggtaacgtatggtacatgtacaactaccggagaacatagacgtgaaaaacgaagtgttgcattagttcctcacgtagggatgggcctagaaaccagaacagaaacatggatgtccagcgaaggagcatggaaacatgttcagagaatagaaacctggatcctacgacaccccggttttacaattatggcagcgattttggcatatactattggaacaactcattttcaaagggctcttatttttattttattaacagcggtggcgccaagtatgacaatgcgatgcataggaataagcaatagagatttcgtagagggggtatcaggtggttcttgggttgatatagtactggaacatggttcatgtgttacaacgatggccaaaaacaaaccaactctagactttgaactgatcaaaacagaagcaaaacaacccgcaaccttacggaaatattgtatagaagcaaaattaaccaatacgacaacagaaagtagatgtccaacccagggagaaccgagtcttaatgaagaacaagataaaagattcatttgtaaacactcaatggtagacagaggatggggcaacggttgtggactgttcggtaaaggaggaatcgtaacgtgcgcaatgttcacttgtaagaaaaacatggaagggaaaattgtgcaacctgaaaacttagaatacacaataatgataaccccacattccggggaagaacatgcagttggcaacgacactggaaaacatgggaaagaaattaaaatcacaccacaaagtagtataacagaagcagaattaacagggtatgggacagttaccatggagtgttcaccgcgtacagggctagattttaatgagatggtattgttacaaatggaagataaagcctggttagttcacaggcagtggttcctagatttaccattgccctggctacctggagcggacactcaggggagcaactggatacaaaaagagacccttgtaacattcaaaaatccacatgctaagaaacaagatgttgtggtgctaggatctcaagaaggagcaatgcacaccgcattgacaggagcaactgagatacaaatgtcatcgggaaatctcttatttacgggccaccttaaatgcaggttgaggatggacaaattgcaacttaaaggaatgagctattcaatgtgcacaggcaaattcaaaatcgtaaaagaaattgctgaaacacaacacggaacaattgtaataagagtccaatatgagggggacggatccccctgcaaaataccttttgaaataatggacttagagaaaagacacgtactaggacggctcattacggtgaatccgattgtcaccgaaaaagattcaccagtaaacattgaggctgagccacctttcggtgactcttacataataataggagtcgagccaggtcaactaaaactgaactggtttaagaaagggagtagtataggtcaaatgttcgaaaccacaatgcgtggtgcaaaacgaatggcgatactcggagacacagcatgggacttcgggtcattaggaggtgtgttcacaagcgtagggaaagcactacatcaagtttttggagcgatctacggggccgcattttcaggagtctcttggacaatgaaaatcttaataggggtaataataacctggataggaatgaactcgagatccacatctctaagcgtgagcctagtactcgtgggagtggtaactctatatctcggagcaatggtgcaggcagactcgggctgtgtagtctcatggaaaaataaagaacttaagtgcggaagcggtatattcattaccgataatgtccatacatggacggaacaatataaatttcaacctgaatcgccaagcaaactcgcatccgctatacaaaaagcacatgaagaaggaatctgtggaatcagatccgtaactcggttagaaaatttgatgtggaaacagataactcccgaactcaaccatattctatctgaaaatgaagtcaagttaaccataatgactggcgatataaagggaattatgcaggccggtaaaagatcattgcgtccccaaccgactgaactcaaatattcatggaagacatggggaaaagcaaaaatgctaagtaccgagtcacataatcaaacatttttgatcgacggcccagaaacggctgaatgtccgaacaccaatcgcgcatggaatagccttgaagtggaggactacggtttcggggtgttcacgaccaatatctggcttaaattacgggaaaagcaagatgtattttgtgattcaaagttgatgagtgctgccataaaggataaccgcgcagtgcatgcagacatgggatactggatcgaatcagcacttaacgatacctggaaaatggagaaggcttcatttatcgaagtaaaaagttgccattggcccaaatctcatacactatggtctaacggagtactggagtccgaaatgatcatacccaaaaacttcgccggacccgtatcgcaacataattaccgaccaggatatcacacacagacagcaggtccatggcatctgggcaaactcgaaatggatttcgatttctgcgaaggcacaacagttgtcgtaacagaagactgcggtaacagaggaccgtctttgagaacaaccacagcatcaggcaagttaattacggaatggtgttgtcgttcttgcactttgccaccactgcgatacaggggagaagacggatgttggtatggaatggaaatcagacccttgaaggaaaaagaggaaaatttagtcaacagcttagtaacagcaggtcatggacaaattgataattttagcctcggggtacttggaatggctttgttccttgaagaaatgcttaggaccagggtcgggactaaacatgctattctcctggtggcagtgtcgtttgttacattgatcaccggaaatatgtcgtttagggatttagggagggtgatggtaatggtaggggctacaatgacagacgacataggaatgggtgtaacctacttagcgttattagcagcttttaaagtccgaccaaccttcgcagcaggacttctactaagaaagttgacaagcaaagaacttatgatggctaccataggaattgcattgttaagtcaaagtaccatacccgaaacaatcctagaactaacagacgcccttgctcttgggatgatggccttaaagatagtcaaaaatatggaaaaataccagcttgcagtgaccataatggcgatcagctgcgtacctaacgctgtgatcctacaaaatgcttggaaagtatcttgtactattctcgcagcagtaagtgtgagccccttgttgttaacttcctcacaacaaaaagcagattggatacctctagctttgacaataaaaggtctcaatcctaccgctatattcttaacaaccctcagtcgaacgtcgaagaaaagatcatggccgctaaacgaagcgataatggccgttggtatggtttctatattagcgagttctctactcaaaaacgatatccccatgacgggtcctctcgttgcgggtggattattaacagtttgttacgtactaacaggaagatctgcagatctagaattagaacgcgccgccgatgtgaagtgggaagaccaagccgagatatcgggttcaagtcctatcctaagcataacaatttctgaagacggatcaatgtcaatacgaaacgaggaggaagaacaaacccttacgatattaatcagaaccggattattagttatttcgggtgtctttccagtaagtataccggtaacggcagcagcttggtacctgtgggaggtaaagaagcaaagggctggagttctatgggatgtaccttcaccaccaccagtcgggaaggcagaattggaagacggtgcctatcgaattaaacaaagagggatattgggctatagccagattggagccggcgtatataaagaagggacgtttcatacaatgtggcacgtaacaagaggggcagtcttaatgcaccgaggcaagagaatagaaccaagctgggctgatgtgaagaaagacttggtatcatacggaggagggtggaagctagaaggcgaatggaaggaaggagaagaagtccaggtactggcacttgaaccggggaaaaatccacgagctgtccaaacaaaacccggaatttttaaaacaaataccggtactataggagccgttagcttagatttctcacctggaacgtccgggtctcctatcgtcgataggaaaggaaaagtagttggactctacggtaacggggtagtaacaagatcaggtgcatatgtttcagcaatagcgcaaaccgagaaaagcatagaggataacccagagatagaagatgatatatttcgcaagaaacgactaaccataatggatctacacccaggtgcaggcaaaacaaagagatatttacctgcgatagtaagagaagccattaaacgaggactgagaactttaatattagcgccaactagagtcgtagcagccgaaatggaggaagcgcttaggggcttgcccattagataccaaacaccagcgattagagcagaacacactggacgtgaaatagtcgatctgatgtgccacgctacattcacaatgagacttctaagtccagtccgagttccaaactacaacttaataataatggatgaagctcattttactgacccagcaagcatagcggctagaggatatatatctacacgagtagaaatgggagaagccgcgggtatatttatgacagcaacacccccgggtagtcgtgacccctttccacagagtaacgctccaattatggatgaggaacgtgagatcccagagcgaagttggaatagcggacatgaatgggttacagattttaaaggaaaaacagtatggtttgtgcccagtataaaagctggaaatgacatcgcagcatgtctcaggaaaaacggcaagaaagtgattcagctctccagaaaaacatttgactctgaatacgtcaaaacaagagctaatgattgggacttcgtggttactactgatatctccgaaatgggagcaaactttaaagcagagagggtaattgaccctaggaggtgtatgaaaccggtcatactaaccgatggggaagaaagagttatacttgcaggtcccatgcccgttactcacagtagtgcagcacaaagacgcggaagaattggaagaaaccccaagaatgaaaatgatcaatacatctatatgggggaaccattagaaaacgacgaagactgtgcacactggaaggaagcaaaaatgctgttagataacatcaataccccagaaggcataataccaagtatgtttgaacccgaacgggaaaaagttgatgcaattgatggagagtaccgtttaaggggtgaagctagaaaaaccttcgtagatttgatgcgcagaggagatttaccagtgtggctagcttataaagtggcagctgaaggaataaactacgcggaccgtcgctggtgcttcgatggtattaaaaataatcagatcctggaagaaaacgtcgaagtagagatatggacaaaagagggtgaacgtaagaaattaaaaccccgttggcttgacgcacgcatttactcggaccctcttgcactaaaagaatttaaagagtttgcagctggtcgaaaaagccttacactaaatcttatcacagaaatgggacgccttcctacgtttatgacacaaaaggcacggaacgcccttgataacctggctgttttgcatactgccgaagccggtggaaaagcatacaaccatgcactgtctgaactgccggagacattggaaacgttactactactaacgctattagcaacagtaactggaggaattttcctgtttctgatgtctggtaaggggataggaaaaatgactctcgggatgtgttgtattatcaccgcaagtatattgttatggtacgcacagattcaaccacattggatcgcggcaagcattatactcgaatttttcctaattgtgttattaatacctgaaccggaaaaacaacgtaccccgcaggataaccaattgacgtatgtagttatagcaattctaacagtcgttgcagcaaccatggctaacgaaatggggtttcttgaaaagactaagaaagatttaggtttaggaagtattaccacacaagaatctgagagtaatatattagatattgatttaagaccagcttcggcgtggactttatatgcagttgctacgacttttgtgactccgatgttgagacattccatagaaaattcatcagtcaatgtgagtttgactgctattgcgaatcaagcaactgttttaatgggactaggcaaaggctggccattaagtaaaatggacataggcgtacctttattagctattggatgttatagtcaagttaatccgataactcttacagcagcgctcctactcttagtggcccactatgctattataggaccaggactacaagcaaaagccacacgagaagcccaaaaacgagcagcggctggaattatgaaaaatccgaccgttgacgggatcactgttatagaccttgaaccaataccgtatgaccccaaattcgaaaaacaactaggacaagtaatgttattaattctatgcgtaacacaagtgctaatgatgcgaacaacctgggctctatgcgaagcactaacattagcaacaggtcctataagcacgctatgggaaggaaatccgggacgattttggaatacgaccatagccgtaagtatggcaaatatttttcgaggaagctacctagctggagcaggtttactattctctatcatgaaaaacacaacaaatacaagacgaggtacaggaaatatcggagaaaccttaggagaaaagtggaaaagcaggttaaacgctcttggtaaatctgagttccaaatttataagaaaagcggtatacaagaagtagacaggacacttgctaaagaaggcattaaaaggggagaaacggaccatcacgcagtatctcggggatcagcaaaattgcgttggtttgtagaacgaaatatggtaactccagaagggaaagtcgttgatctgggatgtggacgaggaggatggtcatattattgcggagggctcaaaaacgtccgggaagtaaaaggactaacaaaaggaggcccaggtcatgaagaacctattaccatgagtacatacggatggaatctagttaggttgcaaagcggagtcgatgtattctttacaccaccagaaaaatgtgatactttgctttgcgatataggggagtccagtcctaatcctaccatagaagctggccgaacactccgcgtattaaatctggtggagaattggcttaacaacaacacgcagttttgcatcaaagtattgaatccttacatgccaagtgttatagaaaagatggaaactctacaaagaaaatatggtggagctcttgtacggaacccattaagcagaaactcaactcatgagatgtactgggtttccaatgcaactggaaacatagttagttctgttaatatgatcagtagaatgttaattaacagatttaccatgaagcacaagaaagctacatatgagccagatgttgatctaggatcaggtacgcgaaatattggtattgagagtgaaatcccaaacttagatattataggtaagaggatcgaaaagataaaacaggaacatgaaacttcatggcactacgatcaggaccatccatataaaacatgggcataccacggatcttacgaaacaaagcagactggttcagctagttccatggtaaatggtgttgtccgcttactaacaaagccatgggatgtggttcctatggttacacagatggcaatgactgacacgacacccttcggacaacaaagagtgtttaaagagaaagttgataccagaacacaagagcctaaagaagggacaaagaaattaatgaaaattacggcagaatggctatggaaagaattgggtaaaaagaaaacaccccgtatgtgtactagggaagaatttacaaggaaagttaggtcgaacgctgcccttggagctattttcacagacgaaaacaaatggaaatctgctagagaagcggttgaagatggaaggttttgggaattggtagacagagaaagaaatttacacctagaaggcaagtgtgaaacgtgcgtatataatatgatgggtaagagagagaagaaattaggggaatttggcaaagccaagggatcacgcgcgatttggtatatgtggcttggagcacgattccttgagttcgaggcgctgggattcttaaatgaagaccattggttctctagaggtaacagtttgtctggagtcgaaggggaaggattgcatcggctgggatatatactacgagatgttagtaagaaagaaggaggagcaatgtacgcagacgacacggctggatgggatacgaggatcacattagaagacctcaaaaacgaggaaatggttactaaccatatgaagggtgagcataagaaactagcagaggcaatatttaaactcacatatcagaataaagttgtcagagtgcaaagaccaacgcccagggggactgttatggatataataagcaggcgggatcagagaggaagtggccaagtaggaacttacggcctaaatacctttacaaacatggaagcacaattgattagacaaatggagggagaaggaatatttaaatctatccaacacttaaccgtaactgaagagatagcagtacagaattggttagctcgagtgggtagagaacgtttgtcacgcatggcaattagtggtgacgattgcgtggttaagcctatagatgataggttcgcgtctgctttaacagcattaaacgacatggggaaagtaagaaaggatattcaacaatgggaaccttcacggggttggaatgactggacccaagttcccttctgctcacaccacttccacgagctagtaatgaaagatggtcgggtcctagttgtaccatgtagaaatcaagacgaacttataggtagagcaagaatcagtcagggagcaggatggagtttaaaagaaactgcttgtttaggaaagtcatacgcccaaatgtggacactcatgtattttcacagaagagatctaagattagcagcgaatgcaatatgtagcgcagtacccagccactgggtacctacatccaggacgacatggtcaattcacgctaagcatgaatggatgaccactgaagatatgctcgcagtatggaatcgtgtgtggatacaagaaaacccgtggatggaagacaagacgccagtcgaatcgtgggaagaggtaccctatttgggaaaacgtgaagaccaatggtgtggctcactcataggtcttacctctcgcgcaacgtgggcaaagaacattcaaaccgcaatcaaccaagtgaggtctctcatcggaaatgaagaatatacggattacatgccgtcaatgaaacgattcaggcgagaagaagaggaagccggagtactgtggtag

SEQ ID NO: 22627 - RNA, 9876 nt, synthetic construct
  misc_feature 1..9876: note = derived and/or modified CDS sequence (opt6) from DENV-2__EU482735__SS-prME
  source 1..9876: mol_type = other RNA
actgctggagtaatagtcatgctaattcccacagctatggcttttcatttaacaacgagaaatggtgaaccccacatgatagtaggaagacaagaaaaaggaaaatcactgctatttaaaactgaagatggagttaatatgtgcactcttatggctatcgacctaggtgaattatgtgaagacacaattacgtataaatgtcccttattaagacaaaatgaacctgaagatatcgattgctggtgtaattcaacgagtacatgggtaacctatgggacatgtacgactacaggtgaacatcggagagagaaacgaagtgttgcgctcgtaccccacgtcggtatgggacttgaaacacgaactgaaacttggatgagtagtgaaggtgcatggaaacatgtacaaagaattgaaacatggattctaagacatccaggatttactataatggcagcaatcttggcttacaccataggaacaacacatttccaaagagcgctgattttcattctactcacagcggtagcaccatcaatgacgatgagatgtattggaatttcaaacagggattttgtggaaggtgtatctggaggttcgtgggtggacattgtcctagaacatggttcctgcgtgacaacgatggctaaaaataaaccaactttagattttgaactaatcaaaacagaggcgaaacaacctgctacgctgcgaaaatactgcatagaagcaaaactcacaaacacgacgacggagagtagatgccccacacaaggagagccctcactaaacgaagaacaagataaaagatttatttgcaaacattccatggtagatagagggtggggaaatggatgcggactatttggaaaaggaggtattgtaacatgtgcaatgtttacttgcaagaaaaacatggaaggaaaaatagtccaaccagagaacttggaatatacaataatgatcacgccacacagtggagaagaacatgcagtcggcaacgatacaggaaaacatggaaaagaaataaaaattactccacagagttcaatcacagaagctgagctaacgggatacgggaccgtgacaatggaatgttcacctcgaacaggtttggattttaatgagatggtactgttacaaatggaagataaagcatggctagtacatagacaatggtttctagatctgccattaccatggcttccaggagcagatactcaaggtagtaattggattcagaaagaaactttagtaactttcaaaaatcctcatgcaaagaaacaagatgtagttgtgttaggcagccaagaaggagcgatgcatactgctttaactggggcaacagaaatacaaatgagctcgggaaacttactatttactggtcatttgaaatgcagattaagaatggataaacttcagctaaaaggaatgtcatacagtatgtgcacaggtaaatttaaaattgtgaaagaaatcgctgaaacgcaacatggaaccatagtaatacgtgtccaatatgaaggagatggctcaccatgtaaaattccctttgaaattatggatctagagaaaaggcatgtattgggaaggctaataacggtaaaccctatagtgactgaaaaagacagtcctgtcaacatcgaagcggagcccccttttggtgattcctacatcatcataggtgtcgaaccagggcaattaaagctcaattggtttaaaaaggggtcctctatagggcagatgtttgaaacaaccatgagaggggcaaaaagaatggcaatactaggagacacagcctgggattttgggtctctaggaggagtgtttacaagtgtaggaaaagcattacatcaagtgtttggagccatttatggagctgcgttttcaggagtatcctggacaatgaaaatcctgatcggagtcataattacgtggattggcatgaactctagatcaacaagtttatccgttagcctagtattggttggtgtagttacactgtacctaggtgccatggtacaagcagacagtggatgtgttgtatcctggaagaataaagaactcaagtgtggatccggaatttttataacagataacgtacatacatggacagaacaatacaagtttcaaccagaatcaccatctaaacttgcatcagctattcaaaaagcacacgaagaaggtatatgtggtattcgatcggtcacgaggcttgaaaatctcatgtggaaacaaattactcccgaattaaatcacatcctttccgaaaatgaggtgaaactgacgataatgactggcgatattaagggcataatgcaagcagggaaaagatctttaaggccccagcctactgaactgaaatatagctggaaaacttggggtaaagcaaaaatgctttcaaccgaaagtcataatcaaactttcttaatagacggacctgagaccgcagaatgtccaaatacaaatagggcatggaatagtttagaggttgaagattacggttttggagttttcactacaaacatttggttaaagttaagagagaagcaagatgtgttttgcgactcaaaattaatgagcgcagccataaaagataacagggccgtccacgccgacatggggtattggatagaatcagcattaaatgatacttggaagatggagaaggcaagttttatagaagttaaatcatgccattggcctaaaagtcacacattatggtcaaatggagtcttggaaagtgaaatgataatacctaagaattttgctggtccagtctcgcaacacaactatcggccaggataccatacccaaactgctggcccttggcatctcggtaaattggaaatggatttcgatttttgcgaaggaacaacagttgtggtaacggaagactgtggaaacagaggaccgtctctgagaacgaccactgctagtggaaaactaataaccgaatggtgttgccggagctgtaccttaccaccattacgctacagaggcgaagatggctgctggtatggaatggaaatacgtcccttaaaagaaaaagaagaaaatctggttaattcgctggttacggctgggcacggccaaattgataacttcagcttgggggttttaggaatggctttgtttttagaggagatgctacgaacaagggtcggtactaagcatgcaatacttttagttgctgtttccttcgtaactcttataacgggaaatatgtctttcagagatctcggacgagtaatggttatggtaggcgcgactatgacagatgatataggtatgggcgtcacttatctagccctacttgctgcgtttaaagtacgcccaacctttgctgcaggcttattgcttcggaaactaacttcaaaagaacttatgatggctacaattggaatcgcactattatcccagtccacaattccagaaaccatattagaactcacagacgctttggccctgggtatgatggctctcaaaatagtcaaaaatatggagaaatatcaactggcagtaaccatcatggccatctcttgcgtcccgaatgcagtcattctacaaaacgcatggaaagtgtcgtgtacgatactagctgcagtatccgtatctcctctcttgctcactagctctcaacaaaaagcagattggataccgctggcgttaacaataaagggactgaaccctacggccatttttctaactactctatcccgtacgagcaagaaaagaagctggccgctcaatgaggcaataatggcagtcggaatggtatctattcttgcttcctcactgctcaaaaatgatatccctatgacagggccgttagtagcaggaggtctgctcactgtatgttacgttttgactggacggagcgcagatcttgagttagaaagggctgccgatgtcaaatgggaggaccaagcagaaatttcaggatcatccccaatactctcaataacgattagcgaagatggttcaatgagtatcagaaatgaagaagaggagcagaccttaactattctcattagaacaggcttgcttgtgatttccggggtgtttccggtttctatacccgtaacagcggctgcgtggtacctctgggaagtgaaaaagcaaagagctggtgttttgtgggatgttcccagcccaccaccggtaggcaaagcagagttagaagatggggcataccggattaaacaaagaggcatcttgggttactcacaaatcggagcaggagtgtacaaagaaggtacatttcatactatgtggcatgtaactcgaggagcagtacttatgcacagaggtaaaaggatagaaccaagttgggccgacgttaagaaagacttggtatcctacggaggaggatggaagttagagggtgaatggaaggagggagaggaagtacaagttctagctctcgaaccggggaaaaacccaagagctgtgcagaccaaacccggtatattcaaaacaaacacaggtacaataggagcagtcagtctagatttctcaccagggacgtcaggctcccccatcgtagacagaaaaggtaaagtagtaggattgtatgggaatggtgtagtcacgagatcgggagcatacgttagcgccatcgctcaaacagaaaagtcgatcgaagataatcccgaaattgaagatgacatcttcaggaaaaagcgattaacaattatggacttgcatcctggagcaggtaaaacaaaaagatatttacctgcaatagttcgtgaagcaataaaacgaggattaagaacattaatattagcacctaccagagtagtagcagcagaaatggaggaagcactaagggggctaccgattcgttatcaaactcctgcgatacgtgcggaacatactggcagagaaatagttgacctcatgtgccacgcaactttcacaatgcgactacttagtcctgtacgagtaccaaattacaacctaattattatggacgaagctcactttacggatccggcatcgatagcggcaagaggatacatatctacgcgtgtagaaatgggtgaagctgcagggatttttatgaccgcaacacctcctggatcacgagatccattcccgcagagtaatgcgcctatcatggacgaagaacgggaaatacctgaacggagttggaactcgggtcacgagtgggtcaccgattttaagggaaaaactgtatggttcgttccgtcaataaaagccggaaacgatattgctgcctgcttacggaaaaacgggaagaaagtaattcaattatcaagaaaaacatttgatagtgaatatgtcaagactagagctaatgactgggactttgtcgttacaacggatatatcagaaatgggagcaaattttaaagcagaacgggttatagatccacgacgttgtatgaagccagtgattcttaccgatggagaagaaagagttatactcgcggggccaatgcctgttacacactcaagcgccgctcaaaggaggggtcgaattggacgaaaccccaaaaatgaaaacgatcaatatatttacatgggggaaccactggaaaacgacgaggactgtgcacactggaaagaagctaaaatgttgttagacaatattaatacacctgaaggaattattccgagcatgtttgaaccggagcgggaaaaagtagatgcaatagacggcgaatacaggctacgtggagaagcaagaaaaacttttgtggacctcatgaggagaggtgatctccccgtttggttggcatataaagtagctgctgaagggattaattacgctgatcgccgatggtgttttgacggtattaaaaataatcagatattagaggaaaacgtggaggtagagatatggaccaaagaaggtgaaaggaaaaagctaaaacctagatggttagatgcaaggatctattctgatccattggccttaaaagaatttaaagaatttgctgccggcagaaaatcattaacgttgaatcttatcacagaaatgggtcgactccccacttttatgactcaaaaagcacgcaatgccctcgataaccttgctgtattacacacggcagaagccggtggtaaagcatacaaccatgcattaagcgaactcccagaaacactcgagactctacttttactcactttactcgcaacggttacaggaggaatcttcttatttctcatgagcggtaaaggaataggtaagatgacattaggtatgtgttgtattataactgcttccatccttttatggtacgcacaaattcagccacactggattgctgcgtccatcatccttgaatttttcctaatagtcttattaataccagagccggaaaaacagcgaacaccccaggataatcagctaacctatgtcgtaatagccatattaacggtagtagctgctaccatggctaacgaaatgggattcttagagaagactaagaaagatttaggattgggaagtataacaacccaagaatcagaaagcaatatacttgatatagatctgcggccagcgtcggcctggaccctatatgcagtagccacaacctttgtcaccccaatgttgcgacactcgatagaaaattcgagtgtaaatgtgtcgctgacggcgatagctaatcaagcaactgttctcatgggtctaggtaaagggtggccgctaagcaagatggatataggtgtgccactcttagctataggatgttatagccaagtgaacccgattactttaacagctgcactactattgctagttgcacactatgcaataataggtccaggattacaagctaaagctactcgcgaggcccaaaagcgagcagcggcaggtattatgaagaatcctacggtggacggcataacagtaatagatttagagcctataccctacgaccccaaatttgagaaacaattgggacaagttatgttactcattctctgcgtgacacaagttctaacaatgagaactacctgggcgctatgtgaagccttaactttagcaacgggtccaatctctacgttatgggaaggaaacccgggaagattctggaatacaacaatagcggtttccatggctaatatttttaggggttcttacctagcaggggcagggttattatttagcattatgaaaaacacaacaaacacacggagaggcacaggcaatattggtgaaaccctaggcgaaaaatggaaaagcagacttaacgcactaggtaagagtgaatttcaaatttacaaaaagtctggcattcaagaggtagacagaacattagcaaaagaaggcattaaaagaggggaaacggaccatcacgcagttagtaggggctcggcaaaattacggtggttcgtcgaacgaaacatggttacaccagaaggaaaagtggtagatttgggatgcggccgaggcgggtggtcatattactgcggtgggctcaaaaatgtccgcgaagtaaaaggattaacgaaaggaggacccggacatgaggaacccataccgatgtcgacatacggttggaatctggtacgtcttcaatctggcgttgacgtattctttactccacccgaaaaatgcgatacgctcttatgtgatattggtgaatcgtctccaaaccctacaatagaggccggacgcaccttaagggtactcaatttagtagaaaattggctaaacaataatactcaattttgtattaaggtgctcaatccgtatatgccttcagtgatagagaaaatggaaactttacaacgaaaatacggaggtgctctagttcgcaatcctttatccagaaacagtacacacgaaatgtattgggtctccaacgctacaggcaatatagttagttcggtaaacatgatatctagaatgttaataaatagatttaccatgaaacataagaaagctacatacgagccggatgtggatctcggatcaggtactaggaacatcggtatcgaaagcgaaatcccaaacttagacataattggaaaacgaatagagaaaatcaagcaagagcatgaaacgtcatggcattacgatcaagatcatccctacaagacctgggcatatcatggtagttacgaaacaaaacagaccggtagtgcttccagcatggtcaacggcgtagtaagacttttgaccaaaccctgggatgtggtaccgatggtgacgcaaatggccatgacagacacaacaccgttcgggcaacagagagtgtttaaagaaaaagtagatactcgaacccaagagccaaaagaaggaactaagaaattgatgaagataaccgccgaatggttatggaaagagctcggcaagaagaaaactcctaggatgtgtacgagggaggaatttacccgaaaagtgcgctctaatgctgcgctcggagcaatatttactgacgagaataaatggaaaagtgcacgcgaggccgttgaagatggaagattttgggagctagtagatagagaacgaaatttacacttagagggaaaatgtgaaacatgtgtttataatatgatgggcaaacgggagaagaaattgggcgagttcggtaaagcgaaggggagtagagctatctggtatatgtggctcggggcaagattcctagaatttgaggcgctgggtttcttaaacgaggaccattggttttctcgaggaaattccctttcaggcgttgaaggagaaggattacatcgacttggatacattctgagggatgtaagtaagaaagaaggtggagcgatgtatgcagatgacacagcagggtgggatacgaggataaccttagaagacctaaagaacgaagaaatggtgaccaatcatatgaaaggtgagcataagaaactggcagaagcgatatttaagttaacttatcaaaataaagtggttagggtccaaagaccaactccgcgaggaacagtgatggacataatttcgagacgagatcaaagaggatcaggtcaggtaggaacgtacggtctaaacacgtttactaatatggaagctcaactaattcgccaaatggagggagaaggaatatttaaatcaatacaacatttaacagttaccgaggaaatcgcagtacaaaattggctggcacgcgtggggcgggagcgtctttcaaggatggctatctctggagatgattgcgtggttaaacccatagatgatagatttgcttctgccctaaccgcattgaacgatatgggaaaagtacgtaaagacatccaacaatgggaaccttccagaggatggaatgactggactcaggtacctttttgttcccatcactttcacgaactggttatgaaggacgggagagtattagttgtcccatgccgaaatcaggacgagctaatagggcgagcaagaatatcacagggagccggatggtcattgaaagagacagcttgcctaggcaaatcatacgctcaaatgtggacattaatgtatttccatcgacgcgatttacgattagctgcaaacgcgatatgttctgctgtaccatcgcactgggttccgaccagtagaacgacttggtcaatacatgcaaaacatgaatggatgacaaccgaggacatgctagcggtgtggaatagggtatggattcaagaaaacccatggatggaggataaaacacctgtggagagctgggaagaggttccgtatttgggaaagcgtgaagaccaatggtgtggatcactcattggtttgacttcaagagccacttgggccaaaaatatacaaacagcaataaatcaggtcaggagtcttattggaaatgaagaatacacggactacatgccatcaatgaaacgttttcgcagggaagaagaggaagccggtgtgttatggtaa

SEQ ID NO: 22628 - RNA, 9876 nt, synthetic construct
  misc_feature 1..9876: note = derived and/or modified CDS sequence (opt6) from DENV-2__EU482736__SS-prME
  source 1..9876: mol_type = other RNA
acggctggggtaattattatgttaatacccacagcaatggcttttcacttaacaactagaaatggggaacctcatatgatagtggggagacaagaaaaaggaaaaagtttactcttcaaaacggaagatggggtaaatatgtgtacacttatggctattgacttgggagaattatgtgaagacacgataacttacaaatgtccattactcaggcaaaatgaaccagaagatatagactgctggtgtaattcgacaagtacttgggtcacatatgggacatgtacaactactggagaacacagacgcgagaaaagatccgttgcgcttgtacctcacgtgggtatgggattagaaacaagaaccgaaacttggatgtcgtccgaaggagcatggaaacatgtccaaaggatagaaacgtggatacttaggcaccctggctttacgattatggcagcaatattagcatacactattggaacaactcactttcaaagagcactaatatttatcttgttaacagccgtggccccgtctatgactatgagatgtataggaattagtaatcgggatttcgtcgaaggagtatctggagggtcttgggtagatattgtattagaacacggaagttgtgtaaccaccatggccaaaaataaacctacgttagattttgaactaattaaaacggaagccaaacaaccggctacactgagaaaatactgtatagaagctaaactgaccaatacaacaacagaatcccgatgccctacacaaggggaacccagtttaaatgaagaacaagataaacgattcgtgtgtaaacattccatggtagacaggggatggggaaatggctgcggtttatttggaaaaggaggaatagttacgtgtgcgatgtttacttgtaagaaaaatatggaagggaaagtagttcttccagaaaatttagaatacacaattgtaataactccacactccggagaagaacacgcagttggcaacgacaccggtaaacatgggaaagagataaaaatcacaccccaaagttccataaccgaagcagaactcacgggatatggcactgtaactatggaatgcagcccgagaacaggtctagattttaacgaaatggtactattgcaaatggaagataaagcctggttggtacatagacaatggttcttagatttaccgcttccatggctaccgggagcagatactcagggtagtaattggatacaaaaagagactttagtaacatttaagaatcctcatgctaagaaacaagacgtagtagtgcttggaagccaagaaggcgctatgcatactgcattaactggcgcaactgaaatacaaatgtccagcggcaatctccttttcactgggcatctaaagtgtcgcttgcgcatggacaaattgcaattgaaaggcatgtcatacagtatgtgtacaggtaaattcaaaatcgtgaaagaaatagcagagacgcaacatggaactatagtgatacgagtccagtacgaaggagatggaagcccatgtaaaattcccttcgagattatggatttagagaaacgacatgtcttaggaaggctaataaccgtaaatcctatcgtagccgaaaaagactcgccagtgaacatagaggccgaaccacccttcggtgattcgtatatcatcataggtgttgagccgggacagttgaaactaaactggtttaaaaagggatcatccattggtcaaatgtttgaaacaacaatgcggggagcgaaacgtatggccattctaggggatactgcgtgggactttggatccctcggaggagtttttacttcaatcggcaaagcactacatcaagtgttcggagctatttacggagcagccttctcaggcgtatcttggacaatgaaaatactaataggcgtaattataacatggataggcatgaactctcggagcacatctttatcggtctcgctagtcttagtcggggttgtaaccctttatttaggtgctatggttcaggctgacagcggctgtgtggtgtcatggaaatccaaggaattaaaatgtggaagtggaatcttcatcacggacaacgtccatacgtggactgaacaatacaaattccagccagagtcgccctcaaaattagcgtccgcgatacaaaaagcacatgaagaaggaatatgcggaatcagatccgtaaccagattagaaaatttaatgtggaaacagattacgcctgaattgaatcacattctatcagagaacgaggttaaattaacaatcatgactggcgacattaaaggaataatgcaagcaggtaaacggagcctacgcccacagccaacagaacttaaatattcttggaaaacatggggaaaagctaagatgctatctaccgaatctcacaatcaaactttcttaatagatggacctgaaacagccgaatgtccaaacactaaccgcgcgtggaactcactagaggttgaggactatggatttggcgtgtttacgaccaacatttggctgaaactgagggagaaacaagatgtattctgcgactccaaattgatgtcagctgcgataaaagataaccgagctgttcatgctgacatgggctactggatagagtcagctctgaacgatacatggaaaatggaaaaagcctcatttattgaggtaaaatcatgtcactggcctaagagccatacactctggtcaaatggcgtgttagaatcagagatgatcattcctaaaaattttgcaggaccagtgtcacaacataactacagaccaggctatcacacacaaacggcgggcccttggcatcttggaaaattagaaatggacttcgacttttgtgaaggaactactgtagtagtcacagaagactgtggaaacagaggacccagtcttagaactacgactgcaagcgggaaattaattacagaatggtgctgtcgttcgtgtaccttaccaccattacgatacagaggcgaggatggttgctggtacggaatggagataaggccacttaaagaaaaagaagaaaatctagtaaatagtctggtaacagcgggtcacgggcaaatagataatttttcgttaggtgtactgggaatggctttatttttagaagaaatgctaagaaccagagttggcaccaaacacgcaatgttattagttgtagtatctttcgtaaccctaataacaggtaatatgagtttcagggatctaggaagagttatggtaatggtaggtgcaactatgactgatgacataggtatggggattacctatctggcccttcttgcggcattcaaggtaaggccaacgtttgctgcgggactcttattaagaaaactaacgtcgaaagagttaatgatggctaccattggtatagccctcttatcacagtcaacgatacccgagaccatactcgagctcactgacgctttggcgctgtcaatgatggtattaaaaattgtacggaacatggaaaaataccaacttgccgtgacgatcatggccattagctgtgtgccgaacgcagtaatcctgcaaaacgcatggaaggttagttgtacgattttggcagcagtgtcagtctcgccactcttactaacgtctagtcaacaaaaggcagattggataccgctagctctaactataaaaggtctcaacccgacggcaatattcctgaccactttatcccgtacaagcaagaaacgatcttggccattgaacgaagcgataatggcagttggcatggtttccattttagctagttcattgttaaagaatgacatacccatgaccggccccctcgtagctgggggtctattaacagtctgttacgttcttacaggccgatccgccgatctagaattagaacgtgcagcagatgttaaatgggaagatcaagctgaaataagtggttctagtcccattctcagtatcacaatatcggaagatggaagtatgagtatcaaaaatgaggaggaagaacagacgctaacgatacttatcagaactggactgttagttattagtggtgtttttccagtcagtatccctatcaccgcagcggcttggtacttatgggaagttaagaaacaaagggcgggagttttatgggatgtaccatccccacccccagtcgggaaagcggaattagaggatggtgcttaccgcatcaaacagcgaggaatattagggtactcacaaataggtgcaggcgtatataaggaaggaacatttcatacaatgtggcatgttaccaggggtgcagttcttatgcacagaggaaaacgtatcgaaccaagctgggccgatgttaaaaaggatttaattagctacggcggcgggtggaagctagagggggagtggaaagaaggagaagaagtccaggtcctggcactagaaccgggcaaaaacccgagagcagtccaaacaaaaccaggactattcaagactaatacaggaacaataggagcagtaagtctagatttttctccagggacgagcgggagccctatcgttgatcgtaaagggaaagtagtcggtttatatggtaacggagtagttactcgaagtggagcatacgtgtccgcaatagctcaaacagagaaaagtatagaggacaaccctgaaatagaagacgacatctttagaaagaaaaggctaacaatcatggacctacatccgggagcggggaaaactaaaagatatctaccagcaatcgtacgagaggcaataaaaagagggctaagaacattaatcttggcacctacccgagtagtagccgctgaaatggaagaagcgttaaggggattaccaatccgctaccaaacaccagcaattcgagcagaacataccggtcgtgagattgtagatcttatgtgtcatgctacattcaccatgagactacttagcccggtaagagttccaaattacaatcttatcatcatggatgaagcacattttacagatccagcgtcaattgcagcaagagggtatatatcaaccagagtagaaatgggagaagcagcaggtatattcatgacggcaacacctcctggaagtagagatccctttccacaatctaatgcacctataatggatgaagaaagagaaatacccgaacgttcatggaactcaggtcatgaatgggtgaccgactttaaaggaaaaacagtatggttcgtcccatcaatcaaagcgggaaatgatatagcggcttgcctccggaaaaacggcaagaaagtaattcaattgtcccgaaaaacatttgatagtgaatatgtaaaaacacgtgcaaatgattgggattttgtagtaacaacagatatatcggaaatgggtgcgaattttaaggccgaaagagtgatcgatcctcgaagatgcatgaagccggtaatactaactgacggtgaggagcgagtaatattggcaggaccaatgccagtaacacattctagtgccgcacaaagacgaggacgtattgggagaaatcctaaaaacgaaaacgaccaatacatatatatgggggagccactagaaaatgatgaagattgcgcacactggaaggaagctaaaatgttactagataatataaacacgcccgagggcataataccaagtatgtttgagccagaaagggaaaaagttgatgccatagacggagaatataggttacgaggagaagcgagaaaaacgttcgtagatctgatgcgtagaggagatctcccagtatggcttgcttacagggtcgcagcggaagggattaactacgccgaccggcgttggtgtttcgatggtattaaaaacaatcaaatcttggaagagaatgtagaagtagaaatttggaccaaagaaggtgaaagaaagaaactcaaaccacgatggcttgatgcccgcatatacagtgatccattagcgttaaaggaatttaaggagtttgctgcagggaggaaaagtttgacactaaacctaattacagagatgggccgactacctacatttatgacacaaaaagccagagatgcactagataatttagctgttttacacacagctgaggctggtggtagagcttataaccatgctttatctgagttacctgagactcttgagacactattgctgctcactttacttgctacagtaacgggcgggatttttctcttcctcatgtccggtaaaggcataggtaaaatgacgctaggaatgtgttgcataataacagcgagtatattattgtggtatgcacaaatacaaccgcactggatagctgcctcgatcattttggagttctttttaatagttctattaattccggaaccagaaaagcaacgtacacctcaagacaatcagctgacttatgtagtgattgccatattaactgttgtggcagcaacaatggccaatgaaatgggtttcctagagaagacgaagaaagatctagggttggggagtatagctacacaagaatccgaatcaaacattctagacattgacttaagaccggcatcagcctggactttatatgcggtcgctactaccttcgtaacaccaatgttgaggcatagtatagaaaattcaagtgtaaacgtatcccttacggcaatagcgaatcaagcgactgttttaatgggtttaggtaaaggctggcccctgtctaagatggatatcggggttcccctattagctattggatgttactctcaagtgaatcctattactctgacagctgctttgttactcctggtagctcactacgctataataggacctgggttacaagcgaaagctacgagggaagctcagaaaagagccgccgctgggattatgaagaatccaactgttgacggcattactgttatagatctggaacctataccttatgatccaaaatttgaaaaacaattaggacaggttatgctattaatactttgtgtcactcaagttttaatgatgcgtacaacatgggccctatgtgaagctctaactcttgctactggtccaataagtacactgtgggaagggaatccaggaaggttctggaatacaacgatcgccgtgagtatggcaaacatttttcggggatcatatttggcaggcgcgggtttactattttcgattatgaagaacacaacaaatactcgtagaggtactggaaatattggtgagacactaggcgaaaagtggaagtcacgactgaacgcgctcggaaagtccgagttccaaatatataagaaatcaggtattcaggaagtcgacagaacactagcaaaggaagggataaaaagaggggaaacagatcaccacgccgtctcgaggggatcagcaaaactaaggtggttcgtggaacgaaatatggtcacgccggaggggaaagttgttgatctaggttgcggtagaggaggctggtcatactactgcggcggactaaagaatgtacgagaagtcaaagggttaacaaaaggtggaccagggcatgaagaaccaataccgatgtccacgtacggatggaacttagttagactacagagcggagttgatgtgttctttacaccacctgagaaatgcgacacccttttatgtgatataggagaaagcagtcctaatcctacaatagaagcgggcagaaccttgagagtattaaatctagtagagaattggctgaacaataatacacaattttgcattaaagtcctaaatccctatatgccgagtgttattgagaaaatggaaaccctacagaggaagtatggaggcgcgttagttagaaatccactaagtagaaattctacacacgaaatgtattgggtaagtaacgctactggaaatatagtgagctcagttaatatgattagtcgaatgctgattaacagattcacaatgaaacacaagaaagctacctatgaacccgatgtagatttaggatccgggacaagaaacatagggatagagtcagaaatcccgaatctagatattatcgggaaaagaatcgagaaaataaaacaagagcacgaaaccagttggcattacgatcaggatcatccatacaagacttgggcttaccatggttcctatgaaacaaagcaaacaggatcagcctcgagtatggtcaacggagtcgtacgtctgctcactaaaccatgggatgtcgtaccaatggtaacccaaatggctatgacagatacaacaccatttggacaacagagggttttcaaagagaaagtcgacacaagaacgcaggagcctaaagagggaaccaagaaactaatgaaaatcacagctgaatggttatggaaggaactcggcaagaagaaaactccaaggatgtgcactcgtgaagagttcacccgaaaagtgagatcgaatgcagctctaggcgcaatttttacagatgaaaacaaatggaaatcggcaagggaggccgtagaagatagtcgattctgggaattaattgatcgcgaaaggaaccttcatttggaaggaaaatgcgaaacatgtgtctataatatgatgggcaaaagagagaagaaactcggagagttcggtaaagctaagggctccagagccatttggtatatgtggttaggtgctcgctttctagagttcgaagctctaggtttcttaaatgaggaccactggttttcacgaggtaactctctgtcaggcgttgaaggagagggtttgcaccggctaggctatatactgagagatgtctctaagaaagagggaggagcaatgtatgcagatgacacggctggctgggatacaagaatcactttagaagacctgaaaaacgaggaaatggtaactaaccatatgaaaggtgagcataagaaacttgcagaagccatattcaagctaacatatcaaaacaaagtagtaagggtacaacgacctactccacgaggaacggtaatggatataatatcaagacgcgaccaacgaggctccgggcaagtgggtacatatggtctaaatacttttaccaatatggaagcacaattgattagacaaatggaaggagaaggaatatttaaaagtatccaacatttaacggtgacagaagagattgcggtgcaaaactggctggcacgagttgggagagaaagattgagtcgtatggcaattagtggagatgactgtgttgtaaaaccactcgacgatagatttgcaagcgccctaacggctttaaacgatatgggaaaggtaagaaaggacatacaacaatgggaacctagtaggggctggaacgattggacacaggtccccttctgtagtcaccattttcacgaactcgtaatgaaagatggaagagttttagtcgtaccctgcagaaaccaagatgaactgattggaagggctcgaatatcgcaaggcgctgggtggtcgttaaaagaaacagcctgcttaggtaaaagctacgcacaaatgtggacactaatgtactttcatcgaagagatttaaggttagctgccaatgcgatttgcagcgcagtccctagccactgggttccaacatcgaggaccacctggagtatccatgcgaaacatgaatggatgactacagaagacatgttagccgtctggaatcgagtgtggatccaggaaaacccatggatggaagacaaaactcctgtcgagtcttgggaagaagtcccgtatctaggaaaaagagaggaccagtggtgcggttcgttgattggacttacttcgagggccacatgggctaaaaacatacagacagccataaatcaagtaagatcacttatcggcaacgaagagtatacagattatatgccctcaatgaagagatttaggagagaagaagaagaggcaggggtactttggtga

SEQ ID NO: 22629 - RNA, 9876 nt, synthetic construct
  misc_feature 1..9876: note = derived and/or modified CDS sequence (opt6) from DENV-2__EU482737__SS-prME
  source 1..9876: mol_type = other RNA
actgctggggtaatagtaatgttaatcccaacagctatggcttttcatctaacaacgagaaatggagaacctcatatgatcgttggtagacaagaaaaaggtaaatctctgctgtttaaaacagaagacggagttaatatgtgtacattaatggcaatagacttaggagaactttgcgaagatactataacatataaatgcccgctcttgagacaaaacgaacctgaagacatagattgctggtgcaattcaacatctacatgggttacttacggaacatgtaccacaaccggcgaacatagaagagagaaaagatcggtagcattagtcccacacgtcggtatgggactagaaacgcgaactgaaacatggatgtctagtgaaggtgcatggaaacatgttcaacgaatagaaacttggattttgagacacccgggatttaccattatggcggctatattagcatatactataggaactacacattttcaacgagcattaatatttatattattaacggcagtagcaccaagtatgacgatgaggtgtatcgggatatcaaaccgtgattttgtcgaaggagttagcggaggctcatgggttgacatagtgttggagcacgggtcctgtgttactacaatggccaaaaataaaccaactctcgattttgaattaataaaaacagaggcaaaacagccggcaactcttaggaaatattgtattgaagcaaaactgaccaataccacgacagaatctcgatgcccgacacaaggagaaccaagtctgaatgaggaacaagacaaacgattcgtatgcaaacatagcatggtagaccgcggttggggtaacgggtgcggtcttttcgggaaaggcggaatagttacttgtgctatgtttacttgtaagaaaaacatggaaggtaaagtggtgttaccagaaaatctagaatatacaatagtaataaccccacacagcggggaggagcatgctgtaggtaatgacaccggtaaacatggaaaagaaattaaaataactccacaaagctcaataacagaggcagagttgactggttacggtacagtgacaatggaatgtagtcctcgaaccggattagactttaatgaaatggttttacttcagatggaagataaggcgtggttagttcatagacaatggtttcttgatttgccccttccttggctgcccggagctgatacgcagggaagtaattggatccaaaaagaaactttagtaacattcaagaatcctcacgctaaaaagcaagacgtagttgttctagggagccaggaaggggcaatgcacacagctctaactggagcaactgagatacaaatgagcagtggtaatttgttattcacaggtcacttgaaatgccgattacgtatggataaactacagctaaagggaatgtcttacagtatgtgtacgggaaagtttaaaatagtaaaagaaatagcagaaacacaacatggtacaatcgtaatacgcgttcaatacgaaggtgatggctctccatgtaaaataccattcgaaataatggacctggagaaacgacacgtcctaggaaggctaattaccgtaaatccaattgtagctgagaaggacagccctgtaaacatagaagcggaacctccatttggagattcttatattatcataggtgtggagccgggtcagcttaaactaaattggttcaagaaaggtagttcaattggacagatgttcgaaacgacaatgagaggagcaaagagaatggcaattctaggggacacagcatgggatttcggaagcctcggcggagtttttacttcaataggcaaagcacttcatcaagtcttcggagcgatatacggtgcggccttctcaggagttagttggaccatgaaaattctaattggtgttataatcacatggattgggatgaatagtagaagcacttctctatcggttagcctagtcctagtaggagtcgtaacattatatttaggtgcaatggtccaggctgatagcggttgcgttgtttcctggaaatcgaaggaactcaagtgtggtagtgggatatttatcactgacaatgtacatacttggacggaacagtataaatttcaaccggaaagcccgagcaaattagctagcgcgatccaaaaagcgcacgaagaaggaatatgtggtattagatcagtaaccagattggagaacttgatgtggaaacaaatcactccagaattaaatcatatactctctgaaaacgaagtaaagttaactataatgacaggagatatcaaaggcataatgcaagcaggaaaaagatcgctacgaccacaaccaactgagctgaaatatagttggaaaacctggggcaaagcgaagatgttatcaacagaatcccacaaccaaacttttctaattgatggtccagaaacagcggagtgtcccaacaccaatagggcttggaactctttggaggttgaagattacggcttcggggtattcacaacaaacatatggctaaaattacgtgaaaaacaagatgttttctgcgattctaaattgatgagcgctgcaatcaaagacaacagagcagttcatgcagatatgggctactggatagaatccgcattaaatgatacctggaagatggaaaaggcttctttcatcgaagttaagagttgtcattggcctaagtcgcacactctgtggtccaatggggtcttggagtcggaaatgataatcccaaagaatttcgcaggtccagtgtcccaacacaattatcgaccaggataccatacgcaaacggcaggcccttggcacttgggcaaacttgaaatggattttgacttttgcgaagggaccacagtagtagtgactgaggactgcggtaatcgcggtcctagtctacgcaccaccaccgcaagcgggaaactgattaccgaatggtgttgtagatcctgcaccctccctcctttaagatatcgaggagaagatggatgttggtacggaatggaaatccgtccactgaaggagaaagaagagaatctggttaattcattagtgaccgctgggcatggacagatagacaacttctcgctaggagtattgggtatggcgttattcttagaagaaatgttaagaactcgagtaggaactaaacacgcgatgctgttagtagttgttagctttgtgaccctaatcacaggaaacatgagtttccgagatcttggccgggtaatggtcatggtaggggctacgatgacagacgacattggaatgggcataacatatttagcacttctagcagcatttaaagttagacctactttcgcagcaggcctattattgagaaaactaacaagtaaagaattaatgatggccacaatcgggatagcattattgtcgcaaagcacgatacctgaaacaatactcgaactcacggacgcattagcgttaagtatgatggttctaaaaatagtaaggaatatggagaaatatcagttagctgtaacgattatggcaatatcatgcgtaccaaatgctgtaatactacaaaacgcatggaaggtctcttgtactattctagcagccgtctctgtttcaccgctcctactgacatcctcacagcaaaaagcagactggataccgttagccttaacgattaaggggttaaatcctactgcgatttttctcacaacattaagtcgaaccagtaagaaacgttcttggccgctaaatgaagctattatggcagtaggaatggtttctattttagcaagctctttactcaaaaatgacatcccaatgacaggtccattagtagcgggaggactcctcacagtatgctacgtgcttaccggtagaagcgccgacttggaattagaacgagctgcagatgtgaaatgggaagatcaagctgaaatcagtggctccagccccatattatctataactatcagcgaagacgggagtatgtctattaaaaacgaagaagaagaacaaaccttaacaattctaattcgaacaggcctattagtcatatcaggcgtttttccggttagtatccccataaccgctgcggcttggtatttgtgggaggtaaagaaacagagagcaggggttctttgggatgtcccaagcccaccaccagtcggaaaagccgaacttgaagatggtgcataccgaattaagcaaagagggatacttggatattcgcaaattggtgctggagtatataaagaagggacatttcacacaatgtggcacgtaactagaggagcagttctgatgcatagaggaaaaaggatcgaaccgagttgggcagacgttaaaaaggaccttatctcatatggaggcgggtggaagctcgaaggtgaatggaaagaaggggaagaagtgcaagtgctagcgctggagccagggaaaaatcccagagctgtgcaaacgaagccaggactttttaaaactaacactggcacaatcggcgcggtgagcttagatttttcacctggtacttctgggagcccaatcgttgaccgaaagggaaaagtcgtaggactatacgggaacggagtggtaacgagaagtggagcgtatgtaagtgctatagcccaaacggaaaaatcaattgaggataaccccgaaatagaagatgacatctttagaaagaaacgattaacaataatggatctacaccctggagcaggtaagacaaaacgatatctacctgcaatcgtcagagaagctattaaaaggggtctaaggacattaattctcgcacctacgcgcgttgtagcagcggaaatggaagaagctctaagaggactccctattcgatatcaaacgccggctatacgagcggagcacactggaagagagatagtcgacttaatgtgtcatgcaacatttacgatgagattattatctccggtacgtgttcctaattataacttaataatcatggatgaagcccactttacagatcctgctagtattgcagcgagaggctatataagtacaagggtagaaatgggtgaagcagcaggaatatttatgaccgctacgcccccgggctcacgcgatccattcccacagtctaatgcacccataatggacgaagaaagagaaattcccgaacgctcatggaatagcggccatgaatgggtaaccgattttaagggaaagacggtttggtttgtccccagcattaaggctggcaacgacatcgctgcgtgcctcaggaaaaatggtaagaaagtaattcagttgtcaagaaagacattcgactcagaatacgtgaaaacacgagctaatgactgggatttcgtggtaactacagacatatcggaaatgggggccaacttcaaagcagaaagggtaatagatccaagaagatgcatgaaacccgtcatattaacagatggagaagaacgtgtcatacttgctggtccaatgcccgtgacacacagctctgcagctcagagacgaggccgtataggtcgtaaccctaaaaatgagaatgatcaatatatctatatgggtgagccactagaaaatgacgaagattgtgcacactggaaagaagcaaaaatgttgctcgataacataaacacgccagagggcataatacctagtatgttcgagcctgaaagagaaaaagttgacgcgatcgatggagaatacagacttagaggtgaggctagaaagacctttgttgatctgatgaggagaggggatctacccgtatggctagcctatcgagtagcagctgaggggatcaattacgcagataggcgttggtgtttcgatggtattaagaacaatcaaattctagaagaaaatgtggaggttgaaatttggaccaaagagggagaaagaaagaaacttaagccgagatggctagacgcaagaatctattcagatccattagcattaaaagaatttaaggaatttgccgccggtcgcaaatccctaacgttaaatttaattaccgagatgggcaggttaccaacattcatgacccagaaggcaagagatgcacttgacaatctcgccgtactacacacggcggaagctgggggaagggcgtacaatcacgctttgagcgaactacctgagacgctcgaaactcttttattactaactctcttagcaacagtcacaggcggtatatttttattcttaatgtctggaaaaggaataggaaaaatgacgctagggatgtgttgtataattacagcatcaattctactttggtacgctcagatacaaccacattggatcgctgcctcgataatactggagtttttcttaatagtcctattaatacctgaacctgaaaaacagagaacacctcaagataatcaactgacatatgtagtcatagcgatccttacggtcgtcgctgctaccatggcaaatgagatgggttttctagagaaaacgaagaaagatctaggtctaggaagcattgccacacaagagtcggaaagtaatattcttgacatagacttaagaccagcttctgcgtggacattatatgcagttgcaaccacatttgtgacccccatgttaaggcacagtatagaaaatagtagtgttaacgtaagtcttactgctatagcaaaccaagcaactgtattgatgggactcggaaaaggatggccattatctaaaatggatataggagttccattactagcaataggctgttacagtcaagtaaatccgataacgttaacagcggcgcttctattattagtcgcacactatgcaataattggtccgggattgcaagctaaagccactcgtgaagctcagaaaagagcagcggcaggaatcatgaaaaacccaaccgtggatggaatcacggtgatagaccttgaaccaatcccatatgatccgaaatttgaaaaacagttgggacaagtgatgcttttgattttgtgtgtcacacaggttctaatgatgagaacaacgtgggctctttgtgaagcccttacattagcgactggtccaatatcgaccctatgggaaggtaacccgggaagattttggaacacgaccatagccgtttctatggcaaacattttcaggggaagctacctagcgggagccggacttttatttagcatcatgaaaaatactacaaacaccagaaggggtactgggaacattggggaaacactcggcgagaagtggaagagtcgattaaatgctctaggtaagagcgagttccaaatctacaagaaatctggcattcaggaagtggatcggactcttgccaaggaaggaatcaaaagaggcgaaactgatcatcatgctgtgtcccgaggcagtgcaaaactaagatggttcgttgaacgaaatatggtaaccccagagggcaaagttgttgacctaggatgcgggcgcggtgggtggagctattattgtggaggcctaaagaatgtgagagaagtaaaagggcttaccaaaggtggcccaggccacgaagaacctataccaatgtcaacatatggatggaatttagtcagattgcagagtggagtagatgtattctttacgccacctgaaaaatgcgatactcttctttgtgacatcggagaatccagcccaaaccctactatcgaggcaggtagaacactacgcgtgctaaatttagtggaaaattggctcaacaataacacccaattttgcattaaagtattaaacccctatatgccttcagttatagagaaaatggagacactacaaaggaaatacggtggcgcactcgtacgcaatcccttaagtcgtaactcaacacatgaaatgtattgggtttcaaacgctacaggaaatattgtatccagtgttaatatgatttctcgcatgctaataaatagatttactatgaagcataagaaagcaacttacgaaccagatgtggacctcgggagtggtactcgcaacatcggaatagagtctgagatcccaaaccttgacataataggtaaaaggatagagaaaataaaacaagaacatgaaaccagttggcactacgaccaagaccacccttataaaacctgggcataccatggctcatacgaaacaaaacaaaccgggagcgctagttcaatggtgaatggtgtggtcaggctgcttacgaagccttgggatgtagtcccaatggtaacacaaatggccatgactgatacaacgccgtttggtcaacaacgagtgtttaaagagaaggttgacacacgaacacaagaacctaaggagggtacgaagaaactaatgaaaattaccgctgagtggctatggaaagaactaggcaagaagaaaacacctcgaatgtgtactagggaggagttcacaagaaaagttagatctaacgctgctttaggcgctatttttaccgatgaaaacaaatggaaatcagctcgtgaagcagtagaagactcaagattttgggaacttatagatagggaaagaaatttacatctggaagggaaatgcgaaacgtgtgtatataatatgatgggtaaaagggagaagaaactgggagaatttggaaaagcgaaaggtagtagagctatctggtacatgtggcttggggcaagatttttagaatttgaagctctcggctttctaaacgaggatcactggtttagtagaggaaattcgctttcaggagtagaaggggaaggactacatagactgggttacatactacgagatgtaagtaagaaagagggtggcgccatgtacgcagacgacacagctgggtgggatacaagaataaccttagaggatcttaagaatgaagaaatggttacaaaccatatgaagggagaacataagaagttggctgaagcgatatttaaattaacgtaccaaaacaaagtggtcagagtacaaagaccgaccccaagaggaacagtcatggacattataagtcgtcgtgaccagagaggatccggacaagttggtacatatggactaaatacttttaccaacatggaagcacagttaataagacaaatggaaggtgaaggcatatttaaatcaatccaacacctgactgttactgaagaaattgcagttcaaaactggttagctcgggttggacgcgagcgactatcaagaatggcgatcagtggagatgattgcgttgtaaaacctttagatgataggttcgctagcgcactaacagccctgaacgatatgggaaaagttcggaaagacattcaacaatgggagccctcgcgtggatggaatgactggacccaagtcccattctgcagccaccattttcatgagctagtaatgaaagacggtagagtgctagtggtgccttgcagaaatcaagacgagttaattggacgggcccgtatatcccagggtgctgggtggagtctgaaagaaactgcctgcctaggcaaaagttacgcacaaatgtggactctaatgtattttcacaggagagacttacggcttgccgctaatgctatatgctccgcggttccatcgcattgggtgccaacctcgagaacaacttggtccattcacgcgaaacatgaatggatgacgacggaagacatgctagcagtatggaacagagtttggatacaggaaaatccgtggatggaggataagaccccggtagagtcctgggaagaagtcccatacctcggtaagagagaagaccagtggtgtgggtccttaataggactcacctccagggcaacctgggccaaaaacatccaaactgctataaaccaagtaaggtcactaataggaaacgaagaatatacagattatatgccaagtatgaaacggtttagaagggaagaagaggaagcaggagtactatggtaa

SEQ ID NO: 22630 - RNA, 9876 nt, synthetic construct
  misc_feature 1..9876: note = derived and/or modified CDS sequence (opt6) from DENV-2__EU482739__SS-prME
  source 1..9876: mol_type = other RNA
actgctggtgtcatcataatgttaatccccacagcaatggcattccatttaacaacgaggaatggagaaccacacatgatcgtaggaagacaagaaaaaggaaaaagccttttgttcaaaacagaagatggagtgaacatgtgcacattaatggctatcgacttaggagaactgtgtgaagatacaataacctataaatgtccactactgcgccaaaatgaacccgaagacattgattgttggtgtaatagtacttccacttgggtgacttatggtacttgtactacgacaggtgaacacagaagggaaaaacggagtgtagctctagttcctcatgtaggtatggggctggaaacaagaactgaaacctggatgagcagcgaaggtgcttggaaacatgtacaaagaattgaaacgtggatacttcgtcatccaggatttactattatggcagcaatattggcgtataccataggtactacgcactttcagagagctttaatcttcatcctactcactgcagtagcgccatcaatgactatgaggtgtataggaatttcaaacagagatttcgttgaaggggtatcagggggttcatgggtagacatagtattagagcacggtagttgcgtaactaccatggcgaaaaataaaccgacgttagatttcgagctaataaaaacagaagcaaaacaacctgcaactctacgtaaatactgtatagaggcaaaacttactaatacaactaccgaaagtagatgtccaacacagggagaaccatcacttaatgaagaacaagacaaaagattcatttgcaaacactcgatggtggacaggggatggggtaatgggtgtggactttttggcaaaggaggaatagttacctgcgcaatgtttacatgtaagaaaaatatggaaggaaaggttgtgctaccagaaaatttagaatatacaatcgtaataacaccacactcgggagaggaacatgcagttggtaacgacacaggaaaacacggaaaggaaatcaagataacgccacagagtagcataactgaagcagaattaacaggatatggtaccgtgacaatggagtgtagcccgcgaacaggactagactttaatgaaatggtgctcttacaaatggaggacaaagcatggttggtgcacagacaatggttccttgatctacctttgccatggttacctggtgcggatacacaaggatcaaattggatacaaaaagaaacattagtgacatttaaaaatcctcacgccaagaaacaagatgttgtagtgttaggtagtcaagaaggtgcaatgcatactgcgttaacaggagcaactgaaatacaaatgagcagcgggaaccttctatttacaggacatttaaaatgtagactgagaatggacaaattacagcttaaaggtatgagttatagtatgtgcacaggtaaattcaagatagtaaaggaaattgcagagactcaacatggtacgattgtaataagagtacagtacgaaggagatggtagcccttgcaaaattccatttgagataatggacctggagaaacgtcatgtcttaggtaggttaattacagtaaacccaattgtgaccgaaaaagactcacccgtcaacatagaggcagaacctccttttggagactcatacataataattggcgtcgaaccagggcaacttaaactgaattggttcaagaaaggttcctccatcggccagatgtttgaaacgactatgagaggggcgaaaagaatggcaatcttaggggatacagcatgggactttgggagtctgggtggggtattcacttctataggaaaggctttacaccaagtatttggtgctatatatggcgctgcgttcagcggtgttagctggacgatgaaaatactaattggtgttattataacttggatagggatgaactctaggtctacctcgctgtcagtgagtctagtgttagttggggtagttacgttatatctaggagtaatggtacaggccgattctgggtgtgtagtgagttggaaaaataaggagctaaagtgtggttcaggaatttttataacagacaacgttcatacatggacagagcaatataaatttcagccagaatcgccatctaagttagcgtcagcaatacaaaaagcacacgaagaagggatttgcggtattcgctcggtaaccagattagagaacttaatgtggaaacaaatcacacctgagttaaaccacatactgagcgaaaacgaagtaaaacttactattatgacaggtgacatcaaaggtataatgcaggccggaaaaaggtccttaagacctcaaccaaccgaactaaaatatagttggaagacttggggtaaggctaaaatgttatctactgaaagtcacaaccaaacattcctaatagatggtccagagactgcagaatgtcctaatacgaatcgagcatggaatagtttagaggtagaggattatgggtttggtgtattttcgactaacatctggctaaagttacgagaaaaacaagacgtattttgtgacagcaaattaatgagtgccgcaataaaagataatcgggcagtacacgctgatatgggctattggatagaatccgcattaaacgatacttggaaaatggaaaaggcttccttcatagaggttaaatcatgccactggcctaaaagtcacaccctatggtcaaatggggtcctcgaatcagaaatgattatacccaaaaattttgcgggaccagtttcgcaacacaattatagacctggataccatacacaaacggcaggaccttggcatttgggaaaacttgaaatggactttgatttttgcgaaggaaccacggtagttgttactgaagattgtggtaacagaggaccgtctctaaggacaacaactgccagcggtaaattaattactgaatggtgttgtcgttcatgtacccttccgcctttaaggtatcgaggtgaagatggttgttggtacgggatggaaatacgtcccctgaaggaaaaagaggaaaatttggtaaattcattggtaaccgctggacacggacaaattgacaattttagtctaggagtactcgggatggcgctatttttagaggagatgctaagaaccagagtgggtacaaagcacgctatccttcttgtagccgtatctttcgtaacactcataactggcaatatgtcctttagagaccttggtagagtgatggtcatggtaggtgcgacaatgacggatgatattggtatgggagtcacatatttagctctactcgctgcatttaaggtaagaccgactttcgcagcagggctactcttaagaaaacttacttctaaagaattaatgatggccacaatcggcatcgcgctattatcgcaatcaactatacccgaaacaattctagagctaactgacgcgctagcacttgggatgatggtactaaaaatcgtcagaaatctagaaaagtaccaactagctgtaacaattatggctatatcatgcgtcccaaatgctgtaatattacaaaatgcgtggaaagtctcatgtactattcttgcagcagtttctgtatcgccgttattacttacaagttcacagcaaaaagcggactggataccactggcgttaactattaaagggttaaacccaacagctatttttctcacgactttatcaagaacgtctaagaaacgatcttggccattgaacgaagcagtcatggcagtaggtatggtctcaattttggcttccagcttgcttaagaatgatatacctatgacaggacccctagttgcaggcggtctactaaccgtatgctatgtcctaactggaaggtcagctgatttagaactcgagagagctgcggatgtaaaatgggaggatcaagccgagatctcagggtcaagtccaattttgagtataacgatatcggaagacggatcaatgagcatcaaaaatgaggaagaagaacaaacattgacaatattaataagaactggcttactggttattagtggagttttcccggtctctatacctataacggctgcagcttggtacttatgggaagtgaaaaagcaacgcgcgggagtgctatgggacgtaccctctccaccacctgtaggaaaagcagaactagaagacggcgcttacagaataaagcagagaggcatattcggttattcccagattggagcaggagtatacaaagaaggtacatttcacactatgtggcatgtgacgaggggcgctgtacttatgcacagaggaaaaagaattgagcccagttgggcagacgtcaagaaagatttaatatcatatggtggcggatggaaactagaaggtgaatggaaggaaggtgaagaggttcaagtgctagcactagagccaggcaaaaatcctagagctgttcaaactaaacctgggttattcaaaactaacacggggacaatcggagcagtaagtttagacttcagtccaggaacatctggaagcccaatagtcgataggaaaggaaaagtagtcggcctttacggcaatggagtggtaacacgatctggtgcgtatgtctcggcaatagcgcagacagaaaagagtatagaggataaccctgaaatagaagatgacattttcaggaagaaacgattaacaattatggatttacatcccggtgcaggtaaaacaaaacgatatctaccggctatagtcagagaagctataaaaagaggcttacgcacgttaattttagcgccgacaagggtggtcgcagcagaaatggaagaggctttgcgaggcttacctataaggtatcaaacgccagcaatacgagcggagcacacaggaagagagatagttgacctaatgtgtcatgctacgtttaccatgcgattactttctccagtaagagtgcctaattacaacttaatcataatggatgaggcccattttacagatccagcaagtattgcagcccgtgggtatataagcactagagtagaaatgggtgaagcggcaggaatctttatgactgctactccccctggatcacgagacccattcccacagagcaatgccccaataatggacgaggaacgagaaataccagagagaagctggaacagtggccacgagtgggtcacagactttaaaggaaaaacagtttggtttgtcccatctattaaagccggaaatgacattgcagcatgtcttaggaaaaatggaaagaaagttatacagctgtcacgcaaaacatttgacagtgagtatgtaaaaactcgagcaaacgattgggatttcgttgtaacaacggacattagtgagatgggcgcaaacttccgggcagagagagtaatagatcctaggaggtgtatgaagccggttatactaacggacggtgaagaaagggtaattttagctggtcccatgcctgtgactcatagttctgccgcacaaagacgaggtcgaatagggagaaacccgaaaaacgaaaacgaccaatacatttatatgggcgagccattggaaaacgatgaagattgcgcacactggaaagaagcaaaaatgctattggataacattaacaccccggaaggcatcataccaagtatgttcgagcctgaaagggaaaaagttgatgctatagacggcgaatacaggttgcgtggtgaagcaagaaaaacatttgtagatcttatgaggcgaggtgacctccccgtttggctagcttatcgggtagccgcggaaggcatcaattatgcagacagacgatggtgttttgacggtatcaagaataaccagatactagaggagaatgtagaggtggaaatttggactaaagaaggcgaaagaaagaaattgaaaccacgatggctagacgcaagaatctatagcgatccattagcgttaaaggaatttaaggaatttgcagcaggaaggaagtcccttactcttaatttaataacggaaatgggccgactaccaacattcatgacccaaaaagcgcgtgacgcgctggataatctagcggtcttacacactgctgaggtcggagggagagcttacaaccatgccctaagtgaactacccgaaacattagaaacgttgctgctgctaacattattagctaccgtgaccggtggtatatttttatttttaatgtcgggcaaagggatcggaaaaatgaccttaggaatgtgttgtataataacggcgtctatactactttggtatgctcaaattcagcctcactggatagcagcctcgatcatactagaatttttcttaatagttttgctaattccagaaccagaaaaacaaagaacaccacaagacaatcaactaacctacgtagtcatagccatcttaacagttgtggcagctacaatggctaacgagatgggttttctggagaaaactaagaaagatctaggtttaggatcaatcactacgcaggaatcagaatccaatatccttgatatagacctcagaccagcatctgcttggaccctatatgcagtggccactacattcgtaacccccatgttaaggcactcaatcgaaaactcttcagtcaacgtttcactaactgcgatagcaaaccaagcaactgttttaatgggattagggagaggttggccgttatcaaagatggacataggtgttccattgctagcaattggatgttattcacaagtgaatccaatcacgttgactgcggctctactactattagtggcacactatgccattataggtccgggcttacaagcaaaggcaacaagagaagctcaaaaacgagcggcagcaggcataatgaaaaatccaacggtagacggtataacggtaatcgacctagagccgataccatatgaccctaaatttgaaaagcaattaggacaagtaatgctactcgtactctgcgtaacacaagtacttatgatgagaacaacttgggccctatgtgaagccctgacccttgcaactggacccatatcaacattgtgggagggaaatcccggccgattttggaatactactatagccgtctcaatggccaatatatttagagggtcatatttggccggtgcgggacttctgttcagtataatgaaaaacacgacaaatacaagaagaggcactggaaacataggagaaaccctcggagaaaaatggaaatctcgcttaaatgcgttaggaaagtcagagttccaaacctacaaaaagtcaggcattcaggaagtagatagaaccctagcaaaagaaggaattaagagaggtgaaacagatcatcatgcagtttcacgtggtagcgcaaaactacgctggtttgtagagcgtaacatggttactcctgaaggaaaagtggtcgatttaggatgtgggagaggagggtggtcatactactgcggcggtttgaaaaatgtacgggaagttaaaggtctcaccaaaggaggacctggccatgaagaaccaatacctatgagtacttatggatggaacttagtcagattacaatcgggagtagacgtattctttacacctcctgaaaaatgtgacacactgctgtgtgatattggggagtcttcacctaaccctacaatcgaagcaggtagaacactgcgtgtgttaaacctcgtagagaattggctaaacaacaacacacaattttgcattaaagtcctcaatccgtacatgccatcagttatagaaaagatggaaactcttcaacgtaaatatggaggggctcttgtcagaaacccactaagtaggaatagcacacatgaaatgtattgggtatctaatgcaacggggaatatagtaagtagtgttaatatgatctcacgcatgttgataaatcgatttacaatgaagcacaagaaagcaacatatgaacctgacgtagaccttggttctggaactcgaaatatcggtatagagaatgaaataccgaaccttgatatcattggaaagagaatagagaaaattaagcaggaacacgaaaccagttggcactacgaccaagatcatccttacaaaacctgggcctaccatggttcctacgaaacaaaacaaacgggatcagcatcatcaatggtgaacggagttgttaggctactcacaaaaccatgggacgtagtaccgatggtaacccaaatggctatgacagatactacaccctttggtcagcaaagagtatttaaagaaaaagttgatacaaggactcaagaacccaaagaggggacaaagaaacttatgagaataacggccgaatggctttggaaagaacttgggaaaaagaaaactcccaggatgtgcaccagagaggagttcactcgaaaagtaaggagtaacgcggctttaggagcgatatttacggacgagaataagtggaaaagcgcccgagaagctgtagaggatagccgattctgggaactcgtagatagggagaggaatcttcatctcgaaggtaagtgcgagacctgtgtatacaatatgatgggaaaaagggagaagaaactaggagagtttggcaaagcgaaaggatcgagagctatatggtatatgtggttaggcgcacgcttcctcgaatttgaagccctggggttcttaaatgaagaccactggttttccagaggaaattcactctcaggtgtagaaggtgaaggactgcataaactaggatatattttaagggacgtatcaaagaaagaaggaggggctatgtatgcagacgatacggcgggttgggacacaagaattactttagaagatcttaaaaatgaagaaatggtgacaaaccatatgaagggagaacataaaaagctcgccgaagcaatattcaaattgacttaccaaaacaaagtggttcgagtacagaggccaacgccacgcggtacagtaatggacattatttcacgtaaggaccaaagagggagcggccaagtgggaacatacgggcttaatacttttactaatatggaggcgcaactaatacgacaaatggaaggggaaggaattttcaagtcaatacaacatctcaccgtcactgaagaaatagcagtgcaaaactggttggctagagttggccgggaaagattaagccgaatggcaataagcggagatgattgtgtcgtcaaacctttggatgacagatttgcgtcagccttaaccgctttaaatgatatgggcaaagtcagaaaagatatacaacaatgggagccatcgagaggttggaatgattggactcaagtgcccttttgcagccatcactttcacgagctagtaatgaaagacggtagggtacttgtggttccatgtagaaaccaggacgaattaatcggccgagcccgtatatctcaaggagcgggatggtcgttgaaagaaactgcgtgcctgggaaagagttatgcacagatgtggacgctgatgtactttcatcgaagggatttacgacttgcggcgaatgctatatgttcggccgtaccaagtcattgggtacctacttcaaggaccacttggtcgattcatgcaaaacacgaatggatgactacagaagacatgctcgcagtgtggaatcgggtttggattcaagagaatccatggatggaagataagaccccagttgaaagttgggaagaggtaccttacctaggaaagagggaagaccaatggtgtggcagcttaattggactgacaagtagggcgacgtgggccaaaaatattcagactgccatcaatcaagttagatctttaatcgggaatgaagagtatacagactacatgccatcgatgaaaagatttcgcaaagaagaggaagaagctggagttctgtggtag

SEQ ID NO: 22631 - RNA, 9876 nt, synthetic construct
  misc_feature 1..9876: note = derived and/or modified CDS sequence (opt6) from DENV-2__EU482740__SS-prME
  source 1..9876: mol_type = other RNA
acagcaggggtcattataatgttaattcctacggccatggcttttcacctgactacaagaaatggtgaaccccacatgatagtaggcagacaggaaaaaggtaaaagcttgttattcaaaactgaggatggtgttaatatgtgcacacttatggccatagatttgggagagctatgcgaagacactataacctacaaatgtcccttgctacgacagaacgaacccgaggatatagattgttggtgtaactcgacttcgacatgggttacatatggaacttgtactacaactggagaacacagacgcgaaaaacgatcagttgcgcttgtaccacacgttggtatgggtcttgaaacgcgcacagagacttggatgtcatcggaaggcgcttggaagcatgtgcaaaggattgaaacgtggatactccgccatccgggattcacaattatggcagcaatattggcatacacaattggaacaacacattttcagagggctctcatctttatcttattgacggcagtagctccaagtatgacgatgagatgtataggaataagtaaccgagacttcgttgaaggtgtcagtggaggaagttgggtagatattgtattagagcatggatcctgtgttacaacgatggctaaaaataagccgacattagatttcgaactgataaagactgaagccaagcaaccagcgactttgcgaaaatattgtattgaggcgaaattaacaaacacaactacggaatcaagatgtccaacacaaggggaaccctctctaaacgaggaacaagataagcgctttgtatgtaaacatagcatggtagaccggggatggggaaatggatgtggtttgtttggaaagggaggtattgttacctgcgcaatgtttacatgtaagaagaacatggaagggaaagtagtcctcccggaaaacttagaatatacaatcgtcattactccccattcaggagaagagcatgctgtggggaatgacacgggtaaacatggaaaagaaataaaaatcacaccgcaaagttcaattacagaggcagaattaaccggatacgggaccgtcaccatggaatgttcgccgcggactggcttagactttaatgaaatggtattactacaaatggaagacaaagcgtggctggtccatcgacaatggtttctagatttaccattaccttggttgcctggcgctgatacacaaggaagtaactggatacagaaagaaactcttgtcacttttaaaaatccacacgctaaaaaacaggatgtagtagtattagggtcgcaagagggcgccatgcatactgcattaacaggtgcaacggaaatacagatgagttcaggaaatctactctttacaggacatttaaagtgccgattgagaatggataaactacagttgaaaggaatgtcatactctatgtgcacaggcaagttcaaaatcgttaaggaaatcgctgaaacccaacacggaacaatagttattagagttcaatatgaaggagacgggagtccttgtaagattccattcgaaataatggacctagaaaaaagacatgtactgggacgattaattactgtcaacccaatagtaactgagaaagacagccctgtaaatattgaagcagagccgccattcggtgattcatacatcattataggtgttgaacctggtcaactaaaattaaactggttcaagaaaggaagttctataggtcaaatgtttgagactacgatgagaggagctaagaggatggctatcctaggagatacggcctgggactttggatctttggggggggtgtttacatccatcggaaaagcgcttcatcaagtgtttggtgcaatatatggtgccgccttttccggagtgtcatggaccatgaagattctgataggggtcatcattacctggattggaatgaactcgcgttccacatctctctcggtaagtttggtgttggtgggggttgtcaccctgtatttaggagccatggttcaggcagattctggatgcgttgtgtcgtggaaatcaaaagaattaaagtgtggttcgggtatctttatcaccgataatgtccatacctggactgaacaatacaaatttcagccagaaagtccctcaaaattagcctcagctatacaaaaagcgcatgaagaaggcatatgtggtataagaagtgttactagacttgaaaacttgatgtggaaacagataacgccagaattaaatcacattctatcagagaatgaagtcaaattgacaataatgactggagatatcaaagggataatgcaacctggtaaaagatcgctacgtccacaacctactgagttgaagtactcttggaaaacttggggaaaagcaaaaatgttatcaacggagtcacataatcaaacttttctaatagatggaccagaaacggctgaatgcccgaatactaacagagcatggaatagtttggaagtagaagactacggattcggtgtatttacaacaaatatctggttgaagttacgagaaaagcaagatgtcttttgtgattcaaaattaatgtctgcggcaattaaggataacagagcagtgcatgctgacatgggatattggattgaatcagcactaaatgatacttggaaaatggaaaaggcaagttttattgaagtaaaaagttgtcattggcccaagtcccatacattatggtcaaacggagtcctggaatcagagatgattattcccaagaatttcgctggtccagtgtctcaacataattatcgtccaggatatcatacccagacagcaggcccatggcatcttggtaaactcgaaatggattttgatttttgcgagggaactacagtagtggttacggaagactgcggtaacagaggtccgtccctccgtacgacaacagcaagtggaaaactaattaccgaatggtgttgcaggtcgtgcacacttccgccactgagatataggggagaagacggttgctggtacggtatggaaattagaccattaaaagaaaaagaagaaaacctagttaacagcttggtaactgcgggtcatggccagattgacaacttctctttaggagttctaggaatggcactgtttcttgaagagatgttacgtacccgggttggtactaaacacgcaattttattagtagcggttagttttgtaacgctaataacgggaaatatgtccttccgcgacctaggtagagtcatggtcatggttggtgcaacaatgacagatgacataggaatgggagtgacttaccttgctctgctagcagcgttcaaagtaagacccacgtttgcagcaggtttgttacttcgaaaattaacatcgaaggagcttatgatggcgactataggtatagccttattatcacaatctacaattccagaaacaatattagaacttacagacgcacttgcgctcggaatgatggtactaaaaattgtacggaacatggaaaaataccaactagcagtgacaataatggcgatttcgtgtgtaccaaacgccgttatcctgcaaaacgcttggaaggtatcttgcactattcttgcggttgtatctgtcagtccactattattaacttcttcacagcagaaggcagattggatacctctagctttgacaattaaaggtctaaatccaactgccatattcctaacaacactaagtcgaacttccaaaaaacggagctggccattgaacgaggcaattatggcggtgggaatggtctcaattctagcctcctcacttttaaaaaacgacattccaatgactggtccattagttgcaggcgggctattgacagtatgttacgttttaaccggtagaagtgcggacttagaactagaaagagctgcagatgttaaatgggaggatcaagcagaaatatctggctcgtcaccgattttatctataaccatttctgaggatggaagtatgagtataaaaaatgaagaggaggaacaaacgttaaccatcttgataagaacaggattactagttatctccggcgtattccccgttagtatccccataacagctgcggcatggtacctttgggaagtaaagaaacagagagcgggagtcctttgggatgtcccctctcctccaccagtaggaaaagcagaattggaagacggcgcctacagaataaagcagcgaggtatcctgggatatagtcaaattggcgcaggagtgtataaagaaggaaccttccacacgatgtggcatgtaacacggggagcagtattgatgcatagaggaaaacgaatagaaccatcatgggcagacgttaagaaggaccttatatcttatggcgggggttggaaactagagggtgaatggaaagaaggtgaagaagtgcaagtgttggcattggagcctggcaagaatccccgcgcagtccaaactaagcccggactatttaaaactaacactggcactataggagccgttagccttgattttagccctggaacaagtggatccccgatagtcgatcgcaaagggaaggttgtcgggctgtatggaaatggggtcgtaacaagatccggagcgtatgtttctgcaatagcgcaaacagaaaaaagcatcgaggacaatcctgaaatagaagatgacatatttaggaaaaaacgattgaccataatggatttacatcccggagctggtaaaacaaaacgttatttaccagcaattgtaagagaagcaatcaagagggggttgaggacattgatactcgcgccaacgagagtagttgcggctgaaatggaagaagcgctacgggggctgccaattagatatcaaaccccggccataagagcagaacatacaggacgtgaaatcgtagatttaatgtgccatgcaacattcacaatgcgattactaagtcccgtaagggtcccaaattataacttaataataatggacgaggctcacttcactgaccccgcatcaattgctgcccgtggctatatctcaacacgagtcgaaatgggagaagcagcaggaatcttcatgactgctacaccaccgggatcacgggacccgttcccgcaatcgaacgcccctattatggatgaagaacgcgagatacctgaaaggagttggaactcaggtcatgaatgggtaacggatttcaaaggaaaaactgtatggtttgtcccgtcaataaaagccggaaatgatatagccgcgtgtctgagaaaaaatggtaaaagggtgatacagctctctagaaaaacgttcgattcggagtacgtaaaaactagagcaaacgactgggacttcgttgtaacaactgacatcagcgagatgggcgcgaattttaaagcagaaagagtcatagatccaaggcgatgcatgaagcccgtgatacttacagatggagaagagagggtcattttagcggggccaatgcccgtcacccatagttcagcggcacaacgcagaggaagaattggaagaaaccctaaaaacgaaaatgatcaatatatatatatgggagaacctcttgaaaacgacgaagattgcgctcactggaaggaggctaagatgcttttggacaatatcaatacgccagagggaattatccccagtatgtttgaaccggagagagagaaagtggatgcaatcgatggagagtatagactgagaggtgaagcccggaaaacattcgtcgacttgatgagacgaggggatttaccggtatggttggcataccgtgttgcggcagaaggaattaattacgcggatagaaggtggtgcttcgatggaatcaaaaacaatcaaattttggaggaaaacgtggaggtggagatttggactaaagaaggtgaacgaaaaaagttaaaacccagatggttagacgctcgtatttattcagatcctcttgctttaaaagagtttaaagaattcgcagcaggtcggaagagcctaacgttgaacttgatcacagaaatgggaagattgccgacattcatgacacaaaaggctagagatgctctggacaatttggcggtactgcacacagccgaggcgggcggacgggcatacaatcacgcattatcagaactaccagaaacactagaaacacttttacttctgacacttctagccaccgtaactggtggaatatttctatttttaatgtctggaaaaggtattggaaaaatgactctaggtatgtgttgtataattactgcatccatcttgttatggtacgcccaaattcaaccgcattggatagccgcttcgattattcttgaatttttcttaatagtcttacttataccagaaccagaaaaacaacgcaccccgcaagataaccaattaacatatgttgttattgccatactaacagtcgttgctgctacaatggccaatgaaatgggatttttagaaaagactaaaaaagaccttggtttggggtcgataacgacccaagaatcagaaagtaatatcttagatatcgatttgaggccggcgtccgcatggacgttatacgcggtagccaccacttttgtgactcctatgcttagacattccatagaaaatagctcagtgaatgtctcgttaactgcaattgctaaccaagcaaccgtattaatgggactaggtaaaggttggccattgagcaaaatggatatcggagtcccgttattagctattggatgttattcacaagttaaccctattaccttaacagccgctcttttattattagtagcgcattacgctattattggcccaggactgcaagcaaaagcaacacgagaggcacaaaagcgagctgcagctggtataatgaaaaatcctacagtagatggaataacagtgatagatctagaaccaatcccgtatgatcccaagttcgaaaaacagttaggacaagtaatgttattaattttatgtgtaacacaagtactgatgatgcggacaacttgggctttgtgtgaagccttaacactcgccacagggcctatttcaactctatgggaagggaatccaggtaggttttggaacacgacaatagccgtaagtatggctaatattttcaggggtagttacctggcaggtgcaggactactgtttagcataatgaaaaataccactaatacgaggaggggaaccggaaatataggagaaaccttaggagagaagtggaaatctcggctcaatgcacttgggaagtcagaattccaaatttataaaaaatcaggaatccaagaggtagaccggactctagccaaagaagggataaagcgaggtgagacggatcatcatgctgtatcgagaggaagtgcaaaactgagatggttcgtagaaagaaatatggtgactcccgaaggaaaggtagtagatttagggtgcggaagaggaggttggagttattattgcggcgggcttaaaaacgtaagagaagttaaaggtttgacaaaaggcgggccaggacacgaagaacccatacctatgagtacttacggctggaatttagtaagactgcagtcaggcgttgatgttttttttactccaccagaaaaatgtgatacactgctttgcgacataggtgagtcgtcgccaaacccgaccatagaagctggtagaacgttgagagtcctcaatttggtggaaaactggctaaacaataacacccaattctgcgtaaaagtgttaaacccatacatgccaagtgttatagaaaaaatggaaactttacaaagaaaatatggaggcgcactagtgagaaaccccctctctcgtaatagcacacatgaaatgtactgggtgtccaatgccacaggtaacatagtatcatcagtaaacatgatatcccgtatgctaattaacagatttactatgaaacacaagaaagcaacgtatgaaccggatgtagacctaggcagtggaacaagaaatattggaatagaatcagaaattcctaacttagacatcatcggcaaacggatagagaaaattaaacaggaacacgaaacaagttggcattatgaccaagatcacccgtataaaacttgggcgtaccatgggtcatacgaaactaaacaaacaggtagcgccagcagtatggtcaacggagtggtcagactattgacgaagccttgggacgtagtacctatggtaacccaaatggccatgaccgatacaacacctttcggccaacagcgcgtatttaaagaaaaagtagatactcgtacccaggagcctaaagaaggaacaaagaaactaatgaagattactgcggaatggctgtggaaagagttaggaaaaaaaaaaacgccgcgaatgtgtactagagaggaatttacaagaaaagtaagaagcaacgccgctttaggcgccatatttactgacgaaaataaatggaaatcggctagagaggcagtagaggattccagattttgggaactcattgatagagaacgtaatttacacctcgaaggcaaatgcgagacttgtgtgtataatatgatgggaaaaagagaaaaaaaattaggtgaatttgggaaagctaaaggctcccgagctatatggtacatgtggcttggcgcacgctttttagaatttgaagcgctcgggttcttgaatgaggaccactggttttcaagggggaatagtttgagtggagtagagggcgaagggttgcatagattgggatacatactccgagacgtatcaaaaaaagaaggaggagcgatgtatgctgatgacacagcaggttgggacactcgaattactcttgaagatctaaaaaatgaagaaatggtaaccaatcacatgaaaggggaacacaagaagctagccgaagctatatttaagctaacctatcaaaataaggttgtcagagtgcaacgcccaacaccgcgaggaacagtgatggacataataagcagaagagatcaaagaggctcaggacaagtaggcacttacggattaaatacatttaccaatatggaggctcagttaatacggcaaatggaaggagaaggtattttcaaaagcatacaacacttgacagtaacggaggaaatagccgttcaaaactggttggcacgggtcggaagggagagattaagtagaatggccataagtggagacgactgtgtggtaaaaccgttggacgatcggtttgcaagcgcactcacagctctaaatgacatgggaaaagttaggaaggatattcaacaatgggaaccgtctaggggatggaatgattggacacaggttccattttgttcccatcactttcatgaacttgtaatgaaagacggccgggtactagttgttccatgcagaaatcaagacgaactaataggcagagcgcgaataagccaaggagctggatggagtcttaaagagacggcatgcctaggaaaatcctacgcccagatgtggactctaatgtacttccatcggagagatttaagactagctgcgaacgcaatctgttcggcagtaccgagtcattgggtcccaacttctagaaccacttggagtattcatgctaaacacgagtggatgactacggaggacatgttggccgtttggaacagagtatggattcaagaaaacccatggatggaagacaaaacgcccgtcgagtcttgggaggaagtcccatatttaggaaaacgagaagatcaatggtgcggatctcttatcgggctgacatcgagagcaacttgggccaaaaacatacaaaccgcaattaatcaagtgcgaagtctaataggaaatgaggaatataccgactacatgccttcaatgaagcgatttagaagagaagaagaggaggcaggagtactctggtaa

SEQ ID NO: 22632 - RNA, 9876 nt, synthetic construct
  misc_feature 1..9876: note = derived and/or modified CDS sequence (opt6) from DENV-2__EU482741__SS-prME
  source 1..9876: mol_type = other RNA
acagcaggagtgattatcatgcttatcccaacagcaatggcgtttcatttaacgaccaggaacggggaaccacacatgattgtgggtcggcaagaaaaaggtaaatctcttttatttaaaacagaagacggggttaacatgtgcaccttaatggcgatagacctaggtgaactatgtgaagacacaataacttataaatgtccgttattacgacaaaacgaaccagaagacatcgattgttggtgcaattcaaccagcacatgggtaacatatggtacttgcacgacgactggggaacatcgtagagaaaaacgttcggtggccctagtaccacatgtaggaatgggtcttgaaactagaacagaaacctggatgtcaagcgaaggggcctggaaacacgtacaacgaatagaaacctggatactgcgacatcccggatttacaataatggcagcgatattagcttatacaatcggtacaacacattttcaaagagcgctaatattcatattgctaactgcagttgctccctctatgactatgagatgtatagggatttcaaatcgagattttgtagaaggggtatccggaggttcgtgggtcgatattgtccttgaacacgggagctgcgtaacgacaatggccaaaaataaaccaactctggattttgaactaatcaaaacagaagcgaaacaacccgcaacattaagaaaatactgcatagaagccaaactaaccaacacaacaacggagtcacgctgcccaacgcaaggagagccaagtcttaatgaggaacaggataaaagatttgtatgtaaacacagtatggtcgacaggggatggggcaatggctgtggtctatttggaaaaggcgggatagtcacttgtgctatgtttacttgcaagaaaaatatggaggggaaagtggtgttgccggaaaatctagagtacaccattgtaataaccccacattcaggggaagaacatgcagttggaaacgatacagggaaacatgggaaggaaattaaaattacgccccaaagctcaataacagaggcagaactaaccgggtatggaacagttactatggaatgttcacctagaacaggcctagatttcaatgaaatggttttattacaaatggaagacaaagcatggttggtacaccgacaatggtttcttgatcttccgttaccttggcttccaggtgctgatacgcaaggttccaattggatacaaaaggagacactggtgacgttcaaaaatccacatgctaagaaacaagacgttgtcgtgctggggtcacaagaaggagctatgcatacggcattgacgggagcgacggagatacaaatgtcgtcaggtaacttattattcacaggtcatcttaaatgccgactacgcatggacaaactacaattgaaagggatgagttatagcatgtgtaccggaaaattcaaaatcgtaaaagaaatcgctgaaacccagcacggaactatagtcattagagtacaatacgaaggggatggctcaccctgtaaaataccctttgaaataatggacctagagaaaaggcatgtgttggggaggttaatcacagttaatcccattgttgcagagaaggacagtccagtaaacattgaagccgagccgccttttggagattcatatataataatcggtgtagaacccggacagctgaaacttaattggttcaagaaaggatcatcaataggtcaaatgttcgaaacaacgatgaggggtgccaaacgtatggctattttaggcgatacagcgtgggacttcgggtcgctaggtggagtatttacatcaataggtaaggcccttcaccaagtttttggagctatttacggtgcagcattttctggggtaagttggactatgaaaatattaataggcgtgatcattacctggataggaatgaactcacgatccacatcactttcggtaagtttagttctagtaggcgttgtaacattgtatttgggtgccatggtgcaagccgattctgggtgtgtagtttcatggaaaagtaaagagcttaaatgcgggagcggaatcttcattacggataatgtgcatacgtggactgaacaatacaaatttcaaccagaatctccgagcaaattagcgagtgcaattcaaaaagcccacgaagaaggaatttgcggaataagatctgtgacccgattggaaaacctaatgtggaaacaaataacaccagaactaaatcatatactgagtgagaacgaagtaaagctcaccataatgaccggagatattaaaggaataatgcaggcaggaaaaaggagcttgaggccccaaccaactgagctgaaatatagctggaagacctggggcaaggcaaaaatgctaagcacagaaagtcacaatcagacatttttaattgatggaccagaaactgccgaatgtcccaacacaaatcgcgcgtggaatagtttagaggtcgaagattatgggtttggtgttttcacaacaaatatctggctgaaattaagagaaaaacaagacgtattctgcgattcaaaattaatgagtgctgccataaaggataacagagctgtgcatgcagacatggggtattggatagagtcagctttaaacgatacttggaaaatggaaaaagctagtttcatagaggtgaaaagctgtcactggccaaaaagtcatacactgtggtcaaatggtgtattagagtcagagatgatcatacccaaaaatttcgcagggccagtcagtcaacataactatcgaccaggctatcacacccaaactgccggaccatggcacttgggaaagttggaaatggacttcgacttttgtgaaggtaccaccgtcgtcgttacagaagactgcggtaaccggggaccatccctaagaacaaccacagcatccggcaagttgatcacagaatggtgttgtagaagttgtactctaccgcccctccgttatcgaggtgaagacggctgttggtatggaatggagataagaccactgaaagaaaaagaagagaatctagtcaattccttagtgacagcaggtcatggacaaatcgacaatttctccctgggcgtattgggaatggcactatttttagaggaaatgttacgaacaagagtaggtaccaaacacgcgatgctcctagtagtcgtcagctttgtaacactgattacaggtaacatgtcttttagagacttaggtagagtaatggttatggtgggtgctacaatgacggatgacatcgggatgggcataacgtacttagccttgctagcggcttttaaagtaagacctacttttgctgcaggtcttttgttacggaaactaacaagcaaagaattgatgatggcaaccataggcatagctttattgtcacagagtactataccagaaacaatattagaactcacagacgctttagctttaggtatgatggtcctgaagatagtacgaaatatggaaaaatatcaattagcggtgaccattatggctataagttgcgtcccaaacgcagtaattttacaaaatgcgtggaaagtttcgtgtactattctagcagcagttagcgtaagccccctactactcacaagctcacaacaaaaggcagattggataccattagccttaacaataaaagggctgaacccgacggcaatattcttaacaacgctatcacgaactagcaagaaacgtagttggccattaaacgaagcaattatggctgtaggaatggtgagtatacttgcatccagcctgctgaagaacgacattcccatgaccggtcctttagtagctggaggactcctgaccgtctgttacgttctaacaggcaggtctgctgatcttgaactcgagcgagctgcagatgtaaaatgggaagatcaagccgaaataagtggctcgtctccaattctatcaataactatctccgaagatggaagcatgagtattaaaaatgaggaggaagaacaaacactgacaattctaataagaacaggattactggtaataagtggagtgtttcctgtgagtataccaatcacagctgcagcatggtacctgtgggaggtcaaaaagcaacgagccggggtattatgggatgtaccttccccaccgcctgtcgaaaaagctgaattagaagatggtgcttatagaataaaacaacgggggattctgggatactcccaaataggagccggcgtatataaagaaggaaccttccataccatgtggcacgttactaggggtgccgtactgatgcatagaggaaagagaatagagccatcatgggccgacgtgaaaaaggatctaatctcttacggagggggctggaaacttgagggggaatggaaagaaggagaagaagtccaagtgttagccttagaacccggcaaaaatccgcgcgctgtccaaacgaagcctggcctatttaaaaccaacaccggtacgatcggtgctgtgtcccttgactttagtcccgggaccagcggatcacccattgttgacaggaaaggcaaagtggtaggattatacggaaacggagttgtaacaagaagtggcgcctacgtctccgccatagcacaaactgaaaaatctatagaagataacccggagatagaggacgacatatttaggaagaagcggttgactataatggacctacatccgggtgccgggaaaaccaaaagatatctgcctgccatcgtccgagaagcaataaagaggggattacggacgcttatactagcccccactagggtagtggccgcagaaatggaagaagcacttaggggtctacccataagataccagacaccagctataagagctgaacacacaggtagggaaatagtagatcttatgtgtcacgcaacgtttacaatgagacttctgtcgcctgtgagagtcccaaattacaatctgataatcatggatgaggctcacttcacagatccggcaagtatagcagcacgtggttacatttccacacgggtggaaatgggagaagcagctggtatattcatgaccgcaacaccaccagggagccgagacccatttcctcaatcaaatgcgccaataatggatgaagaacgagaaatacctgaacgctcatggaacagcgggcatgagtgggtaactgactttaaaggcaaaacagtctggtttgtaccaagtattaaagcgggtaatgatatcgcagcgtgcctcaggaagaatggaaagaaagtaatacaactaagtaggaaaacgtttgactcagagtacgtgaaaaccagagcaaatgattgggattttgtagttacaactgatataagtgagatgggagctaatttcaaggcagagcgggtaatagatccccgtagatgtatgaaacccgtaatattaactgatggtgaggaaagagtgattttagcgggtcccatgcctgtcacccattcatcagcggcacaaagacgagggagaataggccggaatcccaaaaatgagaatgaccaatatatttatatgggtgaaccactagagaatgacgaagattgcgcccattggaaagaagcaaaaatgttactcgataacatcaacacaccagagggaatcatacccagtatgttcgaaccagaaagagaaaaagtagatgcgatagatggagaatatcgcttgagaggagaagctaggaaaacatttgtagacttgatgagaaggggagatttaccggtctggctagcatacagagtagcagcagaaggcataaattacgctgacagacgttggtgttttgatggcatcaaaaacaatcaaatcttagaagaaaatgtggaagtagagatctggacgaaagaaggagaaaggaagaaacttaaacctaggtggctagatgcacgtatatattcggatcctttagctttaaaagagtttaaagagttcgctgcgggacgtaagagtttaacattaaatcttattacagagatgggccgattaccaacttttatgactcaaaaagcaagagatgccctagataatttggcagtactacatactgcggaagcaggagggcgagcatacaatcacgcactatcggaacttccagagacactagaaacactcttgctattgacactgcttgctactgttaccgggggcatatttctttttctaatgtcgggaaaaggtatcggaaaaatgacccttggcatgtgttgcataattacggcatcaatacttctatggtatgcccaaattcaaccacactggatagctgcatccataatattagagttcttcctcatagtactactgatccctgaaccagagaagcaaagaacaccgcaagataaccagctaacgtatgtagtgattgctatccttactgtggtagcagcgacgatggcaaacgagatggggtttttagagaaaactaagaaagatcttggactcggatcaatagcgacccaagaaagcgagtccaacatactcgatatcgatcttcgacctgcaagtgcttggacactttacgcagtagcgactacttttgtcacaccgatgctgagacattcaattgaaaattctagcgttaacgtcagcttaactgcgattgcaaatcaagctactgttttaatggggctaggcaaaggttggcccttgtcaaaaatggatataggggttccactccttgcgataggatgctactcacaggttaatccgattaccctaacggcggcgttgttgctcctagtagctcactacgccataataggtcctggattacaagccaaggcgaccagagaagcccaaaagcgagcagcggctggaattatgaagaaccccactgtggacggaattacagtaatagatttggaaccaatcccatatgatccaaaattcgaaaaacaacttggccaagtaatgttattaatattatgtgtgacacaagtactaatgatgcgaaccacttgggccctctgcgaggcactcacgctagcaaccggaccgataagtacactttgggagggtaatccaggaagattctggaacacaacaatagccgtttccatggctaacatttttcgaggatcgtatttagccggggcagggttattatttagcataatgaagaataccacaaacacacgaagaggtacagggaatattggtgaaacacttggcgagaaatggaaaagccgtttaaacgctcttgggaaatcagagttccaaatctacaaaaagagcgggatacaagaagttgacagaaccttagcgaaagaaggtataaaacggggtgaaactgatcaccatgccgtctctaggggtagcgctaaactacgttggttcgtagaaaggaatatggtaacacccgaaggcaaagtagttgatttagggtgtggcagaggtgggtggtcttattattgtggtggactcaaaaacgttagagaagtaaaaggacttacaaaagggggacctggtcacgaagaaccaattcctatgtcgacatacggatggaatttagtaaggctgcagtcgggagtagatgttttcttcactccccctgaaaaatgtgatactttattatgcgatatcggcgaaagcagtccaaatccaacaattgaagcaggtagaacgctaagagtactaaacttagttgaaaattggttaaataataatacgcaattttgcataaaagtgctcaatccatacatgccatcagtcatagaaaagatggaaaccctacaacgtaaatatggcggagccctggttcgaaacccactaagccggaacagtacgcatgaaatgtattgggtgtcaaacgcaacgggaaacatcgtatcttccgtaaatatgatttctaggatgctaattaacaggtttacaatgaaacataagaaagcaacttacgaaccggacgtagatctaggtagtggaacacgaaacataggtatagagtctgaaattccaaacttagatattataggaaagcgaattgagaaaatcaaacaagagcacgaaacaagttggcattatgaccaggatcacccatataaaacttgggcttatcacggaagctatgaaaccaaacagacaggttcagcctccagtatggttaacggtgtagttcgactattaaccaaaccgtgggacgtggttcctatggtaacacaaatggctatgaccgacacaacgccattcggacaacagagggtatttaaggagaaggtagacacacgaactcaagaacctaaagaaggaaccaagaaactaatgaaaataacagccgaatggttatggaaagaattaggcaaaaagaaaacgccccgtatgtgtacacgagaagagttcactcgaaaagtccgatcgaacgcggcgctaggggctatattcactgacgagaataaatggaagtcggcacgagaagctgttgaagatagtcgcttctgggagctgatagacagggaacgaaatctacatcttgaaggaaaatgtgaaacatgtgtatacaacatgatgggaaaaagagaaaagaaactaggagagttcggaaaggcgaaaggaagtcgcgcgatctggtacatgtggctaggcgcgaggtttttagagtttgaggcactgggatttctcaatgaggaccactggttctcaagaggaaattctctatctggggtagaaggggaaggtttgcatcgactcggatacatactaagagatgtgagtaaaaaggaaggaggagcaatgtatgcagacgatacggcaggatgggatacaagaataacactcgaagacctcaaaaacgaagaaatggtaactaaccacatgaaaggcgagcataagaaactagcagaagcaatatttaaacttacatatcaaaataaagtggttcgagtccaaagaccaactccgcgtggtactgttatggatataatttcacggagggatcaacgaggaagcgggcaagtaggaacctacgggctaaatacttttactaacatggaagcgcaattaatccgacaaatggaaggagaaggaatttttaaatcaatacaacacctcactgtcactgaggaaatcgcagtgcaaaattggttagcaagggtaggtagagagcgtttgtcccgtatggccataagcggcgacgattgcgtagtaaaaccccttgacgacagattcgcttcagcgttaaccgccctaaacgatatggggaaagtacgaaaggacattcaacagtgggaacctagtcgtggatggaacgactggactcaggtacccttctgtagtcatcactttcacgaacttgtgatgaaggatgggagggtacttgtggttccttgtcgaaatcaggatgaactcattggaagggcaagaatcagccaaggtgcaggttggtcactcaaagagactgcttgcctgggaaaaagctatgcgcaaatgtggactttaatgtactttcaccgtagagacctgagattagctgcaaatgccatttgttccgcagtaccatctcattgggtccccacgtccagaacaacttggagcattcatgccaaacacgaatggatgacaacagaagatatgctagccgtttggaacagagtgtggattcaagagaatccatggatggaagacaaaactccagtggaaagctgggaggaagttccttacttaggtaaacgcgaagaccaatggtgcggttcactaataggacttacgtcgcgggccacctgggctaagaacattcaaacagctattaatcaagtcaggtctttaataggaaatgaagaatacaccgattatatgccatcaatgaaacgcttccgtagagaagaagaagaggcaggcgtcttgtggtga

SEQ ID NO: 22633 - RNA, 9876 nt, synthetic construct
  misc_feature 1..9876: note = derived and/or modified CDS sequence (opt6) from DENV-2__EU482742__SS-prME
  source 1..9876: mol_type = other RNA
acggcaggggtaatcataatgttaataccgacggctatggcatttcatctgacaacacgaaatggagaaccacacatgatagtaggaagacaagaaaaaggtaaaagcctactgtttaaaactgaagacggtgtaaacatgtgtacgttgatggcgatagaccttggagaactgtgtgaagatacgatcacatacaaatgtcctctactaagacaaaacgaaccagaagacatagattgttggtgcaattcaacatctacatgggttacatacggcacttgtacaacgacaggggaacatagacgtgagaaacgatcagtcgccctggtgccacacgttggaatgggcttagaaacaagaactgaaacatggatgagcagtgaaggagcatggaaacatgtacaacgaatagaaacatggatcctaaggcatccaggatttactataatggcagcaattctagcatacactattggaacaacacacttccaaagagcattgatatttattttactcactgctgtagctccctcaatgacgatgcggtgcatcgggatatcgaaccgagattttgttgaaggggtatcaggtgggtcatgggtcgatattgtcctcgaacacgggtcttgtgttacgactatggctaaaaataaaccaacactagactttgaacttatcaaaacagaagcaaaacaacccgcaacactaagaaaatattgtattgaagcaaaattaacaaacactactacagaaagtcgctgtccaacacagggtgaaccatcattaaacgaagaacaagataaaaggttcgtatgtaaacacagtatggttgataggggatggggtaacggatgcggactgtttggaaaaggaggtatagttacgtgcgcgatgtttacctgtaaaaagaatatggaagggaaagtggttcttccagaaaaccttgaatatactatagttatcactccccacagtggagaagaacacgcagtcggcaatgatacaggaaaacacggcaaagaaataaaaataactccccaaagcagtattacagaagcggagctaacaggctacggaacggtcactatggaatgctctccgcgaacaggcctcgacttcaatgaaatggtactgttacaaatggaagataaagcatggctagtccatagacaatggtttttagacttaccattaccctggctaccaggagcagatactcaaggaagcaattggattcaaaaagaaaccttagtcacttttaagaatcctcatgcgaagaaacaagatgtagtagtattgggttcacaagaaggagcgatgcacacagctttaacaggcgctcctgaaatacaaatgtcctctggtaaccttctttttaccgggcacctgaaatgcagattgagaatggacaaacttcaactaaagggtatgtcctattccatgtgcactggaaaatttaaaatagttaaagaaatcgcagaaacacagcacggtacgatagtcataagagtgcagtacgaaggcgatggatcaccatgtaaaatcccgttcgaaataatggacctagaaaaacgacatgttctgggacggttaattacagtaaatccaatagtaacggagaaagattcacccgtaaacatagaagcagaaccgcccttcggtgattcatatataataataggtgttgagccaggacagttaaaattgaattggttcaagaaaggaagttcaatcgggcaaatgtttgagacaactatgagaggagctaagaggatggcgattttaggggatacggcatgggacttcggtagtttaggtggagtatttacgagtattggtaaagccctccatcaagttttcggagcgatatatggcgcagccttttcaggcgtgagctggacgatgaagattttaataggggttataataacatggatcggaatgaactctcgaagtaccagcctaagtgtctctctagttttagttggcgtagtaacgttataccttggagcaatggttcaagctgactccggttgcgtagtgtcttggaaaagcaaggaattaaaatgtggtagtggcatattcataactgacaatgtacatacctggacagaacaatataaattccaaccggaatcaccaagtaaattagcctcagccattcaaaaagcacatgaggaaggaatttgcgggatacgcagtgtaacacgattagagaatctcatgtggaaacaaataactcctgaactcaatcacatattatcagagaacgaggtaaaattaacaataatgactggtgatataaaaggcattatgcaggctgggaaaaggagccttagaccacaaccaacagagctgaaatactcctggaagacatgggggaaagcaaaaatgttatctaccgaaagtcacaaccaaaccttcctaattgatggtccggagactgcggaatgtcctaataccaaccgagcgtggaactcgttggaagtggaagattatggattcggcgtatttacaacaaacatctggctaaaattgcgagaaaagcaagatgtcttttgcgacagcaagttaatgagcgcagccatcaaggataatagggcagtccatgccgatatgggatactggatagaatctgctctaaatgacacgtggaaaatggagaaggcttcgtttattgaagtaaagtcgtgtcattggccaaagagtcatactctatggtcaaacggagtcctagagtctgagatgatcatacccaaaaatttcgcgggcccagtatcacaacataactaccgacctggttaccacacacaaacagcgggaccatggcacctcggaaagctagagatggactttgacttctgtgaaggaacgacggtagtagtgacggaagactgtggtaacagggggccctctttgaggaccacaacagcatcaggtaaacttattacagaatggtgctgtcgatcatgtactttacctccattacgttatagaggagaggacgggtgttggtatggcatggaaatacgtccactaaaggaaaaggaagaaaatttagtgaactctctagtaaccgcgggacatggacaaatcgacaatttttcgctcggcgttctcggtatggcactgtttctagaagaaatgctaagaactcgagtgggaaccaaacatgcgatactattggtagctgtatcattcgtgacattgataactggaaatatgtcatttagagacctaggacgagtgatggtgatggttggagctacaatgactgacgacattggtatgggggtgacttatctagctttactagctgcttttaaagttcgaccaacttttgctgctggattactattaaggaagttaacgtcaaaggaacttatgatggcaactataggcatagcattactatcacagagtaccatcccagaaacaattttggaattaacagacgcgttggctcttggaatgatggttttaaagatagtaaggaacatggaaaagtatcaactagcagtaacaatcatggcgattagttgtgtacctaatgcggtgatattacaaaatgcgtggaaagtttcttgtacaatactagcggcagtatcagtaagccccttactactcacctcaagtcaacaaaaagccgattggatacccctagccctaacgatcaaaggtttaaatccaacagcaatattccttactaccctctcaagaactagcaagaaacgaagctggccacttaacgaagcaattatggcggttggaatggtttcaattcttgcaagtagtttacttaaaaatgatataccaatgaccggacccttagtagccgggggtcttttaacagtatgttacgtgttaaccggaaggagcgccgatctcgagttagaaagagcggctgatgtaaaatgggaagatcaagcagaaatatctggaagttcacccatcctcagtatcaccatatcagaagatggcagcatgagcattaaaaatgaagaggaagaacaaaccctaacaattctcattcgtacagggcttctagttatatccggcgttttcccggtaagcattccgataacagcggcagcctggtatctatgggaagtaaagaaacaacgagctggtgtactatgggatgtaccatcacctccaccagtgggaaaagctgagttggaggatggagcatatcggattaaacaacgtggcatcctagggtactcacaaattggtgcaggcgtttataaagaaggaacctttcacaccatgtggcacgtaactaggggcgcggttttaatgcacaggggaaaaagaatagaaccatcttgggcagacgtaaagaaagacctgataagttatggagggggatggaaattggaaggagaatggaaagagggtgaagaagtacaagtactcgcactggaacccggaaagaaccctagagctgtgcaaaccaagcctggcttgtttaagacgaacacgggtacaatcggagcagtgtcattagatttctcacccgggacaagcggctcgccgatagtagatagaaagggaaaagtggtcggtctatatggaaatggagtagtaactaggtcaggagcttacgtttctgctatagctcaaacggaaaagagtattgaagataacccagagattgaagatgatatattcaggaagaaaagactaacaataatggacctccatcctggtgcagggaaaacaaagagatacctgcccgctatagtaagggaagccataaaaagagggctacgtacactgattctagcacctactcgtgtagtagcggccgaaatggaagaagcgcttcgcgggttaccgattaggtatcagacaccggctataagagcagaacatacaggccgagagattgtcgatttgatgtgtcatgcaacgttcacaatgaggttactaagccccgtgcgggtgccaaattataacctaataataatggatgaagcacattttacagatccagcttctattgcagcgaggggctacatctcgacaagggtagaaatgggtgaagcagcaggaatcttcatgactgccactccccctggctcacgtgatccattccctcagtcaaatgctccaatcatggatgaagaaagggaaattccagaacgcagttggaactctggtcacgagtgggtaactgattttaaaggaaaaacagtgtggtttgtgccatccataaaagctggaaatgatattgctgcatgtttgaggaaaaacggcaagaaagtaatacagttaagccggaagacgtttgatagcgaatatgtaaaaaccagggcaaatgactgggactttgtcgtcacaacagacatttcagaaatgggggcaaactttaaagcagagcgcgtaatagacccacgacgatgcatgaaacctgtaattctcacagatggagaagaacgagtaattctagcaggaccaatgcctgtaacacattcgtcagccgcacaacgacggggacgaataggcagaaatccgaaaaatgagaatgatcaatatatatacatgggagaacctttagaaaatgatgaagattgtgcacattggaaagaagctaaaatgctactcgacaacataaatacaccagaaggaataataccgagtatgtttgaaccggaacgagagaaagtagatgcaatcgacggagaatatcggctacgaggagaggcaagaaagacttttgtagatttaatgagaagaggggaccttccggtatggttggcatatagagtggcagcggaaggaataaattacgctgatcgaagatggtgttttgatggaatcaaaaataaccaaatcttagaagagaatgtagaagtagaaatttggactaaagaaggagaaagaaagaaactcaaaccgcgttggcttgacgcaaggatatactctgatccactagctttaaaagagttcaaagagtttgctgccggtagaaaatcattgacattaaaccttattacggagatgggacgccttccaaccttcatgacacagaaagcaagagacgcattagataatttggcagttttacatacggcagaagccggaggtagagcatacaaccatgcattaagcgaattgcctgaaacgctcgaaacactgttactgttaacgttactggctgctgtgacgggaggaattttccttttcttaatgtcagggaaaggaattggtaaaatgacactaggtatgtgttgtatcataaccgcatccatactattatggtatgcgcaaatccaaccgcactggattgcggcaagcataatccttgaatttttccttatagtacttcttattcctgagccagagaaacaaaggacaccacaagataaccagttaacgtacgtcgtaattgcgatactaaccgtcgtagctgcaacaatggctaacgaaatgggtttcttagagaaaaccaagaaagaccttggtttagggtcgataaccactcaagaaagtgagagtaacattttagatatcgatctcaggcccgcctccgcgtggactctgtacgcggtcgcaaccacttttgtaactcctatgcttcgccatagtatcgaaaactccagcgtaaatgtatcacttacagctatcgccaaccaggcgacagttctaatgggattaggtaaaggatggcctctaagcaaaatggatattggggtacccttactagccattggctgttatagccaagtcaaccccataacgctgacagcagcgctgctcctattagtagcacattatgccattatcggacctggcctacaagcgaaagctacgagggaggcgcagaaaagagcggcggccggaatcatgaaaaatcccacggtagatggaataacagtaatagatttagaaccaataccttacgacccgaagtttgaaaaacaactggggcaggtcatgctactcattttatgtgtaacacaagtactcatgatgagaaccacctgggctctctgtgaagcattgacattagctactggaccaattagtacgttatgggagggaaaccctggtcgcttctggaatactacaatcgcagtatcaatggcgaatatattccgtggatcttatttagcgggagcagggctcttattcagcataatgaaaaacactactaatactcgaagaggtacaggaaatatcggagagactttaggagaaaagtggaaaagccgtttaaatgcgctaggtaaaagcgaatttcaaatatataagaaatctggcatccaagaagtagatagaaccctagcgaaagaaggcatcaaaaggggtgaaactgaccaccatgctgtgtcaaggggttctgcgaaattaagatggttcgtagaacgaaacatggtcaccccagagggaaaagtagtggatctgggatgcggtcgaggtggatggagctactattgtgggggactcaaaaacgtgagggaggtaaagggtctaacaaagggaggccctgggcacgaagaacctatacctatgtcaacgtatggatggaacttagtaaggctacaatcaggggttgacgtatttttcacacctcctgagaaatgtgatacgctcctatgtgatattggcgaaagtagcccgaaccccacaatagaagctggcagaactttacgtgttctgaatctggtagagaactggttaaataacaatacccaattttgtattaaggtactaaatccctatatgccgagcgtaatagagaaaatggagacattgcagcgtaaatatggaggggcgctggtaagaaaccctctttctagaaattctacacacgagatgtactgggtatcaaatgcaacaggtaatatcgtcagttcagtcaatatgattagtagaatgcttattaaccgttttaccatgaaacacaagaaagcaacatatgaacctgacgtagatctgggatccggcacacgtaacataggaatagaaagcgaaattccaaaccttgatataataggaaaaagaatagagaaaataaaacaagaacacgaaacctcatggcactatgatcaagatcatccatacaaaacttgggcttatcatggttcatacgaaaccaaacaaacagggagtgccagctctatggtgaatggtgtagtaagactgctaacaaaaccttgggatgtggttcccatggttacacaaatggccatgacagacacaactccatttgggcaacagagagtctttaaagaaaaagtagacacgagaacgcaggaacctaaagaaggaacaaagaaactcatgaaaataactgccgaatggctatggaaagaactggggaagaagaaaacgccaaggatgtgcaccagggaagagttcactagaaaagtacgttccaacgcagccctaggggcgatttttaccgatgaaaataaatggaagtccgcgagagaagcagtagaagattcaagattttgggaactcattgaccgagagagaaacttacacctcgaagggaagtgcgagacgtgcgtatacaatatgatggggaaaagagagaagaaactaggggagttcggtaaagccaaaggcagtagggctatatggtatatgtggcttggggcaagattcctagagttcgaggcattaggatttctcaatgaagaccattggttctcaaggggtaacagcttgtctggagtagaaggggagggtctacataggttgggttatatattaagggatgttagcaagaaagaaggaggagcaatgtacgcggatgatacagctggatgggatacacgaataacgctggaagacctcaaaaatgaagagatggtgaccaatcatatgaaaggtgaacacaagaaactagcagaagcaatttttaaattaacataccaaaacaaagtcgtccgggtgcaacggcccaccccgcgaggtacagtgatggacatcatttctcgcagagatcaaagaggaagtggccaagttggaacatacgggttaaatacgtttacgaatatggaagcgcaattgatccggcaaatggaaggagagggcatttttaaaagcatacaacacttaacggtaaccgaagaaatagctgtccaaaattggcttgcaagggtaggccgagaaagactttccagaatggctatcagtggtgatgattgtgttgtcaaaccactagatgaccgattcgcatcggctttaactgccctcaatgatatgggaaaggtgcgcaaagacatacagcagtgggaaccgagccgcggttggaacgattggacacaggtgccattctgcagtcaccacttccatgagctagtgatgaaagatggcagagtgttagtggtaccatgtagaaatcaagatgaactaatcggtagagcaagaattagccagggggcaggatggagccttaaagaaactgcatgcctaggaaaaagttacgctcaaatgtggaccctgatgtactttcatagaagagatcttagattagcagcaaatgcgatatgttccgctgtgccctcacactgggtcccaaccagtagaactacgtggtcaatccatgcgaaacatgaatggatgactacagaagacatgctagctgtctggaatcgagtttggatccaagaaaacccatggatggaagacaaaacgcctgtagagtcctgggaagaagtgccctaccttggtaaacgcgaagatcagtggtgtggatcacttattggtttaacatcacgggcaacatgggccaaaaacattcaaacagcgataaatcaggttcgtagcttaattgggaatgaggagtatacggattatatgcccagcatgaaaagattcagaagggaggaagaagaggcaggggtactctggtga

SEQ ID NO: 22634 - RNA, 9876 nt, synthetic construct
  misc_feature 1..9876: note = derived and/or modified CDS sequence (opt6) from DENV-2__EU482744__SS-prME
  source 1..9876: mol_type = other RNA
acagctggagttattataatgttgatacctacggctatggcattccaccttacaacacgtaacggagaaccacacatgatcgtcggtagacaggaaaaaggaaaatctttattattcaaaacagaagacggcgttaatatgtgtacactaatggcaatagatcttggtgaactatgtgaagatacaataacctacaaatgtccattacttcgtcaaaatgaacctgaagatattgattgctggtgtaactctacatcaacgtgggtaacgtacggaacatgcacaacaacaggggaacacagaagagagaaaagaagtgtagcgttagtgccgcacgtcggtatgggcttagaaactcgaacagaaacatggatgtcgagtgaaggagcttggaaacacgtgcaaagaatagaaacctggatcttgaggcaccctggattcacaattatggcagcaatactagcatacacaatcggaaccacacattttcaacgcgctcttatttttatcctactaacggccgtcgctcccagtatgaccatgcgatgcatcggcatcagtaatagagactttgtcgaaggcgtatcagggggaagttgggtcgatattgtactagaacacggttcttgcgtaacaacaatggccaaaaacaaacctactctggattttgaactaattaaaactgaagcaaaacagccagcaacgctccgaaaatactgcatagaagctaaattaacaaataccactaccgaaagtcgatgccctacacagggagaacctagtttaaatgaagaacaggacaaacggttcgtatgcaaacattcgatggtggacaggggttggggcaacggttgcggcctattcgggaaaggtggtatagttacttgcgcaatgtttacatgtaagaaaaatatggaggggaaagttgtattaccagaaaatctagaatacaccatagtgattactccgcacagtggagaggaacatgcagtaggtaatgataccgggaaacatggcaaggaaatcaaaattactccgcagtcctctattactgaggcagaactaacagggtacgggactgttaccatggaatgctcgccgcggactgggctagacttcaatgaaatggtcctactacagatggaggataaagcatggcttgtacatcgacagtggtttttagacctgcctttaccatggctcccaggagctgacacacagggctcgaattggatacaaaaagaaaccctagtgacgttcaaaaatccacacgctaagaaacaagatgtggtcgtattaggatctcaggaaggagctatgcacactgcactgacaggtgcaacagaaatccaaatgagctccggtaatttattgttcacaggccacttgaagtgtagattaagaatggataaattgcagcttaaaggaatgagttattccatgtgtacaggaaagttcaagattgtaaaagagattgcagaaacacaacacggtactattgtgataagggttcaatatgaaggggatggtagcccatgcaaaatcccatttgaaatcatggaccttgagaaaagacatgtacttggtcgtttaatcacagttaatccaatcgtaactgaaaaggattcaccagtcaatattgaggcagagcccccgtttggggactcctatataataataggagtagagcctgggcaacttaaactaaattggtttaagaaaggaagctcgataggccaaatgttcgagacgaccatgagaggggcaaagcgaatggcaatacttggtgacacggcttgggatttcggatcattgggaggggtatttacttcaataggcaaggcacttcaccaagtttttggagccatctatggtgccgcatttagcggggttagttggacgatgaaaatccttattggggtaatcattacctggattggaatgaatagcagatcaaccagcctttctgtatcattggttttagtaggcgtagtaacactatacttaggagcaatggtacaagcagattccggctgcgttgtaagttggaaaaacaaagagctcaagtgcggttcaggaatattcataacagataatgttcacacgtggacagaacagtacaaatttcagcccgaatctccaagtaaattagcaagtgctatacaaaaagcacatgaagaaggcatatgtggaatccgatctgtaaccaggcttgaaaatttaatgtggaaacaaataacacccgaattgaaccatatcttaagtgaaaatgaggtgaaactaactattatgaccggagatattaaaggaattatgcaggccggcaaaagatcactacggccgcaacccaccgagcttaaatatagttggaagacgtggggaaaggcaaaaatgttatctactgaatctcacaatcaaaccttcctaattgatggaccagagacagcagaatgtccgaacaccaatcgagcgtggaatagccttgaagtagaggactatggattcggcgtattcacaacaaatatctggctaaagttacgcgaaaaacaagacgtattttgtgactcaaaattaatgtcagccgccatcaaagataacagagccgtacacgcagacatgggatactggatagaatccgcactaaatgacacctggaaaatggaaaaggcaagttttatagaagtaaaatcgtgtcactggcctaaatcacataccttatggtcaaatggagtacttgagagcgaaatgataataccgaaaaactttgccgggcctgtgtcacaacataactacagaccagggtaccatacgcagacagcgggtccatggcacttaggaaagctagaaatggactttgatttttgtgaaggtacgacagtggtagtcacggaggattgtggtaaccgaggaccttcactaagaaccacaacagcctcaggcaaattgatcactgaatggtgttgcagatcctgcacgctccctccgctcagataccgaggggaggatggttgttggtatgggatggagataaggcccctcaaagaaaaagaagaaaacctagtaaattcgttggtaacagctggccacggacaaattgacaacttttcattaggagtactaggaatggcactatttttggaagaaatgttgaggactagggtagggaccaaacatgctatcctcttagtcgccgtgtcgttcgtgacgttaataacgggaaacatgtcctttagagatcttggacgggtaatggtcatggtgggcgctacgatgactgacgacattggtatgggtgttacatacctggcgctgctagctgcatttaaagttagacctaccttcgcggcgggactacttcttagaaagctaacctcaaaggagttaatgatggctacaattggcatagctctactttcacaaagcacgataccggaaactatcttagaattaacagatgcattggccctaggaatgatggtccttaaaatagtaagaaacatggaaaagtatcagttagcagtatccataatggctattagctgcgtccctaacgccgtgattttacaaaatgcctggaaggtaagttgtacaatccttgctgctgtgtcggtttctccattactgttaacgtcatcccaacaaaaagcagattggataccattagcactgactatcaaaggtcttaatcctacagcaattttcttgacgacattaagtcgcaccagcaagaaaaggagttggcctctaaatgaagcaataatggctgtgggaatggtgagtatacttgcatcatcacttctcaaaaatgatattccgatgactgggcctctagtcgctggagggcttcttacagtctgttatgtcctgacgggaaggtcggcggatttggaacttgaaagagctgcagatgtcaaatgggaagatcaggcagaaataagtggtagttcgcctattctctccatcacaatttcagaagatggaagtatgtctattaagaatgaagaagaagaacaaacattaacaatactaattcgcaccggattacttgtaatttccggagtctttccggtatctataccaataacagcagctgcttggtatttatgggaagttaaaaagcaaagagcgggagtcttatgggatgtgccatcaccacccccagtcggaaaggcagagttggaagatggggcataccgcataaaacagagaggtatattagggtactctcagataggcgccggagtatacaaggagggaacatttcacaccatgtggcatgtaacacgaggtgcagtattaatgcacagaggaaaacgaatagagccatcatgggcggatgtcaagaaagatctaatcagttatggtgggggatggaaactggaaggtgagtggaaagaaggggaagaagtacaagtactcgcacttgaaccgggaaagaatccgcgagcagtgcaaaccaagccaggcctttttaagacaaatacaggaactattggggcggtaagcctagacttttctccagggaccagtggatcacctattgtggatagaaaaggtaaagtcgtcggcttatacggtaatggagttgtgaccagatccggggcatatgtatctgccattgcacaaaccgagaaaagcattgaagacaatccagaaatagaagatgatatatttaggaagaaaagattaaccataatggatcttcatcccggtgcgggaaaaacaaaacgttatttacctgccatcgttagggaggctatcaaacgcgggctgagaaccttaatattagcaccgacacgcgtagtcgccgccgaaatggaagaggcgttaagaggtttaccaattagatatcaaacacccgcgattagagccgaacacactggaagagaaatcgtagaccttatgtgccatgcaacctttacaatgagattattatccccggtaagagttccaaactataatttgataataatggatgaagcccacttcaccgacccagcgtccattgccgctagaggatacataagtacaagagttgaaatgggagaagccgcaggaatattcatgactgctacccctccgggatcaagggatccttttccacaatctaatgctccaatcatggacgaagaaagggaaattccggaaagaagttggaactcaggccacgaatgggtaaccgattttaaaggaaaaaccgtctggtttgtacccagtataaaagctggtaatgacatagcagcctgtttgaggaaaaacggtaagaaagtcattcaactttccaggaaaacattcgacagtgaatatgttaaaacaagggcgaacgactgggattttgtagtaacaacagacataagtgagatgggagcaaactttaaagccgaacgagttatcgatccgcgaagatgtatgaagccagtgatccttaccgatggcgaggaacgagtcatcttggcaggacctatgcctgttacgcattcctcagcggcccaaagaagaggcagaatcggacgtaatccaaagaacgaaaacgaccaatatatatacatgggtgaaccactagaaaatgacgaggactgtgcccactggaaggaagcaaaaatgctgttagacaacataaatactccggaaggcataataccgtcaatgtttgaacctgaacgtgaaaaagttgatgctatagatggtgaataccgactacgtggcgaggccagaaagacatttgtagacctaatgcgacgtggagacttaccagtatggttagcatacagagtagctgcagaagggataaattacgcagatagaagatggtgtttcgatggcatcaagaataaccaaatcctcgaagagaatgtagaagtcgagatctggacaaaagaaggcgaacgaaagaaacttaaaccaaggtggctagatgcaagaatatattccgatccactagcacttaaagaatttaaagaatttgcagcaggacgaaaatcattgacactaaacttaataacagagatgggcagactccctacatttatgacgcagaaggcaagggatgcgttggataacctcgcagtgctacacactgcagaagcaggcggacgtgcttataatcacgcattaagtgagctacccgaaactttagagacattgctccttttaactctgctagcaacagttacaggaggcatatttttgtttctaatgtcaggaaaaggaattggaaaaatgactttaggaatgtgttgcataattacagcgtccattctactatggtacgctcaaattcagccacattggattgcagcgtcaataatattagagttcttccttatagtattactaattcctgaacctgaaaaacagcgaacaccacaagacaatcaattaacatatgtggtgatcgcaatacttaccgtggtagcagcaaccatggctaatgaaatgggattcttggaaaagaccaagaaagaccttggactaggcagtattaccacccaagagtctgagagcaacattttagacatagatctaagacctgcgtctgcgtggacactatacgccgtagcaactacatttgttacaccgatgttacgccatagcatagaaaatagctctgtaaatgttagcttaacggcaatagccaatcaagcaactgttttgatgggactagggaaaggatggcctttatccaaaatggacattggcgtcccgctattagccattggctgctatagccaagtaaatccaattacattaacagcagcgctattattgttggtcgctcactatgctataataggaccgggcttacaagcgaaagcgactagagaagctcaaaaacgcgctgctgccggtataatgaaaaatccaaccgttgacggaatcacagtaatagacttggaaccaattccttacgatcccaaatttgaaaaacaattaggtcaagtaatgttattaattctctgcgtaactcaggtcctaatgatgagaacaacatgggcactctgtgaagcgttaactttagcaactggaccaatctctacgctttgggaagggaatccggggagattctggaatacaaccattgcggtctcaatggctaatatttttagaggcagttacctagcgggggcaggtctcctattctcaataatgaaaaacactactaacacaaggcgcggcacaggaaatattggagaaaccttgggtgaaaaatggaaaagcagactcaacgcattaggaaaaagcgagttccaaatctataagaaatctggcatacaagaagtagatagaacattggccaaagagggcatcaaaagaggagaaactgaccatcacgcagtcagccgaggcagtgcaaaattgagatggttcgtcgaaagaaacatggttacacctgagggaaaagtggtagacctaggttgtggacgtggaggttggagctactattgtgggggtcttaaaaacgtaagagaagtgaaaggcttaacaaaagggggaccgggacatgaagaacccattcccatgtcaacatatggatggaacctagttagattgcaaagtggcgtggacgtattctttacaccacctgaaaaatgcgatacgcttttgtgtgatattggagaaagttcgcccaatccaaccattgaagccgggagaacacttagggttcttaatttggttgaaaactggctgaacaataacactcaattctgtataaaagtcctaaatccgtacatgccctcagtaatagaaaagatggaaactcttcaaaggaaatacggaggtgcattggtgagaaatcccctatcaagaaattctacacacgaaatgtactgggtttcaaacgcaacaggcaacatagtatccagtgttaatatgatctcaagaatgttaataaacagattcacaatgaagcataaaaaggcaacatacgagccggatgtagacctaggtagcggtactcggaacattggaatagaatccgagataccaaatttggatataattgggaagcgcatagagaaaataaaacaagaacatgaaacttcgtggcattacgaccaggatcacccctataaaacctgggcgtaccacggttcgtatgaaacgaaacagacgggtagcgcatctagcatggttaacggggtagtgcgattacttacgaaaccatgggatgtcgtacccatggttacgcagatggccatgactgatacaaccccttttggacaacagagggtttttaaggaaaaagtggatacaagaacacaagaacccaaagaaggaactaagaaactcatgaagataacagctgaatggttatggaaggagctaggcaagaagaaaactccaagaatgtgcactcgggaagaatttacacgtaaagtaagatccaatgcagcgttaggagccatatttacggacgaaaataaatggaaatcagcacgtgaagcagtggaagattccaggttctgggaactgatcgatagagaaagaaacctacatttagaaggcaaatgcgaaacatgcgtttacaacatgatggggaaacgtgaaaagaaactgggagaatttggcaaagctaaaggaagtcgtgcaatatggtatatgtggttgggagcgcggttcttagagttcgaagcgctaggatttttaaacgaagatcattggttttcccgaggcaattctctatcaggagttgagggggaggggctacataggttaggatatatcctcagagatgtttcaaagaaggaaggaggagcaatgtacgcagacgacaccgcgggatgggatacccggattactctagaagacctcaaaaatgaagaaatggtgaccaaccacatgaaaggagagcataaaaagctagcagaagctatatttaaattgacatatcaaaataaggttgttcgagtgcaacgacctactccacgaggaaccgtcatggacattatatcgagacgagatcaacgaggaagtggccaggtgggaacttacggactaaatacttttactaatatggaggcacaattgattcgacaaatggaaggggaaggtatatttaaatctatacaacatctaactgtgacagaagagattgccgtgcagaattggctagcaagagtaggaagagaacgactatcgcggatggccataagtggtgatgattgtgtagttaaacccttagatgaccgctttgctagtgcgctgactgccttgaatgacatgggaaaagtccgaaaagatattcagcaatgggaaccatcaagaggatggaacgactggactcaagtaccattctgcagccaccatttccatgagctagttatgaaggatggcagagtattagtagtaccttgtagaaaccaagacgaactgattggacgagcgagaatctctcagggagcaggttggtcactgaaagaaacagcttgtctagggaaatcgtatgcacaaatgtggaccctaatgtactttcatcggagagatctcagactagctgctaatgctatttgtagcgcagttccatcccattgggtaccaacctcgaggactacttggagtatacatgcgaaacatgaatggatgactacggaggatatgctggcggtctggaatagggtatggattcaagagaacccgtggatggaggataaaacgccggtagaaagctgggaagaggttccgtacctgggtaaaagagaagatcagtggtgtggatcgctaatcggactaacatccagagcaacatgggccaaaaacattcagacagcaattaaccaagtaagatcattaatcggtaacgaagaatatacggactatatgccctcgatgaaaagatttcgtaaggaagaagaggaagcaggagtcctatggtga

SEQ ID NO: 22635 - RNA, 9876 nt, synthetic construct
  misc_feature 1..9876: note = derived and/or modified CDS sequence (opt6) from DENV-2__EU482745__SS-prME
  source 1..9876: mol_type = other RNA
acagcgggtgtaataataatgcttatacctaccgctatggcgtttcatttaacaactagaaacggggaacctcatatgatagtcgggagacaagaaaaaggaaaaagtctactatttaaaacggaagatggtgtaaacatgtgcacactcatggctatcgatctgggtgagctatgcgaggataccataacttataaatgtcccttactaagacagaatgaaccagaagatatagattgttggtgtaattcaacatccacatgggtaacctatggtacatgcactaccactggagagcatagaagagagaaaagatcagtagccctagttcctcacgtgggaatgggactagaaacgagaacggaaacgtggatgagttcagagggggcatggaaacatgtacaacgcatagaaacatggatattacgccatcctggtttcactatcatggcagcgattctagcttacacaatcggaacaacacattttcagagagccctcatattcatcctactcactgcggtagcaccaagcatgactatgcgctgtatagggatatccaatagggatttcgtcgaaggagtaagtggcggttcatgggtagacattgttcttgaacatggcagctgtgtgacaaccatggctaaaaataaaccaacgctggactttgaactaattaaaaccgaagcaaaacaacctgcgaccttaagaaaatactgcatagaggcaaaactgacgaatacgaccaccgagtctcgttgtccaacgcagggagaaccatcattaaacgaagaacaggacaaacgattcgtgtgtaaacattctatggtagaccgaggttggggcaatggatgcggacttttcggcaaaggcggaatcgtaacttgcgctatgtttacttgcaagaaaaatatggaaggtaaagttgttctaccagaaaatctagagtatactattgtaataactccgcacagtggtgaggaacatgcagtaggtaatgacacaggtaaacacggaaaagaaattaaaatcactccccaatcaagtataacggaagcagaacttaccggttatggaacggttactatggaatgtagtccccgaactggtttggattttaatgaaatggttttactacaaatggaagataaagcatggctggtacaccgacagtggttcctagatctgcctctaccctggctgcctggagcggacacacaaggcagtaattggattcaaaaagagacgctagtaacattcaaaaacccgcacgccaagaaacaagatgtggtggtattaggatctcaagaaggagcaatgcataccgcgcttacgggagcaaccgagatacaaatgtcctcgggaaacttactgttcactgggcacctaaaatgtagactcagaatggataaattacagttaaaaggaatgagttacagtatgtgcacgggcaaattcaaaatcgtcaaagaaatcgcagaaacacaacacgggacaatagtgataagggtgcaatacgagggggatggttcgccatgtaaaataccattcgaaataatggatctggagaaacgccacgtgttaggtaggctaatcaccgtcaaccccattgtaactgaaaaagattcgcccgtaaatatagaggccgagcccccattcggggatagctatataataataggcgtagagcctggccaactaaaattgaattggttcaagaaagggagtagcataggtcagatgtttgaaacaaccatgcggggtgcgaaaagaatggctattctcggcgatacggcgtgggattttggttccctagggggagtatttacgtcaatcgggaaagcgctccatcaagtgtttggagctatatatggagctgcattttcgggcgtctcctggacaatgaaaatcttaattggagtaataattacctggataggaatgaactcaagatcaacatctttgtcagtaagtttggtattagtaggcgtggtaacactctatttaggggctatggtccaagccgatagtgggtgcgtcgtatcgtggaaatctaaagaattaaaatgcggcagtggcatatttataacagataacgttcacacatggactgaacagtataaattccagcctgaaagcccaagtaaacttgcgagtgcaatccaaaaagctcatgaagaaggaatttgcggcataagatcggtcacaagattagagaatctaatgtggaaacaaataacacctgaactgaatcatatactaagcgaaaacgaggttaaattaacaataatgaccggagatataaaaggtattatgcaagctggtaaacgtagtctaagaccacagccaactgaattaaaatacagctggaagacatggggcaaagccaaaatgctgtctacagaaagccacaaccgtacatttctgattgacggaccagaaacagccgaatgtccaaataccaaccgagcatggaactccctagaagtcgaggactatggttttggcgtgtttacaaccaatatatggctaaaattgagagaaaaacaagatgtgttttgtgactcaaagctcatgtctgctgcaataaaggacaatagggcagtccatgctgatatgggatactggatagaatcagcattaaatgacacatggaaaatggaaaaagcatcgtttattgaagtaaaaagttgtcattggcctaaatcgcacactctatggagtaatggagtactggaatcagagatgataattcccaagaacttcgctggtcctgtaagtcaacacaattatcgaccagggtaccacacccagacagcaggaccatggcatttaggcaaattagaaatggacttcgatttttgtgaaggcacaactgtggtagtgacagaagactgtggaaacaggggaccgtcactacggacaactacagcatccgggaaattaatcaccgaatggtgttgccgcagctgcactctaccaccgttaaggtatcggggtgaggacggttgctggtacggaatggaaataaggccattgaaagagaaagaggaaaacttggttaactctctagtaactgcaggacatggacaaatagataatttttcacttggcgtactagggatggccctatttctagaagaaatgctaagaaccagagtggggactaaacatgctatactactcgtcgcagtatctttcgtaaccttaattacgggcaacatgagctttcgggatctagggcgagtaatggttatggtgggagctacaatgacggacgacataggaatgggcgtgacctaccttgcgttattagcagcgtttaaagttaggccgacgttcgctgctggtcttttactaaggaaattaacaagtaaagaactaatgatggcgacgataggtatagcattactatcacaaagtacaattccagagacaatcttagaattaacagatgcattagctttggggatgatggtgctaaaaatagttagaaacatggaaaaatatcaactggcggtcactataatggcaatatcatgcgtgcccaacgcagtaatattacaaaatgcatggaaagtgtcgtgtactatactcgctgccgtatcagtgtcccctttactattgacttcttcacaacagaaggcagattggatcccactagccctgactataaaaggattgaatcctacagctatttttctcaccactttaagccgaacaagtaaaaagaggtcatggccactaaacgaagctattatggctgtagggatggtatcaatcctagcgagctcattactcaaaaatgacatccccatgacaggaccgctggtagccggagggttactgacagtgtgttacgttttgacagggcgatcggcagacttagaactagaacgagctgctgatgtcaaatgggaagatcaggcggaaatttcaggatcgtcacctatattaagcataactatatcagaagatggatctatgtccatcaagaatgaggaagaggaacagacattgacaatactcataagaaccggcttattagtgataagtggcgtctttccggtgtctataccaataacggcggcggcttggtatttatgggaagtcaagaaacagagagccggtgtactttgggacgttcccagtccaccacccgttgggaaagcagaattggaagacggagcatatagaataaaacaacggggcatcttggggtactcccaaataggagcgggtgtatataaagaaggtacatttcatacaatgtggcacgtaacccgcggtgccgtattaatgcatcgcggtaaacgtattgaaccatcttgggccgatgttaagaaagacttgataagctacgggggtggctggaaactagaaggcgaatggaaagagggtgaagaggtccaagtgttagcgcttgaaccagggaaaaacccaagagccgtccaaacaaaaccgggactctttaagacaaatactggaactataggagcagtgtcactggatttttcacccggtacatctggtagcccgattgtagatagaaaaggcaaggtagtgggcctatatggaaacggagtcgtaactagatctggcgcatacgtttcagccatagcccagaccgaaaagtccattgaggacaatcctgaaatagaggacgatatatttcgaaagaaaaggctcacaataatggatttacatcccggggcagggaagacgaaacgatacttgcctgctattgtaagagaagccataaaacgtggtttacgcacactaattctggctcccacccgcgtagttgcggctgagatggaggaggcattacgtggactaccgataaggtaccaaaccccagcaataagagcagaacacacaggaagagaaatcgtagatttgatgtgtcatgctacattcacaatgaggttgctatctcctgtaagggtaccgaattataatctgattataatggatgaagcgcatttcactgatccagcgagcatagcagcaagaggatacatatcaacaagagtcgaaatgggagaagcggcaggcatatttatgacagccacaccccctggatccagagatcccttcccccagagcaatgcaccaatcatggatgaggagcgagaaatacctgaaagatcttggaatagcgggcacgaatgggtaaccgactttaagggaaaaactgtttggttcgtaccaagcataaaggctggcaacgatatagccgcgtgcttacggaaaaacggcaagaaagttattcaacttagtcgcaagacattcgattcggaatatgtaaaaacacgtgcgaatgattgggactttgtagttacaacagatatatcagaaatgggtgcaaactttaaggcagaacgagtaatagatcctagaagatgcatgaaaccggtcattctgaccgacggagaggaacgagtaatcttagcgggccctatgccagtcacgcattcatcagcagcgcaacgaagaggtagaataggtagaaatccgaaaaatgagaatgatcaatacatatacatgggagaaccattagagaatgatgaggactgcgcacattggaaagaagcaaagatgctcctagacaatataaatacgcctgaaggcattattccgtcaatgtttgaaccagagcgggaaaaagttgatgcaatagatggtgaatatagactaaggggagaagcacgaaaaacgtttgtagatttaatgcgccgaggtgacttaccagtatggctagcatatcgagtcgcagcagaaggtataaactacgcggacagacgttggtgctttgacggaattaaaaataatcaaatattagaagaaaatgtggaagtagaaatatggacgaaagagggagagaggaagaaacttaaacccagatggttggatgcaaggatttactcagacccgttagctcttaaagaatttaaagaatttgccgcaggccgcaaaagtctaacattgaatttgataacagaaatgggtagattaccaacatttatgacacaaaaagcgagagacgccttagacaatttagcagtactacatacagctgaagcgggcggacgggcatataatcacgctttatcagaactaccagaaacactcgaaacactactattattgacattgttagccacggtaactgggggcatatttctattcttgatgtctggtaaaggaataggcaagatgacattagggatgtgctgtattattacagcttctatcctactatggtacgcgcaaatacaaccccattggatagccgcatcaattatattggagttctttttaatagtcttactaatacccgaaccagagaaacaacggacacctcaagataatcaactaacatacgttgtgatagccattcttacagtagtagcagccacaatggcgaacgaaatgggattcctagaaaagactaaaaaggatttaggcttgggaagtataacgaccaaagaatctgaatctaacatattagacattgacctccgtcctgcttcagcatggactttgtatgccgtcgccacaacatttgtgacccccatgctacgacacagtatagaaaactcaagtgttaatgtatcactaacagcaattgcaaatcaagcaacagtcttaatggggttgggcaaaggatggccattaagtaagatggacatcggagttcctttactagctatcggctgctattcgcaagtaaacccaataactttgacagcagcgttgctattgttagtagcccattacgccataatagggcctgggttacaggcaaaagcaactagagaagcgcaaaagagagccgcagcgggaattatgaaaaatcccactgtcgacggaatcactgtaatagacttagaacctataccatacgacccgaagtttgagaaacaattggggcaagttatgttattaattctatgcgttacgcaagttttaatgatgagaacaacttgggccttatgcgaagctctgacgcttgcaacaggtcccatttcaacactgtgggaaggtaatccgggcagattttggaataccacgatcgcagtttctatggcaaatatttttcgtggctcatatctagctggcgccggtctactattttcgatcatgaaaaatacaacaaacacacgaagagggactggtaatattggggagactctaggagaaaagtggaaatccaggctaaacgccctaggaaaaagtgaatttcaaatctacaagaaaagcggcatacaagaagtcgacagaacactcgcaaaagagggaattaagcgaggagaaacagatcaccatgccgtttcgcgcggaagcgctaagctaagatggtttgttgagcgtaatatggtcacaccggagggcaaggtagtagaccttggttgcggaagaggaggttggtcctactattgtggaggcctgaaaaatgttagggaagtaaaagggctaacaaaaggcggaccaggccacgaggaacccattcctatgtccacttacggatggaatcttgtaagattacaatctggcgtggacgtatttttcacacctcctgaaaaatgtgataccttgttatgtgatattggagaaagttcaccaaacccaacaatagaagcaggtagaacacttcgggttctcaacctagtggaaaactggttaaacaataatacacaattttgtattaaggtattgaatccctatatgccttcagtaatagagaaaatggagacattacaaaggaaatacggaggtgctttagtaaggaaccccctctccaggaactcaacacatgaaatgtactgggttagtaacgcaactggcaatatagtatcctcagttaacatgataagccgaatgttaatcaataggttcacgatgaaacataagaaagccacatacgagcccgacgtagacctgggaagcggaacgcgaaacatcggaatcgaatccgaaatcccaaatttagacatcattggaaagaggatagagaaaataaaacaagaacatgaaacaagttggcattatgaccaggatcacccatacaagacatgggcttatcacggttcttacgagactaaacaaacaggctcagcgtcgagcatggttaatggagttgtgagattactgacaaaaccttgggacgtagtacctatggtcactcaaatggctatgaccgacaccacaccattcggtcaacagcgcgtatttaaagagaaagttgatacaaggactcaagaacctaaagaaggtaccaagaaactaatgaaaatcacagccgaatggttatggaaggaacttggcaagaagaaaacacccaggatgtgtacaagagaagaatttacacgtaaagtcagaagcaatgcagctctcggcgcaatttttactgacgagaataagtggaaaagtgcacgtgaagcagtagaagattcccgtttctgggaactaatagaccgtgaacgtaatctccatctggaaggaaagtgtgaaacttgtgtttataacatgatgggtaagcgagaaaagaaactaggcgagttcggtaaagcaaaaggatctcgcgcaatatggtatatgtggctcggagcaagatttcttgaatttgaagcattaggcttcctcaatgaggatcattggttcagccgaggaaattcactttctggagttgaaggtgaaggtctacatagactgggatatattctgagagatgtgtccaagaaagaaggaggggctatgtacgctgacgacacagccggatgggatacgaggatcaccctagaggacctcaaaaatgaagaaatggtcacaaatcatatgaaaggtgaacataagaaacttgcagaggcaattttcaaactgacctatcaaaataaagtggtcagagtgcaaagaccgacaccgagaggaaccgttatggatattatttctagaagagaccagagaggatcaggtcaggtaggaacatacggcctcaataccttcacaaatatggaagctcagttaatacgacaaatggaaggggaaggtatttttaaatcaatccagcacctaaccgtcacagaagagatagctgtacaaaactggcttgcgagagtaggacgagaaaggttaagccgcatggctattagtggagatgattgcgtggtcaaaccgctagacgatcggtttgctagtgcattgaccgcacttaatgatatgggcaaggttcgcaaggacatccaacaatgggaacccagtcggggatggaacgattggacacaagttcctttttgtagtcatcattttcatgagttggtgatgaaggatggaagggttctagtagtcccgtgtagaaaccaagacgaattaatcggccgagcgagaatatcacaaggtgcgggctggtctttaaaagaaacagcttgtttagggaaatcttatgcgcagatgtggacattaatgtattttcatcgaagggatttaagattggcggccaatgctatatgttcggcagtacctagccactgggtaccaacgtcaagaaccacgtggtccatacatgccaaacacgagtggatgacaactgaagatatgttggcagtatggaatagggtatggatccaagagaatccctggatggaggataagacccctgtagaaagctgggaagaggtaccatacctaggaaagcgtgaagatcaatggtgcggatctttaataggattaactagcagagctacatgggcgaagaacatacaaacagcgataaatcaagtgaaatctcttataggtaacgaagaatatacggactatatgccgtctatgaagcgcttccgaagagaagaggaagaagctggagtactatggtga

SEQ ID NO: 22636 - RNA, 9876 nt, synthetic construct
  misc_feature 1..9876: note = derived and/or modified CDS sequence (opt6) from DENV-2__EU482746__SS-prME
  source 1..9876: mol_type = other RNA
acggcaggagttattattatgttaataccgacggctatggcttttcatttaactacccgaaatggggaaccacatatgatagtcggacgacaggagaaaggaaaaagtctactattcaaaactgaagatggagtaaatatgtgcactctgatggcaatagacttaggagagttatgcgaagatactattacatacaaatgcccactgctaagacaaaatgaaccggaagatatagattgctggtgcaatagtacgagcacatgggtcacatacggaacatgcacgactacgggagaacatcgtcgggagaaaagatcggtggccctagtgccgcatgttggaatgggcctagaaactagaacagaaacatggatgtcctcggagggagcatggaaacatgttcagagaattgaaacatggattctacgacatccaggatttactataatggctgctatactagcttataccataggaactacccacttccaacgcgcacttatattcatactactcacagctgtcgcaccgtcaatgacgatgagatgcataggtataagtaaccgcgatttcgttgaaggcgtaagcggcggcagttgggtagacatagtactagaacatggttcatgcgtaacaacaatggctaaaaataaaccaacgctcgactttgaactgataaaaactgaggcaaaacaaccggcaactctgagaaaatactgtattgaggcaaaactcacaaacaccactaccgaatcacgatgcccaacgcagggggaaccgtcattaaacgaagaacaagataaaagatttgtctgcaaacactcaatggtagacagagggtggggcaacggatgcggactatttggaaaaggagggatagttacctgcgcgatgtttacgtgtaagaaaaatatggaaggaaaagtcgttctgccggaaaatttagaatatactatagtaattacgccacacagcggggaggaacatgccgtaggcaatgatacgggaaaacatggtaaagaaatcaaaattaccccacaatctagtattactgaggctgaattaacaggatatggaactgtgactatggaatgtagtccccgaacaggcttggactttaacgaaatggtattactacaaatggaggacaaggcttggttagtacaccgacaatggtttttagaccttccattgccctggcttccaggagcggacacgcaaggctccaactggatacaaaaagaaacccttgtcacatttaaaaacccgcatgccaagaaacaagatgtagtggtcctggggtcacaggaaggtgcaatgcacacagcgttaacgggagctactgagatacaaatgagtagcgggaatctattattcaccggtcatctgaaatgtcgtttaagaatggataaactacaactgaaaggaatgtcgtattctatgtgcacaggtaaatttaaaatagtaaaagagatcgcggagacacaacacggtaccattgtaataagagtccaatacgagggggacggttcaccctgtaaaataccttttgaaataatggacctagagaaaaggcatgtgcttggaagattaatcaccgtgaaccccatagtaacggagaaagactcacctgttaatatcgaagcggagcctccattcggggacagttacataataataggagtggaaccaggacaacttaaattaaattggtttaagaaaggatcatcaattgggcaaatgttcgaaacgaccatgaggggagcaaaaagaatggcaatcctgggagatactgcgtgggatttcgggtccttaggtggagtatttaccagtataggaaaagccttacatcaggtcttcggtgccatttacggagcagctttttctggggtttcgtggacaatgaaaatattaataggtgtgattattacgtggattggcatgaatagtaggagtacgagtctcagtgtttctctagtccttgtaggggtcgtcacactatatctaggcgctatggtgcaagcagactcaggttgtgttgtgagttggaaaagcaaagaactaaaatgtgggagtggaatatttattacggacaacgtccatacgtggaccgagcaatataagttccagccagaaagcccctccaaactcgcttctgcgattcaaaaggcacacgaagaaggaatatgcggaatacgaagcgtaaccaggttagagaatcttatgtggaagcagataacccccgaactaaatcatatattatcagaaaacgaagttaaactcactataatgacaggtgatatcaaaggaattatgcaagcaggcaagagaagtttacgtccacaaccgacagaattaaaatattcatggaagacatggggcaaagcgaaaatgctgagtactgaatcgcataacagaacctttttgattgacggaccggaaacagcggagtgcccaaatacaaatagagcatggaatagcctagaggttgaagactacggatttggtgtattcactaccaatatatggcttaagttaagagaaaaacaggatgttttctgtgattccaaattgatgagtgctgcaattaaagacaatcgggcagtgcacgccgatatgggctattggatagagtctgccctgaatgacacatggaagatggagaaagccagtttcattgaagtaaaatcatgtcattggcctaagtcacacactctatggtcaaatggtgtcctagagtcagaaatgattatacccaaaaatttcgcaggtcccgtgtctcaacataattaccggcctgggtaccatacacaaacagcgggtccatggcatttgggaaaactcgaaatggatttcgatttctgcgaaggaactactgttgtcgtgacagaggattgtggaaatcgtgggccaagtttgcgtactactacagcatccggaaaattaataactgaatggtgttgcagaagctgtaccttaccacccctccgttatcgtggtgaggatggatgctggtacggtatggaaatacgcccactgaaggaaaaagaagaaaatttagtaaactcgttagtgaccgcgggtcatggccagatagataacttcagtctaggagtgctaggcatggctcttttcctggaagaaatgttaagaacccgtgtaggtaccaaacatgcaatcttgttagtggccgtatctttcgttactctaataaccggaaatatgagttttagagatctaggccgagtaatggtaatggtcggagccacgatgacggatgatattggaatgggcgtcacataccttgctcttttggcggcatttaaagtaagacccacgttcgccgctggattgctcttaagaaaattgacgtcaaaggaactgatgatggcaaccatcggtatcgcattgcttagtcaatcaacaattccagaaacaatactagagctaacggacgcactggctctaggcatgatggtacttaaaatagtgagaaacatggaaaaatatcaactagccgtcacaattatggcgatatcgtgtgttccaaatgccgtaatattacagaacgcatggaaagtaagttgcaccattctcgcagccgtttcggtaagcccccttctacttacaagctctcaacagaaagcagactggataccattggcactgacaataaaaggactcaatccaactgctatatttttaaccacattaagccggacgagtaaaaagagaagttggcctttaaacgaagcaatcatggcagtcggtatggtttccattcttgcaagctcgctattaaagaatgatataccgatgaccggacctctcgtcgcaggaggtttacttacggtatgctatgttttaacaggcagatcggcagatttagagttagaacgagcagccgatgtaaaatgggaagatcaagcggaaatatcaggtagcagtccaattctatcgataacaataagcgaagacggatccatgtcaatcaaaaacgaagaagaggaacagaccctgacaatactaatacgaactggcttgttggtcataagtggtgttttcccagtgtcaattcctataactgcagccgcatggtacctatgggaggtcaagaaacagcgagccggtgtgttatgggatgtaccgtcccctccaccagttggaaaagcagaattagaagatggagcataccgaattaaacagcggggcattctaggttatagccaaattggcgccggagtttacaaagaaggaaccttccatactatgtggcatgtaacgcgaggggctgtcctcatgcacagaggaaaacggattgaaccatcttgggcagatgtaaagaaagacctaattagttacggcggcggctggaaattggaaggtgaatggaaagaaggagaagaagtacaggtattagcgttggaacctgggaaaaatcctcgagctgtacagacaaaacccggattgtttaagaccaacaccggcacaattggcgcagtatcgttggatttcagtccgggcaccagcgggtccccaatcgttgatcgaaaaggaaaagtagtcggattatatggaaacggagtagtcaccaggagtggtgcctatgtaagtgctattgcccaaacagagaaatcaatagaggacaatcccgaaatcgaagatgatatttttagaaagaaacgactaacaattatggacctacatccaggagcaggtaagacaaaaaggtatttaccagcgatagtacgggaggcaataaaacgaggactaagaacactaatcttagctccaactagggtagtagcagcagaaatggaagaagcgttaaggggactaccgataagatatcagacaccggctattagagccgagcacacgggaagagaaatagttgaccttatgtgtcatgcaactttcacaatgcgacttctctcaccagtacgggtacccaattataatttaattataatggacgaagcgcactttaccgatccagcttcgattgctgcacgggggtacatatcaacgagagttgagatgggtgaagcagcaggtatattcatgaccgcaacccctccaggtagcagagacccattcccccaatcaaacgcgcccataatggatgaagaaagagaaattccggaacgttcttggaactcaggccatgagtgggtaaccgactttaaaggaaagacagtttggtttgtaccatcaattaaagccggcaatgacattgccgcttgcctgagaaagaacggcaagaaagttatccagttatcaagaaaaacattcgatagcgagtatgtgaaaacacgagccaatgactgggactttgtagtaacaacagatatatcagaaatgggagcaaacttcaaagctgagagagtgatagatccaagacgatgcatgaaacccgttattctcactgacggagaggaacgagtgattctcgccgggccaatgcctgtaacacattcatctgctgcacaaagacgaggaagaattggcaggaaccccaaaaatgaaaacgatcaatatatatacatgggcgagcccttagaaaacgatgaagactgcgcgcattggaaggaagccaaaatgttattagacaatattaatacaccagaaggcataataccatctatgtttgaacccgagagagagaaagttgacgcaatagacggtgaatatagattacgaggggaggcacgcaaaacatttgtggatctgatgagacgaggagacctgccggtttggttagcatatagagtggcagccgaagggatcaactatgcagaccgacgatggtgctttgatggcatcaaaaataaccaaatacttgaagaaaatgtggaagtggaaatatggacaaaagaaggcgaacgaaagaaattgaaaccacggtggttagacgcacgtatctatagtgatcccttagcactgaaagaatttaaagaatttgcagctggacgcaaatcgttaacgcttaatttgataactgaaatgggtcgtttgccgacctttatgacacaaaaagctcgggatgccctagataatttagcggtgttgcatactgctgaggcagggggccgcgcctataatcatgcgttatcagagcttcccgaaacacttgaaactctattgctactaactttgctcgcaacagtcaccggaggaatcttcctatttttaatgtctggaaagggaatcggaaagatgacacttggaatgtgttgtatcataacagcatcaatattgctatggtacgcacaaatacaaccccattggatcgccgcgtcaatcattcttgaatttttcttaatagtgctattaatacccgaacctgaaaaacaacgcacgcctcaggataatcagcttacatacgtggttatagctattttgactgtagtagcagcaacaatggctaacgaaatgggcttcctcgaaaagaccaaaaaggatctaggattggggtctatcacgacgcaggaatcagagagcaatatactagacatagacctaaggcctgcaagtgcttggacgctttatgccgtagctacaacttttgtaacaccaatgttacgtcatagcatagaaaatagtagtgtaaacgtcagtttgacagcgatcgcgaatcaagcaacggttttaatgggacttggaaaagggtggcccctgtcaaaaatggacataggtgtaccactgcttgcaatagggtgttatagccaggtaaacccaataaccttaacggccgcattgcttctacttgtagcacattacgcgatcattggtcctggactacaagctaaagcaacaagagaagcacaaaaacgcgctgccgctgggatcatgaaaaacccaacagttgacggaataacagttatagatttggaaccaataccatatgatccgaaattcgaaaaacaattgggacaagtaatgttattaatcctatgcgttacacaagtattaatgatgcgtacaacatgggcattgtgtgaagctctaacccttgcgacaggtcccataagtactctgtgggaaggaaatccgggccgattttggaatactacgatagccgttagtatggctaatatattcagaggtagctatctggcaggggcaggactattattttccattatgaaaaacactactaatacaagaagagggacaggcaacataggagagaccctcggcgaaaaatggaaaagtcgcttaaacgcattgggaaagagtgagtttcaaatatataagaaaagtggcattcaagaagtagaccggactttggccaaggagggtattaagagaggcgaaacagaccatcacgccgttagcagaggatccgccaaattgagatggtttgtagaacgaaacatggtaacacctgaaggcaaggtagtcgatctaggctgcgggcgcggtggctggagctactattgcggaggactcaaaaacgttagagaagtaaagggactaacaaaaggaggaccgggacatgaggaaccaatacctatgagtacatatggatggaatttggtaagattacaatctggtgtcgatgtattctttactccgccggagaaatgtgatactttactgtgcgacattggcgaatcaagtccaaaccctacaatagaagcaggacgtacactacgagtactaaatttagtggagaactggttaaataataatacacaattctgtatcaaggttctaaatccatatatgccgtcagtcattgagaaaatggaaaccctacaacgcaaatatggcggggcattggttcgcaatccgctatcacgaaacagtacccatgagatgtactgggtaagtaatgctacgggtaatatagtttcctcggtaaatatgatctcacgtatgctgattaatcgatttaccatgaaacataagaaagcaacctatgaacctgatgtggatttggggtctggaacaagaaatatcggaatagaatccgaaatacctaacctggacataataggaaaaagaatagagaaaattaagcaagaacatgagacctcctggcattacgaccaggatcacccttataaaacatgggcatatcatggatcgtacgagaccaaacaaactggatccgcaagtagtatggtcaatggagttgtgagactcctaaccaaaccctgggatgtcgttccaatggtgactcaaatggcgatgacagataccactccatttggccaacaacgtgtatttaaggaaaaagttgatacgagaacgcaagagccaaaagaaggaacaaagaaactcatgaaaataacagcagaatggttatggaaagaattagggaagaaaaagactcctcgtatgtgtacacgtgaagaatttaccagaaaagtgcgctcaaatgctgcacttggagcaatatttacagatgagaataagtggaaatcagcacgagaagctgttgaagattctagattttgggagctaatagacagagagcgtaacctgcatcttgagggtaaatgtgaaacatgcgtatacaacatgatggggaaaagagagaagaaactcggcgagttcggaaaggctaaagggagccgagcaatttggtatatgtggttgggtgcacgtttcctagagtttgaagccttaggatttcttaatgaagaccattggttttcacgtggcaactcattatctggtgtagagggcgaaggcctacataggctaggctacattttgagggacgtcagcaagaaagagggaggagctatgtacgctgacgatacggcaggttgggatacacgtataacattggaggacttaaagaatgaagaaatggtcacaaatcacatgaaaggagaacacaagaaactagccgaggccattttcaaattaacataccagaataaagttgtaagagttcagaggccaacgccccggggtacagtgatggacataataagccgtcgtgatcaaaggggatccgggcaagtggggacatatggattgaatacattcacaaatatggaagcccaactaattagacaaatggaaggtgaaggaattttcaaatctatacaacatcttacggtaacggaagaaattgctgtacaaaactggttagctagagtcggaagagaaagattaagtagaatggccatatcaggtgacgattgtgtggtaaaaccactagacgataggtttgctagtgctcttacggctctaaacgatatgggaaaagtcaggaaagatatacaacaatgggaaccatcaaggggatggaatgactggacacaagtgcccttttgttcacatcatttccatgagctggtaatgaaggacggcagggttttagtagtaccatgtcgaaatcaagatgaactgattggccgtgcgcgtataagtcagggggcaggatggagtctcaaagaaaccgcgtgtctgggtaaatcctacgctcaaatgtggactctcatgtatttccatcgacgcgatctaagactagctgcaaatgcgatatgtagtgcagtaccaagtcattgggtgccgacaagtcgcacaacttggagtatccatgctaagcatgagtggatgacaacagaggacatgttagcggtatggaatagggtctggattcaggaaaacccgtggatggaagataaaactccagtagaatcctgggaagaggtaccatatcttggaaaacgtgaagaccaatggtgcggcagcttgataggtctgacaagtagggcaacatgggccaaaaacatccaaacagcaattaatcaggttaggagcttaattgggaatgaagaatacaccgattacatgccctcaatgaaaagattcagaagagaagaagaagaagcgggagtattatggtaa

SEQ ID NO: 22637 - RNA, 9876 nt, synthetic construct
  misc_feature 1..9876: note = derived and/or modified CDS sequence (opt6) from DENV-2__EU482590__SS-prME
  source 1..9876: mol_type = other RNA
actgctggagtaattatcatgttgataccaactgcaatggcatttcatcttacaacaaggaacggtgaaccccacatgattgttgggaggcaggaaaaagggaagagtttattatttaagactgaagatggcgttaatatgtgcactttaatggcgattgatctaggtgagctctgcgaagacacgataacttataaatgtcctctgttgagacaaaacgaacctgaggacatagattgttggtgcaattccacttcaacctgggtcacttatggtacctgtacaaccacgggagagcacagacgagaaaaaaggagcgtagcattagtacctcatgttggtatgggattagagactagaacagaaacttggatgtcaagcgaaggagcttggaagcatgtacagcgaattgaaacgtggattttgcgacaccctggcttcacgatcatggcggctatattagcgtacacaataggcacgacccactttcagagggcattaatcttcattttgttaacggcagtggcaccatcaatgacgatgcgttgcattggcatttctaatcgtgattttgttgaaggcgttagtggtggaagctgggtagatatagtactagaacatggcagctgtgtaacaacgatggctaaaaataagccgactctagacttcgaactaatcaagactgaagctaaacaacccgcaacattacgcaaatattgcatagaagcaaagttaaccaatactacaaccgaatcaagatgccctacacaaggtgagccatctcttaatgaagagcaggacaaaagatttgtctgcaaacactcaatggttgacagaggctggggcaacgggtgtggactattcgggaagggcgggattgtcacatgtgcgatgttcacgtgtaaaaaaaatatggaagggaaagtggtattaccagaaaatctagaatacactatagtaattactccgcattccggcgaggagcatgcagtagggaatgacacaggaaagcatggaaaagagataaaaataactccacagtcctctataacagaggccgaactcactggttatgggacagtaacaatggaatgttcacctagaactggacttgactttaatgagatggtactattacagatggaagataaagcatggcttgtacatcgtcagtggtttcttgatttacctctgccttggttacctggtgccgacacacagggaagtaattggatacaaaaggaaacacttgttactttcaagaacccacatgcaaaaaagcaagatgtagtcgtcttaggatcacaagaaggagcaatgcacactgcattgactggagcaactgaaattcaaatgagctcaggcaaccttctctttacaggacatttaaaatgtcgcttaagaatggataaattacaacttaaaggcatgtcatatagtatgtgtaccggaaaatttaaaattgttaaagaaattgcagaaacgcaacatggaaccatagtaatcagggtgcaatatgaaggagacggaagtccgtgtaaaattccttttgagattatggacctggaaaaaaggcatgttttaggtcgtctaataacagtaaatcctattgttacagaaaaagattcacctgtaaacattgaagcggaacctccgtttggagattcttacattattataggagtagaaccaggtcaactcaaactaaattggttcaaaaaagggtcatcaataggacaaatgtttgaaacaacaatgcgcggtgctaagagaatggcagtcctgggtgacacagcctgggacttcggcagccttggcggcgtatttacttcaataggtaaagcattgcaccaagtattcggagcgatatatggagcggctttcagtggcgtctcttggactatgaaaattttaataggagtaataataacctggataggtatgaattcaaggagtacaagtctttcagtgtcactagtcctagttggagttgtgacgttatacttgggtgccatggttcaagctgattcaggatgcgttgtaagttggaaaaacaaagaactcaaatgcggatcagggatatttattactgataacgtccatacttggacagaacaatataagttccaacccgaatcgccgtctaaactggcaagtgcaatacaaaaagcgcatgaagaaggcatttgcgggatacggtcagttactagattagagaatcttatgtggaagcaaatcaccccagaactaaatcacatattaagcgagaatgaagtaaaattaacaataatgacgggtgacatcaaaggtatcatgcaagcaggaaaaagatctttaagaccacaacctacggagctcaaatattcatggaaaacctggggtaaggctaaaatgttaagcactgagccgcacaatcaaactttcttaatagatggaccagaaacagcggaatgtccaaacacaaatagagcatggaactcgttagaggtcgaagactacgggtttggagtatttacaactaacatatggttaaagttgcgtgagaaacaagatgtattttgcgacagtaaactaatgtctgctgcaataaaggacaatagagctgttcacgcggatatgggctactggatcgaaagtgcgctaaatgacacatggaaaatggagaaggcttcatttatagaagtgaaatcatgtcactggccaaagtcacataccctctggtccaatggtgtcttagaaagtgaaatgataattccgaaaaatttcgcagggccggtgagccaacataactatcgtcctggctaccacacacaaacggccggaccctggcatcttggaaagctagagatggattttgatttctgtgagggaacgacggtggtggtgaccgaggattgcggcaacaggggtccgagtctaagaacaactacagcgagtgggaaactgataactgagtggtgctgcagaagctgcaccttacctccactaaggtatagaggtgaggatggatgttggtatggtatggagatacgaccattgaaagagaaagaggagaacttagtgaacagcctagttacagcagggcatggacaaatcgataatttttctttgggggtacttgggatggcattatttctagaagaaatgctacgtacacgtgtaggaacaaaacatgcaatactattggttgctgtttcatttgtcacattaatcacaggaaacatgagctttagagatttaggacgggtaatggtaatggtaggcgctacaatgacagacgacataggaatgggtgtgacttacctagccctgttagctgctttcaaagttagacctactttcgcagcgggattactcttacgtaagttaacgagtaaggaactaatgatggcaacgattggaatagctctactaagccagtccacaatacctgaaactatactagaattgacagatgcattagcacttggtatgatggtcctaaaaattgttagaaacatggaaaaatatcaattagccgttacaataatggcgatttcttgtgttccgaatgctgttatattacaaaatgcttggaaagtaagctgtactatactagcggcagtatcggtatcaccgctcctgttgaccagtagccaacaaaaagctgattggattccattggcacttactattaagggtttgaatccgacagcaatattcctaacaacactgagtagaacgagcaaaaaacgcagctggcctttgaatgaagcaataatggcagttggaatggttagtatattagcttcgagtttactaaaaaacgacataccgatgactgggccgttagtagctgggggattactaacagtttgttatgtactgacagggagatcggctgatttagaattagagagggcagcagacgtaaaatgggaggatcaagcggaaataagtggctcgtcgcctattctgtccattacgatctccgaagacggaagcatgtcaattaaaaatgaggaggaggaacaaaccctaacaatcttaataagaacagggttgctagtaatatccggcgtatttcccgttagcatacccataacagccgctgcttggtatctctgggaggtgaaaaagcaaagagctggtgttttatgggatgtgccatctccacctccggtaggaaaggcagagttagaggacggtgcctatagaatcaaacaacgtggaatcctaggatatagtcaaatcggagccggcgtatataaagaagggactttccatacgatgtggcatgtcactagaggtgctgtactaatgcatagagggaaaagaatcgaaccaagttgggcagatgttaaaaaggacctgatttcctacggaggaggttggaagctagaaggtgaatggaaagaaggcgaagaagtccaagtcttggctctcgagccggggaaaaatccgcgtgcagtacaaacgaaacccggattgttcaaaacaaatactggcacaataggtgcggtgagtctcgatttctcgccagggacgagtggatccccgattgttgatagaaaaggtaaagttgtaggcctatatggtaatggtgtcgttacacgtagtggagcatacgtatcagccattgcacaaacagaaaagagcatagaggataatcccgaaatcgaggatgatatatttagaaaaaaacgacttactattatggatttacaccccggtgccgggaaaactaaaaggtacctgccggctatagttcgagaagctattaagagaggactgcgaacactcatattagcccctactcgtgttgttgcagctgaaatggaagaagctctcaggggactgcccatacgatatcagactcctgccatcagggcagaacatacaggccgggagatagtagatttgatgtgtcacgctactttcactatgagattattgagtccggtgagagtacctaactacaacttaattataatggatgaagcgcacttcaccgaccctgcttcaatagcggctaggggatatatatctacaagggtagaaatgggcgaggcagctgggatattcatgaccgccacgccaccaggatcgagagatccatttccgcaaagtaatgcgccgatattagatgaagagagggagattccggaacgatcatggaacagtggtcatgaatgggtaactgacttcaaagggaaaacagtatggttcgtgcctagtataaaagccggaaatgacatagcagcttgtctcaggaaaaatggtaaaaaagttatacagttatcaagaaaaacatttgacagtgaatacgtaaaaacaagagccaatgactgggacttcgtagtaacaactgacatatcagaaatgggtgcgaatttcaaagcagaaagagttatagacccaagaagatgtatgaagccagtaatactaacagatggtgaagaaagagttatattggcaggacccatgccggttacacactcaagcgccgcccaaagaagaggaagaatcggcagaaatcctaagaatgaaaacgaccaatatatatatatgggggaaccattagaaaacgatgaagattgtgctcactggaaagaagcgaaaatgctactagacaatattaataccccggagggtattataccaagtatgttcgagcctgaacgggaaaaagtagacgctatcgacggggaatatcgtttaagaggcgaagcgaggaagacgtttgtagatttaatgagaaggggcgatttacctgtttggcttgcttacagagtcgccgctgaaggaataaactatgcggacagacggtggtgttttgacggaatcaaaaataaccaaatcctagaagaaaacgttgaggtagaaatctggactaaagaaggagaacgtaaaaaactaaaaccgcgttggttagatgcaagaatttattcagatccgcttgcattaaaagaatttaaagagtttgccgctggcagaaaatcattaacccttaatttaatcacagaaatgggcaggttaccaacatttatgacacaaaaagcaagagatgcactcgataacttagctgtattacacaccgcggaagttggcggtcgcgcttataatcatgcactaagtgaattacctgaaaccctagaaacgcttcttctattaacacttttagccacagttaccggtggaatattcctcttccttatgagcggcaaaggaattgggaaaatgactttaggaatgtgctgtataattacggcgagtattctgttatggtacgcgcagattcaacctcactggattgcagcatcaataatactagaattcttcttaattgttcttttgattccggaaccggaaaaacaaaggactccacaagacaaccagttaacatatgtagttatcgcaatattgaccgtcgtggcagcaactatggctaatgaaatggggttcttagaaaagaccaaaaaagaccttggtttaggaagcatcacaacacaagaaagcgaatcaaacatactcgatattgatttaagaccagcgtcagcttggaccttatacgcagtggcaacaacatttgtcactcccatgttaagacacagtatagaaaattcaagcgtgaatatttctttaacagccattgcgaaccaagcaaccgtgctgatgggactaggaaaaggatggcccttatccaaaatggacattggtgtacctttgctagcaataggttgttactcacaggtaaatcccataacactgaccgccgctctgttacttcttgttgctcattacgcaataattggaccaggattacaagcaaaagcgacccgtgaagcacaaaaacgagccgctgccgggataatgaaaaacccgacggtagacgggataaccgtcattgacctagaaccaattccatacgacccaaagtttgaaaaacaactaggacaagtaatgctactcatcttatgcgttacacaggtacttatgatgcgaactacatgggcactttgcgaggccctgaccttagcaacgggacccataagcaccctatgggagggcaatcccggcagattctggaatacaaccatagctgtctcaatggcaaatatatttaggggatcgtatcttgctggtgctggtctccttttttctattatgaagaatacaactaacacacgaagaggcactgggaatataggagaaacattaggggaaaagtggaagtccagattaaacgcattaggaaaaagtgaatttcagatatacaagaaatctggaattcaagaagtcgacagaacactggcaaaggagggaattaaacgtggagaaactgaccatcatgcagtgagtagagggagtgcaaaactccgatggttcgtggaacgcaatatggtgacaccagaaggtaaagttgttgacctcggatgtggccgcggaggttggtcgtattattgcggaggcttaaaaaatgttcgagaagttaagggcctgactaaaggaggaccaggccacgaagagcccatacctatgagcacatacggatggaatcttgtgcgactacaaagtggtgtggatgttttcttcacgccaccggaaaaatgtgatacgttgctttgtgatataggcgaatcatcacccaatccaactatcgaagcagggcgaacgttgagggtactgaatctggtagaaaactggttaaacaacaatactcaattctgcataaaggtcttaaatccttacatgccttcagtaatcgagaaaatggaaactttacaaagaaaatatggaggtgcactggtacggaatccactttcaagaaatagtactcatgagatgtactgggtctccaatgctacgggaaacattgtttcctctgtaaatatgatttcgcgaatgttaataaatagatttacgatgaaacataaaaaagccacctacgagccggatgtcgatcttggtagcggaactcgcaacataggaatcgagtcagaaataccgaatttagacattattggcaagagaattgagaaaattaaacaagagcatgaaacatcgtggcactatgatcaagaccacccatataagacttgggcctaccatggtagctatgagacaaaacaaaccggaagcgcctcttcgatggtaaatggggtagtgcgactactaacaaagccatgggacgtagtccccatggtgacccaaatggcgatgacagacactactccatttggacaacaaagagtatttaaggaaaaagtcgacaccaggacacaagaaccgaaagagggcactaagaagcttatgaagattacagcagaatggttgtggaaagagcttggcaaaaaaaaaacacctcgaatgtgtacgagagaagaattcacacgcaaagtcaggagcaatgccgcactcggagcaattttcactgatgaaaacaagtggaaaagtgcgagggaggcagtagaagacagtaggttttgggagttgattgatagagaacgcaatctgcacttagagggtaaatgtgagacatgcgtctataatatgatgggaaaacgggaaaaaaaactaggggaatttggaaaagcaaaaggcagtcgggcaatatggtacatgtggttaggggctagattcttagaatttgaggcacttggctttctaaatgaagatcactggttcagtagagggaactccttaagtggtgtagagggcgaaggtttacatagattagggtacatactacgcgatgttagcaaaaaagaggggggagcaatgtatgcagatgatacggcaggatgggacacacgaatcacattagaggatttgaaaaatgaagaaatggttaccaatcatatgaaaggcgaacataaaaagctagctgaagcaatatttaaactaacctaccagaataaggtggtacgggttcaaagacctacgcctagaggaacagttatggacattattagtagaagagaccaacgtggctcaggacaggttggaacctatggtctgaacacctttacaaacatggaagcacaacttataagacagatggaaggtgaaggaatttttaagtcaatacaacatctaacggttaccgaagaaattgcggtacagaactggcttgcccgagtaggaagagaacgcctgtcaagaatggccataagtggcgatgactgtgtagtgaaacctttagatgatagattcgcctcagcattgactgccttaaatgacatgggcaaagttcgcaaagacattcaacaatgggaacccagccgaggctggaacgactggacccaagtaccgttttgttcacatcactttcacgaactggtaatgaaagatggacgggttcttgtagtaccctgtcgcaatcaggacgaattaatcggtagagcaagaatatcgcagggagcagggtggtctctcaaagagacagcatgcctaggaaaatcatatgcccagatgtggacgttaatgtattttcaccgaagagaccttagactagcagccaatgctatatgcagcgctgtgccttcacattgggttccaacatcgaggacaacatggtcaatacacgcgaaacatgaatggatgacgacggaggatatgttagccgtctggaatcgcgtgtggatccaagaaaatccctggatggaggacaaaaccccagttgaaagttgggaagaagttccttatttgggtaaacgggaagaccaatggtgtgggagtcttatagggttaacctccagggcgacctgggctaaaaatattcaaacagctataaaccaggtcagatctctgattggtaacgaagaatataccgattatatgccgtctatgaaaagattccgacgtgaggaagaagaagccggggtgttatggtga

SEQ ID NO: 22638 - RNA, 9876 nt, synthetic construct
  misc_feature 1..9876: note = derived and/or modified CDS sequence (opt6) from DENV-2__EU482594__SS-prME
  source 1..9876: mol_type = other RNA
actgctggtgtcataattatgctaatccccacggcaatggcatttcatttaacaacgcgtaacggagaaccccatatgatagttgggcgacaagaaaaagggaaaagtttactttttaaaacagaagatggggtgaacatgtgtactttaatggcgatagatttaggtgagttatgcgaagacactattacttataaatgtccattactaagacaaaatgaaccggaagacattgattgctggtgtaacagtaccagtacatgggttacctacggaacatgcaccacaacaggagagcacagaagagaaaaacgtagtgtagccttagttccacatgtaggtatgggtcttgaaacacgtacggagacatggatgtcaagcgagggagcatggaaacacgtacaacgaatagaaacatggatattgcgtcatcccggtttcactattatggcagcaatactagcttacactataggtaccacccacttccaaagggcattaatatttatactattaacagcagtagcaccatcaatgactatgcgatgtataggaattagcaacagggactttgtagaaggcgtgtctggaggatcctgggtggatatagttttggagcatggtagctgtgtaactacaatggcgaaaaacaaacctactttagacttcgaactgataaaaacggaagcaaaacaacctgcaacattacgaaaatattgcatagaagcaaaattgacaaatacaactaccgaaagtagatgtccaacccaaggggaaccatcccttaatgaggaacaagacaaaaggtttgtatgtaaacacagcatggtagatagaggttggggaaacggctgtgggctgtttggtaaagggggaattgtgacttgtgcaatgtttacttgcaagaaaaatatggaaggcaaagttgtcttaccggagaacctagaatataccatagtaattacacctcattcaggggaggagcatgccgtaggaaacgataccggtaaacatggtaaagagattaaaataacaccacagagcagtatcacagaagctgagttaactggctacggtaccgttacgatggagtgttcaccaagaacaggtttggatttcaatgaaatggtacttctgcaaatggaagacaaagcatggctagtacaccgccaatggttcctagacttaccactgccatggcttcctggagctgatacccaaggatctaactggatacagaaagagaccttagtaacattcaaaaatccccatgccaagaaacaagatgtagtggtcctcggttcacaagaaggagcgatgcatacagctttaacaggagctacagagattcaaatgtctagtggaaacttattatttacaggacacctaaaatgccgcctcaggatggacaaattacagctgaaaggaatgagctattcaatgtgtacgggtaaattcaaaattgtgaaagaaattgcagaaacgcaacacggaactatagtaataagagtccaatacgaaggcgacggctctccatgtaaaattccgttcgaaataatggaccttgagaaacgacacgtgttgggtagactcataacagtcaaccccatagttgctgagaaagactcgccggtaaatatagaagctgaacctccatttggagattcatacataatcataggcgttgaaccggggcaactaaaattaaattggtttaagaaagggtcaagtattggccaaatgtttgagacgaccatgcgtggtgcaaagcgaatggccatactaggagatacggcatgggattttggctcattaggtggtgtcttcacctcaattggaaaagcacttcaccaagtttttggagctatttatggcgccgctttttcaggcgtcagctggactatgaaaatattgattggtgttattattacatggattggtatgaactccaggtcaacatcgcttagtgtaagtctggtcttggttggagttgtgacattataccttggtgcaatggtacaagccgattcaggatgcgtggtttcatggaaatctaaggaattgaaatgtgggagcggaatattcattacagataatgtacacacctggaccgaacaatataaattccaaccagaatcaccctctaaactggcttcggcaatacaaaaagcacacgaagaaggtatatgtggtattagaagcgtaacaaggttagaaaatctcatgtggaaacagataacgccagaacttaaccatatacttagtgaaaatgaagtaaaattaacaataatgactggggacattaaaggcatcatgcaagcagggaagcggtcattacgacctcagcccactgagcttaaatattcttggaaaacatggggtaaagcaaagatgttatcgaccgaatcacataaccaaacgtttttaattgacggtcctgagacagcagaatgtccgaatacaaatagagcatggaactcattggaggtggaagattatggatttggtgtctttacgactaatatatggctaaagctgagagagaaacaagacgtgttttgcgacagtaaattaatgtcggctgcaatcaaagacaaccgcgcagtccacgcagatatgggttactggatcgaatcagcactaaatgacacatggaagatggagaaggcttcatttatagaggtcaaatcttgccactggccgaaatctcatacattgtggtcgaatggagtattggagagtgaaatgattattcctaaaaatttcgccggtcctgtaagccaacataattacaggccaggatatcacacacaaacagcgggcccttggcacctgggtaaacttgaaatggacttcgatttttgtgagggaacaacagtagtagtcacggaggattgtggcaacaggggacctagtttacgtacgactacagcatcgggaaaactaatcacggaatggtgctgccggagctgcaccctgccaccacttagataccgtggcgaagacggttgttggtacggcatggaaattcgaccgttaaaagaaaaagaagagaacctagtaaactctttagtaacggcaggtcacgggcaaattgataacttttcattaggtgttttgggaatggcattatttttagaagaaatgcttagaacccgtgtaggcactaagcatgcgatattattggtggcggtatcatttgtaacactcataacaggtaatatgagcttccgtgacttgggacgagttatggtcatggtcggggccacaatgacggatgacattggcatgggaataacttatctagctttactagcagcttttaaagtaagaccaacctttgcggccggtctattactaaagaaactcacaagtaaggagcttatgatggctactataggtatagccttgttaagtcaatcaacgattccagaaacgatattagaattgacagacgcactcgcgttagggatgatggtattaaaaatagtaaggaatatggaaaagtaccaactggctgtaaccataatggccattagctgtgttccaaatgctgtaattctacagaacgcttggaaagtatcttgcacgatattggcagcagtgtcagtctcgccgttattattaacgtcttcccaacaaaaggcagattggatacctctagctttaacaataaaagggctgaatcctacggctatcttcttgactaccctatcacgaacaagtaagaaacgaagctggccgttaaatgaggccattatggcggtaggaatggtaagcatattagcctccagtctacttaaaaacgacatacccatgacaggtccactggttgctggtggtcttctcaccgtatgttacgttttaactggaagatcagcagatctcgagttagaacgtgccgcggatgtgaaatgggaggatcaggccgaaatttcgggatcgtcacctatattatcaataacaataagcgaagatggaagtatgagtatcaaaaatgaagaggaagaacaaactctgactatcttaataaggacaggactcctagtaatcagcggagtcttccctgtatcgatacccataaccgcagctgcttggtatttgtgggaagtcaagaaacaaagagccggagtactctgggatgtaccaagtccccctccggtgggaaaagcagaactagaggacggcgcatatcgtataaagcaaagaggaatactaggttattcccaaataggggctggtgtatacaaagaagggacatttcatacaatgtggcatgtcactcgtggagcagtattgatgcataggggaaagcgtatagaaccatcctgggctgatgtcaaaaaggacttaatctcctacggaggcggatggaagttggagggggaatggaaggaaggagaggaagttcaagtcttagctttagaacccggcaaaaatccaagagctgtacaaactaagccaggattatttaaaacaaacacgggaactattggggctgtttctcttgatttttcaccaggtacgagcggcagcccgatagtggataggaaaggaaaagtagtaggactgtacggtaacggagtagtaacacgatccggagcttatgtcagcgctatcgcacaaacagaaaagagtattgaagacaacccagagattgaagacgatatatttaggaagaaaagacttactataatggacttacaccctggagctggaaaaacaaaacgctatctgcccgccatagtgagagaggcaattaaaagaggattgagaacacttatactagcaccaaccagagtcgtagcagctgaaatggaagaggcattaaggggattacctataagatatcagacccctgctatacgagcggaacatactggacgagagatcgtcgatttaatgtgccatgcaacgttcacaatgaggctattatctcccgtgagagtaccaaattataacctaataataatggacgaagcacatttcacggatccggccagcatagcagcacgtggatacatttcaacacgagtggagatgggtgaggcggcaggaattttcatgacagcgacgccgccaggtagtcgggatccttttccacagagcaatgctccaatcatggatgaggaacgggaaatcccagaaagaagctggaactcgggacacgaatgggtaacagattttaaaggcaagaccgtctggttcgtacctagtataaaggcagggaatgatatagcagcgtgccttcgtaaaaacggtaagaaagttattcaattaagtagaaaaaccttcgatagtgaatacgtcaaaacaagagcaaatgactgggatttcgtagtaactacagacatatcagaaatgggtgctaatttcaaggcagaaagagtgatagacccgaggcgatgcatgaaacccgtgattttaacagaaggagaggaaagagttatcttagcagggccaatgccagtcactcattctagtgcagctcaacgtcggggaagaataggacgaaatccaaagaacgaaaatgatcagtacatatacatgggtgaaccattggaaaacgacgaagactgcgcacactggaaagaagcaaagatgctacttgataacataaacaccccagaaggtataatcccgtccatgtttgaaccagagagggaaaaagtcgatgcgatagatggagaatatagacttaggggagaggcgaggaagacctttgtagacttaatgagacgcggcgacctacccgtatggttagcatatagagtagccgctgaaggtatcaactatgcggaccggcgttggtgcttcgatggaatcaaaaataatcaaatattggaagaaaatgtggaagtggaaatatggacgaaagaaggggaaagaaagaaactcaaaccacgttggcttgacgcgagaatatatagcgacccgcttgcccttaaagagttcaaagagttcgcagcaggtagaaaatcactaacactaaacttgataacagagatgggtagattgccaactttcatgactcaaaaagctcgggatgctttagacaacttagcagtactacatacagctgaagcgggagggagagcttacaatcatgccttatccgaactaccggagacattagagactctgctactgctaacgcttctcgcgacagtaacaggaggaatttttctctttttaatgagtgggaaaggtataggaaaaatgacactgggaatgtgctgcattataaccgcgagcatacttctatggtatgcacaaatccaacctcattggatagccgcaagcattatattagaatttttcttgatcgtattactcatccctgaaccagagaaacaaagaacaccacaagacaatcaattaacatatgtagtgattgctatactaacggttgtagccgctactatggcaaacgaaatggggtttcttgaaaagaccaagaaagatttaggattaggatccatcgcaacacaagaaagcgaaagcaatattttggatattgacctcaggcctgcaagcgcatggaccctatacgcggttgctaccactttcgtgacgccaatgctcagacacagcatcgaaaattcaagcgtcaatgtgtctctaactgctatagctaatcaagccactgtccttatgggtcttggaaaggggtggccattatcaaaaatggacattggtgttcctctcctagcaattgggtgttattcacaagtaaatccaatcactctcacggcagcacttctattattagtggctcactatgcaatcatagggccggggttacaagctaaagccaccagggaagcacagaaaagagcagccgctgggatcatgaaaaatcccaccgtagatggaattactgtcatagaccttgaaccaatcccatacgatccaaaatttgaaaagcaactgggacaagttatgttactaatattgtgtgtcacacaagttctaatgatgcgaactacttgggccttatgcgaggctctaactctagcgactggacctatcagtacactatgggagggcaatccgggaagattctggaacacgaccatagcagtttcaatggccaatatttttaggggatcctatcttgcaggagcaggactactcttctccataatgaaaaacaccacaaacacccgccggggtacagggaatatcggagaaacattaggagagaaatggaaatcgcggcttaatgcgctagggaaatctgagttccagatttacaaaaagagtggcatccaagaagtcgaccgaacactagcgaaagagggcattaaacgtggcgaaacagatcaccacgccgtttctcggggaagtgcaaaacttagatggttcgtcgagcgtaatatggtaactcctgaagggaaggtcgtagatctaggctgtggaagagggggatggtcctactattgcggtggactcaaaaatgtgagggaagtaaagggtttgacaaaaggaggaccaggacatgaggagcccatcccaatgagtacatatggttggaatttagttcgcctacaatccggagttgatgttttctttacacctcccgaaaaatgtgacactcttctatgtgatatcggtgagagtagcccgaatcccacaatagaggcgggtcgtaccttgcgagtattaaatttggtagaaaattggctaaacaataatacccaattctgcattaaagtattaaatccatatatgccgagtgttattgagaaaatggaaacactacagcggaaatatggaggtgctcttgttagaaacccactaagtcgtaattcgacgcacgaaatgtactgggtatcgaacgccacaggtaatattgtatcaagcgtaaacatgataagtcgcatgttgataaataggtttacaatgaaacacaaaaaggctacgtatgaaccagatgtagatctgggcagtggaacaaggaatatcggcatcgaatcggaaattccaaatcttgacattatagggaagcgcattgaaaagattaaacaagaacacgaaacatcttggcattacgatcaagatcacccatataaaacatgggcataccacggaagttacgaaacaaaacaaaccgggagtgcaagctcaatggtaaacggcgttgttagacttctaaccaaaccctgggatgtggtccctatggtcacgcaaatggcgatgaccgacacgactccattcggtcagcaaagagtatttaaggagaaagtagacacaaggactcaagagcctaaggaggggactaagaaactaatgaaaataacagcagaatggctctggaaggaactcggcaagaagaaaacaccacgtatgtgtacccgagaagaatttacaaggaaagtgagatctaatgcagctctgggagctatattcacagacgaaaataaatggaaaagtgctcgtgaagctgtagaagactcacgattctgggaactaatcgacagggagagaaacctacatcttgagggaaaatgtgaaacatgtgtatacaatatgatgggaaaaagggagaaaaagctaggagagtttggaaaagctaagggatcaagagcaatatggtacatgtggcttggcgcacggtttttagagtttgaagccttaggatttttaaacgaagaccattggttcagtagaggtaatagtttatcgggagtagaaggagaaggtcttcatagattgggttacattctaagagatgtcagcaagaaagaagggggagcaatgtatgctgatgacacggctggatgggatacacgtatcactctggaagaccttaaaaatgaggaaatggtaacaaatcacatgaagggtgaacacaagaaactagcagaagcaatatttaaactaacctaccaaaataaagtagttcgcgtgcaaaggccaacaccccgtggtacagtcatggatataataagccgaagggaccaacgaggtagtggtcaggtgggtacatacggactaaacaccttcacaaatatggaagctcaactgatacggcagatggagggtgaaggaatctttaaaagcatccagcaccttacggtgaccgaagagattgcagtacagaactggttagcccgcgttgggcgtgaaagattgtctcgaatggctataagtggggatgactgcgtcgtgaaacctttggacgatcgatttgcctctgcactcacagccttaaatgacatgggaaaggtgagaaaagacatacaacaatgggagcccagtcgaggatggaatgattggacacaagtacctttctgttcacaccactttcatgagctagtcatgaaagatggacgagtcctagttgttccctgtaggaaccaggacgaacttatcggtagagcaagaatcagtcagggcgcaggatggtcattaaaagaaaccgcatgcttaggaaaatcctatgcccaaatgtggacgcttatgtatttccacagaagagatttaaggttagctgcaaacgcaatatgcagtgcagtgccgagtcactgggttcctacaagcagaacaacatggtccattcacgcaaaacatgaatggatgactacagaggacatgttagctgtctggaatagggtatggattcaggagaatccctggatggaggacaaaactccagttgaaagttgggaagaagtgccttacttaggcaaaagagaagatcaatggtgtggttctttaatagggctaacaagtcgagcaacatgggctaaaaatatccaaaccgctataaatcaagttaggagcctgataggaaatgaggaatacacagattatatgcccagcatgaaacgattcagacgcgaagaagaagaagcaggagtcctctggtaa

SEQ ID NO: 22639 - RNA, 9876 nt, synthetic construct
  misc_feature 1..9876: note = derived and/or modified CDS sequence (opt6) from DENV-2__EU482604__SS-prME
  source 1..9876: mol_type = other RNA
actgccggagttattataatgttaataccaactgcaatggcttttcatctaactactcgaaacggagaacctcatatgatcgtaggacggcaagaaaaagggaaaagtctgttatttaaaactgaagacggagtaaacatgtgtacactgatggctatagatttaggggagttgtgcgaagatacaataacgtataaatgcccactactaaggcaaaatgaacctgaagatatagattgttggtgtaactcgacttcgacctgggttacctatggtacatgtactacgactggggaacaccggcgggagaaaagaagtgttgctcttgtaccacacgtaggaatgggtctagaaacaagaacggaaacttggatgtcgtctgagggagcttggaaacatgtacagcgcattgagacatggatactgcgtcacccaggattcactataatggctgcgattttggcgtatactataggaacaacacacttccaaagggctctaatttttatactgctgacggcagtagctccatctatgaccatgcggtgcatcggaataagtaatagagatttcgtggaaggggttagcggaggttcgtgggttgatatagttctggaacatggatcctgtgtaacaacaatggctaaaaataaacccacgcttgactttgaattgataaagactgaagcaaaacaaccggcaacattgcgcaaatactgtatcgaagcaaaattaacaaacacaacaactgaaagcagatgcccaactcaaggtgaaccgagcctgaatgaggagcaagataaacgttttatttgcaaacactctatggtagaccgaggatggggaaatggttgtggtttgtttggaaaagggggcatagtaacctgtgcgatgtttacttgtaagaaaaatatggaaggtaaggtagtccaacctgagaatttggaatacaccatagtaataactccacattcaggcgaagaacatgcagtaggtaatgataccggaaaacatggaaaggaaataaagataactccacagtctagcattacagaagctgaattgacaggctacggcacggtaacaatggaatgtagtcctaggactgggctggattttaacgagatggtattattacaaatggaagacaaggcttggctagtacatcgacaatggtttcttgatttacctctaccttggcttccgggtgcagatacgcaaggatctaattggatacagaaagaaacattggtgacatttaagaatccgcatgcaaagaagcaagatgtagtagtactgggatcccaagaaggcgctatgcatacggccctaacaggggctacagaaatacaaatgtcttctggaaatctactatttacgggacatttaaaatgccgtctccgcatggataaattacaattaaaagggatgtcttactctatgtgcaccggtaaatttaaaatagttaaggaaattgcagagacccaacatggtacaattgtgatccggatccagtacgagggagacgggtccccctgcaaaattccatttgagattaccgaccttgagaaaagacacgtactaggacgattgattaccgtcaatccgattgttatagagaaagatagcccagttaatatcgaggcggagcctccgttcggagattcttatatcattataggtgtagaacccgggcaacttaaactaaactggtttaaaaagggttcttcaataggccaaatgttcgaaacaacaatgaggggtgctaaaagaatggcgatcttaggtgatactgcttgggattttggaagtttaggtggagtgtttacaagtatcggaaaagctctccaccaagtgtttggtgccatatatggggctgcattctctggagttagctggacaatgaaaatattaataggagtagtaattacatggataggaatgaatagtcgaagtacaagtttatcagtttctttagtattagtaggggtggtgactctttatctcggtgccatggtccaagcagattccggttgtgtagtatcgtggaaaaataaggaactcaaatgcggaagcggaatttttataacagataacgtgcatacttggacagaacagtacaaattccaacctgaatcgccgtccaaacttgctagcgcgatacaaaaagctcacgaagagggaatatgtggcattcgttcggtcaccagattagaaaatttaatgtggaagcagataacaccggagttgaatcacatactctctgaaaacgaggttaaattaacaataatgacaggtgatacaaaagggataatgcaagctggaaaaagaagtttaagaccacaaccaacagaattaaaatactcatggaagacgtggggaaaagctaaaatgttgtctacagaaagtcataatcaaacgtttctcatagatggtccagaaaccgcggagtgccctaacacaaatcgtgcatggaatagtttggaggtcgaagattatggattcggggtatttacgaccaacatctggttaaaactcagggaaaagcaagacgtattttgcgacagtaaactaatgtctgccgcgattaaggacaaccgagcagtccatgcagatatgggttattggatagaatcggcattgaacgatacgtggaaaatggaaaaagcgagctttatagaagtcaaatcttgccattggcctaaatctcacaccttatggtcaaatggagtattggaatccgaaatgataatcccgaagaatttcgcaggccctgtttcacagcataattatagaccaggataccatactcaaaccgcgggaccgtggcatctcgggaaattagaaatggacttcgatttttgtgaggggacgaccgtggtagtaacagaggattgcggcaatcgaggtccttcgctgagaactaccacagccagtggaaaattgataacagaatggtgctgtaggtcgtgtactcttcctcctttacgctacaggggtgaagacggttgttggtatggcatggaaatcagaccgttaaaagaaaaggaagaaaaccttgtcaacagtttagtaactgcgggacacgggcagatagataattttagcttaggagtattgggaatggccttatttctagaggaaatgcttagaaccagagtaggaacgaagcacgctatactccttgtggcagtttcttttgtaacactaataacaggtaatatgagcttccgtgatctcggccgcgtgatggtgatggttggagctacaatgactgatgatatagggatgggagtgacatatctagccctgctcgccgctttcaaagtgcgaccaacctttgcggcaggactactattacgaaaattaacaagtaaagagttaatgatggcaaccattggcattacgttactttcacaatccacaataccggagacaatattggaattgacagatgccctcgcactagggatgatggttttaaaaatagtccggaatatggaaaagtaccaactagctgtgacgataatggcaatctcatgcgtcccaaacgctgtaatcctacgtaatgcgtggaaagtatcatgtacgatactagctgctgtaagtgtcagtccactacttcttacgtcttcgcaacaaaaggcggactggattcctcttgctctaactattaaaggccttaatcccacagccatttttctaaccaccttatcgaggacaagtaaaaagcgatcgtggcctctgaatgaagcaatcatggcagtcggcatggtatccatattagcgagctccttactcaaaaatgatatacctatgacaggtccccttgtggctggaggtctattaaccgtttgctacgtattaacaggcaggagtgcagacctggagttggagagagccgcagacgtaaaatgggaagatcaggctgaaattagtgggagttcacctatactatcaattacaatctcagaggacgggtcaatgtccataaagaacgaggaggaagaacaaactctaactatcttaatacggacggggttattagtgatatctggagtgtttccagttagtataccaatcactgcagctgcatggtatctatgggaagtcaaaaagcaaagggccggagttctatgggacgtaccatcacccccacctgtgggaaaagccgaattagaagacggcgcttacagaattaagcaaagaggaatcctagggtattcacagataggcgcaggagtatacaaagaaggcacattccatacgatgtggcatgtaacaagaggagcagttctaatgcacaggggcaaacgtatagaacctagttgggcagatgtcaagaaagaccttataagctatggtggcggatggaaactagaaggagaatggaaagaaggtgaagaagttcaggttttagcacttgaaccaggcaaaaatccaagagctgttcaaacaaaaccaggaatatttaaaacaaatactggaacaatcggagcagtatctctagatttttcaccggggacaagtggaagtccaatagtagaccgaaaaggtaaagtcgttgggttatatgggaatggagtcgtaacaagaagcggagcatatgtttctgcaatagcgcaaaccgagaaatcaatagaagacaatcctgaaatagaagatgatatttttcgaaagaaaaggctaacaataatggaccttcatccaggagccggaaaaactaaacgttatcttcccgcaatagttcgagaagcgatcaaaagaggccttaggaccctgatactggcacctacacgtgtagtagccgcggaaatggaagaagctctcagaggactcccaataaggtatcaaaccccagcgataaaagcagaacacacaggtagagaaatcgttgacctgatgtgccatgcaacattcacaatgagattattgtcaccagtgagagtccccaattataacctaataataatggatgaagctcactttactgatcctgcgtcaatagcggcaaggggatatattagtacacgggttgagatgggagaagctgcgggaatatttatgacagcaacaccacctgggagcagagatcctttcccgcaaagtaatgctcctataatggatgaggagcgagagattcctgagaggtcttggaacagcggccatgaatgggtaacagattttaaaggtaaaactgtatggtttgttcctagtataaaagccgggaacgatatagcagcgtgtttaaggaaaaacgggaagaaagtaatacagttatcacgaaaaacttttgacagtgaatacgtcaaaacaagagccaatgactgggattttgtagtaacaacagatatttctgaaatgggagcaaactttaaagcagaaagggtaatagatccaagaagatgcatgaaaccagtcattctcactgacggcgaagaacgggtaatcctagcaggtcctatgcctgttacccacagtagcgcagcacaacgtcgtggccgaataggcagaaatcctaagaatgaaaatgatcaatatatatacatgggcgaacccttagaaaatgacgaggattgtgcacattggaaggaagcaaaaatgttactagacaatatcaacactcctgaaggcataataccttccatgtttgaacctgagagggaaaaggtcgatgccattgatggcgaatatcgattaagaggagaagcgaggaagacttttgtggatttaatgagacgtggagacctaccagtctggttagcttataaagtggcggcggagggtatcaactacgcagatagaaaatggtgcttcgatggaatcaaaaataatcaaatattagaagaaaacgtggaggtagaaatatggacgaaggaaggagaaaggaaaaagttaaaacccaggtggttagatgcaagaatatactcggatccgcttgcgttaaaggagtttaaagaatttgcagcagggagaaaatcattgacactaaatttaattactgaaatgggacgtctaccaacgtttatgactcaaaaggcacgtaatgccttggataatctcgccgtgttacatactgcggaagcaggcgggcgagcttataaccatgccctaagcgaattacccgaaacgctagaaacacttttattgttaacactacttgccaccgtcactgggggaatattcctgtttctcatgtctggaaaaggaataggaaaaatgacgttaggaatgtgctgtatcataactgcatctgttcttttatggtacgcccaaatacaaccgcattggatcgccgcgtctataatattagagttctttttgattgtactacttattccagaaccagaaaaacagcggacaccccaagataaccaacttacatacgtagttattgcaatcttaacagtggttgcggccacaatggctaatgaaatgggtttcttagagaaaactaagaaagatctaggattaggctcgattacaacacaggaaagcgagagtaatatactggatattgatttgaggccggcttcagcatggactctgtatgcagtagcgactacgttcgtcactcccatgctgagacatagtatcgagaactcatcggtgaacgtctcactgaccgccatagccaatcaggcgaccgtattgatgggactcgggaaaggctggcccttaagcaaaatggatattggagtacctcttttagcaataggctgttactcacaagttaatccgataacactaacagccgcactactcttattagtagcgcactatgctatcattggaccaggattgcaagcaaaagctactcgagaggcacaaaaacgtgcagctgcaggtattatgaaaaatccgactgtggatggaattacagtaatcgacttagaaccgataccttacgatcctaaatttgagaaacaattgggccaagtaatgcttctaattctatgtgtgacgcaagttttgatgatgagaaccacttgggccttatgcgaagcccttacattggcgaccggcccgattagcactttatgggaaggaaatccaggacgtttttggaacactactatagctgtctcaatggcaaacatatttcgaggcagctaccttgccggcgcggggttactattttcaataatgaaaaacacgacaaacaccagacgtggtactgggaatataggagaaacactgggagaaaagtggaaaagtcgcctcaatgcacttggaaagagtgagtttcaaatctataagaagtcgggtattcaagaagttgaccggacattagcaaaagaaggcatcaaacgaggagaaacagatcaccatgctgtgtcacgaggaagtgcgaaactcaggtggttcgtagaaagaaatatggtgactccagaaggtaaagtagtcgatctagggtgcggaagagggggatggagctattattgtggaggactgaaaaacgtaagggaagttaaaggcttaacaaaaggaggcccaggacacgaggaaccaataccaatgagtacatatggttggaacctagttagacttcagagtggggtcgacgtatttttcaccccgcccgaaaagtgtgacacactactgtgtgatatcggtgagtcttcgcctaatccaacgatagaggcaggtagaactttaagagtcttgaatcttgttgaaaattggttaaataacaacacgcaattttgcatcaaagtccttaatccgtatatgccctcagttatagaaaagatggaaacgctacaaagaaaatatggtggggcattggtaaggaatccactaagccgtaattcaacccatgaaatgtactgggtctcaaatgctacaggtaatatagtgagttcagtcaacatgatatcacgcatgttgataaatagatttaccatgaaacataagaaagctacttacgagccggacgtggatctaggatcagggacaagaaacataggaatcgaatctgaaatacctaacctagatataatagggaaaagaatcgagaaaataaaacaagaacacgaaacgtcatggcattatgatcaagatcacccatataaaacatgggcgtatcatggttcatacgaaaccaaacaaactggtagcgcgagttcaatggtaaacggcgtggtaaggctacttacaaagccctgggacgtagtccccatggtaacacaaatggccatgacagatacgacgccgtttgggcaacaaagagtctttaaagaaaaagtagatacacgcacacaagaaccaaaggaaggtacgaaaaagctcatgcggataacagcggaatggctgtggaaggagttgggtaagaagaaaacccctaggatgtgcactagggaagaatttacgagaaaagtacgttcaaatgcggctctgggagctatctttacagatgaaaacaaatggaaaagtgcgagagaagcagttgaggatggcagattctgggaactcgtagacaaagaaaggaatttacacctggaaggtaaatgtgagacatgcgtatacaatatgatgggtaagagagagaagaaattaggcgagttcggaaaggcaaaaggaagtagagcgatatggtacatgtggttaggcgcgagatttttagaatttgaagccttaggttttctcaacgaagaccattggttctcccgaggaaatagtctatctggcgttgaaggggaagggttacacagattaggctatatcctaagggacgttggcaagaaagaaggtggtgctatgtatgctgacgatacagcaggctgggatacaagaattacgctagaagacctcaaaaatgaagagatggtaactaatcatatgaagggcgaacacaagaaacttgctgaagcaatattcaagctgacttatcaaaataaggttgtacgagtacaacgaccaactccaagaggtactgtaatggacatcatctcacgtagagatcaaagaggatcaggacaagtaggcacttatggattaaacacgtttacaaatatggaagctcagctaatacgacagatggagggagaaggcatattcaagagcatacaacatttaacagcaaccgaagaaatagcggttcaaaactggttagccagagtaggacgagaaaggcttagtaggatggcgatcagtggagatgactgtgtggtcaaacctatagatgatcgttttgcaagtgcattaactgcgctgaacgatatggggaaagtaagaaaagacatacaacagtgggagccctcacggggttggaacgattggacacaagtaccattctgttcacatcatttccatgaactcgttatgaaagacggccgagtactggtagttccatgtaggaaccaagatgaactaataggtagagctcggatatctcaaggggctggatggagcttaaaagaaaccgcctgccttggtaaatcatacgcccaaatgtggactttgatgtattttcatcgacgtgatttacgccttgcagctaatgccatatgtagtgctgtgccgtcacactgggtaccaacgagtcggacaacatggtcgattcatgctaaacatgagtggatgactacggaagacatgctagcagtatggaacagagtttggatccaagaaaacccttggatggaagacaaaacaccagtagaaagctgggaggaagtcccgtatcttggaaaacgagaagatcaatggtgcggaagtttaataggattaacaagccgagcgacttgggcaaagaatatacaaactgcaataaatcaagtaagatccctaattgggaatgaggaatatacagattatatgccctcaatgaagcgatttagaagagaagaggaagaagccggtgtgttatggtaa

SEQ ID NO: 22640 - RNA, 9876 nt, synthetic construct
  misc_feature 1..9876: note = derived and/or modified CDS sequence (opt6) from DENV-2__EU482605__SS-prME
  source 1..9876: mol_type = other RNA
acagcaggagtcataataatgctaatcccaacggcaatggcatttcacctaacgactagaaatggagaacctcatatgatcgtcggtagacaggaaaaagggaaatcgcttttattcaaaacagaagatggagttaatatgtgcactcttatggcaatcgacttaggtgaattatgtgaagatacaatcacatacaaatgtccattgttaagacaaaatgaacctgaagacattgactgttggtgtaatagcacatcaacttgggtgacttacggaacatgtacaactacaggagaacatcgaagagaaaaacgaagtgtcgcgctagtaccgcacgtaggaatggggctagaaacgagaaccgaaacatggatgagttcagaaggagcatggaaacacgtacaacgaatagaaacatggatcttgcggcacccagggtttaccataatggcagcaatacttgcatacacaatagggacaacacatttccaaagagcacttatattcatattacttacagcagttgcaccttcaatgaccatgcggtgcattgggataagtaatcgggattttgttgaaggtgtcagcggaggttcatgggtagatatagtattagaacacggttcttgtgtgacaactatggccaaaaataaaccaacgctagattttgaattaataaaaaccgaagcgaaacaaccagctacacttaggaaatactgtattgaagcgaaactgacaaatactacaaccgaatctaggtgcccaacccaaggggaaccatccctaaatgaagaacaagataaacgttttatatgcaaacactcgatggttgacagggggtggggaaatgggtgcggacttttcggaaaaggaggtatcgtaacttgtgctatgtttacatgtaagaaaaatatggagggaaaagtcgttcaacctgaaaatctggagtatacgatagttattacccctcacagtggagaagaacatgcagttggaaacgataccgggaaacacggcaaagaaattaaaataactccgcaatcctcgatcacagaagctgagctgacagggtatggtacagtaactatggagtgttcacccagaacaggcttagacttcaacgaaatggttctactacaaatggaagacaaagcatggttagttcacaggcagtggttcctagatcttcctttaccttggctaccaggggccgacacacaagggtccaattggatacaaaaggaaaccctagtaacttttaaaaatccacatgcaaagaaacaagatgtagtagtgttgggatctcaagaaggagcaatgcacacagctctaacgggcgcaacggaaatacaaatgtcatcgggtaatcttttagtgacaggtcatcttaaatgcagacttcgtatggataaacttcaattaaaaggtatgagctatagtatgtgtacggggaagtttaaaattgtcaaggaaatagcagaaactcaacatggtacaattgtcatccgcattcaatacgaaggtgacggatcaccttgtaaaatacccttcgagattacagacctagaaaaacgtcatgttttaggtaggcttatcactgttaatcctatagtaatcgagaaagatagtcccgtaaatatagaagcagagccaccgtttggtgacagttacattattatcggggtagaacctggacaactaaagctaaattggttcaagaaaggttcatcaatcggacaaatgtttgagacgactatgcgaggtgcaaaacgtatggcaatcctaggtgacaccgcatgggatttcggatcgttaggaggcgtatttacttcaatcgggaaggctttacatcaagtcttcggcgctatatatggagctgccttctcaggtgtgtcatggacaatgaaaatccttataggcgtggttataacatggatcgggatgaactcgagatccacgagcctctcagtaagcctagtgttagtaggggttgtcacactgtatttgggtgcgatggtccaagcggacagtggatgtgtagtttcatggaagaacaaagagctgaagtgtggttctggaattttcattacggataacgttcatacgtggacggaacaatacaagtttcaacctgaatcaccatccaaattagcctcagctattcagaaagcgcacgaagaaggcatatgtggaattagaagcgttactcgactagagaacttaatgtggaagcaaataacgcccgagttaaaccacatactatcagaaaatgaggtgaaattaacaatcatgaccggtgatacgaaaggcatcatgcaagcaggtaaacgtagtttacgaccgcaaccaacggaactaaagtattcgtggaaaacttggggaaaggccaaaatgttaagcaccgaaagtcataatcaaacattcctaatagacggtccggagactgccgagtgtcctaacactaaccgagcttggaactctttagaggtggaagattatggatttggggtgtttactacaaatatttggttaaagttgcgagaaaaacaagacgttttctgtgattctaaactaatgagtgcagcaatcaaggataacagggctgtgcacgctgacatgggatactggatcgaatcagctctgaatgatacctggaaaatggaaaaagcatcctttattgaggtaaagagttgccactggccgaaatcacatactttatggtcaaatggagtactcgaatcagaaatgataatacctaagaattttgctggacccgtttcgcagcacaattataggccgggttatcatacgcaaacagcgggaccatggcatctaggaaaactagaaatggattttgatttctgtgaaggcaccacagtagtagttactgaagactgtggcaatagagggcccagtttaagaactacaaccgcaagcggaaagctaattacagaatggtgttgtagatcttgtacactcccgcctctgcgatatcgaggagaagatggatgctggtacggtatggaaatccgacccctgaaagaaaaggaagagaaccttgtcaattcgttagttactgccgggcacggccaaatagataatttttcgcttggagttcttggaatggccttgtttctcgaagaaatgttaagaacacgagtcggcactaaacatgcgatccttttggttgctgtgtcgtttgtcacgttaataacaggaaatatgtctttcagagatttaggcagagtaatggtaatggtgggtgcaactatgacagacgacattggaatgggtgtcacttacttagcactcttagcagctttcaaggtacgaccgaccttcgcagcaggtttgctgctccgaaaacttacgtctaaagaattaatgatggcaacgataggtatcactctattatctcaatcaaccatacccgaaacgatacttgaactcacagatgctttagcattaggaatgatggtactaaaaatagtccgaaatatggagaagtaccagttagcagtaacaataatggcaataagttgcgtaccaaacgccgttatccttagaaatgcatggaaagtctcatgcaccattcttgcagcagtctcggtgagtccactattgttgacttcatctcaacagaaggccgattggatacctctggctctgaccataaaaggactaaatcctacggcaatatttctcactactctaagccgtacatcgaagaaacgttcgtggcccctaaatgaagctataatggccgttggaatggttagtatactagcttcgtcgttacttaaaaatgatataccgatgaccgggcccctagtggctggaggcctgcttacagtctgttacgttctaacaggaagatccgcggacttggaactcgagagggcagcagacgttaaatgggaagatcaagcagagattagcggatcaagcccgattctatctataacaatctccgaagatggaagtatgagcattaaaaatgaagaagaggaacaaactctaactattctcataagaactggattactcgtcatcagtggagtattcccggtaagtattccaataactgcagcggcctggtatttgtgggaggtcaagaaacagcgtgccggtgttttgtgggatgtaccctctccaccccctgttggaaaagctgagctggaagatggagcatatagaataaaacaaagaggtatactaggatactcacaaataggtgcaggggtatataaagagggaactttccacacgatgtggcacgtcacccgtggagctgtactgatgcatagaggaaaacgtatcgagcccagctgggcggacgtcaagaaagatctaataagttatggcggcggatggaaactagaaggggaatggaaagaaggagaggaggtacaagtcctcgcattagaaccgggtaaaaaccctcgtgctgtacaaacgaaacccggaatatttaaaacaaacacaggtactattggagcagtgtctcttgatttttccccgggaacatcaggctcccctattgtggatcggaaggggaaggtggttggactatacggaaacggagtagtaacacgatccggcgcatacgtgagtgcgatagcacaaacagaaaagtccatagaggcgaacccagaaatagaagatgcgatatttcgaaagaaacggcttaccataatggatctgcaccctggagcaggaaaaccaaaacgatcactaccagccatagtacgcgaagccataaaaagagggttaagaccgttgattttggcgccaccccgagtcgtaccggcagaaatggaagaaccgctaagagggttaccgatacgatatcaaaccccggccataaaacccgaccacacaggaagagaaattgttgcactaatgtgtcatgccccgtttacaatgagactactctcaccagtgcgagtaccaaattacaacctaataataatggatgaggcccatttcactgaccccgcgtcaattgccgcacgcggttacatttccacgagagttgaaatgggcgaagcagctggcatattcatgacagccaccccaccgggatcaagagatccatttccccaatccaatgcacctattatggacgaagagagagaaattcctgaaaggagctggaactctggtcacgaatgggtaacagactttaaaggaaaaactgtttggttcgtcccttctataaaagctggaaatgacattgctgcatgcttaaggaaaaatggcaagaaagttatacagttaagtagaaaaacctttgattcagaatacgtaaaaacccgggcaaacgattgggattttgtagtcacaaccgacatatctgaaatgggagccaattttaaggcagaacgagtcatcgatcccagaagatgcatgaagcccgtaattttaacagacggcgaagaacgagtcattctcgcaggccccatgccagttacacattctagtgcggcacagcgcagaggaagaattggacgaaaccccaaaaacgaaaatgaccaatatatctacatgggcgaaccactggaaaatgacgaagactgtgcccattggaaagaggcgaagatgttacttgacaacattaacacaccagaaggaatcattccgtcaatgtttgaacccgaaagagagaaggtagacgctatagacggagagtatcgcctccgaggtgaggcgcgaaaaacgtttgtagatttaatgagaaggggagatttgccagtttggttagcttacaaagttgcagcagaaggaatcaattatgcagatagaaaatggtgtttcgacgggatcaaaaataaccagattctggaagaaaacgtggaagtcgaaatatggacaaaggaaggagaaagaaagaaactaaaacctagatggctcgatgcacgcatctattctgacccgttagcattaaaagagttcaaagagttcgcagctggacgcaagagtctcactcttaacctaattacggaaatgggaagattgccaacttttatgacacaaaaagcaagaaatgcactagataaccttgccgtcttgcatacagccgaggcaggagggagagcttataaccatgcactttctgaactacctgaaacattagagacattattactactgacactactagcaacagtaacgggaggtatttttctttttcttatgtcgggcaagggtataggcaaaatgaccctaggaatgtgttgtatcattactgcgtccgtgcttttatggtacgctcaaattcagcctcactggatagctgccagtataatactggagttctttttaatagttttgctaatacctgaaccggaaaagcaacgaactccacaagataaccaacttacttacgtagtgatagccatcctaactgtcgtagcagctacaatggcgaatgaaatgggattcctagagaaaactaagaaggacctaggcttaggctcgattacaactcaagaatcagaatccaacatactagatatagacttgaggcctgctagtgcttggacactgtatgccgtagcaaccacatttgtaacacccatgttaagacactcaatagaaaacagtagcgtaaatgtcagtctaactgcgatagcaaaccaagcaactgtcctcatgggcttaggaaaggggtggccgctaagtaagatggatatcggcgtaccgttactagctattggatgctatagtcaagtcaatcccatcacattgactgcagcacttctattgctggtagcgcactacgcgattattggaccaggacttcaagcaaaagcaacgagagaagcacaaaaacgagcggctgcaggaataatgaagaatccaacagtggatggaataacagtcatcgatcttgaaccgattccatatgatcctaaattcgagaaacagctaggacaagttatgctattaatcttatgtgttactcaggtgcttatgatgagaactacttgggcgctctgtgaagcgcttacgttagcgaccgggccgataagtacactctgggaaggtaacccgggtaggttttggaacacgacaatcgccgtctcgatggcaaacatcttcagaggttcttatctcgctggtgccgggcttttgttttccattatgaaaaatacgactaatactcgtagaggaactggtaatataggagagactctgggcgaaaaatggaaatcacggttgaacgctctaggtaaatccgagtttcaaatatataagaaatctggtatacaagaggtggacagaacactagctaaagaggggataaaacggggagaaactgatcatcacgctgtatcgcgaggctcagctaagttaagatggtttgtagagagaaacatggtcacacccgagggaaaagttgtagacctgggatgcggtagaggcggttggtcatattattgcggcggactcaaaaacgttcgggaggttaaggggctaacaaaaggaggacctgggcacgaagaaccgatacccatgtctacatacggctggaatctcgtccgattacaaagtggagtggatgtattcttcacaccacctgaaaaatgtgatacgctcctgtgtgatatcggtgaaagctcacccaaccccactatagaagcaggacgtactctaagagtcctaaatttggtagaaaattggctaaacaataatacacagttttgtataaaagtactaaacccttatatgccatctgtgattgagaaaatggaaacgttacaacgtaagtacggtggtgctcttgtaaggaatccattaagccgtaattcaacacatgagatgtactgggtcagtaatgctaccgggaacatagtatccagtgtaaacatgataagtagaatgttaattaatagatttacaatgaaacataagaaagcgacatatgaacctgatgtagatcttgggtccggaactaggaacatcggcatcgaaagtgaaattccaaatcttgacatcataggcaaaaggatcgaaaagattaagcaggaacacgaaacctcatggcattatgaccaggaccacccatataaaacttgggcttatcacggttcatatgagactaagcagactggtagcgcttccagtatggtaaatggagttgttcggttactcacgaaaccttgggatgtagtaccaatggtcacgcaaatggcaatgactgacaccacaccgtttggccaacaaagggtctttaaagagaaggtagacacaaggacacaagaaccaaaagaaggtactaaaaggcttatgagaataacagcagaatggttatggaaagagttaggcaagaagaaaacaccacgcatgtgtacaagggaagagtttacacgtaaagtaagatcaaatgccgcattaggtgctatatttaccgatgaaaacaagtggaaatcggcaagagaggcagtagaagacggtagattttgggagcttgttgataaggaaagaaacctccatctcgagggtaaatgtgaaacgtgtgtatataacatgatgggaaaacgagagaagaaattaggcgaatttgggaaggctaagggttccagagcaatttggtacatgtggttaggagcgcggttcctggagttcgaggcactaggcttcttaaacgaagaccactggttttcccgagggaacagtttgagtggtgtagaaggagagggattgcatcgactaggatacattcttagagatgtaggcaagaaagagggaggggcaatgtatgcagatgatacggcaggatgggatactcgaatcacactggaagacttgaagaacgaggaaatggtaactaatcatatgaagggagaacataagaaattagcagaggcgatatttaaacttacttatcagaataaagttgtgcgggtgcaaaggccaactcccagaggaacggtaatggatatcatatcaagaagagaccaaagagggtctggtcaggtaggaacatatggactcaatacctttactaatatggaagcccaactgattagacaaatggagggggaaggaatatttaaaagtatacaacacctgacagcgacagaagaaatagcggtacaaaattggcttgctcgagttggaagagaacgactaagtagaatggcgatatcaggagacgattgtgtagtgaaaccaatcgatgacagatttgcctcagctctaacagccttaaatgatatgggcaaggttcgaaaagacatacaacaatgggagccatcaagaggctggaatgattggacccaagttcccttttgctctcatcattttcatgagttagtgatgaaagatggaagagtattggtcgtaccctgtaggaaccaggatgaactaataggcagagcacgaataagtcaaggggccgggtggagcctcaaagaaacagcctgtcttgggaaatcttatgcccaaatgtggacactaatgtattttcatcgtagagacttaagattagctgcaaacgccatctgtagcgcagtacctagccattgggtcccaacgagccgaacgacatggtcaatccacgccaaacatgagtggatgacaacggaagatatgctggctgtctggaacagggtatggattcaagaaaacccttggatggaagataaaacaccagtagaaagctgggaagaggtaccatacctaggtaaaagagaagatcagtggtgcggctcactaataggtttgacatctagagccacttgggccaaaaacatacaaacagctattaatcaagtcaggtcacttataggcaacgaagaatataccgattacatgccctcaatgaaacgtttcagacgtgaagaagaagaagcaggagttttatggtga

SEQ ID NO: 22641 - RNA, 9876 nt, synthetic construct
  misc_feature 1..9876: note = derived and/or modified CDS sequence (opt6) from DENV-2__EU482606__SS-prME
  source 1..9876: mol_type = other RNA
actgcgggtgttatcattatgttaattccgacagcaatggcttttcatttaacaacacgaaatggggaaccgcatatgatcgtaggtcgtcaggaaaaaggtaaatctttattattcaaaacagaagatggtgtaaacatgtgcactctaatggctatagacttgggagaactgtgtgaagatacgataacctataaatgccccttactaaggcaaaatgaacccgaagacatcgactgttggtgtaattccacgtctacatgggtaacatacggtacatgtactacgacaggggaacatagaagggagaaaagatctgttgcactcgtaccgcacgttggaatgggtttagaaacccgtactgaaacatggatgtcaagtgaaggtgcttggaaacacgtacaaagaattgaaacatggatactgagacatcccggatttacgatcatggcagcaatccttgcatatacaatcggtaccactcatttccaaagggcattaatattcatactcctcactgcagtagcgccaagcatgactatgagatgcataggaatttccaatagagattttgttgaaggagtttcgggaggatcttgggttgatattgtgttagaacatggatcctgtgtaacaacaatggccaaaaataaaccaactctagactttgaattaattaaaactgaagctaaacaacccgcaactctacgtaaatattgtatagaagctaaattaacaaatactactacagaatcacgttgcccgacacaaggagaaccttctctgaatgaagaacaagacaaaagatttatttgtaaacacagtatggtagatagaggatgggggaacgggtgtggactgtttggaaaaggcggcatcgttacatgtgcaatgttcacttgtaaaaagaatatggaaggaaaagtagttcaacctgaaaatctagaatataccatcgtgataacgccccattcaggcgaagaacatgcggtcggaaatgatacaggaaaacatggaaaagaaataaaaattactccacagtcatccataacagaagcagaacttacagggtatggcactgttacaatggaatgctcgcccaggactggattagactttaatgaaatggtcttattacaaatggaagacaaggcttggcttgtccatagacaatggttcctggacctacccttgccgtggttacccggtgctgatactcagggatcaaattggattcaaaaagagacgttagtgacgtttaaaaatcctcacgccaagaaacaagatgtagtcgtactcggaagtcaagaaggtgcaatgcatacagctctaacgggcgcaactgagattcagatgtcaagtggaaatttattatttacgggacatcttaaatgtcgactgagaatggacaaattacaactgaaagggatgagttattccatgtgcacgggaaaattcaaaatcgtaaaagaaatagcagaaactcaacacggcactatagtgattcgtatacaatatgagggtgacgggagcccttgtaaaataccattcgaaataacagatctagaaaaacgacacgttctcggtaggctgataacagtaaatccaatagtaattgaaaaagactcaccagtcaacatagaagctgagccaccattcggggattcttacataatcataggtgtcgaaccgggccagttaaaacttaattggttcaagaaagggtcatcaattggacaaatgtttgaaaccacgatgagaggggctaaaaggatggcaatattaggagacacggcatgggattttggttcacttggcggcgtttttaccagtataggaaaagccctacatcaagttttcggagcaatatacggtgcagcttttagtggggtaagttggacaatgaaaatcctaatcggggttgttattacttggataggaatgaatagccgctcgacttcgctcagcgttagcttagtgctagtaggtgtagtaacactataccttggagcaatggtacaagctgacagtggctgcgtggtctcatggaaaaataaagagttaaaatgtggatcaggtatcttcataacagacaatgttcacacgtggaccgaacaatacaaatttcaaccagagtcaccaagtaagttagcatcagccatacaaaaggcacacgaagaggggatttgtggaatccgaagcgttacgaggcttgagaatttaatgtggaaacaaattacccccgaactgaatcatatattgagcgaaaacgaggttaaattaactatcatgacaggggacacaaaaggtattatgcaagctggaaagcgatcgctacggccccaacccacggagctgaagtattcatggaaaacttggggaaaggccaaaatgctttcaacagaatcacataaccagaccttcctaattgacggacccgagactgctgagtgtccgaatactaatagggcttggaactccttagaggtagaagattacggtttcggagtatttacaactaacatctggctaaaactccgagaaaaacaggatgtgttttgtgacagtaaattaatgagcgccgcgatcaaagacaatcgcgctgtacatgcagatatgggctactggattgagtcggcattaaacgacacttggaagatggaaaaggcttcctttatcgaagttaaaagttgccattggcctaaatcccacacattatggagcaatggagtcctcgaaagtgagatgataatccccaaaaattttgctggcccagtatctcagcataactacagaccaggctatcatactcaaactgctggaccatggcatcttggcaagttagagatggactttgacttctgtgaaggaactaccgtagtagtaactgaagactgcggaaaccgaggaccctctcttcgtacaactacagcttcaggcaaattaattacggaatggtgttgtcgctcatgtacattacctccgctgagatacagaggtgaggacggatgctggtacggaatggaaatacgtccattaaaagaaaaagaggagaatttagtaaactccttagttacagcaggacatggtcagatagataacttcagtctaggcgttctaggcatggcattgtttttagaagaaatgctgcgtacaagagtaggaaccaaacatgctatattgttagtagcagtcagttttgtaacacttatcactggaaatatgtctttcagagacttaggtagagtcatggtaatggtcggtgcgacaatgacggatgatatcggaatgggtgtaacttatttagcgttacttgcagcgtttaaagttcggccaaccttcgctgcaggcctactactccgaaaacttacttctaaagaattaatgatggcaacgatcggcattacgttgttatcgcaaagcacaattcccgaaaccatattagaattaacagatgcgttagcactaggcatgatggtattaaaaattgtgagaaacatggagaaataccagctagcagtaacaattatggctatatcttgtgtgcctaacgctgtgatacttcgaaacgcttggaaagtgagttgtaccatattggctgcagtatccgtaagccccttgctgctaacatcttcacagcaaaaagcagattggatcccacttgctttaactataaaaggcttgaatcccactgcgatatttttaactacgttgtctcgcacgagcaagaaaagatcctggccattaaacgaggccattatggctgtaggtatggtgtctatactagcttcaagtttattgaagaatgacatccctatgacgggtccattagtggctggtgggctgctgaccgtttgttacgtattaaccggtaggagtgcagatctagaattagaacgagctgcagatgtgaaatgggaggatcaagccgagatatccggaagttctccaatattgagtattactatatcagaagatggatcaatgtcaattaaaaacgaagaagaagaacaaactctaactattttaatacgtacaggcctacttgtgatatcaggtgtttttccagtaagtatacccatcacggccgcggcatggtatctatgggaagtcaagaaacaaagagcgggggttttatgggacgtcccttccccacctccggtcggaaaagccgaactagaagatggagcatatagaattaaacagagaggcattctcggctacagtcagattggggcaggcgtttataaagaaggtacatttcatactatgtggcacgttactcgaggagcggtacttatgcataggggaaagcgtattgaaccatcctgggccgatgtaaagaaagacttgatatcgtatggtggtggttggaaacttgaaggagaatggaaggaaggagaagaagtacaagttcttgcattagaacccggcaaaaatcccagagcagtacaaacgaaacctgggattttcaaaacaaataccggaacgataggagcggtcagcttagacttttcacctggaacatctggaagccccatagtagatcgaaaggggaaggtagtaggattatacggtaacggggtcgttactagaagtggtgcgtacgtatctgcaatagcccagacagagaagtcgatcgaggataatccagaaatagaagatgatatatttcgtaagaagagattgacaatcatggacctacatccaggagctggcaaaacaaaaaggtacttaccagccattgtcagagaggcgatcaaacggggtttaagaacgctaatcttagctcctacaagggtcgttgcagctgaaatggaagaggcgcttcgcggcctaccaatcaggtaccagacgcctgctatcaaagccgaacatacgggacgtgaaatagtagacctaatgtgtcacccaacttttacaatgagattgttgtcaccagttcgtgtgccaaactataacttgatcataatggacgaggcacatttcacagaccccgcctctattgcagcaagaggctacatctctacaagagtggaaatgggagaagcagcgggtatctttatgacagcaacaccacccggaagcagagatccattcccgcaaagcaacgcgcccatcatggatgaagaacgggaaataccagaacgttcatggaactctggtcacgaatgggttactgatttcaaaggaaagacagtctggttcgtaccaagtataaaggccggtaatgatatagctgcttgtctccgaaagaatggaaagaaagtgatacaattgtcacggaaaacatttgattccgaatacgtaaaaacaagggcgaacgactgggatttcgttgtgacaaccgacatctcggaaatgggagcaaacttcaaagctgaaagagttatcgacccgagacgttgtatgaagcctgttatactaaccgatggtgaagaaagagtaatacttgcaggacctatgccggtcacacatagttcagcggcacaaagacgtggaaggataggccgaaaccctaaaaatgaaaatgatcaatatatatatatgggggaacctctagaaaatgacgaagattgcgcacactggaaagaagcaaagatgttactagataatattaacactcccgaaggaattatacctagcatgttcgaaccggaaagggaaaaagtcgatgcaatcgatggagagtacagactcagaggcgaagcaagaaaaaccttcgttgatctgatgcgtaggggagatttaccggtctggctcgcatacaaggttgccgctgaagggattaattatgcggatcgtaaatggtgtttcgatggtattaagaataaccagattctcgaggaaaacgtggaagtagaaatatggacaaaggaaggtgaacgtaagaaacttaaacctcgctggttagacgctagaatatattctgatccccttgcccttaaggaatttaaggaatttgcagccgggaggaaatcacttacgttaaatttaatcactgaaatggggcgtctacccaccttcatgacacaaaaagctcgtaatgctttagacaatctagcagtattacatacagcagaggctggaggcagagcctataaccacgcactgtcagaattaccggaaaccctcgaaacactattactcctaacgcttcttgcgacggttacaggaggcattttcttatttctaatgtctggtaaaggtattggaaagatgactctagggatgtgttgtatcatcacagctagtgtgttattgtggtatgcacaaatccagcctcactggatagcagcatctattattttagaatttttcctcatagtattattaataccagaaccagaaaagcaaaggactcctcaagacaatcaactgacatacgtcgtaatagccatactgacagtggtagccgctacaatggctaatgaaatgggtttcctagagaaaacgaaaaaggacttagggctaggcagtattacaacacaagaatctgaatcgaacatcttggacatagatctaaggccggcatccgcctggaccttatatgctgtggccacgacatttgttacacccatgcttagacattcgattgaaaactcaagtgtcaatgtttcactcacagcaatcgctaaccaagctacagtactaatgggcttaggcaaaggatggcctctttcaaaaatggatatcggagtccccctcctcgctataggctgttacagccaagtaaatccaatcacattgacggcagcacttctactgttagtagcccactacgccataatagggccaggtctacaggcgaaagcaactagagaagcacagaagagagcggcggcaggcataatgaagaatccgacggtggacggaataacggtaattgatttagagcctattccatatgatcccaaatttgaaaaacaattaggacaagtcatgttattaatcttgtgcgtcacacaagtcttgatgatgcgaaccacatgggcactatgtgaagcactaaccctagccaccggacctatcagtaccttgtgggagggaaacccaggtcgtttctggaacacaacaatagcggttagcatggctaacatattcagaggatcgtacttagctggagcaggtctactctttagtatcatgaaaaacactacaaatacacggcgcggaacggggaatataggagaaactctgggagaaaaatggaagtcaagactaaatgcattgggtaaaagcgagttccaaatctataagaaatcaggtattcaagaagtcgacagaactctcgcaaaagagggaatcaaaagaggagaaacagaccaccacgcggtaagcaggggtagcgcgaaattaagatggtttgtggaaaggaacatggtaactccagaggggaaagttgtagacttagggtgtggaagaggtggttggtcctattattgtggaggactgaaaaatgtccgagaagtaaaaggtcttactaaaggtggccctggccatgaagaaccgatccctatgtctacgtacggttggaatttagtccgtcttcaaagcggagtagatgtgttctttactccccctgaaaaatgtgatacactattatgtgatataggtgaaagttcacctaatcctactattgaagcaggaaggaccctgagggtcttaaatctggtagaaaactggcttaataataacacgcaattctgcataaaagtacttaatccatacatgcccagtgtaatagagaaaatggaaactcttcagagaaaatatgggggcgcactggttagaaatcccttaagtcgaaactctacccacgaaatgtactgggtatctaatgcaacaggaaacatagtaagttccgtcaatatgatatcccgaatgcttataaatcgttttactatgaaacacaaaaaggctacttatgaaccggacgtggatcttgggtcaggtactcgcaatataggtatagaatcagaaattccaaacttagatatcattggaaaacgaatagaaaagataaaacaggaacacgaaacatcttggcactacgaccaagatcatccatataaaacgtgggcgtatcatgggtcatatgaaaccaaacagactggatctgcctcttctatggtaaatggagtggtgagattattaacaaaaccttgggatgttgtaccaatggttacacagatggccatgacagacactacaccttttggacaacagagagtgtttaaagaaaaagtcgacactaggacccaagagccaaaggaaggtacaaagaaattaatgcgtataacagcagagtggttatggaaagaattaggtaaaaagaaaaccccacggatgtgtaccagggaagagttcacaagaaaggttcgaagtaatgccgcactaggagccatatttacagatgaaaataaatggaaaagtgcgcgtgaagccgtagaagatggaagattttgggaacttgtagataaagaaaggaatttgcatctcgaaggaaaatgcgagacctgtgtatataatatgatgggaaaacgggagaagaaattaggtgaatttggtaaagcgaaaggcagcagagctatttggtatatgtggctaggcgcgaggtttttagagttcgaagccttaggatttttaaatgaggaccactggtttagtcgcgggaatagtttatcaggtgtagaaggcgaagggttacaccgtcttggctatatattaagagatgttggcaagaaagaaggaggagcaatgtacgcagacgacaccgctggttgggatacacgcataaccttagaagatttaaagaacgaggaaatggtgacaaaccatatgaaaggcgaacataagaaattggcagaagccatctttaaactaacttatcaaaacaaagtggtcagagtacaaagacctactccgagagggactgtgatggacattataagtaggcgagaccaacgtggatccggacaagtaggaacttatggcttgaataccttcaccaacatggaagcacagctgattagacaaatggagggggaagggatctttaagtcaatacagcacctaaccgctaccgaagaaatcgctgtgcaaaactggctagcaagagttggaagagagaggcttagtagaatggctataagtggagatgactgtgtcgtaaaaccgatagacgatagattcgcatcagcattaactgctctgaacgacatgggcaaagtccgcaaagatatacaacaatgggaaccttcgagaggttggaatgactggacacaggtccccttctgcagccatcatttccatgaattggtgatgaaagacggtcgggtattagtggtaccttgccgcaatcaagacgaattgataggccgcgccaggataagccaaggggcaggatggtctctaaaagaaacagcctgtcttgggaaatcgtatgcacagatgtggacattaatgtacttccacaggagagacctgcgtttagcggctaacgctatatgctcagccgttccatctcattgggtgccaacatctagaaccacatggtcaatacatgcaaaacacgagtggatgactacagaggatatgctagctgtttggaaccgcgtatggatccaggagaacccctggatggaagataaaacacctgttgaatcctgggaagaagtaccttacttaggaaagagagaggatcaatggtgtggatcactgatagggttgacatccagagctacctgggctaaaaacatacagacagctattaatcaggtgcgttctctaatcggaaatgaagaatacacagattacatgccctcaatgaagagattcagaagagaagaagaagaagccggcgtcttatggtaa

SEQ ID NO: 22642 - RNA, 9876 nt, synthetic construct
  misc_feature 1..9876: note = derived and/or modified CDS sequence (opt6) from DENV-2__EU482607__SS-prME
  source 1..9876: mol_type = other RNA
acagcaggggtaatagttatgttaatacccaccgcaatggcatttcatctcactaccaggaacggagaaccacatatgattgtcggacgccaagaaaaagggaaaagtttattatttaaaacagaagatggagtaaacatgtgcacattaatggcgattgatctaggagaattatgtgaagatacgataacatacaaatgcccactattacggcagaatgaaccggaagacattgactgttggtgtaactccacaagtacgtgggtaacgtacggtacatgtacgacaacaggagaacatcgaagagaaaaacggtctgtagcattggttccccatgtaggaatgggattagaaacaagaaccgaaacctggatgagttcagaaggagcatggaaacacgtccaacgcatagagacttggattttacggcatcctggatttactataatggcagcaatacttgcttacaccataggcacaactcactttcagagagcactgattttcatattattgacagcagtagctcctagcatgacaatgagatgcattggagtttctaacagggattttgttgaaggtgtttctggaggttcatgggtagacatagttctggaacatggttcatgtgttactacaatggccaaaaacaaaccaacactagactttgagctgataaaaacggaagcaaaacaaccagctaccctaagaaaatactgtatagaagcaaaactgacaaacaccactactgaaagcagatgccctactcaaggagaaccgagtctcaacgaagaacaagataaacgattcatatgtaaacacagcatggtggatagagggtggggaaatggatgtggcctattcggtaaaggagggatagtaacatgtgcaatgtttacatgtaagaaaaatatggagggcaaagtggtacagccagaaaatttagaatatactatcgtaataacaccacactccggggaagaacacgcagttggtaatgacacaggtaaacatggtaaagaaattaaaataactcctcaatcaagtataatagaagctgaacttactggctatggaacagtcacaatggagtgtagtccgagaacgggtttagatttcaatgaaatggtcctattacaaatggaagacaaggcatggcttgttcacagacagtggttccttgatctgccgctcccatggctacccggggcagatacacaaggtagtaactggatacaaaaagaaactttagtgacattcaagaacccccatgccaagaaacaagacgtagttgtcttaggatcacaggaaggtgctatgcacaccgccctaacgggtgcgacggaaattcaaatgtcttcaggaaatttgttattcacgggacatctgaaatgccgactaagaatggataaattacaattaaagggtatgagctatagcatgtgcacaggaaagttcaagatagtaaaagaaatagcagaaacccaacacggtaccatagtaatcagagttcaatacgaaggagatggctcaccgtgcaaaatacctttcgaaatcacagatttggagaaaaggcacgttttaggaagattaataacagtgaatcctatcgtaacaggtaaggatagtccagtaaacattgaagcagaaccaccgttcggcgattcttacataataataggtgtagaacctggacaattaaaattaaattggttcaagaaggggtcaagtattggccaaatgtttgaaacaacaatgagaggtgctaagaggatggcgatactaggtgacacagcctgggattttggatcgctaggaggagtcttcacatcaataggcaaagcgctacaccaagtattcggagccatatatggtgcagcattttctggggtgagctggacaatgaaaattctgataggagtaataataacgtggatcgggatgaatagcagaagcaccagcctttctgtgtcattagttctagttggtgttgtaacgctttatttaggggcaatggtccaagctgatagcggatgcgtggtatcttggaagaataaagaattaaaatgtggtagcggaatttttataaccgacaacgttcatacttggacagaacaatacaaatttcaacctgaatcaccctccaaactagcatctgccatacaaaaagcgcatgaggaaggaatatgtggcatccgttcggtaactaggttagagaatctcatgtggaaacaaataacgccggagcttaatcatatactatcggaaaatgaagtcaaattaactataatgacaggagacatcaaaggaataatgcaagcagggaaacgatccctacgacctcagcctacagaactgaagtactcttggaagacatgggggaaagcaaaaatgttatctactgaaagccacaatcaaacgtttctaatagacgggccggaaacggccgaatgccctaatacaaatcgtgcttggaactccttagaagtagaagactacggttttggtgttttcactacaaatatatggctaaaactaagggaaaagcaggatgtgttttgtgatagtaaacttatgagtgcggcgattaaagataaccgcgcagtacacgcggatatgggatattggattgaatcggcactgaatgatacttggaaaatggaaaaagcaagtttcatagaggtgaaaagctgtcactggccaaaaagtcatacattatggtccaatggagtattagaatcagaaatgataatccccaaaaattttgcaggtccagtaagtcagcataactataggcctggataccatacgcaaaccgctggtccatggcatttaggaaaacttgaaatggattttgacttctgcgaaggaactacagtggtagtaacggaagactgtggaaacaggggcccgtcattgaggacaacaactgccagcggaaaactgattacagaatggtgttgccgctcctgtacattaccgccgttacgatatcggggtgaagatggatgttggtatggtatggagattagaccacttaaagaaaaagaagaaaatctagtgaactctttagtgaccgcaggtcacggacagatagacaatttttcattgggtgtcttagggatggcacttttcttagaagaaatgctccgtacacgagtgggaacaaaacatgctatcctacttgtcgcagtatcttttgtgaccctaataacgggaaacatgtcatttagggatctaggaagggttatggtcatggtcggagcaacgatgaccgacgatataggaatgggtgtaacttatctagcattattagcagctttcaaggtaagaccaacatttgcagccggattgctgttaagaaaattaacaagcaaggaacttatgatggcaaccatcggcatagcactactctcgcaatcaaccatacctgaaactatactagaactaacggatgcgctagcactaggaatgatggttcttaaaattgtgagaaacatggaaaaatatcaactagctgtaacagtcatggcaatttcctgtgtaccaaacgccgtaattcttcaaaatgcatggaaagtgagttgcactatacttgcagccgtatcggtatcacctcttttactcacttcaagtcagcagaaagcggattggattccattggcattaacgataaagggtctcaacccaacagctatattcctgacaacattatcacgcactagcaagaaaagaagttggccgctaaacgaagcgataatggcagtaggtatggtatccatactcgctagttcgctactcaaaaatgatattcctatgacaggaccacttgtcgcgggagggttgttaacagtatgttatgtgctaacaggcagaagcgcagatttggaattagaacgagccgctgacgttaaatgggaagaccaggcagaaatatctggatcctcgcccatacttagcattactataagtgaagatggttcaatgtcaatcaaaaacgaagaggaggaacaaacacttacaatcctgatccggactggattattagtcataagcggtgtgtttcctgtcagcatccccatcacagcagctgcttggtatctatgggaggttaagaaacagagagcgggcgttttgtgggatgtgccaagtccaccacccgttggaaaagctgaattagaggatggagcatataggataaaacaaagaggtattcttggatattcgcaaataggtgcgggcgtttataaggaaggtacttttcacacaatgtggcatgtgacaagaggggctgttctaatgcacagagggaagcgtattgagcccagctgggcagatgtcaagaaagatttaatcagttatggagggggatggaagttagaaggtgagtggaaggaaggggaagaggtacaagttcttgccttagaaccaggtaaaaatccccgagcagttcaaactaaacccggaattttcaaaactgacaccggcacaatcggcgctgtctcattagacttctcccccggtacaagtggaagcccgattgtagaccgaaaaggaaaagttgtaggactttacggaaacggagttgttactagaagcggagcatacgtctcagcaatcgcacaaacggaaaagtctattgaagacaatcctgaaattgaagacgacatatttaggaagaaaagattaaccataatggatctacacccaggtgctggtaaaacgaaaaggtatcttccagctatagtccgggaagcaataaaaagaggtttgcgaacactaatattggcgccaactagagtcgtcgctgctgagatggaagaggctcttagaggactcccaatacggtaccagacgccagccataaaagcagaacacactggtagagaaatagttgacctaatgtgtcatgcaacgtttactatgaggctacttagtccagtgagggtccccaattacaatctcatcataatggatgaagcacatttcacagacccggcatcaattgctgctcgcggatatattagcacaagggtagaaatgggagaagccgcagggattttcatgacagccacaccaccagggagtcgagatcccttcccgcaaagcaacgccccaattatggacgaagaacgcgaaataccggaacgatcttggaatagcggacatgagtgggtaacagactttaaaggtaaaaccgtgtggttcgttccaagtataaaagcgggtaatgacatagcggcttgtctaaggaagaacggcaagaaagtcattcaattgagtcgcaaaacttttgacagcgaatatgtaaaaacccgcgccaatgattgggattttgttgttaccactgatatcagtgaaatgggggctaattttaaggctgaacgggttatagacccaagaagatgtatgaagccagttatacttacggatggcgaagagagggtaattcttgcaggtcctatgcctgttacacattcatctgcagcccaaagacggggaagaatagggcgaaaccccaaaaacgagaacgaccagtacatttacatgggcgaacctttagagaatgatgaggactgcgcgcattggaaagaagcaaaaatgttattagacaatataaacactccagaaggcataataccatcaatgtttgagcccgaaagagaaaaagtggatgctatagacggcgaatatagattgagaggtgaggccagaaaaacatttgttgatcttatgcgtagaggagaccttcccgtttggttagcatacaaagttgcagccgagggaattaactacgcagacaggaaatggtgctttgacggaatcaaaaataaccaaatcttagaggaaaatgtagaggtagaaatatggacaaaagagggagaaaggaagaaattaaaacccagatggttagacgcacgaatatatagcgatcctttagcattaaaagaatttaaagaatttgcagctggtcgtaaatcgctggcacttaatttgataacagagatgggcagactacccacatttatgacgcagaaagcgagaaatgcattggataatttggcggtgcttcacaccgcagaagccggtgggagagcatataatcatgcacttagcgaactacctgagaccttggagacgttactacttctgacattgcttgcaactgttactggagggatatttttgttcctaatgtctggtaaaggaataggaaaaatgactctcggaatgtgctgcataattactgcttctgtactactatggtatgcacaaatacaaccccattggatcgcagcgtcaatcattttggagttcttcctaatcgtactgttaatacccgagcccgagaaacaacgaacaccacaggataaccaacttacctatgtggtaatcgctatactaaccgtagttgctgcaaccatggccaacgaaatgggtttcctagaaaagaccaagaaagatttaggtctaggttcgatcacgactcaagaaagcgagtctaatatattagatattgatctacgaccggcttcagcatggactttatacgctgtagcgacaacgtttgtaacgccaatgttgagacatagtatagaaaactccagcgtcaacgtatccttgaccgccatagcaaatcaagctacagtgttaatggggctaggaaagggttggcctttatcaaagatggatatcggtgtaccactgctcgcaataggttgctattcacaggttaaccctataaccttaaccgctgcgctattgctcttagtagcacactacgcgataataggacccggactgcaagcgaaggctactagagaagcccagaagcgggcagcggccggaattatgaagaacccaacagtcgatggaataacagtgattgacttagagccaataccctacgatccaaagttcgaaaaacaattaggacaagtaatgctgctgatcttatgcgtgacacaagtcttaatgatgcgtacaacctgggcgctctgcgaggctttgacactagccaccggtcctatatcaactttatgggaaggcaacccgggaagattttggaacacaacaatcgcagtatccatggctaatatatttagaggatcatatttagctggagccggacttcttttctccataatgaaaaataccaccaacacccgtagggggacaggaaatataggggaaacactcggagaaaaatggaagtcaaggttaaatgctctcggcaaatccgagttccaaatttacaagaaatcaggcattcaagaggtggatagaaccttagccaaagaaggaataaaaaggggcgaaaccgatcatcatgcggtctcacgtggcagcgcaaagctccgttggtttgttgagcgtaacatggtcactccagaaggaaaggttgtggatttaggttgtggacgaggaggatggtcttactattgtgggggattgaaaaatgtgagggaagttaaagggctaactaaaggaggccctggtcacgaagaacccatacccatgtcgacctacggatggaaccttgtacgcttacaatcaggagtggacgtatttttcaccccaccagaaaagtgcgatacattgctttgcgatattggagaatcatccccaaatccgactatcgaagcaggaagaacccttagggtgctgaatcttgtcgaaaactggttaaataataatacccaattctgtataaaagttttaaatccttatatgccctcagtaattgaaaagatggaaacgttacaaagaaaatatggtggagctttagttcgaaatcctctcagtcgaaattccacacatgaaatgtattgggtttccaatgcaacaggcaacattgtttcgtcggtaaacatgataagtaggatgcttataaacagattcacaatgaaacacaagaaagcaacctatgagcccgacgtcgatcttggttcgggtacgagaaatataggaattgaatctgaaatcccgaacttagacataataggtaaacgtatagagaagattaaacaagaacacgagacgtcttggcactacgaccaggaccatccatataaaacatgggcataccatggaagttatgaaactaaacagacaggatctgcgtcaagtatggtgaacggagtagtaaggttattgactaaaccctgggatgttgtgccaatggtgactcaaatggcaatgacagacactacaccttttgggcagcagagagttttcaaagagaaagtggatacacgtacacaggagccaaaagagggaacgaagaaactgatgaaaataacggcagagtggttatggaaagaattagggaaaaagaaaacccctcggatgtgcacacgagaagagttcacaagaaaagtaaggtccaatgcagcactaggcgcaatttttactgacgaaaataaatggaaatcggcaagagaagcagtagaagatggaaggttctgggaactggtcgacagagaacgtaaccttcacctagaaggaaaatgcgaaacttgtgtctacaatatgatggggaaaagagaaaagaaattaggggagttcggtaaagcgaaagggagcagggcaatatggtacatgtggctaggggcacgattccttgagttcgaagctctaggcttcttaaacgaagaccattggttctcccgcggaaattctttatcaggcgtcgaaggagaaggactgcatagattagggtacattctaagagatgtaggtaagaaggaaggtggagcaatgtacgcggacgataccgcaggatgggatacgagaattacattggaggaccttaaaaatgaagagatggttacaaatcatatgaaaggtgaacataaaaagttggcagaggcaatattcaaactaacatatcaaaacaaggtcgtccgggtccagcgtccgactcctcgtggaacggttatggacattatatctagaaaagatcagcgcggttcgggtcaggtcggaacgtatggactcaatacctttacaaacatggaagcccaactgataagacagatggaaggagaaggaatctttaaatctattcagcacctgacagcgacagaagaaatcgcagtgcagaactggttaacacgtgttgggcgtgaacgactctctagaatggcaataagtggagacgattgcgtagtaaagccgatagacgatagatttgctagcgcattaacagctctaaacgatatggggaaggttcgaaaggacattcagcagtgggaaccttctagaggttggaatgattggacacaggtaccattttgctctcatcattttcacgaattggtaatgaaagacggtcgtgtacttgtcgtcccttgcagaaaccaagacgaactaatcggtagggcaagaatatcccaaggagccgggtggtctttaaaggagacagcgtgtttagggaagagttacgcccaaatgtggacgctcatgtatttccatagacgggacttgcgcctagcagcgaatgccatttgcagtgccgtaccttcacattgggtccccacatcacggacgacatggagtatacacgcaaaacacgaatggatgaccactgaagacatgctcgcagtctggaaccgggtatggatacaggaaaatccgtggatggaagataaaacacccgtagaatcatgggaagaagttccttatcttggaaaacgagaagatcaatggtgtggttctctcatcgggctgacctcacgtgctacttgggccaaaaacattcagaccgctataaaccaggttaggtcattaatcggtaatgaggaatacactgattatatgccctcaatgaagcgatttcgcagagaagaggaagaagccggagtactatggtaa

SEQ ID NO: 22643 - RNA, 9876 nt, synthetic construct
  misc_feature 1..9876: note = derived and/or modified CDS sequence (opt6) from DENV-2__EU482608__SS-prME
  source 1..9876: mol_type = other RNA
acagcaggagttataatcatgctgatacctacggcaatggcatttcatttgacaacgcgtaatggagaaccacacatgatagtgggaagacaagaaaaaggaaagagcttattatttaaaactgaagatggagtaaatatgtgtacacttatggctatagatcttggagaactatgtgaagacactattacgtataaatgtccattgcttagacaaaacgaacccgaagatatagattgttggtgtaactcaaccagcacatgggttacgtatggtacgtgtactaccacaggtgagcaccgtagagagaaaaggtctgtagcccttgttccgcatgtaggtatggggctagaaacaaggactgaaacatggatgtcatcagaaggtgcttggaaacatgtacaacgaattgaaacgtggatattacgacatccgggattcacaataatggcagcaatccttgcttatactatcggaactactcatttccaacgagcattaatctttattctactaactgccgtcgcaccatccatgactatgcgatgtataggaatatcaaatcgcgattttgttgaaggagtctcgggaggcagctgggttgatatcgtattagaacacggatcatgcgttacaacgatggccaaaaataaacctacattggattttgaattaataaaaacagaagcaaaacaaccggcaactttgaggaaatattgcatagaggcaaaactaacaaacacgaccacagaatcaaggtgtccaacgcaaggtgaaccttctctaaacgaagaacaagacaaacgattcatatgtaaacatagcatggtcgatcgaggatggggtaatggttgtggattatttggaaaaggaggaatagttacatgtgccatgtttacatgtaagaaaaacatggaaggaaaagtagtacagcctgagaacttggaatataccattgtaataacacctcactcaggagaggaacatgccgtaggtaatgataccggcaaacacggaaaagagatcaaaatcacacctcaatcctcgataactgaggcagaactgacaggatacggcactgtaacgatggagtgctctcctagaaccggattggactttaacgaaatggtgctattacaaatggaggataaagcatggttagtacatagacaatggttcttggatttaccattaccgtggttgcccggagctgatacacagggctctaattggatccagaaagagaccctagtaacatttaaaaatcctcacgccaagaaacaagatgtagttgtactaggttcacaagaaggtgctatgcataccgctctaacaggagcaactgaaattcagatgtcttcaggaaatcttctattcaccggacatctcaaatgccgattgcgtatggataaactccagttaaaaggtatgagctactcaatgtgtacaggtaaattcaaaatcgttaaagaaatcgcagaaacacaacatggaaccatagtgattaggatacaatacgaaggtgacggaagtccatgtaaaattcccttcgagatcacagatctagagaaacgccatgtgttaggacgactcattacagtaaatcctattgtaatagagaaagacagccccgttaatatagaggcagagcctccatttggtgatagctacataataatcggcgtcgagccaggccaacttaaattaaattggttcaagaaaggatcgagcataggacaaatgtttgaaactacgatgcgaggagctaaacgcatggccatattaggagatactgcatgggattttggatccctagggggagtattcacaagtataggaaaagcgctacaccaagtgtttggtgcaatatatggagcggcatttagtggagtaagctggacaatgaagatcttaattggggtagttataacatggattggtatgaactcgagaagtacgtctttgtctgtctcgcttgtcctagttggtgttgtaacattatatctaggagcaatggtacaggccgacagtgggtgtgtggtttcctggaagaataaggaactgaaatgtggttcagggatatttataaccgataatgtccatacgtggacggaacaatataagtttcaacctgaatctccatcaaagctggcaagtgcaatacagaaagcccatgaggaaggaatttgcggaataaggtcagtaacaaggcttgaaaatctaatgtggaaacagataactccagaacttaaccacatactaagtgaaaacgaagttaaacttacgataatgacgggagacacaaaaggtattatgcaggctgggaaacgttccctaagacctcaaccgacagaattgaaatattcctggaagacgtggggaaaggccaagatgttgtcaacggaatcacacaaccaaacgtttttgatagatggaccggaaacagcagagtgtcccaatacaaatagagcctggaactctttagaggtagaggattacggcttcggtgtattcactactaatatatggcttaaacttagggaaaaacaagacgtcttctgtgattccaaacttatgtcggcagcaattaaagacaatagagccgtccacgccgacatgggatattggattgaatcggccctaaacgatacctggaagatggaaaaggcaagttttatagaggtaaagagctgtcattggccaaaaagtcatactttgtggtcgaatggagtcctagagtctgaaatgatcatccccaaaaatttcgccgggccagtctcccaacataattaccgaccgggatatcatacgcaaacagcagggccttggcatctaggaaaattagaaatggacttcgatttttgcgaagggactacagtagtggttaccgaagactgtggaaacagaggaccttccctaagaacaactactgcttctgggaaattgataacagaatggtgctgtcgatcctgtaccttaccacctttgaggtatcgcggcgaagatggttgttggtatggaatggaaattagaccccttaaagaaaaagaggaaaatcttgttaatagtttagtgactgcgggccatgggcaaatagataacttttccttgggtgttttaggaatggcattattccttgaagaaatgcttaggaccagggtaggaaccaagcatgcgattcttttagtagcggtatcatttgttacgttgattaccggcaatatgtcatttcgcgacctagggagagttatggtgatggtcggtgcaacaatgaccgatgacataggcatgggtgttacatacctagcgttattagctgcttttaaagtaagaccaacctttgcagcaggattattactacggaaacttacatcaaaggagctaatgatggcaaccataggaattacactattatcacagtccaccatcccagaaactatacttgagctaacggatgcactagccttaggaatgatggtactgaaaatcgttcgtaatatggagaaatatcaattagctgtcactataatggcgatatcatgtgtcccaaatgcagttatcttacgtaacgcttggaaggtttcatgtacaattctagcagcagtttcagtttccccgttactcttaacgagttctcagcaaaaggcagactggataccgctcgcattaacgattaagggcttaaatccaactgcgattttcctgaccaccctctcgcgaacatcaaagaaaagatcatggccattgaatgaagcaataatggcagttggcatggttagcatattagcgtcttccttattgaaaaacgacatacctatgaccggtcctttggtagctgggggattgttaaccgtatgttatgtgttgacgggtagatctgcggacttggaattagaacgagcggcagacgtaaaatgggaagaccaagccgagatatctggttctagcccaatccttagcataacaatctccgaggatgggtccatgtcgatcaaaaatgaggaagaagaacaaacgctgactattctaatacgcactggtctactcgttataagtggtgtattccctgtttccatccccattactgcagctgcctggtatttatgggaagttaagaaacaaagagctggtgtattatgggacgtacccagtccccctccagtcggaaaagcagaattagaagatggagcctaccgtataaagcaaagaggaatcctaggatatagccagataggagcgggggtctataaagagggaacttttcatactatgtggcacgttactcggggagctgtgttaatgcatagaggaaaacgaatagaaccatcttgggctgatgtcaagaaagatttaatttcatatggagggggatggaagttggaaggtgaatggaaagaaggtgaggaagtccaggtcctagccttagaacccggtaagaatcctagggcagttcagaccaaacctggaatttttaaaacaaacactgggacgattggtgccgtcagccttgattttagcccaggcactagcggctcaccaatagttgatcgaaaaggtaaggtcgtaggactttatggtaacggcgtggtcacaagaagcggagcttatgtctcagcaatagcccaaacagaaaagtcgatcgaagataatcctgagattgaggatgacatatttagaaagaaacgactaacgataatggatctacatccgggagccggcaaaacgaaaagatatctgccagcgatagttagagaagctataaaaagagggcttagaaccttaatactcgcgccaacgcgagttgtcgcggctgaaatggaggaagcacttcggggactaccaatacggtatcaaactccggcaattaaggcggaacatactgggcgagaaattgtagatttaatgtgtcacgcgaccttcacaatgcgactcttgtcaccggtgcgtgtcccaaattataatttgattattatggatgaagctcattttacggaccctgcctcaatagcagcaagaggttacatatccaccagagtagagatgggagaggcagccggtatatttatgaccgctacaccgccaggcagccgagacccattccctcaatcgaatgcaccaattatggatgaagaacgagaaatacccgaacggtcatggaactctggacacgaatgggtaactgactttaaaggaaaaacagtatggttcgtcccgtccattaaggctggaaacgacatagctgcctgtttacgaaagaatggcaagaaagtgatccaactgtccagaaaaactttcgatagcgaatatgtcaaaactagggccaacgattgggactttgtcgtaacaacagatatttcagaaatgggagcgaacttcaaggcagaaagggtaatagatcctagacgttgtatgaaacccgtaatccttacggatggcgaagaaagagtaatattagctgggccaatgcctgtcactcactcaagcgcagcccaacgtcgcggaagaatcggcaggaatccgaagaatgaaaatgaccaatacatctacatgggagaaccactcgaaaatgatgaagattgtgcccattggaaagaggcaaagatgttattagacaatataaatactccagagggcataatacctagtatgtttgaaccggaaagagaaaaagtagatgccattgatggggaatatcgattgagaggtgaagcgaggaaaactttcgtcgatttaatgaggcgcggagacttaccagtttggcttgcatataaggtggccgctgagggaataaattatgccgatcgcaaatggtgcttcgatggcataaagaacaaccaaattttagaagaaaacgttgaagtagagatttggacaaaagagggcgaacgtaagaaattgaaacctcggtggctagatgcccgcatctactctgacccactagcgttaaaagaatttaaagaatttgcggcaggaagaaaatctttaacactcaatttaataacagagatgggaaggttaccaactttcatgacacagaaggcaaggaatgcactagataatctcgcagtactgcacactgctgaggctggaggacgagcatataatcatgctttgagcgaactaccggaaaccctagaaacactactgttgttaactcttttagcaactgtgactggcgggatatttttatttctaatgtccggaaaaggcattggaaaaatgacgttaggcatgtgctgtattataaccgcttcggttctactgtggtatgcgcaaattcaaccccactggattgcggcttcaatcattcttgaatttttccttattgttctacttatacctgaaccggaaaaacaacgaacaccacaagataaccaacttacgtacgtagttatagccatattaactgtagttgccgcaactatggccaacgaaatgggattccttgagaaaactaagaaagatctagggttggggagtataacaacgcaggaatctgaaagtaacatattagatatagaccttagacccgcaagtgcgtggacgttgtacgcggtagcaacgacttttgtaacacctatgttaagacatagcatagaaaactcgtcagtcaatgtttcactaaccgccattgcaaaccaagccacggtcttaatgggtttggggaaaggatggcccctttctaagatggacataggcgtacctcttttagctattggatgttattctcaagtaaacccgattacgctaactgcagcattattactgctggtcgcccactatgcaataataggacctgggttacaagcaaaagctacacgagaggcccagaaaagggccgcagcgggcataatgaaaaatcctaccgttgacggaataacagttatagatctggagccaataccttatgacccgaaatttgaaaagcaacttggacaagttatgttattaatattatgtgtaacgcaagtactcatgatgagaactacttgggcgttatgtgaagctctaactcttgcaacagggccaataagtacgctatgggagggtaatccgggccgattctggaacacaacaatcgcagtttcgatggcaaatatatttcggggatcatacctcgcaggagccggtctactatttagcatcatgaagaatacgactaatacacgaagaggaacgggaaacattggcgaaacgctaggagaaaagtggaaaagcagactaaacgcattgggaaaaagtgagttccaaatatataaaaagtctggcattcaagaagtagataggaccctcgcaaaagaaggtataaaaagaggggagacagaccaccacgcagtcagccgagggagtgcaaagctgagatggtttgtagagaggaatatggtcacaccagagggcaaggtcgtcgacttaggctgcggaagaggtggatggagttactattgtggtggattgaaaaatgtaagggaagtaaaagggctaacaaaagggggacccggtcatgaagaacccattcccatgagcacatatggatggaatttagtgcgattacaaagcggtgtagatgtatttttcacacctccagagaaatgtgatactttattatgcgatataggcgagtcaagccccaacccaacaatagaagccggcagaactctaagagtcttaaaccttgttgagaactggttaaacaacaatacgcaattttgcatcaaagtattaaacccatatatgccgtcggttattgagaaaatggaaacactgcaaaggaaatacggaggtgcgttagtacgtaaccccttgagccgtaattcaacacatgaaatgtattgggtgagtaatgccacaggaaacattgtatcctcagtaaatatgatctcaagaatgttgatcaacagatttacaatgaaacataagaaagcgacatatgagcctgacgtcgacttgggtagcgggacgagaaatatcggtatagaaagtgagatccccaacctcgatatcataggaaaaagaatcgagaagataaaacaggaacatgagacttcttggcattatgatcaagatcacccttacaagacatgggcgtatcacggtagttatgaaacaaagcaaacaggaagcgcttcgtctatggtaaatggcgttgtgaggctactcacaaaaccctgggacgtcgtccctatggttacccagatggcaatgactgacacaacgccttttggacaacagagggtttttaaagagaaagtcgatacaagaactcaagaaccaaaggaaggaacaaaacgtttaatgcgcatcacggctgaatggctatggaaagagttaggaaagaagaaaacaccacgaatgtgtacccgagaagaatttacacgaaaagtaaggagtaatgctgcactaggtgcgattttcacagacgaaaataaatggaaatcagctcgcgaagcagtagaagatggtcgtttctgggagctagtggataaagaacgtaatctacatttggaaggtaaatgtgaaacgtgcgtctataatatgatgggtaaacgcgagaagaaattgggtgaatttggcaaggcaaagggttctagagcaatatggtatatgtggctaggtgcacggtttctagaatttgaggcattggggttcctaaacgaagatcactggttctctcgcggcaacagtctaagtggagtagagggcgaaggattgcaccgtctaggatacattttacgtgatgtcggaaagaaagagggtggtgcaatgtatgcggatgacacagcgggatgggacacacgcataacgttagaagatctcaaaaacgaagaaatggtcacgaaccatatgaagggtgaacataagaaactagcggaggcaatatttaaattaacatatcaaatcaaagtagtgcgagttcaacgtccaacccccaggggcactgtaatggacataatttctcgaagggatcaaagaggatctggacaagtcggaacttatggacttaatacttttacgaacatggaagcacagttaataaggcaaatggaaggggaaggaatcttcaagtcaatacaacatttgaccgccactgaggagattgcggtccaaaactggttagctcgagtaggacgtgaaagattatcacggatggccataagtggagacgactgtgtagttaaacccatcgatgacaggttcgcttcagctctaacagccctaaacgatatgggaaaagttcgtaaagatattcaacaatgggaacccagccgtggatggaatgactggacacaagtaccgttctgctcacatcacttccatgaattagtcatgaaagatggaagagttttagttgtaccatgtagaaatcaagatgagctaatcggtagagctagaatatctcaaggagcgggatggagtctaaaggagacagcttgtctagggaaatcgtacgcacagatgtggacattaatgtatttccacagaagggacctcaggctagccgctaacgccatctgttcagccgttccttcgcactgggttcccacatccaggaccacttggtcaatacatgcgaaacacgaatggatgactaccgaagacatgctagcggtatggaaccgtgtatggatccaagagaacccatggatggaagacaaaacaccagtcgaaagttgggaagaggttccttatcttgggaaaagagaagatcaatggtgcggttcacttataggtctaacatcaagagcgacatgggccaaaaatattcagacggcaataaatcaagtaagatcgttaattggtaatgaggagtatacagattatatgccaagcatgaaaagattccgtcgggaagaagaggaagcaggagtattgtggtag

SEQ ID NO: 22644 - RNA, 9876 nt, synthetic construct
  misc_feature 1..9876: note = derived and/or modified CDS sequence (opt6) from DENV-2__EU687220__SS-prME
  source 1..9876: mol_type = other RNA
acagctggagtaattatcatgttaatacccactgctatggcatttcacctgacgacgagaaatggagaaccgcatatgatcgtagggcgacaggaaaaagggaaaagtttacttttcaaaacggaagatggtgtcaacatgtgtacactaatggcaatagacttaggtgaattatgcgaagatacaattacttataaatgtcctctactaagacagaatgaaccggaagatatcgattgctggtgtaattctacatctacatgggtgacatacggtacttgtacaacaacaggagaacaccgccgggaaaaacgatcagtagcactggtcccgcacgttggtatggggcttgaaacacgaactgaaacttggatgagttccgaaggagcttggaaacacgtgcaacgtattgaaacatggatattgagacatccaggattcgcaatcatggcagccattttagcttacaccattggtacaacacattttcaaaaagctctcatattcatattactaactgcagtagcaccatcaatgactatgagatgcattggcatatctaatcgagatttcgtggaaggcgtttccggcggaagttgggttgatatcgtactagaacacggaagttgcgtcactacaatggccaaaaataaacctacattagacttcgaactcataaaaacggaagcaaaacaacccgcaactcttagaaaatattgtatagaagccaaactcacgaatactacaacagaatcgaggtgtccaacacaaggagaaccatccctaaacgaggaacaagataaaagatttatatgcaaacacagtatggtcgaccggggttggggaaacggatgcggtctattcgggaaaggtgggatagtcacctgtgcaatgtttacatgtaagaaaaacatggagggcaaagttgtcttaccagagaatttagaatatacaatcgttataacccctcacagcggcgaagaacatgctgttgggaacgatacggggaaacacggtaaagaaataaaaattacacctcagtcctcaataacagaggcagaactaaccgggtatgggaccgtaacaatggaatgctctccccggacaggcttagattttaacgaaatggtactattacaaatggaagagaaagcatggctagttcatagacaatggttcttagatctgccactaccatggctacctggcgcagatacacaggggtccaattggatacaaaaagaaacacttgtcacttttaaaaaccctcatgcgaagaaacaggacgtagttgtattagggtctcaagaaggtgccatgcatactgcactgaccggcgccacggaaatccaaatgtcaagtggtaacctcctctttacaggacatctaaaatgccgattaagaatggataaattacaattaaaaggaatgtcttatagtatgtgtaccgggaaatttaaaatagtcaaagaaatagcagaaacgcaacatggaacaatcgtaatacgagttcaatatgaaggcgacggatcaccatgtaaaattccctttgaaatcatggatctggaaaaacgccatgtacttggaagactaatcacagtaaatccaattgtaaccgagaaggattcgcccataaatatcgaagcagagcctccatttggcgatagttatattataatcggggtcgagccgggacaactaaaactaaactggttcaaaaagggtagcagtataggacaaatgtttgagaccacgatgagaggtgcaaaaaggatggccatattaggcgatacggcttgggatttcgggagtttaggaggcgtctttacaagtatcggcaaagcactacatcaagttttcggtgctatatacggtgctgccttttcgggagtatcgtggacaatgaagatactaataggtgtaataattacatggattggaatgaactccaggagtacgtctctatctgtttcattggtcttagttggagttgtaacattatatctaggagcaatggttcaggcggacagtggatgtgtggtttcttggaaaaacaaagaattaaaatgtgggtctgggatatttataaccgataatgtacatacatggacggaacaatataagtttcagcctgagagtccttcaaagctagcgtcggcaatacagaaagcacacgaggaagggatatgtggaatacgatcagtcactagattagagaatctcatgtggaagcaaattactccagaattgaaccatatactatccgagaatgaagtgaagctgaccatcatgaccggagatataaaaggaataatgcaagctggaaaaaggagtctaagaccgcaacctaccgaactgaaatattcttggaaaacttgggggaaagcgaagatgttatctactgaatcacataaccaaacgtttttaattgatgggccagaaacagctgagtgccccaatacgaatagagcctggaactccttagaagtagaagactatggatttggcgtattttcaactaatatatggttgaaactacgtgaaaaacaagatgtattttgtgatagtaagttaatgagcgcagcaataaaagacaatcgagcagtccatgcagatatgggctattggatagaatcggcacttaacgatacatggaagatggaaaaagcatccttcatagaggtaaagtcctgccactggccaaaatcacacacactatggtcaaacggagttttggaatcagaaatgatcattcctaaaaacttcgccggcccagtttcccaacataactatagaccagggtatcatacccagactgcggggccctggcatctagggaaattagaaatggattttgatttttgcgaagggacgacagtggtagtaactgaggactgcggcaatcgaggaccttccctaagaaccactactgcttcaggaaaattaatcacagaatggtgctgcagatcatgcacattgccaccattaaggtaccgaggagaagatggttgctggtatgggatggagatccgacctcttaaagagaaagaagaaaatttagttaatagcctagtcacagctggacatggacaaatcgataacttttcattaggggttttgggaatggcactattcctagaagaaatgcttcgtactagggtcggaacaaaacacgcgatactattagttgcagttagtttcgttacattgataacagggaatatgtctttcagagatcttggtcgagtgatggttatggtgggtgcgacgatgaccgacgatattgggatgggagtcacctacttagctttattagcagcatttaaagtgcgtccaacgtttgcagccggtctattgctcagaaaattaacctcaaaggagttgatgatggcaacaatcggcatagcattactgagtcaatcgacaatacctgaaactatcttggaattgacagatgctttggcattggggatgatggtactcaaaatagtccgaaatatggaaaaatatcaattggcagtaaccattatggcgatatcatgtgtacccaatgccgtaatactattaaatgcttggaaagttagttgcacaattctagcggcagtgtcagttagtccattattactgacatcaagtcaacaaaaagctgattggatcccattggcgttaacgattaagggattaaaccctacggctatatttctaacaacgctctctagaacaagtaagaaacgttcatggccattgaacgaagctgtcatggcagtgggtatggtatcaattttggcgtccagtttacttaaaaatgatatacctatgactgggccattggtcgcgggaggcctactaactgtttgttatgtactaaccggtagaagcgctgacttagaactcgaacgtgctgctgatgtcaagtgggaagatcatgcagaaatcagcggatctagtccaatcttatccatcacgataagtgaagacgggagcatgagcatcaagaatgaggaagaggaacaaacattgacgatattaatacggaccgggttgctagtaatttcaggagttttccccgtgagtatacctatcacagcagcagcttggtacctatgggaagtgaagaaacaacgagccggtgtactatgggatgtcccatcgccaccaccagtaggaaaagccgaactcgaagatggggcctacagaataaaacaaagaggcatcttaggatatagccaaataggtgctggcgtctataaagaaggaaccttccatactatgtggcatgttactagaggggctgtattaatgcaccgcggcaaaaggatagaaccctcatgggccgacgtcaagaaagatctgatatcgtacggcggtggttggaaactggaaggcgaatggaaggaaggtgaggaagtgcaagtacttgcactggagccaggcaaaaatcctagggccgtacaaacaaaaccgggcctatttaaaacaaatacgggaacaatcggagccgtaagtttagatttttcacccggtacatctggatctcctatcgtggaccgcaaaggtaaggttgtaggattgtatgggaacggagtcgttacacgttcaggagcatatgtttcagccatagctcaaacagaaaaatctatagaagacaaccctgaaatagaagacgatatattcagaaagaaaaggctaaccataatggacttacaccctggagcgggaaaaacgaaacgatacctcccagccatagtacgcgaagctataaaaagaggattaagaaccttgatattagcaccgacgagagttgtagctgcagaaatggaagaggcattgcgcggcttaccaataagatatcaaacaccggccataagagccgagcacacaggaagagaaatcgttgatctcatgtgccatgccacattcacaatgagactacttagcccggtccgggttccaaattataatttgattattatggacgaagcccattttacggatcccgcttcaattgccgccaggggttatatatcgacacgtgttgagatgggagaggcagccggtatatttatgacggcaactccaccaggatctagggacccattcccgcaatcgaatgctcctattatggacgaagaaagagaaatccctgaaaggtcatggaatagtggacatgaatgggtaacagatttcaaaggtaagacggtatggttcgttccttcgatcaaggcggggaacgatatagccgcgtgtctaaggaaaaacggcaagaaagtaatccaattatcacgaaaaactttcgatagcgaatatgtcaaaacccgtgccaacgattgggatttcgtagtgactacagatatatcagagatgggagcaaactttagagctgaacgtgttatagacccacgtagatgtatgaaacccgtaatattgacagatggtgaagaacgtgtaatattagcggggcccatgccagtaactcatagtagcgccgctcagagacgtggaaggatcggtagaaacccaaagaacgaaaatgaccaatacatttatatgggagaaccgctagagaacgacgaagactgtgctcattggaaagaagcgaaaatgctactggacaacataaacactcctgaaggtataataccatcaatgtttgaaccagaaagagagaaagtcgatgcaattgacggtgaatatcggttgaggggagaagcacgcaaaacttttgtggacttaatgagacgaggtgacctcccagtttggttggcatatcgagtagctgcagaaggaatcaactacgcagatcggcgctggtgtttcgacggaataaagaacaatcagattcttgaagaaaacgtagaggtagagatatggacgaaagaaggggaaagaaagaagttaaagcctcggtggctagacgcccgaatatactcggatcctcttgctctgaaagagtttaaagagttcgcagccgggcgaaaaagtttaacgcttaacctgattacagaaatgggtagattacccacctttatgacacaaaaagcaagagacgcactcgacaatctagcggtcttacatactgcggaagctggagggagagcttataaccatgctttatcagaattaccagagacacttgagacccttttgttgctgactctacttgctacggttaccggcgggatattcctattcttgatgtccgggaaggggattggaaaaatgacgcttgggatgtgctgtataataacggcgtcgatattattgtggtacgcacaaatacagccccactggatagcagctagtataatattggaatttttcctaattgtcctactcataccagaaccagaaaaacaacgcactccgcaagacaatcaactaacatacgtcgttattgcaatattaacggtagttgcggccacaatggcgaacgagatggggttcctagagaaaaccaagaaagacctcggattgggatccattaccacccaggaaagcgaaagtaacattttagacattgatttacgcccagcatctgcatggactttatacgcagtggcaacgacatttgtgacaccaatgttacgccattcaatagaaaatagctcggtcaacgtatccttaacagccatagctaatcaagcaaccgttcttatggggctaggaaagggctggccattaagcaaaatggatattggagtacccctattggcaataggatgctactcacaagtcaacccaatcactttgacagcagcattattactcctagtagcacattacgccattataggaccaggtctacaggcgaaagcaactagagaagcacaaaaacgtgcggccgcagggataatgaaaaatccaaccgtcgatggaatcaccgtcatagatttagagccaataccttatgacccgaaatttgaaaagcaacttggacaagtcatgcttctaattttgtgcgttactcaagtactgatgatgaggacaacttgggccctttgcgaagccctcacacttgcaactggaccgatatcaacactttgggaaggtaaccccggacgattctggaacacaaccatagctgtaagtatggcaaatatttttagaggatcatatctagcaggagcagggttattattcagcattatgaagaatactacaaacacgagaagaggaactggaaacataggagaaacacttggagagaagtggaaaagcaggttaaacgctctaggcaaatcagaatttcaaatatataagaaaagcggaatacaagaggtcgataggaccctagcaaaagaggggataaagaggggagaaacggaccatcacgctgtgagcagaggttcggcaaaattaagatggtttgtagaacgaaacatggtaaccccagaaggtaaagtagttgatttaggctgtggaagaggagggtggtcatattattgtggtggccttaagaacgttcgggaagtaaaaggacttaccaaaggcggacccggccatgaagaaccaatccccatgtcgacttatggctggaacctagtccgattacaaagtggggtcgatgttttcttcactccgcccgaaaaatgtgacacacttctttgtgatataggtgaatcgtcacctaaccccactatcgaagcgggtagaactttacgagtgttaaatcttgtagagaattggttaaacaataatacgcaattttgcataaaagtgctaaacccttatatgccatccgttattgaaaagatggaaacacttcaacgaaaatacggtggagctcttgtaagaaatcccttgagtagaaactcaactcatgagatgtattgggtgtcaaatgcgactggcaacattgtatcaagcgtaaatatgatctcaaggatgttaataaaccgatttacaatgaaacacaagaaagctacttatgaacccgacgtagatttaggatccggaacgcgtaatattggaatagaatcagagataccaaatcttgacataataggaaaaaggatagaaaagatcaaacaagaacacgaaacctcatggcactatgatcaagatcatccttataaaacctgggcctatcacggttcatacgaaactaaacagacaggtagtgcgtcatcaatggtgaatggtgtagtacgtttactgactaaaccatgggacgttgtacctatggtcacacagatggcgatgaccgataccacaccattcggccaacaaagagtatttaaagaaaaagttgatactagaacgcaagaacccaaggaaggaacgaagaaactaatgagaataacagctgaatggctttggaaagagcttggtaagaagaaaactccccgaatgtgcactcgagaagagttcacaagaaaagtgagaagtaatgcagcattaggtgcaatatttaccgacgaaaacaagtggaaaagtgcgagagaagcagtcgaagattctcgcttctgggaacttgtagatcgtgagaggaacctgcatctagaaggtaagtgtgagacttgtgtatacaacatgatgggaaagagagagaagaaactcggtgaatttggtaaagctaaaggaagtagagccatatggtacatgtggcttggagccagattcttggagttcgaagctctgggatttttaaatgaagatcactggttctcacgcggaaattctttatctggggtagagggagagggacttcaccgacttggttacatacttagagatgtctcgaagaaagaaggaggcgccatgtatgcagacgatacggcgggatgggatactcgcatcacattggaagatttgaaaaatgaagaaatggtcactaatcatatgaaaggagaacataagaaattagctgaggcgatatttaaactaacctatcaaaataaggtagtccgggtccaaagaccaacccccagaggaacagttatggacatcatcagcagaagggaccaaagaggaagcggtcaagtcggtacatatgggctaaacaccttcactaatatggaagcgcagctaattaggcaaatggagggagaaggaatatttaagtctatacagcatttaacggtcacggaagagattgccgtccaaaattggctagttagagtaggaagggaacgattatcaaggatggctatatctggtgacgattgcgtcgtaaaaccactcgatgacagatttgcatcagccttaaccgctctgaatgacatgggaaaagttcgcaaagacattcaacaatgggaaccttctcgaggatggaatgactggacacaagtgccattctgttcacatcactttcatgagttggtcatgaaggatggtagagtcttagtggtaccatgtagaaatcaggatgaattaatcggccgtgcccgtatatcacagggtgctggctggtcgctgaaagagacagcgtgtttgggcaaatcgtatgcacaaatgtggacgttaatgtattttcataggcgagacctacgattagcagcgaacgctatatgctctgcagtaccatcacattgggtacccacatccaggacaacctggagtattcatgctaaacacgagtggatgacaacagaggacatgctcgccgtctggaatcgcgtatggatccaagagaatccctggatggaggacaagacgccagttgaatcgtgggaagaagtgccatatctaggtaaaagagaagatcaatggtgtggttcacttatcggcttgaccagtcgtgccacttgggctaaaaacatacaaaccgcaatcaatcaggtcagatccttaatcgggaatgaggaatataccgactatatgccatcgatgaagagatttagaagggaagaagaggaggccggagtactttggtaa

SEQ ID NO: 22645 - RNA, 9876 nt, synthetic construct
  misc_feature 1..9876: note = derived and/or modified CDS sequence (opt6) from DENV-2__EU726775__SS-prME
  source 1..9876: mol_type = other RNA
actgcgggtgtaattgttatgctgattcccacggcaatggcgtttcatttaaccacacgtaatggggaaccacatatgatagtggggaggcaggaaaaaggaaaatctttactctttaaaacagaagatggagtaaacatgtgcacattgatggctatagacttgggggaactatgtgaagacaccattacgtataaatgtccgttgctgaggcaaaacgaaccggaagacatagattgctggtgtaactcgacatcaacgtgggtaacctacggaacttgtacaactactggagaacataggagagagaaaaggtctgtcgcattagtaccacacgtaggaatgggattggaaaccaggacagaaacttggatgagctctgaaggagcgtggaaacacgttcaacgaattgaaacttggattctcagacatccaggtttcaccattatggcagcaatactagcttatactatagggacaacccattttcaaagggcattgatatttatattattaaccgcggtagctccatcaatgacaatgcgctgtataggaataagcaaccgagacttcgttgaaggagtatctggtggaagctgggttgacatagtactggaacacggatcctgcgtcaccacaatggccaaaaataaacctacacttgatttcgaattaataaaaacagaagcaaaacaaccagcaacactgagaaaatattgtatagaagcaaaattaaccaacacaacgactgagtctcgttgtccaacacaaggtgaacccagtctgaatgaagaacaagacaaaagattcatttgtaaacactcaatggtggatagaggttggggaaacggatgcggtttatttggaaaaggagggatcgtcacatgcgcaatgttcacttgtaagaaaaatatggagggtaaagtggttcagcccgaaaacttagaatacacaattgtaattacgccccattcgggtgaagaacacgcagtcggcaacgatacgggaaaacacggaaaagaaattaaaataactccacaaagttcaatcacggaagcagaattgactggttatggaactgtaacgatggaatgctcccctcggacaggattagactttaatgagatggtcttactacaaatggaagacaaagcctggttagttcatcgccagtggttcctagacttgcccttaccatggttgccaggtgctgatacacaaggttcgaactggatccagaaagagacactcgtaactttcaaaaaccctcatgctaagaaacaagatgttgtagtactaggctcccaagagggagcaatgcacactgcattaacgggggccacagaaatccaaatgtctagtggcaatttgttatttacaggacatttgaaatgtagattgcgtatggacaaattacaactgaaaggcatgagttactcaatgtgcacagggaaatttaaaattgttaaagaaatagcagagacacaacacggaacaattgtgatacgagtgcagtatgaaggagatggaagtccctgtaaaatcccattcgagataacggacctagaaaaacgacacgtcctaggtagattaatcacagttaatccgatagtaacagaaaaagactccccagtcaatatagaagcagaacctccatttggagattcttatatcataataggagttgaaccaggacaacttaaactcaattggttcaaaaagggttcaagtataggccaaatgtttgagaccactatgcgcggcgcaaaaagaatggcaatattaggcgatacggcttgggacttcggaagtttaggaggcgtgttcacaagcataggtaaagcgctacatcaggtatttggggctatatatggggctgcgtttagcggagtgagttggactatgaaaattttaattggagtcatcatcacgtggattggaatgaactcgagaagcacatcattgagcgtctctctcgtcttagttggtgttgttacattgtatctcggagccatggtacaagcggacagtggatgcgttgtatcctggaaaaacaaagaacttaaatgcggttcaggaattttcataactgataacgtgcatacgtggacggaacaatataaattccaaccagaaagtccatctaaactagcctctgctattcaaaaagctcacgaggaaggaatatgcggaataaggtctgtaacacgacttgaaaatcttatgtggaaacaaattacacctgaattaaatcacattttaagtgaaaatgaagttaaactaacaataatgacaggagatatcaagggaataatgcaagctggaaaaaggagtctaagaccgcaaccaacagaattgaaatatagttggaaaacgtggggcaaagccaaaatgttaagcacggagtctcacaaccaaacgtttctaattgacggtccagagacggcagaatgtcctaataccaatcgggcatggaatagtttagaagtagaggactatggctttggagtgtttaccacaaatatatggcttaaactaagagaaaagcaagatgtattctgtgactctaaactcatgagtgctgctattaaagataatagagcagtgcatgccgacatgggatattggatagaatcagcattaaatgacacatggaaaatggaaaaggctagctttattgaggttaagtcctgccattggccaaaatcacatactctttggagcaatggcgtcctggaaagtgaaatgattattccgaagaacttcgcaggcccagtttcacaacacaattatagacctggataccacacgcaaactgctggaccttggcacctgggcaaactcgaaatggatttcgatttctgtgagggaactacagtagtggttacagaagattgtggtaaccgtggtccaagtcttaggacgacaacggcatcaggtaaactcatcaccgaatggtgttgtcgtagttgtacgttgccaccccttaggtacagaggggaagacgggtgttggtacggaatggaaattcgtccattaaaggagaaggaagagaacttagtaaatagcttagtgacagcagggcacggccaaatcgataatttttcattaggagtcttaggcatggctttgttcttagaggaaatgcttcggaccagggtcggaaccaaacatgcgatactgcttgttgcggtatctttcgtgactttaataacgggcaatatgtcatttagggacctagggagagtaatggttatggtcggggcgacaatgacagatgacataggtatgggtgttacctatctggcgttactagctgcatttaaagtcaggcctacattcgccgcaggcttactattgcgaaaattgacctccaaggagctaatgatggccacaataggtattgcgctactgtcccaaagcaccattcctgaaaccatcctagaattaacagacgccttagctctgggtatgatggttctcaagatagtaagaaacatggaaaaatatcagctagccgtaacgatcatggcgatcagttgcgttccgaacgcagttattctacagaatgcctggaaagttagttgtacaattctcgcggcagtaagtgtcagccctctgcttctaacaagcagtcagcagaaagccgattggataccgttggcactaacgattaagggcttaaacccaacagcaatatttttaactactttgtcccgcacatctaaaaagcgaagttggccgctcaacgaggcgatcatggcggtcggaatggtatcaatactggcttcctctttactcaaaaacgacataccaatgaccggacctttggtagccggcggacttttaacagtgtgctatgttttaactggtcgatccgcggacttagaacttgaaagagcggcagatgtgaagtgggaagaccaagctgaaatcagtggttcttctccaatacttagtatcaccatatcagaggacggaagtatgagtatcaaaaacgaggaagaagaacaaacattaaccatcttgataagaaccgggctattagtaattagcggagtatttcccgtctctattccaattacggcggcagcctggtatctatgggaagttaagaagcaacgagctggggttttatgggatgttccatccccgccaccagttgggaaggcagaactggaagatggcgcatataggataaaacaacgaggcatcctgggatattctcaaataggggccggggtgtataaagaaggaactttccacacaatgtggcatgttacaagaggggccgttctaatgcatagaggaaaaaggatagaacctagttgggcggatgtgaagaaagacctaatttcgtatggaggcggttggaaacttgaaggtgaatggaaggaaggcgaagaagtgcaggtcctagcgttagaaccaggaaagaatccacgagcagtacaaacaaagccaggtatatttcggaccaatactggtacaataggtgccatttcgcttgatttctcaccggggacatcgggttctccaattgtagacaggaaaggcaaagtagttggtttatatggcaacggtgtagtgacgagatcgggtgcatacgtgagcgcaatagcacaaactgaaaaatcaatagaagataacccggaaatagaagatgatatttttagaaagaaacgacttactataatggacttacaccctggtgccggcaaaacaaagagatacctaccagcaattgtaagagaggctattaaaagaggcctaagaacactaatattggcaccaacacgggtggtagcagcggaaatggaagaagcattaagaggattaccaatcagatatcaaacgcctgcaattaaggctgagcatacgggaagagaaattgttgacctaatgtgtcacgcaacttttacgatgcgattactatcaccggtaagagttccaaattataatcttataattatggatgaagcgcatttcacagaccctgcttctattgcagcgcgagggtacatatctacgcgtgtcgaaatgggtgaagctgcagggatttttatgacagctacgccacccggtagtagagatccgttcccacaatcgaatgcaccaattatggacgaggaacgtgaaataccagaacgatcatggaacagtggtcatgaatgggtaacagattttaagggcaagactgtatggttcgtaccctctataaaggccggtaacgatatcgcggcctgcctaagaaagaatggtaaaaaggtaatacaactaagccggaaaactttcgatagtgaatacgtaaaaacaagagccaacgactgggattttgtcgtaactactgacattagtgaaatgggagcaaattttaaagcggaacgagtgatagatcctaggagatgcatgaaacccgtaatcttaaccgacggagaggaaagagttatattggcagggcctatgcctgtgacacactcatcagctgcacaacgaagaggccgcataggccgcaatcccaaaaatgagaatgatcaatacatttatatgggtgaaccattggaaaacgatgaggattgtgctcattggaaggaggcaaaaatgcttctcgataatattaatacaccagaagggattattccaagcatgtttgaaccagagcgtgagaaagttgacgcgatagatggagaatatcggcttagaggtgaagcaagaaaaactttcgtagatttaatgagaagaggcgacctgcctgtatggctagcatataaagtagctgctgaaggaataaattacgcggatcgtaaatggtgtttcgatgggatcaaaaataatcaaattttagaggaaaacgttgaggtagaaatttggactaaggagggagaacggaagaaactaaaaccgcgttggctagacgctcggatatactctgatccattggcattgaaagaatttaaagagttcgccgctggcagaaaatctctaacgctaaacttaataacagagatgggaagactcccaacatttatgactcaaaaagctagaaacgctctcgacaacttagcggtattgcacacagcagaagcgggaggaagggcgtacaaccatgcattgtctgaattgccggaaacattagaaactctacttttattaactctccttgctacagtgactgggggtatatttttatttttaatgtctgggaaaggaatcggaaaaatgacactaggaatgtgttgcattataacagctagcatcttattatggtacgcccaaatccaaccacactggatagcagccagtataatactagagttcttcctaatagtactattaataccagaaccagaaaagcagcgtacaccccaagataatcaactaacatatgtagtaatagccatattaactgttgtagctgcaacgatggcaaacgagatgggttttctagagaaaactaagaaagatttaggtctgggtagtataaccacccaagaatcagaatcaaatatcttagatattgatcttcgtccagcctcggcttggacactgtatgctgtggcaactacgtttgtaacgccaatgctacgccatagcatagaaaatagttcggtaaatgtatcactgacagcaatagcaaaccaagcaacggtattgatgggattaggaaagggatggcccctcagcaaaatggatatcggagtacctttactagccattggctgttactctcaagtcaatccgataactctcacagcagcattacttcttctagtggcgcactacgctatcattggtccaggtctacaagctaaggctactagagaagcccaaaagagagcagccgcgggtataatgaaaaatcccactgtcgacgggataacagttatagacctagaacccattccttacgacccaaaatttgagaaacaactgggacaagtcatgttgttaatactatgtgttacacaagtcctcatgatgagaaccacatgggcgctatgtgaagcactaacactcgccactggcccaatctcaacactatgggaaggtaatccagggaggttctggaacacaacgatagctgtgtccatggccaatatctttagaggtagttacttggctggggccggcttactcttttcaatcatgaaaaatacgacaaacacgagacgaggaactggaaatattggagaaaccctcggcgagaagtggaagtcacgactcaacgcacttgggaaaagtgagttccaaatttataagaaaagtgggattcaagaagtggatcgaacactagcgaaagaaggtataaagcgaggagagacagatcatcatgccgtatcgagaggaagtgccaaactaagatggtttgtggaacggaatatggtcacgcctgaaggaaaagtggtcgatttaggatgtggccggggtggctggtcatattattgtggcggtctcaaaaatgttagggaggtaaaaggacttactaaaggaggacccggccacgaagaaccaatcccgatgagtacatacggctggaacttggttaggctgcaaagtggggtggatgtcttctttactccaccagaaaaatgcgatactttattatgtgacatcggcgaaagttccccgaaccctacaatagaggcaggtcgtactctacgagttttaaacctagttgagaattggttaaataataatactcagttttgcataaaggtattaaatccatatatgccctctgtaattgagaaaatggagactttgcagcgcaagtatgggggagcgctagtaagaaatccactttcgagaaattcaacacatgagatgtattgggtatctaacgcaactggcaatattgtatcttcagtgaacatgatatcccgaatgcttatcaatagattcaccatgaagcataagaaagctacctacgagcctgacgtcgaccttggttctggcacgcgcaatataggcattgaatcagagataccaaatttagacatcattggtaaaaggatagaaaagataaagcaagaacatgaaacatcgtggcattacgaccaagatcacccttacaaaacctgggcatatcatggttcatacgagacgaaacaaacggggtcagcaagctcaatggtaaacggagttgtaagacttttaacgaagccctgggatgtagtacctatggtaacgcagatggcaatgacagatacaacaccgtttggtcaacaacgagtatttaaggaaaaagtagatactagaactcaagagccaaaagagggaacgaagaaactaatgaaaattactgcagaatggctttggaaggaattggggaagaagaaaactccacgtatgtgtacacgcgaagaatttaccagaaaagttaggagcaatgcagctctaggtgcaattttcacagatgaaaataagtggaaatcggcccgagaagcagtagaagacggtcgtttttgggaattagtagatcgtgaaagaaatttacatttagagggaaagtgcgaaacctgcgtttataatatgatggggaagcgagagaagaaacttggggagttcgggaaagctaaaggctcaagagcaatttggtatatgtggctcggcgctagattcctagaatttgaggcactagggtttcttaatgaagaccattggttcagtaggggcaatagtttatcaggagtagaaggagaagggttgcatcgtttaggatacatactcagggacgtagggaagaaagaaggtggagcaatgtacgccgatgacacggcaggatgggatacccgaatcactttagaggacctcaaaaatgaagaaatggtaactaatcacatgaaaggagaacataaaaagttagccgaagctatatttaaactaacatatcagaacaaagtagtacgtgtccaacgtccaacacccagaggaacggttatggatatcataagccgacgggaccaacgaggaagcgggcaggtaggcacatatgggcttaatacgtttacaaacatggaagcacagcttataagacagatggagggtgaaggaatatttaggtcaatacaacatttaacggctacagaggaaattgcagtgcaaaattggctagcaagagtagggagagaaagattaagtaggatggccatatccggagatgactgtgttgttaagccaatagacgatagattcgcatctgctttaactgcactaaatgatatgggaaaggtaagaaaggacatacaacaatgggagccaagcaggggctggaacgactggacgcaagtaccgttttgcagtcatcatttccacgagttagttatgaaagatggaagagtacttgttgtgccatgtagaaatcaagacgaactcataggcagagctcgtatatcccagggtgcaggatggagtttaaaggaaacagcctgtctcggaaagtcgtatgcacaaatgtggacactcatgtacttccataggagagatctaagactagccgcaaatgcaatatgctctgcagtaccatctcattgggtaccgacttcacgcacaacttggtccatacacgcaaagcacgagtggatgacaaccgaagacatgttggcagtctggaacagagtgtggatccaggaaaatccgtggatggaagataaaacacccgtagaaagctgggaagaagtaccatacttggggaagcgagaagaccagtggtgcggtagtttgataggcttaacgagtagggcaacatgggccaaaaacattcaaactgcaattaatcaggtacggagcctaataggaaatgaagaatacacagactatatgccatctatgaagaggtttcgccgagaagaggaagaggcgggagtactatggtaa

SEQ ID NO: 22646 - RNA, 9876 nt, synthetic construct
  misc_feature 1..9876: note = derived and/or modified CDS sequence (opt6) from DENV-2__FJ639732__SS-prME
  source 1..9876: mol_type = other RNA
actgcgggtgtaatagttatgctcattcccacagcaatggcattccacctgacaacaaggaatggtgaacctcatatgatcgtaggtcgtcaagaaaaaggaaaatctttgctttttaaaacagaagacggtgttaacatgtgtactttaatggctatagacttaggagaattatgtgaagatacaataacttacaagtgtccattgctacgtcaaaatgaaccagaagatatagattgttggtgtaatagtacaagcacatgggttacatatgggacctgcacaacaactggtgaacatagacgtgaaaaacggtcagtcgccctagtgccccatgtcggtatggggttggaaactcgaacagaaacatggatgagttctgaaggagcatggaaacacgtccaaagaatagaaacatggatattaagacatccagggtttacgattatggcagcaatactagcttataccataggaactacgcacttccagcgcgcgttaatattcatcttattgacagcagtagctccctcaatgaccatgaggtgtattggtatatcgaaccgagattttgtggaaggagtatcaggcggaagctgggtggatattgtgttggaacatggaagctgcgtaacaacaatggccaaaaataaaccaacgctagactttgaactaataaaaacagaagctaaacagccagcgacacttagaaaatattgcattgaagccaagttaactaataccactacagaatcccgttgtcccacacaaggcgaaccttcccttaatgaggaacaagataaacgattcatatgtaaacatagtatggttgacagggggtggggaaatggttgcggactttttggcaaaggaggcatagtcacatgtgcaatgttcacatgtaagaaaaatatggagggaaaggtagtgcagcccgaaaatttagaatatacaatcgtcatcacacctcattctggtgaagaacatgcagtaggcaacgacacaggcaagcacggtaaagaaattaaaataacgccacaaagttctatcactgaagctgaattaacgggctacggtactgtaacaatggaatgcagcccacgaactggcttagattttaatgaaatggtcttactacaaatggaagacaaagcatggctagtacacagacagtggttcctggacctccctttaccgtggttaccgggcgcagatacccagggaagcaattggatacaaaaggaaaccctagttactttcaagaaccctcatgcaaagaaacaggatgtcgttgtattgggttctcaagagggagctatgcataccgcactaactggcgcaactgaaatccaaatgagttctggtaacctattgtttaccggacatctaaaatgcagactcagaatggataaacttcagcttaaaggtatgtcctactcgatgtgcaccggaaaatttaaaatcgtaaaagaaattgctgaaacgcaacacggaacaatagtaatcagagtacaatacgaaggagatggatctccttgtaaaatcccctttgaaattacagacttggaaaaacgacatgttttggggagactaattactgttaatccaattgtaatagaaaaagactcaccagtaaatatcgaagcagaaccaccatttggggacagttatattataataggtgtcgaaccaggccaactaaaacttaattggtttaagaaaggtagttccatcggacagatgtttgagaccacgatgagaggggcaaaaagaatggcgatcttgggagatacagcctgggatttcgggagtttagggggagtttttaccagtataggtaaggcattgcaccaagtatttggagccatttatggtgcagctttctctggtgtgagttggacgatgaaaatactaattggagttgtgatcacatggataggcatgaactctagatcaacaagtttatcagtctccttggtgttggtgggcgtcgtaacactttacttaggtgcaatggttcaagccgactccggctgcgtagtatcgtggaaaaataaagaacttaaatgtggtagcggcattttcataacagacaatgtacacacatggactgaacaatataagtttcagccggaatcaccatctaaacttgcttcagcaatccaaaaagcgcacgaggaaggtatatgtggtataagatcagttactcgtctcgagaatcttatgtggaaacaaataacaccagaattaaatcacattctatctgaaaatgaagttaaacttaccattatgacaggagatacaaagggcatcatgcaagccggcaaaaggagcttgcgcccgcaaccaactgaactaaaatactcatggaaaacatggggaaaggcaaaaatgctttctacagaatcccataatcaaacattcttaatagacggcccagaaacagctgagtgtccaaatactaatcgagcatggaactcattggaagtagaagattacgggttcggtgtgtttacgacgaatatatggttaaaattgagggagaagcaagacgtattttgcgattcaaaattaatgtcagcagcagtgaaagacaatcgagctgtccatgccgatatgggatattggatcgaatccgcattaaatgacacgtggaaaatggagaaggcctcattcatagaagtgaaatcttgtcattggccaaaatcacatactctctggtctaatggcgtccttgaatctgagatgataatacccaaaaattttgctggacctgtctcacaacataattatcgaccaggatatcacacccaaacggcgggaccttggcaccttggtaaactcgagatggattttgatttctgcgaaggaaccacagtagtagtcactgaggattgtggaaatcgaggcccgtcactgcgaactacgacggctagtggcaaattaataacagaatggtgttgtaggtcatgcaccttaccgcccctacgttatagaggcgaagacggctgttggtatgggatggaaataagacccttaaaagagaaagaagaaaatctagtaaactcattagtaactgcaggtcacgggcagatagacaatttctccctaggagtcttagggatggcattattcctagaagaaatgcttagaaccagagtaggaaccaaacatgcgattttactggtagcagtttctttcgtaacactaattaccggtaatatgagctttagggacctcggtcgggttatggtaatggtaggtgcaacgatgacagacgatatcggcatgggagttacgtatctagctctcctggcagcattcaaggtacggccaacttttgcggctggactcctactaaggaaattaacctcaaaggaactcatgatggccactataggcattacactattatcacagagcactatcccagaaactatccttgaattaaccgatgcactagcacttggcatgatggtacttaaaatagtcaggaacatggaaaagtatcaactggcagttacaataatggcaataagctgcgtaccaaacgctgtgatactccgcaatgcatggaaggtctcttgcacaattcttgcagcggtgtcggtgagccctcttctcctaacctcttctcaacagaaggcggactggattccgcttgcactaacgataaaaggactgaacccgacggcgatctttctcacaacactaagcagaacatcaaagaaacgttcctggcctctaaatgaagcaataatggcagttggaatggtcagtatcttggcctcgagtctattgaaaaacgacatcccaatgacagggccattggtagccggtgggttactcaccgtttgctacgtcttaacaggacgaagtgccgacttagaactcgaaagggccgccgacgttaaatgggaagatcaagccgagataagcggttcttcaccaatattgtctattactatatcggaggacggttcaatgtccatcaaaaacgaggaagaagaacagacattgacaatactcatacgcacaggtctcctcgtgattagcggggttttccccgtgagtattcctatcaccgcggcagcgtggtatctatgggaagttaagaaacaacgagccggtgtgctgtgggatgtaccgtcgcccccaccagtaggtaaagcagagctggaggacggagcctacagaatcaaacagagaggtattcttgggtattcccagatcggtgcaggagtttacaaagagggaacctttcacacaatgtggcatgtaacaagaggagcagtattaatgcacagaggcaaaagaatcgaaccttcatgggctgacgttaagaaagatttaataagttatggcggaggctggaaattagagggggaatggaaagaaggtgaagaagtacaagtcttagcgttagagcctggcaaaaatccgagagccgtacaaacgaagccaggtatcttcaaaaccaacactggtactatcggagcggtcagcttggacttttcaccaggtacaagtggaagtcctattgtagatagaaaagggaaggtagttggcttatatgggaacggtgtagttacaaggagtggagcatatgtgtcagctatagctcagacggaaaagtcaatagaagataatccggagatagaagatgatatatttcggaagaaaagacttactattatggaccttcatccaggagctgggaagacaaaaagatatctcccagctatagtgcgcgaagcgataaaaagggggttaaggactttaatcctagcacctaccagagtagtagcagcggaaatggaagaagcacttagaggcttgcctatccgctatcaaaccccggctataaaagcagagcatacaggacgagaaattgtagatctcatgtgtcacgcaacgtttacaatgagactgttatcacccgtcagagtcccaaactacaatttaataattatggatgaggcccattttacagaccccgcgtcaattgcggccagaggctatatatcaacccgagttgagatgggcgaagccgcaggtattttcatgactgctacacccccaggatctcgggacccctttccacagagtaatgcaccaataatggatgaagaacgagagatccccgaacgaagttggaactccggacatgaatgggtaaccgattttaaaggaaaaacggtctggtttgttcccagtatcaaggcggggaatgacatagctgcctgtcttaggaaaaatggtaagaaagtcatacaactttcgagaaagacatttgattccgagtatgtgaaaacaagagctaatgattgggattttgtagtgacaacggacatttcagaaatgggagcaaattttaaagcagaacgcgtcattgatcctagacgttgtatgaaaccagtaattcttactgacggagaagaaagggttatactggcgggacctatgcccgtcacacattccagtgctgcacaaagaagaggcagaataggccgaaatcctaaaaatgaaaacgaccaatacatatatatgggagaacccctagaaaacgatgaagactgtgctcactggaaggaggctaaaatgttgctagacaatatcaacacaccagaaggaataataccgtcaatgtttgagcctgagagggaaaaagtcgacgcaattgacggagaatatagattacgaggagaggctaggaaaacattcgtcgatctcatgagaaggggagacttacctgtatggctcgcttacaaagtcgcagcggaaggaataaattatgctgaccggaaatggtgtttcgatggaattaaaaacaaccaaatactcgaagaaaatgttgaggtagaaatctggaccaaggaaggtgaaaggaagaagctaaaaccgagatggttagacgcgagaatctatagtgatccattagcacttaaggaatttaaagaatttgcagccggtagaaaatcactcacacttaatcttataacagaaatgggcagattaccaacattcatgacacaaaaagctaggaacgccctagataatctggctgttttacacactgcggaggctggaggtagagcgtacaatcatgcactatcagagctacccgaaacattagaaactctcttattactaacattattggcgacagtcacaggtggaatattcctctttttgatgtcgggtaaaggaattggcaaaatgacccttggaatgtgttgtattattacggcaagcgtccttctatggtatgcccaaatccagccacactggatcgccgcatcgataatcttagagttcttcctcatagtattattaattcctgaacctgaaaagcaacggactccacaagataatcagctcacatacgtagtcattgccatcttaacagtcgttgccgctacaatggcaaatgaaatgggattccttgagaaaaccaagaaagatttaggcttaggtagcataaccacacaagaatcagaatctaacatactagatatagatttgaggccggccagtgcttggactctatatgctgtagcaacaacttttgtaactcccatgctaaggcattcgatcgagaacagtagtgtaaacgtaagtcttacggcgatcgcaaatcaagccacagttttgatgggacttggaaagggatggccacttagtaagatggatataggcgttcctctgttagcaatcggttgctactcacaagtcaatccgattacattaacagcagcattacttctattagtagcgcactacgctattataggcccaggcttacaagctaaagcaacaagagaagcccagaagagagcggcagcaggaataatgaagaacccaactgtagatggaataacagtaatagacttagagccgataccctatgaccccaaattcgaaaaacaattgggacaagtgatgttattgatcctatgtgtcacacaagttttaatgatgagaacgacctgggctctatgcgaagcactgaccttagctacagggccaatctctaccctgtgggaaggaaacccgggaagattttggaacacgacaatagcggttagtatggcgaatatttttagaggttcgtatcttgcgggcgctggcctattattttcaataatgaagaatacaactaacacaaggcgaggtacgggtaatatcggagagacgcttggtgagaagtggaaatctagattaaacgcattaggtaaatctgaatttcaaatctataagaaaagcggcatccaggaagttgataggacactcgcaaaagaaggaataaagcgtggtgaaacagatcatcacgccgtatctagagggtctgcaaaattacgatggtttgttgagcgaaatatggtaacccctgaaggaaaggttgtggatctagggtgtgggagaggagggtggagttattactgtgggggcctcaaaaatgtccgagaagtaaagggcctaacaaaaggaggaccaggacatgaagaaccaattccaatgtcaacctatggatggaacctcgttagactgcaatcgggtgttgacgtctttttcacaccgccagagaaatgcgatactcttttatgtgatatcggagaatcttcccctaatccaacgatcgaagcaggtcgaaccctcagagtactaaacttagtcgaaaattggttaaataataatacacaattttgcataaaagtacttaatccttatatgccgtcagtcatagagaaaatggaaacacttcaacgtaaatacggaggtgcacttgtacgtaatccattgtccagaaatagtacccacgaaatgtattgggtttcaaatgcaactggaaatatcgtatcctctgtaaatatgatatcacgaatgttaattaacagattcacaatgaaacacaagaaggcaacttatgaacctgatgtagaccttggttctggcacaaggaacataggaattgagtcagaaatcccaaatttagacattatagggaaacgtattgagaaaataaaacaggaacacgaaacatcatggcactacgatcaagatcacccgtataagacgtgggcgtaccatggatcctacgaaactaaacaaacaggctcggcttcgtctatggtaaacggagtagtgcgattacttaccaaaccgtgggacgtagtccctatggtcacacaaatggctatgactgatacgactccgtttgggcaacaaagagtgtttaaagagaaggttgacacccgaacacaagagcctaaagaaggaacgaagaaattaatgcgcataacagccgaatggctatggaaagaactcgggaaaaagaaaacgcccaggatgtgcacaagagaagaatttacccgtaaggtacgaagtaacgctgctttgggtgcaatatttacagatgaaaataaatggaaatcagcgcgagaagcagttgaggatggaagattctgggaattagttgaccgagaaagaaatcttcatctggagggaaaatgtgaaacttgcgtatataatatgatgggaaaacgtgagaagaaattaggggaatttggaaaagcaaaaggatctagagctatatggtatatgtggctaggcgctagatttctagagtttgaagcgttaggctttctaaatgaagaccattggttcagtagaggaaattccttaagtggcgttgaaggcgaaggactacatcgactaggatacatattaagagatgtagggaagaaggaaggaggcgcaatgtatgctgatgacacagcgggatgggacactcgaataacactagaggatctcaaaaacgaagagatggttaccaatcatatgaagggggagcacaagaaactagcagaagccatttttaagctaacttatcaaaataaagtagttcgtgtccaaaggccaaccccaagaggcacagtaatggatataataagccgtcgcgaccaaaggggatctggccaagtgggcacatatggattaaacacatttactaatatggaagctcagttaattcgccaaatggagggtgaagggatatttaaaagcattcaacatctaacggctacagaagaaatcgcagtacaaaattggttggcacgggtaggtagagaaagattatctagaatggctatctctggagatgattgtgtcgttaaacctatagatgatcgctttgcatccgcattgacagccctgaatgacatggggaaagtacgtaaagatatacaacaatgggaacctagcagaggatggaatgattggacgcaagtgcctttttgttcacatcatttccacgaactcgtgatgaaagacggacgagttttggtagttccatgcagaaaccaggatgaattaataggccgagcacgcatatcacaaggggcaggatggtccttaaaggaaacagcatgtctaggcaaaagctacgcacaaatgtggacactaatgtacttccataggagagacttaagattagcagccaatgcaatatgcagcgctgtgccaagtcactgggtacccacttcaagaactacttggagcatacatgcaaaacacgaatggatgactactgaagacatgttagcagtgtggaaccgtgtgtggatccaagagaatccctggatggaagacaaaacaccagtcgaatcgtgggaggaagttccatatctaggaaaacgggaagatcaatggtgcgggagtctaatcggtctcacctcgagagcaacatgggccaaaaatatacagactgcaataaatcaagtaaggagtttaatcggtaatgaagaatatacagactatatgcccagcatgaaacgatttaggagggaggaagaagaagccggggtgttatggtaa

SEQ ID NO: 22647 - RNA, 9876 nt, synthetic construct
  misc_feature 1..9876: note = derived and/or modified CDS sequence (opt6) from DENV-2__FJ639733__SS-prME
  source 1..9876: mol_type = other RNA
acagctggtgtaataataatgttgatacctaccgctatggcgtttcatttgacaacgagaaacggagaaccgcacatgattgtggggcggcaagaaaaaggcaaatcgttattgtttaaaactgaagacggagttaatatgtgcacgcttatggcaatagatttgggggaactatgcgaagacacgattacgtacaaatgcccattactacgccaaaatgaaccggaagacatcgattgctggtgtaatagcacatctacctgggtaacttatggaacctgcacaacaacaggtgaacatagacgtgaaaaacgttccgtagccttggtaccacacgtcgggatgggtttagaaactagaactgaaacttggatgagttctgaaggcgcttggaaacatgtccaacgcatcgaaacttggatactgagacatcctgggtttaccattatggcagcaatactggcttacacaataggcactacccacttccagcgtgcactaatctttatattattaacggccgtagcaccaagcatgactatgcgatgcatagggatatcaaatcgggattttgttgaaggggtttccggaggatcatgggtagatatcgtacttgaacacggttcttgcgtaaccacaatggctaaaaataaaccaacacttgacttcgaactcattaagacagaagcaaaacaaccggcaacactgagaaaatactgtatcgaggcaaagttaacgaatacaaccacggaatcacgttgtccaacccagggagagccatcgcttaacgaagaacaggacaaacgatttatatgtaaacattccatggtagatcgaggttgggggaacggatgcggtttatttggcaaaggaggaattgtcacatgtgctatgtttacatgtaagaaaaatatggaaggtaaagttgtacagccggaaaatttggaatacacaatcgtaataactccacactctggtgaagaacatgcagttgggaatgacactggaaagcatggaaaggaaattaaaataacaccacagtctagtataacggaggcagaactaactggctatggtactgtcaccatggaatgcagtcccagaacagggttagattttaatgaaatggtactcttacaaatggaagataaagcatggttagtccatcggcaatggtttctagatttgccattaccctggttaccgggagccgacactcagggctcaaactggattcagaaagagactctagtcacttttaaaaacccacacgcaaagaaacaagatgtcgtagtactaggttcacaggaaggggcaatgcacacggcattaactggcgcaaccgaaatacagatgtcatcgggaaacttactattcaccggacatttaaaatgccgattaagaatggacaaactccagttgaaaggtatgtcatatagtatgtgcactggaaaatttaaaattgtaaaggaaatcgcagaaacgcaacacggtactattgtaatccgcgtgcagtacgaaggtgacggatcaccttgtaaaataccgtttgaaatcacagacctagaaaagcgccatgtattaggacgtctcattacggtaaatccaatcgtgatagaaaaagatagccctgtaaacatagaggcggagccgcctttcggagactcctatattattataggagtcgaaccaggccaacttaaattaaattggttcaaaaaggggagctcaatcgggcaaatgtttgaggcaactatgcgaggagctaaacggatggccattttaggggataccgcatgggatttcggaagcctgggtggagccttcacatctataggaaaagcactacaccaggtatttggagcaatctatggggcagcatttagtggagtctcatggacaatgaaaatacttatcggagtcgtaatcacttggattgggatgaactcaagatccacatcactgtcggtgtcgcttgtcctagtaggtgttgttactttatacctaggggcgatggttcaggcagattcaggttgtgttgtgtcttggaaaaataaggaactaaagtgtgggagcggaattttcataacagataacgttcatacatggaccgaacaatacaaattccaaccagaaagtccttcgaaactagcatcagcaattcaaaaagcccacgaagaaggaatatgcggaatcagatcagtaactagattggaaaacttgatgtggaagcaaataacacccgaattaaatcacatattatcagagaacgaggtaaaattaacaattatgaccggtgacacaaaaggtataatgcaagcgggtaaaaggtccctacgcccccaaccaacggagctaaaatactcttggaaaacttggggaaaagcaaagatgttatctactgagtcacacaatcagacattcctgatcgacggaccagaaacagccgaatgtccgaacacaaacagggcatggaactcgctcgaggttgaagactatggatttggagtatttactaccaacatttggttgaaactacgcgagaaacaggacgtattttgcgacagcaaactaatgtcagcagccatcaaagataatagggcagtgcatgctgatatgggatactggattgaatcagcactaaatgatacgtggaaaatggaaaaagcatcgttcatagaagtgaaatcatgtcattggccgaaatcgcacacactttggtccaacggtgtgttagaatcagaaatgattattcccaaaaacttcgcaggacctgttagtcaacataattatcgcccaggatatcatacacaaactgctggcccgtggcatttgggaaaattagagatggactttgacttttgcgaaggtacaacggttgtcgtaacagaagactgtgggaaccgaggaccgagcttgagaaccactacagcaagtggaaaactaatcacagagtggtgctgcaggtcctgcaccctccctccattaaggtatcgaggtgaagacggttgctggtatgggatggagatacgaccgctcaaagaaaaagaagaaaacctggtaaacagtctcgtaacagctggacacggtcagatcgataatttttctctaggcgtgttaggaatggcacttttcttagaagaaatgctgcggacaagagtaggaactaaacacgcaatacttcttgtagcagtatcatttgtcacactcataacaggaaacatgtccttccgagatctaggtcgcgtaatggtcatggtcggtgcgactatgacagatgacataggtatgggagtaacatacctagcactattagcggcctttaaagtgaggcccacattcgctgccggattactcctcagaaaattaacctctaaggaattaatgatggcaacaataggaataacgttattaagtcaatccacgataccggagactatactagaacttacggacgctttggcgttagggatgatggtattaaagattgttagaaaaatggaaaaataccaactggcagtgactatcatggcaatttcctgtgtaccaaatgctgtcattctacgaaacgcatggaaggtcagttgtacaattcttgctgctgtgtccgttagtcctcttcttttaacatcatcacaacaaaaggcagactggattccgctagcattaaccatcaagggcttaaacccgacagcaatatttctaacaacgctaagtagaactagcaagaaaagaagctggcctctaaacgaggcaataatggctgtagggatggtttcaatacttgcaagttccctactcaaaaacgacataccaatgacaggccctctagtagcgggtggattattaacagtatgttacgttctcacagggcgctctgcagacttagaattggaacgagcggcagatgtaaaatgggaagatcaagccgagattagtggaagtagcccaatattatcaatcacaatatctgaagacggatcaatgagtatcaaaaatgaagaagaagaacagacactaaccatacttatcagaacaggtttgttagttatctcaggtgtcttcccagtatctatcccaatcacagcagctgcctggtatttatgggaagttaaaaagcagagagcgggggtcctgtgggatgtaccaagtcccccgccggtaggaaaggcagaattagaggatggagcatatagaattaagcaaagaggcatacttggatatagccaaattggggcgggagtatacaaagaaggaacctttcatacaatgtggcacgtcactagaggagcagttcttatgcatcgcggaaaacgcattgaaccatcatgggctgatgtaaagaaggacctaatctcatacggaggtggttggaaactagaaggtgaatggaaggaaggagaagaagtgcaagtactggctctagaacccgggaaaaaccctagggctgtgcaaacaaaaccaggaatctttaagacgaacacaggaaccataggggccgtcagcctagatttttcaccaggaacgtcgggcagtccgatagtggaccgaaaggggaaagtcgtgggattgtacggtaacggagtggtcactaggagcggcgcatacgtaagtgcgattgctcaaactgaaaaatctatagaagataaccccgagatagaagatgacatcttccggaagaaacgactaaccattatggatctacacccaggagcaggaaaaacaaagcgttatttgccagccatcgtacgagaagcaataaagagaggtttgcgaacactgatattagcaccaaccagagtcgtagcagcagagatggaggaggctttacgaggactacctataagataccaaacaccggcaattaaagcggagcacacaggacgggaaatagtagatttaatgtgccatgcaacttttacaatgagactcttatctccagtaagagtgcctaactataatctcatcataatggatgaggcacattttaccgatcctgcgtcaattgcagcacgcggttacattagtactagagttgagatgggtgaagcagcaggcattttcatgacagccactccgccgggatcgcgagacccattcccacaatcaaacgccccaattatggatgaagaaagggagataccagaacgatcctggaatagcggccatgagtgggtaacggattttaaaggtaaaactgtttggtttgttccttcgatcaaagccggtaatgacattgctgcatgccttaggaaaaacggaaagaaagtaattcaattgtcacgtaaaacatttgactcagaatacgtaaaaacgcgagccaacgactgggattttgttgtaacaacagatatcagtgagatgggcgcaaattttaaggccgaaagagtgattgatcctcgtaggtgtatgaaacctgtcatcttaaccgacggtgaagaacgcgtcattctcgcaggcccgatgcctgtaacacatagctctgccgcccaaagaagaggtagaataggaagaaatcccaaaaacgaaaacgatcagtatatatatatgggcgaaccattggagaatgacgaagattgtgcccactggaaagaggctaaaatgttattagataacataaatacaccagaaggcattattccatctatgtttgagccagaaagggagaaagtcgacgccatcgacggtgaataccgtctacgaggcgaagctagaaaaacatttgttgatctaatgaggagaggggatcttcctgtatggttagcatataaagttgcagccgaaggaatcaattatgcggacaggaaatggtgttttgatggtatcaaaaacaaccagattctagaggaaaacgtagaggttgaaatttggaccaaagaaggggagaggaagaaattaaaaccaaggtggctcgatgcgaggatttattccgatcctctcgccttaaaagaatttaaagaatttgcagcgggtaggaagtcacttacactcaacttgatcacagaaatgggtagacttcccacctttatgacgcagaaggccagaaacgcattagataatctagcggttttacacactgccgaagcgggaggtcgggcctacaatcatgccttaagcgagctgccagaaacattggaaactctcttactgctaacattattggcgactgtgaccggaggcatctttctatttcttatgtcgggtaaaggaataggtaaaatgactttaggcatgtgttgcattataacggcaagcgtgcttttatggtatgcacagatccaaccgcactggatcgccgcatccattattttagagttctttttaatagttttgttaattccagaaccagagaaacaaagaacccctcaagataatcaactgacgtacgtcgttattgccattttaaccgtagtggcggctaccatggcaaacgaaatgggattcttagagaaaaccaaaaaggatctaggactaggctcaatcaccacgcaagaatcggaatcgaacatcttagatatagacctgaggccggcctctgcatggacattatatgctgtggcgactacttttgttacaccaatgctacgacattccatagaaaattcttccgttaatgtttctttaacagcgatagcaaaccaagctacagttttaatgggccttggaaaaggctggcctctcagtaagatggacatcggagtaccgttattagcaatcggctgttatagtcaggtgaaccccatcacattaacagctgccctattactattagtcgcccattatgcgataattggccctggtcttcaggctaaagcgacacgagaagcacagaaaagagctgctgctggtatcatgaaaaaccctactgtagacgggataacggtcatagacttggaaccaattccatacgacccaaaattcgagaaacaattaggacaagtaatgcttttgattttatgcgtcacccaagtattgatgatgagaacaacgtgggcactgtgtgaagcattaacactagcgacaggcccaattagtactctctgggaaggtaatccaggacggttctggaatacaaccatcgcggtctcaatggccaacatcttcagaggatcctacttagcaggagcgggattactgtttagtatcatgaaaaatacaacgaatacaagaagagggactggaaacatcggcgaaacactgggagagaaatggaagtctagattaaacgccctgggaaaaagtgagtttcaaatttacaaaaagtcaggcattcaagaagtagatcgaactttagcaaaagaaggtattaaacgtggagaaaccgatcaccacgcagtaagccgcggaagtgctaaactgcgatggtttgtagaaaggaatatggtgacaccagaggggaaagtagttgatttaggctgtggtagaggaggatggtcttactactgcggtggacttaaaaacgtaagagaagtaaaggggctcaccaaaggaggtcccggacacgaagaaccaatacctatgagtacctatggctggaacctagttcgcttacaatcaggagtagatgttttctttacacccccagagaaatgcgacacactactatgtgatataggcgagtcatccccaaatcctacgatcgaagcaggtcgtaccctaagagtacttaatttggttgaaaattggctaaacaacaatacacaattctgcataaaagtactgaatccatatatgccatcagtaattgaaaagatggaaacactccaaagaaaatatggcggcgcgttagtaaggaatcctctctcacgcaactcaacacatgagatgtattgggtctcaaatgcgacaggtaatatcgtaagtagcgtgaacatgattagtagaatgcttattaacagatttaccatgaaacacaagaaagcaacttacgaacctgatgtagatctaggtagtggaacgaggaacattggaatagagtcggaaattccgaacttagatattattggaaaacggatcgagaagataaaacaagagcatgaaacctcttggcactatgaccaagaccacccctataagacatgggcgtaccacggttcatatgaaacgaagcaaactggctcagcgagttctatggtaaatggcgttgtccgcctactaacaaagccctgggacgtggtccctatggtgacacaaatggctatgacagacacaacaccttttgggcaacagagagtgttcaaagaaaaagtagacactcgtacccaagaaccaaaagaaggtacaaagaaattaatgagaataactgccgaatggttatggaaagaacttggaaagaagaaaacacctagaatgtgcactcgcgaagaatttacaaggaaagtaagatcgaatgctgccttaggtgcaatatttactgatgaaaacaaatggaaatccgcaagagaggctgtggaagatggtcgtttttgggagctagtagataaagagagaaatttgcatttagagggaaaatgtgagacctgcgtttacaacatgatggggaaaagagagaagaaattaggagaatttggaaaggcgaaaggatctagagcaatatggtacatgtggctcggtgctagattcctcgagtttgaggctttaggtttcctcaacgaagatcattggttttccagaggtaactcattatctggcgttgaaggagagggactacacagactaggatatatattgagagacgtgggtaaaaaggagggtggggccatgtacgctgatgacactgcaggatgggacacaaggattacgttagaagatctcaaaaatgaggaaatggtaacaaaccacatgaaaggagaacataagaaattggcagaagcgattttcaaattaacctaccaaaacaaagtagtgcgcgttcaacgacctacacctaggggaacagtcatggacataatatcacgtagagatcaaaggggctcaggacaagttggcacttatggtttaaatacattcaccaatatggaagcacaactcatccgccaaatggaaggcgaaggtattttcaaatcaatacagcacttaacagctactgaagagattgcggtgcagaattggctagctcgagtagggcgcgagagactaagcaggatggcaatttccggggatgattgtgtcgtaaagccaatcgatgatagattcgcgagcgcgctaacagcattaaatgacatgggtaaggtgagaaaagatatccaacaatgggagcccagccgaggttggaatgattggacgcaagtccctttttgtagccatcattttcatgaactcgtcatgaaagatggaagggtgttggtagttccgtgtcgaaatcaagatgagttgattggccgagctcggatttcacaaggagcaggttggagcctaaaagaaacagcttgtctcggaaaatcatatgcccaaatgtggacactaatgtatttccatagaagggacctgaggctcgcggctaatgctatatgctcagccgtaccttctcactgggtcccgacatcgcgtaccacgtggtcaatacatgccaaacatgaatggatgactactgaagacatgctagcggtgtggaatagagtatggattcaagaaaacccttggatggaagataaaacgccagttgaatcttgggaagaagtaccatatctaggaaagcgagaggatcaatggtgtgggagcctgataggattaacgtcccgtgccacgtgggccaaaaacatacaaacagccattaatcaagttagaagtttaataggaaacgaagagtatactgactacatgccttctatgaagagatttagacgcgaagaagaggaagccggagtcttatggtaa

SEQ ID NO: 22648 - RNA, 9876 nt, synthetic construct
  misc_feature 1..9876: note = derived and/or modified CDS sequence (opt6) from DENV-2__FJ639734__SS-prME
  source 1..9876: mol_type = other RNA
acagctggagtaatagttatgcttatacctactgctatagcatttcatctaacaacaagaaacggtgaaccacatatgatagtgggaaggcaagaaaaaggaaagtcgctattgttcaaaacggaggacggagtaaatatgtgcacgctgatggcaatcgacttaggtgaactatgcgaagatacaataacatataaatgccctcttttacgacaaaatgaaccagaggacatagattgttggtgtaatagtacaagtacgtgggtaacatacggaacgtgcacgacaacgggcgaacatcgaagggagaaacgatctgtagccttagtaccgcacgtaggtatgggattagagacgagaactgaaacttggatgtcctctgaaggcgcatggaaacacgtacaacgtatcgaaacttggatattacgtcatccagggttcacaattatggcagcaattctagcttataccatagggacaactcattttcagagagcgcttatcttcatactccttacagctgtagccccatcaatgaccatgagatgtattggcatatcaaatcgcgactttgttgaaggtgtgtcaggcggaagttgggtggatatagtcctggaacatggtagctgcgtgacgaccatggctaagaacaagcctacactagactttgaacttataaaaaccgaagcaaaacagccagcgacattaaggaaatattgtattgaggcaaaattgacaaatacaactacagaaagtcgttgcccgacccaaggtgaaccctcactcaacgaagagcaagataaaaggtttatatgtaaacactctatggtagaccggggatggggaaacgggtgtggattatttggtaaaggaggtatagttacttgcgcaatgtttacatgtaaaaaaaatatggaaggcaaagttgtccagcctgagaacctcgaatacactatagtaattaccccacatagcggagaggaacatgcagttgggaatgatacggggaagcatggcaaggaaattaagattacgccgcaatcatctataacagaggctgaattgacaggatatggtacagtaacgatggaatgttcaccacgtactggtttagacttcaatgaaatggtgctgttacaaatggaagataaggcttggctggtgcaccgccaatggtttttagaccttccgctaccatggctgccaggtgcagatactcaaggctccaactggatacagaaagagactctggtaacattcaaaaacccacacgcaaaaaaacaagatgtagttgtattgggctcccaagaaggagcaatgcacactgcgctaactggagcaacggaaatacaaatgtcatctggcaacttactattcaccggtcatctcaaatgtagactacgaatggacaagttgcaactaaaaggaatgagctattccatgtgcacagggaaatttaaaatagtaaaggagattgcggaaactcaacatggcacaatagtcataagagtccaatatgaaggggacggatctccctgtaagattccattcgaaattacagatttagaaaaaagacatgtcctgggcagactaataacggttaatccaatagtaactgaaaaagatagccctgtaaacattgaagcggaaccgccatttggtgattcgtacattataataggtgtcgagccaggacaactaaaactaaattggtttaaaaaaggatcatccattggacaaatgtttgagaccacaatgagaggcgcaaaacgaatggcaatactgggagatacagcttgggatttcgggtcactcggcggagtctttacaagcattggaaaggcgttacatcaagtgttcggcgctatatacggggcagcattttccggtgtatcgtggacaatgaagatcttaataggagtagtaattacgtggataggtatgaacagtagaagtacatcattaagcgttagcctagtattagtaggagtagtgacactctaccttggcgctatggtgcaggctgacagcggatgtgtagtttcttggaaaaataaagagctaaaatgtggtagtggaatctttattacagacaatgtgcatacttggactgaacagtacaaattccaacccgagagcccatcaaagttggcaagtgccattcaaaaggcacacgaagaaggtatctgcggaatacggtcggtaacaaggttggagaacctgatgtggaaacaaattactccggagttaaatcacattctgagtgagaacgaagtcaaattaacaattatgacaggggacaccaaaggtataatgcaggcgggaaaacgatccctaagaccacaacctacggaattaaaatattcatggaaaacatggggaaaagcgaaaatgctttctaccgaatctcacaatcagaccttcctaatagacggtccagaaacagcagaatgtccgaatactaaccgagcttggaatagtttggaggtcgaagactacggatttggtgttttcaccacaaatatttggttaaaactcagagaaaagcaggacgtattctgtgatagcaaactaatgagtgcagctattaaagacaatcgtgcggtacacgccgatatgggatactggatagaaagtgctctaaatgatacgtggaaaatggaaaaagcatcgttcatagaagttaaatcatgccactggccaaagtcacatacactctggtctaacggggtcttggaatcggagatgatcatccccaagaactttgcgggtccggtaagtcagcacaattatagaccaggataccatacacaaactgctggaccttggcacttaggaaagttagagatggattttgatctatgtgaaggtacgaccgtagtagtaactgaagactgcggtaatcgaggtccctcactacgaactacgacggcctcagggaagcttataacagaatggtgttgtaggagctgtacactaccccccctccggtacagaggcgaagatggttgctggtatggtatggaaatacgccccttgaaagaaaaagaagaaaacctggtaaacagtttggttacagcaggccacggccaaatagacaatttcagcctaggtgtattagggatggcactctttctagaagaaatgttacgaacgagggtagggactaaacacgctattctcctcgttgcagtctcctttgttacattaatcacaggaaacatgtcatttagagacttaggacgtgtaatggtaatggtcggtgcaactatgaccgatgatataggtatgggtgttacttacttagcacttcttgcagctttcaaagtaagaccaacgttcgcggcaggactcttgttacgtaaattaacttcaaaagaattaatgatggctaccataggtatagcgttgttatcccagtccacaatcccagaaaccattttggaattgacagatgcgttagcactaggtatgatggtactcaaaatagtaagaaatatggagaaatatcaactggctgtaacaatcatggcaattagttgtgttcccaacgctgtcattctacgtaatgcttggaaagttagctgtactatcctcgcggcggtatctgtaagtccactactcctcactagtagtcaacagaaggcagactggatacctttagctctaacaatcaaaggtttgaatcctaccgcaatatttttgactactttgagtagaacctcgaaaaaaaggagttggcctctaaatgaagctataatggccgtcggaatggtaagcattttagcctcatctttactaaagaatgatatacccatgaccgggccgttagttgccggaggtcttttaacggtatgttacgtcttaacaggacgaagcgctgatttggaattagaacgtgcggctgaggtaaaatgggaagatcaggccgaaatttctggatctagccctatattgtcgataacaatatctgaagatggatcaatgtcgattaaaaacgaagaggaagaacagacactaacaattttgattagaacagggctcctagtaatatccggagtttttccggtaagcatacctataacagctgcagcatggtatttatgggaagttaagaaacagagagccggagtgctatgggacgttccttcacctccgccggtcggaaaagcagagttggaggatggagcatatagaataaaacagcgcggaatcctaggatattcacaaatcggagcaggagtgtacaaagagggcacatttcatacaatgtggcatgtaacccgaggtgcagtactaatgcatagaggaaaaagaattgaaccatcatgggcagacgttaaaaaggacctaatctcatacggtggggggtggaaattagaaggagagtggaaagagggggaagaagtccaagtattagctttagaacccggtaaaaacccaagagcggtccaaactaaaccaggaatatttaagaccaatacagggaccataggagccgtatcacttgatttttcaccgggtacatcgggaagcccgatagtggatagaaaagggaaggtagttggtctatatggaaacggtgtcgtaactcgatccggagcttatgtatcggctattgcgcaaacagaaaagtcaatagaagataacccagaaattgaagacgatatatttagaaagaaacgattaacaattatggatctccatccaggtgcaggtaaaacaaaacgatacctccccgcaattgtaagagaagccataaaaagggggcttcgaacattaatactagctcccacccgcgtagtggccgctgagatggaggaagcactacgaggtttacctatacgttatcaaacgccagccataaaagcggaacatacgggtcgagaaatagttgacttaatgtgtcacgcaacatttacaatgagattactttctcccgtaagggttccgaattataatcttataataatggatgaggcacactttactgacccagcttcaatagcggcaagaggatacatatcaacaagagtggaaatgggcgaggcagctggaatatttatgactgcaactccacctgggagtcgggacccatttccccagtctaacgcaccaatcatggatgaggagagagagattcctgagcgttcatggaacagcggccacgaatgggtaaccgacttcaaagggaagacggtgtggtttgtcccgtccataaaagcgggtaacgacatagcagcgtgcttgcgaaaaaatggaaaaaaagtgatacaattatcaagaaaaacttttgattctgagtatgtaaagacccgagcgaatgattgggacttcgtggttacgacagatatatcagagatgggagcgaattttaaagccgaaagagttattgaccctcgcagatgtatgaaaccagtgattctaactgatggtgaagagagagttatactagcgggtcccatgcctgttacacattcaagcgcagctcaaagacgaggcagaataggaagaaaccccaaaaatgagaacgatcagtatatttacatgggagaacctcttgagaatgatgaagattgcgctcattggaaagaagcaaaaatgctcttggacaatataaacactcctgaaggaataataccttcaatgtttgagccagagagggagaaagtagatgcaatagacggggagtatagactccgaggtgaagcacgaaaaacctttgtagatttaatgaggagaggagatctgcctgtatggctagcttataaagttgctgcagagggcattaactatgccgatcgcaaatggtgttttgatggaataaaaaacaaccagattttagaagaaaacgttgaagtcgagatatggactaaagaaggagaacgaaagaagttaaagcccagatggctagacgcgagaatatatagcgatccgttagccttgaaagaatttaaggagtttgctgccggcaggaagtcactaactcttaacttaattacggaaatgggacgactacccacattcatgacacaaaaagcaagaaatgcgttagataaccttgcggtattacatacagctgaagcgggcggtagagcatataaccatgcattatcagaactacctgaaacattagaaacacttttgctattgacgttactagcgaccgtaacaggtggaatcttcctgtttctgatgtctggaaaaggaattggcaaaatgaccttaggaatgtgttgtattataaccgcatctgtattattatggtatgcccagattcaacctcactggatagcagcgagcattatccttgagttctttctgatagtactgttgattcccgaacctgaaaaacaaagaacgccccaggataatcagcttacttatgtcgttatagccatattaaccgtggtagccgcgacaatggccaacgaaatgggcttcttggagaaaacgaagaaagacttaggacttggttctatcaccacacaagaatcggaatctaacatattagacatagacttacggcccgcgtcagcctggacactatatgcggttgcaactaccttcgttacacctatgcttcgacattcgattgaaaactcaagtgtcaacgtaagtttaacagcaatagcgaatcaagctacagtgcttatgggcctcggcaaagggtggccattatctaaaatggatattggtgtaccattactagcgatcggatgttactcacaggtgaacccaataaccttgactgccgcattattacttctggtagctcactatgcaattatcggaccaggtttacaagcaaaagcaactagagaagctcaaaaaagagctgctgcaggtatcatgaaaaatcctacagtcgatgggatcaccgtaattgatcttgagccaatcccctatgaccctaagttcgaaaaacaattaggtcaggttatgttgttaattttatgcgtaacccaggtactgatgatgagaacaacgtgggcgttatgtgaagctctcacactagcaaccggaccgatcagtactttatgggaggggaatcccggtcgattttggaatactactatcgcagtaagtatggcgaatatctttagaggttcatatctagcaggagctggtttattgttctctattatgaagaacaccacaaatacaagaagaggaactggaaacatcggggaaacactaggcgaaaagtggaaatctcgattaaatgctcttggaaagtccgagttccaaatctataaaaagagcggtatacaagaagtagacagaacattggcaaaggagggcataaaaagaggtgagactgatcatcatgctgtcagtagaggctctgcaaaactaaggtggttcgtagagagaaacatggtaaccccagaaggaaaagtagtggacttagggtgtggtcgaggtggttggagttattattgtggaggattaaagaacgtacgcgaagtaaagggattgacaaaaggtggacccggacatgaggaaccaattcccatgtcaacttatggttggaacctcgtcagacttcaaagtggagtagacgttttctttacaccccctgaaaaatgtgatacacttctatgtgatataggtgagagtagtcccaatccaactatagaggccgggaggactctaagagtcttaaacctagtagaaaattggttaaataataatacacaattttgcataaaagtactaaatccatacatgccctctgtaatagaaaaaatggaaacactccaaagaaaatatggaggggcccttgtcagaaatccactgtcaagaaactcgacgcatgaaatgtactgggtaagtaacgcaacgggtaatattgtctcatccgttaacatgatatctcgaatgttaatcaacagatttactatgaagcacaaaaaagcaacatacgaacctgatgttgacctcggatcaggaacacgaaacataggaatcgaatcagagatcccgaaccttgatataataggtaagagaatagaaaaaataaagcaagaacacgagacctcatggcactatgaccaagatcatccatataagacatgggcataccacgggagctacgaaacaaaacaaacaggtagtgctagtagtatggtcaacggtgtagttagattgctaactaaaccctgggacgtggtccccatggtaacacaaatggcgatgacagataccacaccatttggacaacaacgtgtttttaaagaaaaggtcgacacccgaacgcaagagccgaaggaaggtactaagaaactgatgaaaataaccgcggaatggttatggaaggagcttggaaaaaaaaaaacacctagaatgtgtactagggaggaattcaccagaaaggtacgaagcaatgcggcattaggtgccatattcaccgacgaaaataaatggaaaagtgctcgagaggccgttgaggatggacgtttttgggaactagtagatcgcgaaagaaatttgcatctggaagggaaatgtgaaacatgcgtttataacatgatgggaaaacgtgaaaagaaacttggcgaatttggcaaagctaaaggcagtagagcaatatggtatatgtggcttggtgctcgatttctggaatttgaagcgttgggatttttaaacgaagatcattggttttctcgaggaaacagtctttcgggtgtagagggtgaaggtctacacagactcggatacatcctacgagacgtgtccaagaaagaagggggagcaatgtatgcagatgatactgcaggctgggatactcgaataacgctagaagatcttaaaaatgaagaaatggtaacaaaccatatgaaaggtgaacataagaagttagcggaggcaatttttaaactgacttatcaaaataaagttgttcgggtgcaacgaccgaccccgcgaggcactgtcatggacatcatatcgcgtagggaccagcgaggaagcggacaagtaggaacttacggtctgaacacatttacaaacatggaggcgcaactaattcgacaaatggaaggagaaggcatatttaaatctattcagcatcttacagccacagaagaaatagcggtgcagaattggttagctagggtcggtagagagagattgtcgcgtatggcaataagcggagacgattgtgtagttaaacctatagatgatagattcgcatcagctctcactgctttgaacgatatgggtaaggtacgaaaagacattcaacagtgggaaccgagtagaggatggaatgattggacccaggtgccgttttgcagtcatcattttcatgaattagtgatgaaagatggtcgagctctcgtcgtcccatgtagaaatcaagatgagctgataggccgcgcaagaacgtcccaaggagccggatggtcattaaaagagacggcttgtctaggaaagtcatatgcacaaatgtggacactcatgtactttcatagacgcgatttaagactcgcagcaaacgcaatttgcagtgcagtacccagtcactgggtccccacttcacggaccacatggtcaatccatgccaaacatgaatggatgaccactgaggacatgctagcggtctggaacagggtctggattcaggaaaatccttggatggaagataaaaccccagtagaaagctgggaggaagtgccctaccttggcaaaagggaagaccaatggtgcggaagtctcataggactgacaagccgagcaacctgggcaaaaaatatacaaacggccattaatcaagtgcgctccttaataggcaatgaagaatatacggactatatgccgtccatgaaaaggttcagacgagaggaggaagaggcgggggttctgtggtaa

SEQ ID NO: 22649 - RNA, 9876 nt, synthetic construct
  misc_feature 1..9876: note = derived and/or modified CDS sequence (opt6) from DENV-2__JN819408__SS-prME
  source 1..9876: mol_type = other RNA
actgctggtgttattgttatgcttattccaacggctatggcgttccacctcacaacacgaaatggtgaaccacatatgatagtaggaagacaagaaaaaggaaaatctttattatttaaaaccgaagatggggttaatatgtgcacactgatggcaatagatttgggggaattatgcgaagataccattacatataaatgccctcttctacgacaaaatgaaccggaagatatagattgttggtgtaacagcacaagtacctgggttacatatggaacatgcacgaccacgggagaacacagaagggagaaaagatcggtagcgctcgttccacacgtaggaatgggactggaaacaagaacggaaacttggatgagctcagaaggagcttggaaacatgtacaacgcatagaaacatggatacttaggcaccccggatttaccataatggcagctatattggcttacaccatagggacgacccattttcaaagagcgctaatatttatcctattaaccgccgtcgcaccgagtatgacaatgcgatgcatcgggatttcgaatagagattttgtagaaggagtttctggaggttcgtgggttgacatagtacttgaacacggaagttgcgtgactacaatggctaaaaataaacctacacttgatttcgaacttattaaaacagaagcgaaacaacctgcgaccctacgtaaatattgtatagaagctaaattaacaaacacaaccacagaatctagatgtccaacacaaggcgaaccgtctttaaatgaagaacaagacaaaagatttatctgtaaacactctatggtggacagaggatggggaaacggatgcggcttattcgggaaaggcggtatagtaacctgtgcaatgtttacatgtaagaaaaacatggaaggtaaagtcgtgcagccagaaaatttagaatataccatagttattactcctcattcaggcgaagaacacgcagttggaaacgatacgggaaaacatggtaaagaaataaaaataacaccgcaatccagcataacagaagcggaattgacaggttatggtactgtaacaatggagtgctcaccaaggaccggcctcgactttaatgaaatggtcctcctacaaatggaggacaaagcatggttagttcatagacagtggtttttagatttgccattaccatggcttcccggagccgatactcaagggtctaattggatacaaaaagaaactctagtaacattcaaaaacccacacgcgaagaaacaagatgtcgtcgtactaggttctcaagaaggtgcaatgcacacggcattgacaggagcaaccgaaatacaaatgtcatcaggtaacttgctttttacaggacatctaaaatgcagactgcgaatggataaactacaacttaaaggcatgagttattcgatgtgtactggaaagtttaaaatagtgaaagaaatagctgagactcagcatggaacaatagttatcagggtacaatatgagggagacggcagtccatgtaaaataccgttcgagataaccgacctagagaaaaggcatgtgttaggtagattgataacagtcaatccaatagttaccgaaaaagattcacctgtaaatatagaggctgaacctccattcggagattcgtatataataattggtgtagaaccaggccaattgaaactaaactggtttaagaaagggagcagtatcggtcaaatgtttgaaacgacaatgaggggcgcgaagcgaatggctatattgggggatacagcatgggattttggatcacttggtggtgtatttacatccataggtaaggcactacaccaagtattcggtgcaatatatggagccgccttctcaggagtcagctggacaatgaagatacttatcggtgtaatcatcacctggattggaatgaatagtcgctcgacatcattaagcgtcagcctagtactggtaggcgttgttacactttacttaggtgccatggtacaggctgacagcggatgtgtcgtatcctggaaaaacaaagaattgaaatgtgggtcgggaatatttattacggataacgttcatacttggaccgagcagtataaatttcaacccgagtctccaagcaagttggcttcggcaattcaaaaagctcatgaagagggaatatgtggaataaggagcgtaactagactcgaaaacctaatgtggaaacaaataacaccggaactgaaccatattctatccgagaatgaggtgaaactaacaattatgacgggagatacaaaaggcataatgcaggcaggaaaacgatcactgcgaccgcaaccgaccgaactgaaatattcctggaaaacatgggggaaagcaaaaatgctcagcaccgaatcgcacaaccaaacatttttaatagatggaccagaaacagctgaatgtccaaatacaaatcgcgcttggaatagcctcgaagtagaggattacggatttggtgtgttcactacaaacatatggctaaaattgcgggaaaaacaggacatattttgcgattctaaacttatgagcgctgcgatcaaagataacagagctgtgcatgctgacatgggctattggatcgaatcagctctaaacgatacttggaaaatggagaaagcaagttttatcgaggtgaaatcttgtcattggccaaaatcgcacaccctatggtctaacggggtacttgaaagtgaaatgattatacccaagaattttgcaggacctgttagtcaacataactacaggcccggctatcacacacagacagctggaccatggcacctaggaaaattagagatggatttcgatttctgtgaaggaaccaccgttgtagttacagaggactgcggcaatagaggaccgtcattacggaccaccacagcgtcgggtaagctcataacggaatggtgctgccgcagctgtacactaccgcccttgcgttatagaggtgaagatgggtgctggtacggtatggaaatccgtccactgaaggaaaaagaagaaaatttggtaaatagtctggtaactgctggacacggtcagatagataacttttctttaggtgtcctcggtatggccttatttttagaagaaatgttaagaacgagggtgggtactaaacatgctattttattagttgcagtatcctttgtaaccctaatcacaggaaacatgtcattccgagatttaggaagagttatggtaatggttggagccacaatgacagatgacataggaatgggggtaacctatcttgcattgctagctgcgttcaaggtacgtccgacatttgcagccggactgcttttaagaaaacttacaagtaaggagctgatgatggcaacaatcggaattgccctactgagccagagtaccattccggaaacaatattagaattaaccgatgccttagctcttggaatgatggctctaaaaattgtaaggaatatggaaaagtaccaattagcagtaacaataatggcgataagttgtgtaccaaatgctgtaatcttacagaatgcatggaaggtgtcatgcacaattctcgctgccgtcagtgtgtccccgctactcctaacgagttcacaacaaaaagccgattggatcccacttgctttgacaataaaaggtttaaatccgacggcgatattcctaaccaccctatccaggacatcaaagaaaagatcatggcctctaaacgaagccatcatggctgtcggaatggtcagcatactagctagttctcttctcaaaaacgacataccgatgacaggtccactcgtagccggcggacttctcacagtttgttacgtcctaacaggtagatcggccgatttagaactagagagagcggcagacgttaaatgggaggaccaggcagaaatttcaggctcatcacctatcttaagcattactattagcgaagacgggtcaatgtctattaaaaatgaggaggaagaacaaactctgacaatattaatccgcacgggacttttggtcatatccggagtattcccagtaagtattccaataacagctgcagcctggtatttatgggaagtgaagaaacagcgagcaggagtgttgtgggacgtaccaagccctccgcctgtaggaaaagccgaactagaagacggtgcatacaggattaaacaacgtggaatactggggtattctcaaatcggtgccggtgtgtacaaagagggaacctttcatactatgtggcatgtaacgcgtggtgcagtattaatgcacagaggtaagagaatagagcccagttgggccgatgtcaaaaaggatctaatctcttatggtggaggttggaaactagaaggggagtggaaggaaggagaagaagtacaagtattggctttagaacccggcaaaaacccacgagcagttcagaccaagcccggtatttttaggacaaataccggaacaataggagcagtcagcttagacttttcaccaggaacatccggaagtccgattgtagatcgaaaagggaaagtagtcggattatatggaaacggggttgtaactagatcaggggcttacgtctcagctattgctcagacagaaaagtcaatcgaggataaccccgaaattgaagatgatatattcagaaagaaacgactaacaattatggatctacatcccggcgcaggcaagacaaagagatatttaccggcaattgttagggaagcgataaagcggggcctcaggacattaattttagctcccacacgcgtcgtggctgcagaaatggaggaggctttgcgaggcctacctatcaggtatcaaacgcctgccatcaaagctgaacataccggccgtgaaattgttgatttaatgtgtcatgcaacatttactatgagattattatcaccggtacgtgtccctaattataacctaattataatggatgaagcacactttaccgacccagcgagcatagccgctagaggctatataagtacacgagtagaaatgggtgaagcggcaggaatattcatgactgcgacgccgccaggatcacgagatccgttccctcagtccaacgcacctattatggacgaagaaagggagataccagaacgaagctggaactcaggtcatgagtgggtcacggatttcaaagggaagacagtatggtttgtcccgagcattaaggccggaaatgacatagctgcatgcctacgcaaaaacggtaaaaaggtaattcagctatctcgaaaaacatttgattctgagtatgtaaaaacgagagccaatgactgggattttgtggttacgacggatatatccgaaatgggagcaaattttaaagcagaacgtgtaatagatcctagaaggtgcatgaagccagtaatattgacagatggcgaagaaagagtaatcttagcaggtcctatgccggtcacccactcttcagccgcacaacgtcgaggtcgcattggaagaaaccccaaaaatgagaatgatcaatatatttacatgggagaacccttagagaatgacgaggactgcgcacactggaaagaggcgaaaatgttattggacaacataaacacacctgaaggtataatcccgagtatgttcgagcctgaacgggagaaagtagatgcaattgatggtgaataccgactaagaggggaagcacgcaaaacttttgtagatcttatgagaagaggagatctcccagtatggttagcctataaagttgcggcggagggaattaattatgcagatagaaaatggtgctttgacggaatcaaaaataatcagatactagaggaaaacgtcgaagtagaaatctggaccaaagaaggagaaaggaagaaactcaaaccaagatggttagatgctcgcatttactcagatccgttggcgttaaaagaatttaaagagttcgcagcaggaagaaagagcttgacgctaaacctaataaccgaaatgggacgattacccactttcatgactcagaaggcaaggaacgcattagataatctagcagtattgcatactgcggaggcagggggtcgcgcctacaatcatgcactttccgaactaccagaaacactcgaaacacttttgttattaaccctattagcaacagttaccggtggaatctttttatttctcatgagtggaaagggcataggcaagatgactttaggcatgtgttgcataataacggcgtccatcttattatggtatgctcaaatacagccacattggattgcggcatcaatcatactggagttctttctaatagtactactaataccagaaccagaaaaacaacgtacccctcaagataatcagctcacatatgttgtaattgctatacttacagtcgtagcggcaaccatggccaacgaaatgggttttctagaaaagaccaagaaagacctaggattaggttctattatcacgcaggaaagcgaaaacaacattcttgatatcgatcttagaccagcatcagcctggacattatatgcagtcgcaacaacttttgtaacacccatgctccgacacagtatcgaaaatagctcagtaaacgtatcattaaccgcaatagcgaaccaagcgaccgtcttgatgggattaggaaaaggatggccattgagtaaaatggacataggagtacccctattagcgattggatgttattctcaagtgaacccaataacactaaccgctgcacttcttttattagttgctcactacgctataattgggcctggtttacaggccaaggcgaccagagaagcgcagaaaagggcggcagcaggtataatgaaaaaccctactgttgatgggatcaccgtcatagatttggaaccaattccgtacgatcctaaattcgaaaaacaactgggtcaagttatgcttctcattctgtgcgttacccaagttttaatgatgcgtacgacatgggcactttgtgaggctttaactttggcgactggaccaatatctaccttgtgggaagggaacccaggaaggttctggaatacaactattgctgttagcatggcaaacatattcagaggatcttatttagcaggggcgggactcttgttttctataatgaaaaataccacgaatacgagacgaggcacaggaaacataggggagacactaggagaaaaatggaagtcccgactaaacgcgttaggtaaaagtgaatttcagatttataaaaagtccggcatccaggaagtagataggacgctagccaaggagggcataaaaagaggagaaacagatcaccacgctgtgagcagaggatccgctaaattacggtggttcgtcgaaagaaatatggtgacaccggaggggaaggtcgtcgacttaggatgcggaaggggaggctggagctattactgtggtggactgaaaaatgtgagagaagtaaaaggattaaccaaaggtggacccggacatgaggagcccatacccatgtcaacatacggctggaatctcgtacgcctacaatcaggtgtggatgtcttctttacaccacctgaaaaatgtgataccctcctctgcgacataggtgaaagtagtccgaatccaacaatagaagctggaaggaccttaagggttttgaatcttgttgaaaattggttaaacaataacacacaattttgcattaaggtacttaacccttatatgccgtcagttatagagaagatggaaacattgcagagaaaatacggtggggcattagtaagaaatcccttaagcagaaatagtacccatgagatgtattgggtgagcaatgcaacaggaaacatagtgtcatctgtaaatatgatatcaagaatgctaataaacaggtttactatgaaacataaaaaggcgacttacgaacccgatgtcgaccttggaagtggtacgagaaatatagggatagaaggtgaaattccaaacttagacataattggaaaaagaatagaaaagataaaacaagaacacgaaacaagctggcattatgatcaagatcatccatataaaacttgggcgtaccatggaagctatgagacaaaacagacaggttcggctagctccatggtcaacggtgtcgttcgtcttctgacaaaaccttgggacgttgtaccaatggtaactcagatggcaatgacagacacaactccattcggacaacaacgggtattcaaagagaaagtggacacacggacacaagaaccgaaggaaggaactaagaaactgatgaagataacagcagaatggttatggaaagaattaggcaaaaagaaaaccccgcgaatgtgcacgagagaagaatttactaagaaagttaggagtaatgccgcgttgggagctatatttactgatgagaataagtggaaatctgcccgggaagccgtcgaagatggacgcttttgggaactggtagacagagaaagaaacctgcacctagaaggtaaatgtgaaacatgtgtatataatatgatggggaaaagagagaagaaattaggtgaatttggaaaagcaaaaggttcacgcgctatttggtatatgtggcttggcgcgcgatttcttgagttcgaggcactgggctttttgaatgaagaccactggttttcaagaggaaatagtttatcgggagtagaaggcgaaggtctacatagattaggctacatattacgcgacgtggggaagaaagaaggaggggcaatgtatgcagatgacactgccggctgggatacccgaataacgcttgaagatcttaaaaatgaagagatggtaacaaatcacatgaaaggagaacataagaaactagctgaagccattttcaaattgacatatcagaataaagtggtacgtgtgcaacgtccaacgccaagagggactgtgatggatataataagtcgtcgagaccaaagaggaagcggacaagtaggcacatacggattaaatacctttactaatatggaagcccaattaataaggcaaatggaaggtgaaggaatattcaaatctatccagcacctaacggcgactgaagaaatagccgtgcagaattggctagcgcgagttggtagggagcgattatcgcgaatggctataagtggtgacgattgcgtagttaaacctattgatgataggttcgcgagcgctcttacagctttaaatgacatgggtaaagtcaggaaggatatacaacaatgggaaccgtctcgcggatggaatgattggactcaagttccattctgttctcatcactttcacgagctggtaatgaaagatggtcgagttttagtagtgccatgtagaaatcaagatgaattgataggtcgagccagaatctcacagggggcaggatggagcttaaaagaaacagcctgtctaggtaagtcatacgcacaaatgtggacactaatgtacttccacaggagagatttgcggctagctgcaaatgcaatatgcagtgcagtaccatcgcattgggtgccaacatcacgcactacatggagtattcatgcgaaacacgagtggatgactacagaagacatgttagcagtctggaatagggtatggatacaagaaaatccatggatggaagataagacacctgtggagtcctgggaagaggtaccttatttagggaaacgagaggaccaatggtgcggatccttaataggattaacgtctagggcaacgtgggccaaaaatattcaaactgcgattaatcaagtaagatcattgattggaaatgaagaatatacagattacatgccgagtatgaaaagatttagacgtgaagaggaggaagcaggggtgctctggtag

SEQ ID NO: 22650 - RNA, 9876 nt, synthetic construct
  misc_feature 1..9876: note = derived and/or modified CDS sequence (opt6) from DENV-2__FJ639783__SS-prME
  source 1..9876: mol_type = other RNA
acggcaggagtaatagtcatgctgataccaacagcaatggcatttcaccttactacaagaaatggagaaccacatatgatagttggtagacaagaaaaaggaaaaagtcttctcttcaaaacagaagacggggtaaatatgtgtactctaatggcaatagacttgggtgaactatgtgaagatacgataacgtataaatgtccattactacgacaaaatgaacccgaagatatcgattgttggtgcaattcaacaagtacatgggttacatacggtacatgtacaacaacaggcgaacaccgcagagagaaacgatcagtagcgttggtaccacatgttgggatgggcctcgaaactagaacggaaacatggatgtcaagtgaaggcgcgtggaaacatgtacaaagaatcgaaacatggattctgagacatcctggattcacgattatggctgcgatacttgcatacacaatcggaaccactcatttccaaagagcattaatatttatacttttaacagcagtagcaccgtcaatgaccatgagatgtatcggagtaagcaatagggatttcgtagaaggtgtaagcggagggtcatgggtagatatagtcttagaacatggatcttgcgtaactactatggcgaaaaacaaacccaccctcgactttgaactgataaaaacagaagcaaaacaaccagctacattaagaaagtattgtattgaagcaaaactaacgaatacaacgactgaatcaaggtgtccaacccaaggagaaccctcgctcaacgaagaacaagacaaaagatttatatgtaaacattcgatggtggatcgcgggtggggcaatggctgcggattgttcggcaaaggaggaattgtaacgtgcgcaatgtttacttgcaagaaaaatatggaaggtaaagttgtccagcccgaaaatttagaatacaccatcgtcataacgccacactcgggtgaagaacacgcagtaggtaatgataccggtaaacacggaaaggaaataaaaattacaccacaatcttcaatcactgaggctgagttaaccggctatggaaccgtaacaatggaatgctcccccagaactgggctagattttaatgaaatggttctgcttcaaatggaagataaagcatggttagtacatagacagtggtttctcgatttacccttaccctggctacctggagcagatacacaagggtcgaattggatacaaaaagagactttggttacatttaaaaaccctcacgccaagaaacaagacgtagttgttttaggcagccaagagggggcaatgcatacagcgttaacgggtgcaacagaaattcagatgtcctcaggaaatctcctatttacaggacacctgaaatgtaggttaagaatggataaattacaactaaaaggaatgagttatagcatgtgcacaggcaaattcaaaatagtaaaagaaatagctgaaactcaacatggtaccatcgtaatccgtgtacaatacgaaggtgatggaagcccatgtaaaataccattcgaaatcactgacctcgaaaaacggcatgtattagggaggctaataaccgttaacccgattgtaacagaaaaagatagccctgtaaatattgaagcagaaccgccttttggtgatagttatattataattggagtagaaccagggcaacttaaattaaactggttcaaaaagggatcaagtataggacaaatgtttgaaacgacaatgagaggagcaaaacgtatggctatcctaggagacacagcttgggatttcggttcgttgggtggggtttttacatcaattgggaaagcacttcaccaagtttttggcgcaatttatggagctgcgtttagcggcgttagttggacaatgaaaatattaattggcgtgattataacatggatcgggatgaactcaagaagtacaagcctttcggtcagtctggtcttggtaggagtggtcaccctatatctcggcgcaatggtacaagcagattccggatgtgtagtaagctggaaaaataaagagctcaagtgcggcagtgggatcttcataacagacaatgtgcatacatggacagaacaatataaattccagcctgagtcgcccagcaaattggcatctgcaattcaaaaagcccatgaagagggaatttgtgggattagatcagtcacgcgattagaaaacttaatgtggaaacaaataacgccagaacttaaccacattcttagcgaaaacgaagtaaagttaacaataatgaccggtgatattaaaggtataatgcaagctggcaagagatcgttaagaccacaaccaacggagctaaaatattcctggaaaacgtggggcaaagccaaaatgctaagcaccgaaagccataatcaaacgttcttaattgacggtcctgagacagcagaatgcccaaacacaaatcgcgcttggaatagcttagaagtagaagactacggatttggagtatttacaactaatatatggttgaaattaagagaaaaacaggatgtcttctgtgattctaaattaatgtctgctgcaattaaagacaatcgtgcggttcatgcagacatgggatattggattgaatccgcgttaaatgacacatggaaaatggaaaaagcatcttttatagaagtaaagagctgccattggcctaaaagtcataccttatggtcaaacggtgtcttggaatcagaaatgattatccctaaaaactttgccgggccggtaagccaacataattacagaccaggatatcacacacagacggccggaccgtggcacttaggaaagttagagatggatttcgatttttgcgaaggtaccaccgtcgtggtgacagaagattgtggtaatcgaggccctagcctacgtactacaacggcaagtggaaagttaataacagaatggtgttgcagaagttgtactttaccgcctctgcgctataggggagaagatggatgctggtacggcatggaaatcaggccacttaaagaaaaagaagaaaatttagttaatagtctagtcaccgcggggcatgggcaaattgataatttctcacttggggtgttaggaatggctctatttctcgaagaaatgttaagaacaagggtggggacaaaacatgcaattcttctagtagcagttagttttgtaacgttaatcacaggaaatatgtcatttagagaccttggtagagttatggtaatggtgggagcaacaatgaccgatgacattggtatgggcgtaacatatctggcactgctagcagccttcaaagttaggcccacttttgctgcaggccttctacttaggaaacttacatctaaggaattgatgatggcgacaattggtattgcattactgagtcagtcaacgattcctgagaccattttagagctgacagatgcccttgcattaggtatgatggtcttaaaaatagtacgtaatatggagaaataccaattggccgtgactgtaatggcaatttcttgtgtacctaatgcagttatattacaaaacgcgtggaaggtctcgtgcaccatacttgcagccgtctcggtgagccccttgctactcacatcatcccaacaaaaggctgactggatcccactagctttaaccataaaaggattgaaccctactgcgatcttcctaacaactttgtccagaacctctaaaaagagaagttggcctctgaatgaagcgataatggcagtagggatggttagtatactagccagttcactcttaaagaacgatataccaatgacaggacctctagtcgcagggggcctactaacagtatgctacgtattgacaggaagaagcgctgatttggaactagaacgagcagcagatgtcaaatgggaagatcaagcagaaatttctggtagttcgcctatactatctataacaatatccgaagatggatcaatgtcaatcaaaaatgaagaagaagaacagacattgaccatcctgatccgcacaggactattggtcatatccggagtattcccagtcagcattccaatcactgcagcagcatggtacttatgggaagtaaagaaacaacgcgccggtgtgttgtgggatgtgccttcacccccaccagtgggtaaggcagagctagaagacggtgcataccgaattaaacaaagaggaattttaggttactcccaaataggagcgggggtatataaagaaggaacattccatactatgtggcacgttactcgtggggcagtcttaatgcaccggggaaagagaatagaaccaagctgggctgatgtcaagaaagatttaatttcttatggtggtgggtggaagttggagggagaatggaaagaaggtgaagaggtacaagttcttgctttggaacccggaaagaacccaagggcggtgcaaactaagcccggcatcttcaaaacaaatacaggtaccataggagcagtatcattggatttttcacctggcacctcagggtctccaatagtagatagaaaaggcaaggttgtgggactctatggaaatggcgtagtaacgagatcaggagcttacgtgtctgcgatagcgcaaaccgaaaagtcgatagaagataatcccgagatagaggatgatatttttagaaagaaacgattaacaatcatggatttacacccaggtgccggaaaaacaaaaagatatttaccagcgatcgtaagggaagcaataaaacgaggtctacgaaccttaatattagccccaacccgtgtagtagcagccgaaatggaagaagctctacggggattgccaattagatatcagactcccgcaatcaaagcagagcataccggaagagagatagtagatttaatgtgccatgcaacatttactatgagactgctcagtcccgtgcgggtaccgaactataatctaataatcatggatgaagcgcacttcactgatccagcttcaatagcagcccgtggatacatatcaactcgagtagagatgggcgaagcagcgggcatcttcatgaccgcaactcctccgggtagtcgtgatccttttccgcagagcaatgcgccgataatggatgaagaaagagaaattccagaacgatcctggaactcaggacatgaatgggttacagattttaagggcaaaacagtctggttcgtaccaagcattaaagcaggaaatgacattgcggcctgtctgaggaaaaatgggaagaaagtaattcaattaagtcgcaaaacatttgactcagaatacgtgaagactagagcaaatgactgggattttgtcgtaactaccgacatctcagaaatgggggcaaacttcaaagctgagagagtaattgatccacgtcgttgtatgaagccagtgatattaacggatggagaagaaagagtaattcttgcgggtcctatgccggtgacgcatagtagtgccgcacagcggagagggcgaataggaaggaaccccaaaaatgaaaatgatcaatatatctatatgggagagccattagaaaatgatgaagattgcgcacactggaaagaggcaaaaatgttgttagataacataaatacgcccgaaggtattataccgagtatgtttgagccagagagggaaaaagtcgatgctatagatggagaatacagactacggggagaggcaaggaaaacttttgtagatctaatgaggagaggtgatctacctgtatggttagcgtacaaagtcgctgcagaaggcatcaactatgcggatagaaaatggtgttttgatggaatcaaaaacaaccaaattcttgaagaaaacgtggaagtcgaaatatggaccaaagaaggtgaacgcaagaaactcaaaccacgatggttagatgcacgtatatatagtgatccattggcacttaaagagttcaaagagttcgctgcaggcagaaaatcactcacgcttaaccttatcacggagatgggccgactaccgacttttatgactcaaaaagcgaggaatgcactagacaacttagctgtgctacacacagcggaagctggtggcagagcgtacaatcacgccttgagtgaattacctgaaacgttggaaacattattactcttaaccttattagctaccgtaaccgggggtatcttcttattcttaatgagcggtaaagggatcggaaaaatgactctagggatgtgctgcatcataacggcatctgtactactctggtacgcccagattcaaccacattggatagccgcatctataattttagagttctttcttatagttctactaatacctgaaccagaaaaacagagaacaccacaagataaccagcttacctatgtcgtgattgcaatccttactgttgtagcagcgactatggcaaacgaaatgggatttcttgagaaaactaagaaagatttaggattggggtccatcactactcaagaaagtgagagcaatatactagacattgatttgcgtccagcatctgcttggactctttatgcagtcgcaactacctttgtaacgcctatgttaagacattcgatcgaaaactcgtcagtcaacgtttcactgacggcgatcgcaaatcaagcaacggttttaatgggtctgggcaaaggttggcctttatctaaaatggacattggagtcccactcctagccataggttgttatagccaagtaaatccaataacactaacggcagccttattactgttagtagcccactacgctataatagggcccggactgcaagcgaaagcaacacgtgaggcacagaaaagagcggccgcgggcataatgaaaaaccctacagtcgacggtataactgtgatagatcttgagccaataccgtacgatccaaaatttgagaagcaacttgggcaagttatgctactaatactctgtgttacacaagttctcatgatgagaacaacatgggccctttgtgaagcgctgacgttagcaactggtccaatttcaacactttgggaaggaaacccaggccgattttggaatactactatcgcagtaagcatggcgaatatcttccgaggtagctatctggcaggagcgggactcctgttctctataatgaaaaatactacaaacactaggcgtggtacaggaaatataggtgagacactaggagagaaatggaaatcgagattaaatgcattgggaaagagtgagttccaaatatataagaagagtggcatccaggaagtagataggactctagcaaaagaaggtatcaaacgaggtgaaacagatcatcatgcggtgtctaggggttcggcgaagctcagatggtttgttgaaagaaatatggttacaccggaaggaaaggtagtagatttaggttgcggtagaggtggatggtcatactattgtggtgggttgaaaaacgtcagagaagttaaaggattaactaagggaggtccggggcatgaagaacccatcccaatgtcgacatacggatggaacttggtaagacttcagagtggtgtagatgtgttctttacaccaccagagaaatgcgataccttactttgcgatataggagaaagtagtcctaatcctacaattgaagcgggacgaacactaagggtccttaacctagtagaaaactggttgaacaataatacacaattttgcataaaagtgttaaatccatacatgccatcggtaatagaaaagatggaaacactacaacgtaagtacggaggtgccttagtaagaaatcccctttcaagaaattcaacacatgaaatgtactgggtcagcaacgcgactggcaatatagtatcgtccgtcaatatgatatcaagaatgttaataaaccgattcaccatgaaacacaagaaagcgacgtatgaaccagacgtagatctcggtagtggaactagaaatatcggtatagagtcggaaataccgaatctagatattatcggaaaacgtattgagaaaataaaacaagagcatgaaacgagctggcattatgatcaagaccacccttacaaaacctgggcatatcatggaagttacgaaaccaaacaaacgggatcggccagtagtatggtcaacggggtagtcagattattaacgaaaccatgggatgtagttccaatggtgacccaaatggcaatgacagatacaaccccttttggacagcaaagggtcttcaaagaaaaagtggacacaagaacacaggaacccaaagaaggcactaagaaacttatgaagataactgctgaatggttatggaaagaactggggaagaagaaaacaccgcgaatgtgcacaagagaagagttcacaagaaaagtaagatccaacgctgcacttggagccattttcacggacgagaacaaatggaaaagtgcacgtgaagcggtcgaagacgggcgcttttgggaattggtagatagagagcggaaccttcacttagaagggaaatgtgagacgtgtgtatataatatgatgggcaaacgagaaaagaaactgggggagtttggtaaagcgaaaggctctcgagcaatctggtatatgtggcttggagcaaggtttttagaatttgaggcattaggatttcttaatgaggaccattggttttcgcgtggaaattcactatctggagttgagggtgaaggattgcatagactaggatatattttacgtgacgttggcaagaaagaaggtggggcaatgtacgcagacgatacagcgggatgggatacacgaataactttagaagatctcaaaaacgaggaaatggtgactaatcacatgaaaggggaacacaagaagctagctgaggccatattcaagctgacttatcagaataaagtagtacgagtacaaaggccaaccccacgtgggacagtaatggacattataagcagaagagatcaacgaggaagcggacaagtagggacatacggattaaacacctttacgaacatggaagcccaattaattaggcaaatggagggagaaggtatcttcaaaagtatccaacatcttacggcaacagaagaaatagctgtacaaaactggttggcaagagtagggcgagagaggctatctaggatggcaataagtggggatgattgcgtcgtcaagcccattgatgatagattcgcgagtgctctaacagctctcaatgacatgggaaaggtgcgtaaagatatacagcaatgggagccttcgcgcggctggaacgattggacacaagtaccgttttgttcacaccactttcacgaattagtcatgaaggacggaagagtgttagtagttccttgcagaaaccaggacgagttaataggacgagcaagaataagtcaaggtgctggttggtcactgaaggaaacagcatgtctgggtaagtcctatgcgcaaatgtggacattaatgtattttcaccgaagagatttgcgtctcgcggctaatgcgatttgctcagctgtgccgagtcactgggttcctacatcaagaaccacgtggagcattcatgcaaagcacgaatggatgacaacagaagacatgttagctgtatggaatagagtttggatacaggagaatccatggatggaagataaaacacctgttgagagttgggaagaagtaccttatctagggaaaagggaagatcagtggtgtgggtctctgataggattaacatcaagagcgacatgggccaagaatatccaaactgcaataaaccaagtccggtccctgattggaaatgaagaatacacagactacatgccatcaatgaagaggttcagacgagaagaagaagaagccggagtattatggtga

SEQ ID NO: 22651 - RNA, 9876 nt, synthetic construct
  misc_feature 1..9876: note = derived and/or modified CDS sequence (opt6) from DENV-2__FJ639788__SS-prME
  source 1..9876: mol_type = other RNA
actgctggtgtaattgtaatgctaataccaactgcaatggcatttcaccttactacccgcaatggagaaccgcatatgatagtagggcggcaagaaaaaggtaaatcattgctttttaaaactgaagatggagttaatatgtgcactttaatggcgatcgatcttggagaactatgtgaagacactataacgtacaaatgtccgttattgagacaaaatgaaccagaagacatagattgctggtgtaattctaccagtacatgggtaacgtatggtacatgtacaacagctggagaacacagaagagagaaaagatcagtggcattagtacctcacgtgggtatgggactagaaactcgtaccgaaacttggatgtctagcgaaggggcatggaaacatgtacagagaatagaaacatggatactaaggcacccaggttttactataatggctgcgatattggcgtacacgatcgggacaacacatttccaacgggcgcttatatttatccttcttactgcagtagccccaagtatgaccatgagatgtataggtgtttcaaacagagatttcgtggaaggggtttcaggaggatcatgggtcgatattgtactagaacatggaagctgcgtcacgacaatggcgaaaaacaagcctactctagatttcgagctaattaagaccgaagcaaaacaaccagcgacattaaggaagtactgcattgaggcgaaactaactaacaccactactgagagtcgatgtccaactcagggagaaccctccttaaatgaggaacaagacaaaagatttatatgtaaacacagtatggttgaccgtggatggggaaatgggtgcggattatttgggaaaggagggattgtaacttgcgctatgtttacgtgcaagaaaaatatggaaggaaaggtagttcagccagagaatttggagtatacaatagttataacaccccattcgggtgaagaacatgcggttggaaatgatactggtaaacacggcaaggaaatcaaaattacccctcaatcgagtatcacagaagctgaattgacaggctatggcaccgtcaccatggaatgtagccctagaactggcttagatttcaatgaaatggtattactacagatggaagacaaggcttggctggtccatcgccaatggtttttagatctacccttaccttggttacctggagctgacacccagggatcaaattggatccagaaagaaacattagttacgttcaagaacccacatgccaagaaacaggacgtagttgtgctcggatcacaagaaggcgcaatgcatacagcactcaccggagcgaccgaaatacaaatgtcctcaggtaatttattgtttacaggtcatctaaaatgtcgacttaggatggataaattacaattgaaaggaatgagttactcaatgtgcacaggcaaatttaagatagtaaaagaaattgcggaaacgcagcatggcacaatagtaattagagtacaatatgaaggcgatggatcaccctgtaaaataccctttgaaataacggacttggaaaagcgacatgttctaggaagacttatcactgtgaatccaatcgtaacagagaaagattcaccggtaaatatagaagccgagccgcccttcggagactcatatataattataggggttgagcccggacagctaaaactaaactggtttaagaaaggcagttctataggtcaaatgtttgagacaacaatgaggggtgcgaaaagaatggcaattctcggagatacagcatgggactttggaagtttgggtggcgtatttacctctataggaaaagcattacaccaagtgtttggcgcaatttacggggccgcattctctggggtttcatggaccatgaagattcttattggcgtgattatcacctggatcggcatgaactcaagatcgacatcgctaagtgtatcattagtgttagtaggagttgtcacgttatacctgggtgcaatggtacaagcagattcaggctgtgttgtttcatggaaaaacaaagaactaaaatgtggatctggaatatttatcacagataatgtacatacttggacagaacagtataaatttcaacctgaatccccgtcaaaacttgctagcgctatccaaaaagcacatgaagagggtatatgtggaatccgatcagtgacgagactagagaatttaatgtggaaacagatcactccggaattgaatcacatattatcagaaaacgaggtaaaattaacgattatgaccggggacataaaaggcataatgcaagccggcaaacgaagcctgagaccacaaccaacagaattgaaatattcttggaaaacgtgggggaaagccaaaatgctatccacagaaagccacaaccaaacttttctaatagatggtcctgaaactgcggaatgtcctaatactaacagggcatggaatagccttgaggttgaagattacggatttggcgtgtttacgacgaacatttggctaaagttacgagaaaagcaagacgttttctgcgacagcaaactcatgagtgccgccatcaaagataatagagctgtgcatgccgacatgggatattggatagaaagcgccctaaatgatacctggaaaatggaaaaagcaagttttattgaggtcaaatcttgtcactggcccaaaagccatacgttgtggtctaacggagtactggaaagtgaaatgataatccccaaaaacttcgcaggacccgtgtcccaacataattaccgcccaggctatcacacacaaactgcaggtccatggcatttaggcaaattagaaatggatttcgatttttgtgaaggcactacggtagttgtcacagaagattgcggtaatcgaggaccctcgctaagaactactacagcatcggggaaattaatcactgaatggtgctgtagaagttgcacacttccacctttaagatacagaggggaagatggatgctggtacggaatggagattagaccacttaaagaaaaagaagaaaatttagtaaattcattggttacggctggacatggacagatagataatttctcactcggtgtattaggcatggcactatttctagaggaaatgctacgaacgagggtagggacgaagcacgccattcttttagtagctgtcagctttgtcaccttaattactggaaatatgagttttcgtgatctaggccgagtaatggtaatggtaggagcgacgatgacggatgacatagggatgggcgtgacgtatctagcactattggcggcattcaaagttaggccaacattcgcagctggcctcctactgagaaaattaacaagtaaagagctcatgatggcaactataggtatagcgttattaagtcagtccactataccggaaacgattctagaattaactgatgcattggccttaggaatgatggtgcttaaaattgttcgaaacatggaaaaatatcaattagctgtaacagtaatggcaatatcttgtgtacctaacgcagtcatactacagaacgcatggaaggtatcgtgtacgatattggcagcggtaagcgtttctcctctattacttacaagctcacagcaaaaagccgattggatcccattagccctaactatcaaaggactgaatccgaccgcaattttccttacaacactaagtcgtaccagtaagaaaagatcgtggccgctaaatgaagcaataatggcagttggaatggtcagtatattggcttcgagtcttttgaaaaatgatattccaatgactggacccctagtggcagggggcctcttaacagtatgctatgtactaacaggccgatctgcggatttagaactagaacgagccgcggacgtcaaatgggaagaccaagctgaaattagtgggagctctcctatcctttcaataacaatcagcgaggatggatcaatgtcaatcaaaaatgaagaagaggagcaaacattgactattctcatacgcacagggttattagtaatatctggcgtgtttccagtcagtattcctataaccgcggccgcctggtatttgtgggaagtaaagaaacagagagcaggggtgctttgggatgttccttctccacccccagtaggtaaagctgaactagaagacggcgcatacaggataaaacaacggggcatcttggggtattcacaaataggagccggagtttataaagaaggaacatttcatacgatgtggcacgtgacaaggggagccgtattaatgcatagagggaaacgcattgaaccatcatgggcggacgtcaagaaagaccttatatcttatggaggcggctggaaactagagggtgagtggaaagaaggtgaagaagttcaagttctagcattagaacccggcaaaaacccaagagcagtccaaacgaagcctggaatctttaagacgaatactggaacaattggagccgtttctctagactttagccctggaaccagtggttctccaatagtagacagaaagggtaaagtcgtagggctttacggcaatggcgtggtgacacgatccggtgcatacgtgtctgccattgcacaaaccgagaaaagcatagaggataatccagaaatcgaagatgacatctttagaaagaaacgtttaacaattatggacttacaccccggtgcaggtaaaactaaacggtatttacctgctattgttcgggaggcaattaaacgaggattaagaacattaatattagcaccaactagagtagtagcggctgaaatggaagaagcacttcgagggctcccaataagataccaaacgccagccattaaagcagagcacactggacgcgaaatagtagacctaatgtgtcatgcaactttcactatgcgcctactatcaccagtacgcgtgccaaactataatttgatcataatggacgaagcacatttcacggaccctgcctcaatagctgcacgcggatatatatccaccagagttgaaatgggtgaggcagctggaatatttatgacagcgactccccctggaagtcgtgacccttttccacagagtaatgcgccaataatggatgaagaacgagagatacctgaacgctcctggaactctggacacgagtgggttacagacttcaaaggaaaaacagtgtggtttgtaccctcaattaaagccggtaatgatatcgcggcttgtctaaggaaaaacggtaagaaggttattcaattaagtcgcaagacttttgacagtgagtatgtaaagacgagagccaatgattgggattttgtggtaactactgacatcagcgaaatgggcgcgaacttcaaggccgaacgtgtgatagacccacgtcggtgtatgaaaccagttatattgactgacggagaagagagggtcatccttgcgggtccaatgcctgtaactcattcgtccgctgcacaaagaaggggtagaataggaaggaatccgaagaatgagaatgatcaatacatatatatgggagagcctctcgaaaatgacgaggattgtgcccactggaaagaagctaaaatgttactagacaacataaatacaccagagggaataataccttcaatgtttgaaccagaacgggaaaaagtcgacgctatagatggtgagtatagattgcgtggtgaagctcgaaaaacctttgtcgacttaatgcggcgaggagacttaccggtttggcttgcatataaagttgcagcagaaggaataaactacgcggatagaaagtggtgttttgacggcattaaaaacaaccaaatattggaggaaaatgtagaggtagagatttggacaaaagaaggcgaacgaaagaaactcaaacctagatggttagatgctaggatttactcagacccactggcattgaaagaatttaaagaatttgcagcgggccggaagtcgctaacattaaacctcataaccgaaatgggccgtttgcccacatttatgacgcaaaaagctcgtaatgcacttgacaacttagcggttctccatacggctgaagctggtggacgcgcctataatcacgctttatcagaattaccggaaactctggaaacattacttttattaactttgctcgcaactgtaaccggtggaatattcttattcttaatgtccgggaagggaatcggaaaaatgacattaggtatgtgttgtatcataacagcaagcgttcttctgtggtatgcacaaatccaacctcattggatcgccgcatccataattttggaatttttcttaatagtattgctaataccagaaccagaaaaacagagaactccacaagacaaccaattaacgtacgtggtaatagcgatactaaccgttgtagctgcaaccatggctaatgaaatgggattcttggagaaaacgaagaaggatttgggtctgggaagcattacaacgcaagaaagtgaaagtaatatattggacatagatctcagaccagcatcggcctggactttatacgcggtagcaaccacatttgtcaccccgatgctacgacatagtatagaaaattcatccgttaacgttagcttaacagctatagctaatcaggcgacggttttgatgggccttggcaaaggttggccacttagtaaaatggacattggtgtcccgcttctggctatcgggtgttactcacaagttaacccaataaccttaacagcagcattattactcctagtggcacattacgccattattggcccgggtttgcaggctaaagcaactcgagaagcccagaaaagggctgccgcagggataatgaaaaacccgacagtagatggcatcactgtaatagatttagaacccataccttatgaccccaagtttgagaagcaattaggtcaagtaatgctcctaatattatgtgttacccaagtcctaatgatgaggaccacttgggcgctatgcgaggcgttaaccctagctaccggacccataagtactttatgggaagggaatccgggaagattttggaatacaacaatcgctgttagtatggccaacatatttagaggatcttatttagctggtgctggactgttattttcgataatgaaaaatactacaaatactcgacgtggaacaggaaacataggcgaaacactaggggaaaaatggaaatcaagattaaatgccctcggaaaaagtgaatttcaaatttataagaaaagcggaatacaagaggtagatcgaacactcgccaaagagggcataaaaagaggagaaaccgatcaccatgcggtatccagagggagcgcaaaattaagatggtttgtagaacggaacatggtcacgccggaaggaaaggtagtagatctaggatgtggtagaggaggctggagttactattgtgggggactgaaaaatgttcgtgaggtcaaaggattgacaaaagggggaccaggtcatgaagaaccgattcccatgagcacatatggatggaatttggtacgactacaatcaggtgtagatgtcttctttacaccaccggaaaaatgcgatacactgttatgtgatataggggaatcctcaccaaatcccacgatagaagctggaaggacacttcgagtcttaaacttagtcgaaaactggctcaattacaacacacagttttgtataaaagttttaaacccatatatgccatctgtaatagagaaaatggaaaccttacaacgaaaatatggaggagcattggtcaggaacccacttagcagaaattctacccacgaaatgtattgggtatctaacgctactggaaatatcgtatcgagtgtaaacatgattagccgaatgctaataaatagatttacaatgaaacacaagaaagctacttacgaacctgatgtcgatttaggatccggaaccagaaacataggaattgaatcagagattcccaatctagacattataggtaaaagaatagagaaaataaaacaagagcacgaaacgagttggcattacgatcaagatcacccatataaaacttgggcatatcatggaagctacgaaacgaagcagacaggaagtgcctcctctatggtaaatggcgtggtaaggctactaactaaaccatgggatgtagtgcctatggtcacacaaatggctatgacagatacaacacctttcggtcagcaaagagtttttaaggagaaagtggatacacgaactcaagaacccaaagaaggtacgaagaaacttatgaagattaccgcagagtggctatggaaagagttggggaagaagaaaaccccacgtatgtgcacacgggaagagtttactagaaaagtaaggtctaatgcggcgctcggtgcaatatttactgacgaaaataaatggaaatccgcccgcgaggcagtggaagatggccgattctgggaattagtagatagagagagaaatttacacttagaaggcaaatgtgagacctgtgtatataatatgatgggaaaaagggagaagaaacttggagagttcggaaaggcaaaaggcagtagggccatatggtacatgtggttaggagctcggtttttagagttcgaggcattaggatttcttaatgaagatcactggttcagtagaggtaattcactatcgggagttgaaggagaaggcctccatagactagggtacattttaagagatgtgggaaagaaagaaggaggagcgatgtatgcagacgacactgccggctgggatacaaggataactcttgaagatctcaaaaatgaagagatggttactaatcatatgaaaggtgaacataagaaacttgcagaagcgatttttaaactaacctatcaaaacaaagtagtacgagtacagagacccacaccaagaggaacggtaatggacataataagtcgccgggaccaaagaggaagcgggcaggttgggacatatggcctaaacacctttacaaacatggaggcccaattaattcggcaaatggaaggtgagggtatttttaaatcaatacaacacttgacagcaacagaagaaatagctgtacagaattggctagccagagtggggcgagagagattatcgagaatggcaatatcaggtgatgattgcgtggtgaaaccaattgacgacaggtttgcatctgcgctcaccgcacttaatgatatgggaaaagtacggaaagatattcagcaatgggaaccatcgcgaggttggaacgattggacacaggtcccattctgttcacaccacttccacgagttggttatgaaggacggtcgagtattagtggtaccttgtagaaatcaagacgagctcataggtcgagcgagaatttctcaaggtgcaggatggtcattgaaggagacggcttgcttaggaaagtcatacgctcagatgtggacactaatgtatttccaccggagggatttaaggctcgcagcaaatgcaatatgtagtgcagtaccgagtcactgggtacctacgtcccgcaccacctggtcaatacacgcgaaacatgaatggatgacgacagaagacatgttagcagtgtggaatagagtatggatacaggaaaacccatggatggaggacaaaaccccagtagagtcgtgggaggaggtaccatatcttggcaaaagggaggaccagtggtgcggttccttgatcggattaacaagtcgagcaacatgggcgaaaaatatccaaacagcgataaatcaagttaggtcgcttataggaaacgaagaatatacagactatatgccgagcatgaaacgatttagacgagaagaagaagaggccggagtactatggtag

SEQ ID NO: 22652 - RNA, 9876 nt, synthetic construct
  misc_feature 1..9876: note = derived and/or modified CDS sequence (opt6) from DENV-2__FJ639822__SS-prME
  source 1..9876: mol_type = other RNA
actgcgggggtaattgttatgctaattccaacagcaatggctttccacttgactacaagaaatggtgaaccacatatgatagtaggaagacaagaaaaaggaaaaagcctgttatttaaaacagaagacggggtaaatatgtgcacattaatggcaatagatcttggagaactatgtgaagacacaataacctacaaatgtcccttattgaggcaaaatgaaccagaagatatagattgctggtgtaactcgacaagtacctgggtcacgtatggaacatgtacaacaacaggagaacataggagggagaaaagatcagtggcactcgtgcctcacgtaggtatgggtctggaaacgcgaacggaaacttggatgagttcagaaggagcatggaaacatgtccaaagaattgaaacttggatacttcgccaccctggattcacaataatggcagctatattagcttatactattggaactacccattttcaacgagcgctaattttcatactactaacagcagtcgcgccgtccatgacgatgcggtgtataggagtttctaacagggatttcgtcgaaggtgtatctgggggttcctgggtagatatagtattggaacacgggtcctgtgtaaccacaatggccaaaaataaaccaaccttggatttcgaattaataaaaacagaagcaaaacagccagcaactttacgaaaatattgtattgaagctaaactaacgaataccaccacggagagccgatgtccaactcaaggcgaaccatcactaaacgaagaacaagataaacggttcatctgcaaacacagcatggttgatagaggatggggaaacggttgtggattatttggaaaaggagggatagtgacctgcgctatgtttacctgcaagaagaatatggaaggcaaagtagttcagcctgaaaacttagaatatactattgtcataacacctcattcaggagaagaacatgctgtagggaatgataccggtaagcacggcaaggaaattaagataacaccgcaatcttcgataattgaggcagaacttacagggtacggtactgttacgatggagtgttccccaagaaccgggttagattttaatgaaatggttttacttcagatggaagataaggcatggttagtgcacagacaatggtttttggacctaccattaccatggctcccgggagcagatacccaagggtctaattggatacaaaaagaaacattagttacttttaagaacccacatgcgaagaaacaagacgttgtggtgctaggtagtcaagaaggagctatgcatactgcattaaccggggcaacagaaattcaaatgtcaagtggaaatttattgtttactggccacctcaaatgccgtttacgaatggataaactccaactcaaaggaatgtcatattctatgtgtacaggtaagttcaaaatagtaaaagaaattgcagagacacaacatggaacaatagtcattagagtacaatacgaaggtgacggttctccgtgcaagataccatttgagattactgacctagaaaaacgacacgtactcggaaggctcataacagttaatcctatagtaactggaaaagatagtcccgtaaatatagaggcggaaccaccctttggtgattcatatataataattggagtagaaccaggtcaattgaaattgaattggtttaagaaaggtagctcaatcggacaaatgtttgaaacgacgatgcgaggagctaaaaggatggctatattaggagatacggcatgggatttcggtagtctgggaggggtctttacttctatcggaaaagcacttcatcaagtgtttggtgcgatttatggtgctgccttctctggcgtaagctggacaatgaaaattttaataggggttataataacttggattggcatgaatagccgatctacttctctgtctgtttctttagtattagtgggtgtcgtaacgctgtatctgggtgcaatggtccaagctgattcgggatgcgttgtatcttggaaaaataaggaactcaaatgtggaagtggaatattcataacagataatgtacacacctggaccgaacagtataaatttcagccagaatcccccagtaaattagcaagtgccatacagaaagcacatgaagaaggaatatgcgggattcgctccgtaacgcgactcgagaatttaatgtggaaacagattactccagaattgaatcatatactatcggaaaacgaggtcaaacttactataatgacaggagacattaaaggtataatgcaagctggcaaaagatccttgagacctcaaccaactgaactcaaatactcatggaaaacatgggggaaagcgaaaatgttatcaaccgaatctcataatcagacattcttaattgacggaccagaaacagccgagtgtcctaatacaaatagagcctggaatagtttagaagtagaagattatggatttggtgtattcacaacaaacatctggctcaagctcagggaaaagcaggacgtattttgtgatagtaaactaatgtccgcagcaataaaggataatagggcagtgcacgcagacatgggctactggatagagtcggcgttaaatgatacatggaaaatggagaaagcctcttttatagaagtgaagagttgccattggccgaaaagtcatacactctggtcaaatggggtgctagaatcagagatgatcatccccaaaaatttcgctggtccggtttcacagcataattacagaccagggtaccatactcagaccgctggcccgtggcatctaggcaaacttgaaatggactttgatttttgcgaaggtaccacagttgtcgtcactgaagactgtggcaatagaggtcccagcttacgcacgactaccgcatctggtaaacttattaccgagtggtgctgtagatcgtgtacacttcctccacttcggtatcgaggcgaagatggttgttggtacggcatggagattagaccactgaaagaaaaagaggaaaatttagtgaactccctagtaacagctggtcacggtcaaattgacaatttttcattgggtgtcttaggcatggccttatttcttgaagagatgctgaggacacgtgttggtacaaaacacgcaatccttttagtcgccgtcagcttcgtcacgttaattaccggcaatatgtccttcagggacctcgggcgagttatggtaatggtgggcgccacaatgacagacgatataggaatgggagtgacatacctagcactccttgcagcttttaaagtgagacctacatttgctgctggtctcttgctcaggaaactaactagcaaagagctcatgatggccactattgggatagcattattatcacaatcaacaatacctgaaactatactagaattgactgatgcactagctctagggatgatggtgttgaaaatagtaaggaatatggaaaaatatcaattagctgttacagttatggcaattagctgtgtaccgaatgcggtaatattgcagaacgcatggaaagtatcatgtacaatacttgccgcagtatccgtcagcccgctcttattaacatcgtcgcagcaaaaggcagactggatcccactagccctcaccataaaaggcctaaaccctacggctatatttttaacgacattatctcggacgagtaagaaacgaagctggcccttaaacgaagcgattatggcagttggtatggtaagcatactcgctagcagtttattgaaaaatgacattcctatgacagggcctttagtagctggaggactcttaacagtttgctatgtattgacaggacgcagcgcagacttagagttggaaagggctgccgacgtaaaatgggaggatcaagcagaaatctctgggtcttcacccatactgtcgataacaatcagtgaagacggctcaatgagtatcaaaaacgaggaagaagaacaaacgctgacgatattaattaggacggggcttttagtaataagcggtgttttccctgtatcaattccaattaccgccgcggcatggtatctatgggaagttaagaaacaacgcgctggagttttgtgggacgttccaagtccgccaccagtagggaaagcagaactggaagatggtgcatatagaatcaaacagcgcggcattctggggtactcccaaataggcgccggtgtttacaaagaggggacctttcatacaatgtggcatgtgactagaggggctgtattaatgcatcggggcaaacgaatcgagccatcatgggcagatgtaaagaaggatttaatatcttatggaggaggatggaaactagaaggtgagtggaaagagggcgaagaagttcaagtcttagcattagaaccaggcaaaaatccacgtgccgtccaaacaaaacccggtatcttcaaaacaaataccggcacaattggtgcagtctcccttgatttcagtccaggaacatcaggttcgccgatcgtagacaggaaaggaaaagtagtaggcctctacggaaacggagtagtaacacgttcaggagcttacgtgtcagcaatagcacagaccgaaaaatccatagaggataacccagaaatcgaagacgacatctttaggaagaaaagactcacgataatggacctacaccctggagcaggtaaaactaagcgttatttgcctgcaatagttcgggaggcaatcaaaaggggtctacgcacacttatcctagcaccaactagggtagtagctgcagaaatggaggaagcgttgcgcggattaccaatacgatatcaaacgcctgctattaaggcagagcatactggtagagaaattgtcgacttgatgtgtcacgcgacgtttacaatgagactactttcgccagtaagagtcccaaattataatttgataataatggatgaagcacatttcacagatccggcatctatagcagcccgagggtacatctcaaccagggtagaaatgggagaagctgcaggtatttttatgactgcgacaccaccaggcagcagagatcccttccctcaaagtaatgcaccaattatggacgaagaacgtgaaatacccgaaagatcgtggaactctggtcacgaatgggtaaccgactttaaaggcaaaaccgtgtggttcgtaccctcgatcaaagctgggaatgacatagcagcctgcttgagaaagaatggtaaaaaggtaatccagctttctagaaaaacatttgactcagagtacgttaaaacacgggctaacgactgggactttgtagtgacgacggacatatcagaaatgggtgctaacttcaaagcagagcgggtcatcgacccaaggaggtgtatgaaaccagttattttaacagacggagaagaacgagtgatattagcgggaccaatgccggttacacacagcagtgcagctcaaagaagaggcagaataggaaggaatccgaaaaatgaaaatgaccaatatatttatatgggcgaaccactagagaacgacgaagattgcgcgcattggaaggaagccaagatgttgcttgataacattaacacaccagagggcataattccttcgatgtttgagcccgaacgcgaaaaagtggatgctatagatggcgagtataggctaagaggtgaagcgagaaaaacctttgtagacttaatgaggcgaggagatctccccgtttggctcgcctataaggtcgcagcggaaggaatcaattatgcagacagaaaatggtgtttcgatggaatcaaaaataatcaaattctagaagaaaacgtagaggtagagatttggacaaaggaaggcgagcgaaagaagctcaaaccacgatggcttgatgcccgaatttattctgatcctcttgcattgaaagaatttaaagaatttgcagctggaagaaaatcgttagccttaaatttaattacggaaatgggtaggcttccgacattcatgactcaaaaagccagaaacgcgttagataatcttgcagtgctgcatacagcagaagcgggtggtagagcttataaccatgctttgtcagaattgccagaaacactagaaactctattgttactaactttactcgccacagtaaccggaggcatattcctctttcttatgtcagggaaaggtatagggaaaatgactcttggcatgtgctgtataataacagcttctgtactattatggtacgcgcaaatccaaccacactggatagcagcatcaataattttggagttctttttgattgtacttttaatacccgaaccggaaaaacaacggactcctcaagataatcaactaacatacgtagtaatagcaatattaaccgtagttgccgcaacgatggcaaacgagatgggattcttggagaaaaccaagaaagatctaggtttaggatcgattacgactcaagaaagcgaatccaatattcttgatatagatctcagaccggcctcagcttggaccttatatgcggtagccactacgtttgtaacaccaatgctacgccacagtatagaaaattcctctgtgaacgtttcattaacagccatagccaatcaagccactgtactaatgggtctaggaaaaggatggcccctaagcaagatggacattggcgtgcctcttctcgcaatagggtgttacagtcaagtcaaccccataaccctaactgccgctcttttactcctagtagcgcactacgcaataataggcccaggtttacaagcaaaagcaacaagagaagctcagaaaagggccgctgctggaataatgaaaaatcccacagttgacggaattacggtgatcgacttagagccaataccttacgacccaaaattcgagaaacaacttggtcaggtgatgcttctaatactttgcgtaactcaagtattaatgatgagaacaacctgggcattatgtgaggccttaaccttagctacagggccaatatctaccctatgggaaggaaatccgggaagattttggaacacgaccatcgcggtgagtatggccaatatcttcagaggatcatatcttgctggggcgggccttttattcagcattatgaaaaatactacgaacacaagaagaggaacgggaaacattggagaaacgttgggagaaaagtggaaatctagattaaatgcgttaggtaaatccgagttccaaatatataagaaaagtggcatacaagaagtagaccgaacattggcaaaggaaggaataaaacgaggtgaaacggatcatcatgcagtatcccgaggctcagcaaaacttcgctggttcgtcgaaaggaatatggttacaccagagggaaaagtcgtggatttaggctgtggcagaggaggctggtcatattattgtggtggcctcaaaaacgtaagagaagtgaaaggcctaacaaaagggggcccaggacatgaagaaccaataccaatgagtacctatgggtggaatttggtaagactccaatcaggagtagacgtgttctttacaccgcctgaaaaatgcgatacattgctttgtgacattggcgagagctctcctaatccaacgattgaagccggcaggacgctgcgtgtattgaatcttgttgagaactggttgaacaacaacacacagttctgcataaaagtcttaaatccatacatgccatcagtaatagagaaaatggagaccctacaaagaaaatacggaggcgcattagtaagaaaccctttgagtcgaaacagtactcatgaaatgtattgggtcagcaatgcgacaggtaacatcgttagttctgttaatatgataagtcgcatgcttattaaccgcttcacaatgaaacacaaaaaggctacatatgaaccagatgtagatttaggtagtggaacccgtaatataggtattgaaagtgagatacccaacttggatataatcggcaaaagaatcgagaaaattaaacaagaacatgagaccagctggcattatgaccaggatcacccatacaaaacctgggcatatcatggatcctatgaaacaaaacaaacagggagtgcaagttcgatggtaaatggagtagtaagacttctgactaaaccttgggatgtggtaccaatggtcacgcaaatggcaatgacggacactactccatttggccaacaaagagtattcaaagaaaaggtagatacgagaacacaagaaccaaaagaaggtacaaagaaattaatgaaaataacagctgagtggctatggaaagaactagggaaaaagaaaacgcctaggatgtgtacgcgagaagagttcacacgaaaagtaagatcaaacgctgcactaggtgctatattcacggacgagaataaatggaaatccgctcgagaagcagtggaagacggtagattttgggaacttgtggaccgcgagcgtaatttgcacttagaaggtaagtgcgaaacttgtgtatacaacatgatgggaaagagagagaagaaattaggtgaatttggtaaagctaaaggttcgagggcaatttggtatatgtggttgggagcacggtttctagaatttgaagcgttaggatttttaaatgaggatcattggttttcaagagggaatagtctgtcaggtgtggaaggagaagggctccacagactcggctacatcctgagagatgttggtaagaaagaagggggagccatgtatgcggatgacacagccggctgggatacacgcataacactggaagaccttaaaaatgaggagatggtgactaatcatatgaaaggagaacacaagaaactagctgaagctatttttaaactaacatatcaaaacaaagtagtccgagtccaaagaccaacaccccgaggaacagtaatggatataattagcagaaaagaccagcgtggatcgggccaagtaggaacatatgggctcaacactttcacaaatatggaagcacaattgatccgacaaatggaaggtgaaggtatctttaaaagcatccagcatctgacagccactgaagagatagcagtccaaaattggttgactagagtaggaagagaacgattatcgcgaatggcaatatcaggagacgattgcgtcgtgaaaccaatagatgaccgtttcgcgtccgccctcaccgccttaaacgacatggggaaagtgagaaaggatatacaacaatgggaaccaagtagaggatggaatgattggacgcaggtaccattctgtagtcaccactttcacgaattagtaatgaaggacggcagggttttggttgtgccgtgtaggaaccaagatgagctgataggtagggcaagaatcagtcaaggtgcaggttggagcctcaaagagactgcttgtttaggtaaaagttacgcacaaatgtggactctgatgtattttcaccgtagagacctcagattagcagcgaatgcaatatgctcagcagttccatctcattgggtgcccacttcaagaacaacatggtcaattcatgccaaacatgagtggatgacgacagaagacatgttagctgtctggaatagagtctggatacaagagaatccatggatggaagataaaacacccgtagagagctgggaagaggtgccgtacttgggtaaacgtgaagatcagtggtgtggatccctaataggattaacgtctcgcgccacatgggccaaaaatatacaaacagcgattaatcaagtacgaagtctaattggcaacgaagagtatacggactatatgccatccatgaaaaggttcaggagggaagaagaagaggctggtgtcctttggtaa

SEQ ID NO: 22653 - RNA, 9876 nt, synthetic construct
  misc_feature 1..9876: note = derived and/or modified CDS sequence (opt6) from DENV-2__FJ850112__SS-prME
  source 1..9876: mol_type = other RNA
acggcaggggtaataataatgctaataccaacagcaatggcgttccatctaactacgcgcaatggggaaccgcatatgatagtagggaggcaagaaaaaggcaaatcgctactattcaaaactgaagacggagtgaacatgtgcactttaatggcgatcgatctaggtgaactttgcgaagatactataacttacaaatgccccctacttagacagaacgaaccagaggatatagattgttggtgcaactccacatctacatgggtaacatatggaacttgtacaacaacaggtgaacacagacgagaaaaacggagtgtcgcgcttgttccgcatgtagggatgggactggaaacacgcacggaaacctggatgtcttcagaaggagcatggaaacacgtgcaaagaatagaaacttggatcttgcgacatcctgggtttaccataatggcggcaattttagcttatacgataggtacaactcatttccagagagccttaatattcatactgttaacagcagtcgccccatcaatgacgatgagatgcataggaatttcaaatcgagatttcgttgagggagtgagtgggggaagttgggttgatattgtattagaacatggttcgtgtgtgacaaccatggctaaaaataaacctacgcttgattttgaactaatcaaaacggaggccaaacaaccagcaactttacgcaaatactgtattgaagccaaactgacaaacacaaccacagagtcacgatgtcctacccaaggcgaaccttccctaaatgaggaacaggataaaaggtttatctgcaaacactctatggtggatcgtggatggggaaacgggtgtggattattcggcaaaggcgggatagttacctgcgcgatgttcacttgcaagaaaaatatggagggaaaagtagtgcaacccgaaaatttggaatatacgatcgtaatcacaccacattcaggtgaagaacatgcagttggtaatgatacaggtaaacatggaaaagagatcaaaataaccccacagtcttcgataactgaagccgaattgactggttatggtactgtaacaatggaatgcagtccaaggaccggactagactttaacgaaatggtattactgcaaatggaagataaagcgtggcttgtacatagacagtggttccttgacttaccgctaccttggctaccaggagctgacacacaaggatcaaactggattcaaaaagaaaccctggtaacattcaaaaacccacatgccaagaaacaagatgttgtagtactcggatcacaagagggcgcaatgcatacggcgttaaccggagctaccgagatccaaatgtcgtctggaaatctactatttacagggcacctgaaatgtaggcttcggatggataaactacaactaaaaggtatgtcctactctatgtgcacgggcaaattcaaaattgtgaaagaaatagcagaaactcaacacggaacgatagtaattcgagtacaatatgaaggagacggttcaccttgcaaaattccattcgagataacagatttagaaaaacgtcacgtattaggtagactcattactgtaaacccgatcgtgattgaaaaagattcacctgttaatattgaagctgaaccacctttcggagattcttacataataataggggttgaacctggacaattgaaactaaactggtttaagaaaggttccagcataggacaaatgtttgagacaacaatgcgtggagcgaaaagaatggctattctgggagatactgcgtgggattttggttcattgggcggcgcatttacttctatcggtaaggctttacatcaagtatttggagctatatacggggcggctttttcaggggtaagttggactatgaagatccttataggagtcgtaataacctggatcggcatgaactcgagatctacgtcattgagtgtatccttagtcctagttggtgtcgtaaccttgtatctgggggcaatggttcaagctgatagtggatgcgttgtgtcatggaagaataaagaattgaaatgtggatccgggatatttataactgataatgtccatacctggaccgagcaatacaaatttcagcctgaaagcccgtcaaagctggcttctgccatacagaaagcccatgaagagggcatatgtggaataagatcagtgacaagactggaaaatctaatgtggaagcaaataactccagaactcaatcatatactttctgaaaacgaagtgaaattaacaataatgactggagacactaagggcataatgcaagcaggaaaaaggtctctaaggccacaaccaacagaactaaagtattcttggaaaacttgggggaaagctaaaatgttgtcaacagaatcacataaccaaaccttcctgatagatggtccagaaacagctgaatgtcccaatacgaatagagcctggaatagcctagaagtggaagactacggatttggtgtatttacgaccaatatatggttgaagttacgagaaaaacaagatgtattctgtgactcaaaactcatgtccgccgcgattaaagataatagagcagtacatgcagatatgggctattggattgaatccgcattaaatgatacctggaagatggaaaaggccagtttcatagaagtcaagtcatgtcattggcctaaatcccatacattgtggtcgaacggtgttctagaatctgaaatgataataccgaaaaacttcgcagggcccgtaagtcaacataactaccgacccggatatcacactcaaactgcaggaccatggcatttggggaaacttgaaatggacttcgatttctgcgaaggtactacggttgtggtaacagaggactgtggaaatcgtggcccttcattaaggacaacgacagcaagcggaaaattaataacagaatggtgctgcagatcatgcactttaccaccgttacgatataggggagaagacggatgctggtatggaatggaaatcagaccactaaaggaaaaagaagaaaatttggtaaacagcctagtaactgccggtcatggacaaattgacaatttcagtcttggagtactaggaatggcactcttcttggaggagatgctgcggacacgagttggaacaaaacatgctatcctattggttgccgtcagttttgtgacacttataaccggaaacatgagttttagagacctaggacgagtaatggttatggttggtgcaacgatgaccgacgacataggcatgggtgttacatacctagccctactagcagcattcaaagtaaggcccacattcgcagccgggttattattaaggaaactcacatccaaagagctaatgatggccacgattggtatcacactactatctcaaagtacaatccccgaaaccattctcgagctaacggacgccttagcgcttgggatgatggtccttaaaattgttcggaaaatggagaaataccaacttgcagttactattatggcaataagttgtgtacctaatgcagtgatcctgcggaatgcttggaaagtctcgtgtacaatccttgcggcggttagcgtaagcccactactcctcacatcatctcaacagaaagccgattggatcccattggcgttaacaatcaagggactcaatcccacagctatttttctgacaaccttgtcgaggacaagcaagaaacgaagttggccgctaaacgaagcaataatggctgtcgggatggtttccatcttagcctcatcgttattaaagaatgatataccgatgacaggaccattagtggcgggagggcttctaacggtatgttatgtactaacagggcgttcagcagatttagaattagagagagccgctgacgtaaaatgggaagatcaagccgaaatcagtggaagttcgcctatactaagtataactattagcgaggatggctctatgagcataaagaacgaagaagaggaacaaactctcacaatacttatacggacgggacttttagtcatatcaggtgtttttccagtttcaataccgattaccgctgctgcttggtacttatgggaagtcaagaaacaaagggccggagtcctctgggatgtgccatcacccccaccggttggaaaggcagaactagaagatggagcttatagaataaaacagagaggaatactaggctattcccaaataggcgcgggtgtatataaggaaggaacttttcatacaatgtggcatgtgactagaggagcagtcttaatgcacaggggaaaacgaatagagcctagttgggcggatgtcaagaaagacctaattagttacggaggtggttggaaactcgaaggtgaatggaaagagggagaagaagttcaagtactagcactagagccaggtaagaatcctagagccgttcaaacaaaacccggtatcttcaagaccaacaccggaacgataggagcagtcagtctggatttctcaccaggaacatccggcagtcctatcgtagataggaaaggaaaagtagtaggattgtatggaaacggcgtagtaactagatccggagcatacgtttcagcaatcgcccaaacggagaaatcaatagaagataacccagaaatagaagacgatatttttcgtaaaaagagactaaccattatggatttgcatcctggggctggtaaaacaaaaagatatctaccagcaatcgtcagagaagctataaagaggggcttacgaaccctaattcttgcacccactagagttgtggctgctgaaatggaggaggccttacgaggattacccatccgatatcaaacccctgcaataaaagcagaacacacaggccgagaaattgtagacttaatgtgtcacgccactttcacgatgaggttgctgtcaccggttcgggtaccaaactataatctaataattatggatgaagcccactttacagaccccgcatcaatcgctgctcggggttatataagcacacgagtcgaaatgggggaagctgccggtatattcatgacggcaacaccacccggttcacgagatccgttccctcaatcgaatgccccaataatggatgaggaaagggagataccggaaagaagttggaactccggacacgagtgggtaactgattttaaaggcaagacggtgtggtttgttccgagcataaaagctggaaatgatattgccgcatgcttacggaagaatgggaagaaagttatccagttaagtaggaaaacatttgattctgagtacgtaaaaacgagagctaatgattgggattttgtagtaacaacagacataagcgaaatgggtgctaactttaaagcagaacgagtaatagatcctaggcgatgcatgaaacctgtcatccttacagacggtgaagaaagagttattttagctggacccatgccagttactcattcgagtgctgcccaacgtagaggtcgaataggtagaaatcccaaaaatgaaaacgaccaatacatatatatgggtgagccacttgagaatgacgaagattgtgcacattggaaggaagcaaaaatgctattagacaatataaatacacctgaaggaatcataccctctatgttcgagccggaaagagaaaaagttgacgcaattgatggggaatacagattaagaggagaagctcgtaagaccttcgtcgacttaatgagacgtggtgacctaccagtatggttagcgtataaggtggctgcggaaggtattaattacgccgacagaaaatggtgttttgatgggatcaaaaacaatcaaatactagaagaaaatgtggaagttgaaatatggactaaagaaggggaacggaagaagctaaaacccagatggctagatgcgcgtatttatagcgatcccctggcactaaaagaatttaaggagttcgcagctggaaggaaatcgttaacgttgaatttgattacagaaatggggcgcttacctacattcatgacacaaaaggccagaaatgcgttagacaatctagccgtgctacacacggcggaagcaggcggaagggcatataaccatgccctttcggaactaccagaaacattggagacacttttattactcacactactagcaacagttactggcggaattttcctattcctaatgtcagggaagggaataggcaagatgacactaggcatgtgctgcatcattactgcatctgtattactctggtacgcgcaaatccaaccgcactggatagctgcctccatcatacttgaatttttcctaatcgttttactcattcctgagccagaaaaacaacgaactccgcaagataatcaattaacgtatgtagttatagctattctcacagtagtagccgcaacgatggcgaacgaaatgggctttttagaaaagaccaagaaagatcttggcctaggatctatcacaacgcaagaatcagaaagcaatattcttgacattgatctgagacctgcgagtgcctggactctatatgccgttgcaactacatttgtaacccccatgcttcgtcacagtattgaaaatagtagtgtcaatgtatcacttacagcaatcgcgaatcaagcaacagtattaatgggactagggaaaggatggcctcttagtaaaatggatataggtgtgccgttactagctataggatgttatagccaagtgaaccccatcacactgaccgccgcattactcctattagtagcccattatgcaatcatcggccccggtctacaagcaaaagcaaccagagaagcacagaaaagagcggctgcaggaataatgaaaaacccgacggtagatggtattacagtaatagatcttgagcctattccatacgatccaaaattcgagaaacagcttggacaggtgatgttgctaatactatgcgtaacacaggtgttgatgatgagaacaacctgggccctgtgtgaagcattgacgttagcgaccggcccaatttcaactttgtgggaagggaacccaggaagattctggaatacgaccatcgcagtttcgatggctaatatctttagaggatcttacctggccggtgcaggcttactatttagtataatgaaaaatacgacaaataccagaaggggcacagggaatataggggagacgcttggagaaaaatggaaatccaggcttaacgcattagggaaaagtgagttccaaatatacaagaaatcaggaatacaggaggttgatagaacacttgcaaaagaaggcatcaagcgaggagaaacagaccatcatgcagtttcaagggggtcagcgaaattacgatggtttgtcgaaagaaatatggtaaccccggaaggtaaagtggttgatctaggttgtgggcgaggcggatggtcctattactgcgggggtttaaagaacgtaagggaagtaaaagggttaacaaaaggaggtccaggacatgaagaaccaattcctatgtcgacatatgggtggaatttagtacgtttacagagtggagttgatgtgttctttacaccgccggaaaagtgtgatacattgctatgtgatataggagagtcatccccaaatcccacaatagaagcaggccgtacactacgagtacttaatctagttgaaaattggcttaataacaatactcaattttgcataaaggtactaaatccttacatgcctagtgtcatagagaaaatggaaacactgcaacgaaaatacggtggagcgctagtccggaatcctctttcacgtaacagtacacacgaaatgtattgggtgtcaaatgcaacaggtaatatagtttcaagtgtaaacatgatctctcgaatgctgataaacagatttactatgaaacataaaaaggccacgtatgaacccgatgtagatttgggaagtggaaccagaaatataggcatagaatcagaaatacctaacttggatataatcgggaaacggatagagaaaattaaacaagaacacgagacaagttggcattatgatcaagatcacccctataaaacgtgggcctaccatggtagttatgaaaccaagcagacagggtcagcaagttcgatggttaatggagtagtacgtttactaacgaaaccttgggacgtagtaccaatggttacccaaatggcaatgactgacacaacccctttcggacaacagcgtgtattcaaagaaaaggttgacactagaacacaagaaccgaaagagggcacaaagaaattaatgcgtattactgcagagtggttatggaaggagttaggtaagaagaaaactccgagaatgtgcacaagagaagagttcacccgaaaggtaaggagcaatgctgcactcggagccatcttcacggatgaaaataaatggaaaagcgccagagaagctgttgaagacggaagattttgggaattagtagacaaagaacgaaatctacaccttgagggaaagtgtgaaacatgcgtttataatatgatgggaaaaagagagaagaaacttggagagttcggaaaagcaaaaggttcacgggcgatttggtacatgtggctaggagcaagattcttggaatttgaagcacttgggttcttgaacgaagaccattggtttagtcgaggtaattctcttagtggagtggaaggagagggtctgcatagattgggatacattttaagagacgtgggcaagaaagagggcggagcaatgtatgctgacgacacagcaggatgggacacccgtataacgctagaagacttgaagaatgaagagatggtaacaaaccatatgaaaggcgagcataagaaattagcagaagcgatatttaaacttacgtaccaaaacaaagtagtacgcgttcaacgaccgacaccacgtgggacagtaatggatattatttctcgtcgcgatcaaagaggaagtggtcaagtaggtacgtatggcctaaatacatttacgaatatggaagcccagttgattcgccaaatggaaggtgagggcattttcaaatcgatccaacacttaacagcaactgaggaaatcgctgttcaaaattggttggcaagggtgggaagagaaagattgagcaggatggctattagcggagatgattgcgtcgttaaacctatagacgatagatttgcctcagcacttactgcgctcaatgatatgggaaaagtaagaaaagacatccagcaatgggaaccttctcggggatggaacgattggacacaggtaccattttgctcgcatcattttcacgaattagtcatgaaggacgggagggttctggttgtgccgtgccgaaaccaagatgaattgattgggcgagcaagaataagtcaaggagcgggttggagcctaaaggaaactgcgtgccttggaaagagctacgcgcaaatgtggactttaatgtattttcacagacgtgacttacgcttggcagctaatgctatatgtagcgccgtgcctagtcattgggttcccacatcgaggaccacgtggagcattcatgcaaaacatgaatggatgacgacggaagatatgttagccgtttggaatcgagtttggattcaagagaacccatggatggaggataagactcccgtagaatcgtgggaagaggttccgtacttaggtaaaagggaagatcaatggtgcggatccttaatcggactaacatcgagggcgacctgggccaaaaatatccaaactgcaataaatcaagtacgttcattaattggcaatgaagagtataccgattatatgccaagtatgaaacgctttaggcgcgaagaggaagaagcaggcgttttatggtaa

SEQ ID NO: 22654 - RNA, 9876 nt, synthetic construct
  misc_feature 1..9876: note = derived and/or modified CDS sequence (opt6) from DENV-2__FJ850105__SS-prME
  source 1..9876: mol_type = other RNA
acagcgggtgtaataataatgcttataccaaccgcaatggcatttcacctaacaacacgaaatggtgaaccgcatatgatcgtaggtcgccaagaaaaaggaaaatcacttttatttaaaaccgaagacggagtaaatatgtgcaccctaatggcaatagacttgggcgaattatgtgaagatacaataacatataaatgtcccctacttagacaaaatgaaccagaggacatcgattgttggtgtaacagcacctctacatgggtgacttacggaacatgtactacaactggtgaacataggcgagagaaaagatcggtagcactcgtgccacatgttggaatgggtctagaaacacgaacagaaacatggatgtccagtgagggcgcttggaaacatgtacaaagaatcgagacatggattctacgacatccaggatttacaattatggcagcaattctagcatacacgatcggaactacccattttcaacgcgcattaatattcattttactaacggctgttgcaccatccatgacaatgcgatgcattggaatttctaacagggactttgtggaaggcgtctccggtgggtcctgggtcgacatagtattagaacatggatcgtgcgtaacaaccatggccaaaaataaacctactctggacttcgaattgataaaaactgaggcgaaacaacctgcaacgctaagaaaatattgtattgaagcaaaactcactaatacaactactgaatcacgttgtccaactcagggtgaaccatcccttaatgaagaacaagataaaaggtttatatgtaaacactcaatggtcgacagagggtgggggaatggctgtggtctttttggaaaaggaggcatcgtaacatgcgctatgtttacttgcaagaaaaatatggaagggaaagtagtccagcctgaaaacctcgaatacacaatagttattacaccccattcaggagaagaacacgctgtgggaaatgacacaggaaaacatggtaaagaaattaaaattaccccgcagtcatctattacagaggcagagttgactggatacggaacagtaacaatggagtgttcaccccgaacgggacttgactttaacgaaatggtcttactgcaaatggaagataaagcatggctagtccacagacaatggttcctggacttgccactaccatggctaccaggagctgacactcaaggcagcaattggattcaaaaagaaacattagtcacattcaaaaatccacacgccaagaaacaagatgttgtagtactcgggagccaagaaggagcaatgcacactgcacttacaggggctacagaaatccaaatgagttcaggaaacttactatttactggtcatctaaaatgtagattgcgtatggataaattacagttgaaaggcatgagttattcaatgtgtacaggaaaattcaaaatagtaaaagagattgcagagacacaacatggcacaatcgtaatacgcattcagtatgagggagacgggagtccgtgtaaaatacccttcgaaattactgatttagaaaaacggcacgttttaggacgactgatcacagtaaatccaatcgtgatagaaaaagactctcccgtaaatatagaagccgaaccaccgtttggggattcttatataattataggagcagagcctggacagcttaaactaaattggtttaagaaaggaagcagcattgggcagatgttcgagacaactatgcgaggagcaaaaagaatggcaatattaggcgatacggcctgggatttcggcagcttaggtggtgtttttacgagcataggtaaagcacttcaccaggtctttggagctatatatggtgcagcattcagtggagtaagttggacaatgaaaatccttatcggcgttgttatcacatggatcggaatgaatagccgcagcacttctttatctgtctctttagtacttgtaggtgttgtgaccctttatctcggtgcgatggtacaggccgactccggttgcgtagtctcatggaaaaataaagaacttaaatgcggctcaggcatatttataactgataatgtacatacatggacggaacaatataaattccagccagaatctccttcgaaattagcgtcggcaatccaaaaagcgcacgaagaaggtatttgtggtatccggtctgtgacccgcctagagaacttaatgtggaaacagatcacaccggaacttaatcacatactatcagaaaatgaagttaaacttacaattatgaccggagacaccaaaggaataatgcaggcgggtaaacggagtttgagaccccaaccaacagaattaaaatattcatggaaaacctggggaaaagcaaaaatgttatccaccgagtcacacaatcaaactttcttaatagatggacctgaaaccgcagaatgccccaatactaatagagcatggaactcgctagaagtagaagattatggatttggcgtattcacaacaaatatctggttgaaattaagagaaaaacaggatgtgttctgtgattcgaaattaatgtcggcagcaataaaagacaacagagccgtgcatgcggacatgggatattggattgaaagtgctttaaatgatacttggaaaatggaaaaggcaagttttatcgaagtgaaaagttgtcactggccaaagagccatacactttggtctaacggggtcttggaatcagagatgattatccccaagaatttcgccgggccagtgtcgcaacacaactatagacctggctaccacacacaaaccgccggtccctggcatctcggcaagttagagatggacttcgacttttgcgaaggaacgacagtagtggtcacagaagactgtggaaacaggggtccctccttacgcacaaccaccgcgtccggcaagttaataacagaatggtgctgtaggagctgtacactaccacctcttcggtaccgtggagaagatggttgttggtacggcatggagatacggccactaaaagagaaagaagaaaatcttgttaactcactggtaacagcaggccacggacagatagataatttttcccttggtgtactaggtatggccctcttcctcgaggagatgcttagaacccgagttgggactaaacacgccatacttctagtagccgtgtcctttgtaaccctaatcactggtaacatgagtttcagagatttaggtcgcgttatggtaatggtaggagccacaatgaccgacgacatcggaatgggcgttacctatttagcgctactagcagcgttcaaagttaggccaacgttcgcagcaggccttctactaagaaaattaacctccaaggaattgatgatggctaccataggaataacgctattatctcaatcgaccataccagaaaccatactagaattaactgacgctctagcattaggtatgatggtcttaaaaatcgtacgtaacatggagaaataccaattagctgtcacgataatggccattagttgtgtaccaaacgctgtaatccttagaaacgcttggaaggtttcatgcacaattttggctgcagtatcagtatcaccattgcttctgaccagctcgcaacagaaggccgactggatacccttagcactcactataaaaggtttaaatccaacagcaatattcttaacgaccttatcacgtacatcaaagaagcgcagctggcccttaaatgaggctattatggccgttgggatggtaagcatcctcgcatcctccttattaaagaacgacattccaatgacaggacccctagttgcaggcggattgcttacagtatgttatgttttaaccggaagaagcgctgatttggagttagaacgcgcggctgatgtcaaatgggaggaccaagccgaaatttccggtagtagtccaattttatcgataactatcagtgaggacggttcaatgagtattaagaacgaagaagaagaacaaacgttaacaattttaataagaacggggttattggtcataagcggcgtttttccagtgagcatacctataacggccgcagcatggtatctgtgggaagtcaagaaacaacgtgcaggagtgctctgggatgtgccgagcccaccgcctgtaggtaaggctgagctagaagatggagcatatcgaataaaacaaagagggatcttgggctactcccagataggagcaggagtttataaagaaggaacgttccatactatgtggcatgtaacaagaggggcagtcttaatgcatagaggcaagagaattgagccatcatgggcagacgtaaagaaagacctgatatcgtacggcggcgggtggaaattagaaggtgaatggaaagagggggaagaggtacaagtacttgcgctagaacctggtaaaaacccaagagccgtacaaacgaaaccaggcattttcaaaacaaatactggaactattggggccgtttcactagacttttctccgggaacgtccggatcaccgattgtcgatagaaagggaaaggtggtaggcctgtatggaaatggggtagtcactcgatcgggagcatatgtttcagcgatagcgcaaacggagaaaagtatagaggataatccagagatagaagacgacatctttaggaagaaaagattaactattatggatctacatccaggagctggaaaaacaaaacgatatttacctgcaattgtgcgggaagccataaagagaggcctaagaacactcattcttgcccctactagagtggtagcagcagaaatggaagaagcacttcgaggtttaccaataagatatcaaactccagcaataaaagctgagcataccggtcgagagatagtcgatctaatgtgtcatgctaccttcacaatgaggttgctgtctcccgtgcgagtaccaaactataatcttatcatcatggacgaagcacattttacagatcctgcatccatagcggcacgggggtacatttctacacgcgtagaaatgggagaagcagctggaatattcatgactgccacccctcctggctcacgggatccttttccccaatcaaatgcgcctataatggatgaagagagggaaatacccgaaagatcatggaactcagggcatgaatgggtaacagactttaaaggtaaaacggtctggtttgtaccgagtataaaagcagggaatgacattgcggcctgcttacgtaaaaatggtaagaaagtcatccaactgagtcgcaaaacattcgatagtgagtatgtcaaaacccgtgcgaacgactgggactttgttgtcactactgacatctccgaaatgggtgctaattttaaagctgagagagtaatagatccacgtcgttgcatgaaacctgtaatattaacagacggtgaagaaagagtcatcctagcaggcccgatgccagtaacccactcctcagcagcccagagacgtggacgaataggtagaaatccaaagaatgagaatgaccaatacatatatatgggggaacccttagaaaatgacgaagattgcgcgcattggaaagaagccaaaatgttattagataatataaacaccccagaaggaattataccttcaatgttcgaacctgagagagagaaagtagacgccatcgacggagagtatagactaagaggtgaagcaagaaaaacatttgtcgatcttatgcgaagaggtgatctaccggtatggctggcatataaagtagctgccgaaggtataaactacgcggatagaaaatggtgttttgatgggatcaaaaacaatcaaatactagaagaaaatgttgaagtcgaaatatggactaaggaaggtgaacgcaaaaagctgaaaccacgatggctcgacgctagaatttattcagatccgctcgctttgaaagagttcaaagaatttgccgcaggacgaaaaagtttaactctgaatttaatcacagaaatgggtcgtctgcccacttttatgactcaaaaagcccgaaacgcgctagataacttggcagtgctccacacagcagaagccggaggccgagcttataaccatgcattaagtgaattaccagagaccctggaaactttactacttctaactctattagccacggtgacaggtggaattttcctatttctaatgagtggtaaaggaattggaaaaatgactctgggaatgtgctgcatcattaccgcctctgtactcctttggtatgctcagatacagccccattggattgcagcgtcaatcatccttgagttctttttaatcgtcctcttaatacctgaacctgaaaaacaaaggaccccgcaggataatcagttaacatacgtagtgatagccattcttaccgtagtggctgcaactatggcaaatgaaatgggattcctggaaaagaccaagaaagatttgggactgggttcgattacaacacaagagagcgaatctaatattttggatattgacctacgacctgccagtgcctggactctctatgcagtagctacaactttcgtcactcctatgctaagacattcgatagaaaatagttccgttaacgtgagtttgactgcgatagccaatcaggccacagttctcatggggctagggaagggctggccgctaagcaaaatggatattggggtacctctattagccataggatgctatagccaagtgaatccgataacattaacggccgctctattacttcttgtcgcacattatgctattatcggtccgggacttcaagcaaaagcaactagagaagcccagaaaagggcagcggcaggaattatgaagaatcctacagttgatggaatcacagtaattgacctagagccaataccatacgacccgaaatttgaaaagcaacttggacaggtgatgttattaatactatgtgtcactcaggtattaatgatgaggaccacctgggcgttatgcgaagctctaaccttggctacaggcccaatatcaacgctgtgggaaggtaaccctggacgtttttggaacacgaccatagcagtcagcatggctaacatctttagaggatcataccttgcaggcgcaggtctactattttctataatgaaaaatacaacgaacacgagaaggggtactggaaacataggtgaaaccctcggtgaaaaatggaaatcgcgcctaaatgccttgggaaaatcagaatttcaaatttacaagaaatcaggaatccaagaggttgaccgcaccctagcgaaagagggtattaaaaggggcgagactgatcatcatgcagtatccagaggaagcgcaaaattgaggtggttcgtcgagagaaatatggtaactcccgaaggcaaagttgtagacttaggttgtggccgtggagggtggtcgtactattgcggtggtctcaaaaatgtcagagaagttaaaggattgactaaaggcggtcctggacatgaagaaccgatccctatgtcaacatatggctggaacctagtgagactgcaaagcggagtagacgtatttttcactcctccagagaaatgtgatacactattgtgtgacattggagaatccagccctaatccgaccattgaagccggcagaactctacgggtcctcaatctagtggagaattggttaaacaacaatacgcaattttgtataaaagtattgaatccatacatgcctagcgttattgagaaaatggaaactttacaaagaaaatatggaggcgcattagtacgcaatccgctatcacgaaatagtacacatgagatgtattgggtgagcaatgccacaggaaatatagtaagctcagttaatatgatctcacgcatgctaataaatagatttacaatgaagcataagaaagcaacatatgaacctgatgtggacctaggatcaggaacaaggaatataggaatagaatctgaaattcccaatttagacattatcggaaagagaatagagaaaataaaacaagaacacgagacatcttggcattacgaccaagaccatccatataagacatgggcataccacggatcttatgaaactaaacaaacgggaagtgccagctctatggtaaatggcgtcgttagattgttaactaagccctgggatgttgtgccaatggtgactcaaatggccatgactgatacaactccttttggacaacaaagggtctttaaagagaaggtagacacacggactcaggagcctaaggagggtacgaagaaattgatgagaatcacggccgaatggctatggaaagaactcggtaagaagaaaacccctagaatgtgcacaagggaagaatttacccgaaaagttcggagcaacgcagcactaggtgccatttttaccgacgaaaacaaatggaaatccgctagagaagccgtagaggatgggaggttctgggaattagtggataaggaacgcaacttgcatttggagggaaaatgcgaaacatgcgtgtataatatgatgggaaagagagagaagaaactaggagagttcggcaaggcaaaaggatcgagggcgatctggtatatgtggctaggcgctcgattcttggaatttgaagcacttggtttccttaatgaggatcattggttcagcaggggaaatagtctgtctggtgttgaaggagaagggttacaccgacttggatacattcttagagacgtagggaagaaggagggtggagcaatgtatgccgacgataccgcaggttgggatactagaataacgttagaggatctaaagaatgaggaaatggtcactaatcacatgaaaggagaacataagaaattagccgaggccatattcaaactaacatatcaaaataaagttgtcagagtacagaggccaacacccagaggtacagtcatggatataataagtcgaagagaccaaagagggagcgggcaagtcggaacctacggactaaacacctttaccaatatggaagcacaactgattcgtcaaatggaaggcgaaggaatattcaagtcaatccaacatttaacggcaacagaagagattgcggttcaaaattggcttgcaagagtgggcagagaaagacttagccgtatggcaattagtggggatgattgtgttgtaaaaccgattgatgatagatttgcaagcgccctgactgcattgaacgacatgggaaaagtgaggaaagatatccagcaatgggaaccctcaagaggatggaacgattggacccaagtgccattttgttcacatcattttcatgagttagttatgaaggatggtagggtacttgtggttccttgccgaaatcaagatgaactaattggcagagcgcgcatatcacaaggtgcaggttggtcactaaaagagacagcttgcttaggaaagtcttatgcacaaatgtggacactaatgtattttcatcgtagagatttgaggttagcggctaatgcaatatgtagtgcagtaccgagtcattgggtgcccactagcaggaccacctggagtattcatgctaaacatgaatggatgacgacagaggatatgttggcagtatggaatcgagtatggatccaggaaaatccatggatggaggataaaacaccagtcgaatcctgggaggaagtaccatatcttggtaagagagaagatcaatggtgtggcagtttaattggattaacttcaagagcaacatgggctaaaaatattcaaacagcaattaaccaggtgcgttcattaatcgggaatgaagagtacacagactatatgccaagtatgaaaagatttcgaagagaagaagaagaagcgggcgtattgtggtaa

SEQ ID NO: 22655 - RNA, 9876 nt, synthetic construct
  misc_feature 1..9876: note = derived and/or modified CDS sequence (opt6) from DENV-2__FJ850106__SS-prME
  source 1..9876: mol_type = other RNA
acagcaggggtgataattatgctcatacccactgctatggcgttccatctaaccacgaggaacggggaaccacacatgatagttggacggcaagaaaaaggaaaaagccttctttttaaaacagaagacggagtaaatatgtgcaccctcatggcaatagatctgggagaactatgtgaagataccataacttataaatgcccattacttaggcaaaacgaacctgaagatatagattgctggtgtaactctacctcaacgtgggtaacgtatggaacatgcactactacgggagaacatagacgcgaaaaacgatctgtagcattggtacctcacgtgggaatgggtctggaaactagaactgaaacttggatgtcctctgaaggtgcatggaaacacgtacagcgaatcgaaacatggatattgcggcatcctggattcacaataatggcagctatactagcttacacgataggcacaactcacttccaacgggcattaatatttattctgttaacagcggtagcaccatctatgacaatgagatgtataggcataagcaatagagactttgtcgaaggagtaagcggaggtagctgggtagatatcgtattagaacatgggtcttgtgtaaccacaatggccaaaaataaaccaacactagatttcgaactaataaaaactgaagcaaaacaacctgcaacgctaagaaaatactgcatagaagcaaaattgacgaatacaacaaccgaatcacgctgccccacacagggcgagccttcgttaaacgaagaacaagacaaacgatttatatgcaaacatagtatggtggatcgcggatggggtaatggatgtggattgtttggaaaaggaggcattgtgacctgcgcaatgtttacatgcaagaaaaatatggaaggcaaagtggtacagccagagaatttagaatacacgattgtaattaccccgcattctggggaagaacatgcagtcggtaacgatacaggcaaacatgggaaagaaatcaaaattacaccccaaagttcgattacggaagccgagctaacagggtacgggactgtcacgatggaatgctcaccaagaacaggtctagatttcaacgaaatggtgctactccaaatggaagataaagcatggttggtacataggcagtggtttttagacttgccactcccttggttaccaggtgccgatacacaaggaagtaactggatccagaaggaaacattagtaacatttaagaatccccacgctaaaaagcaagatgttgtcgtgcttggaagccaggagggggcgatgcacacggcgttgacgggagcgactgaaatacaaatgagtagcggaaacctactgttcacgggccatctaaaatgcagactaaggatggataaactccaattaaaagggatgtcatacagtatgtgtacaggcaagtttaaaattgtaaaagagatcgcagaaacacaacacggaacaatagtaataaggatacagtatgaaggggatggcagcccgtgcaaaataccttttgaaattaccgatttagaaaagcggcatgtactcggccggctcattacagtcaaccccatagtaatagaaaaagacagccccgtcaatatagaagccgaaccaccatttggagatagttatataattataggagttgaacctggacaattaaaattaaactggttcaaaaagggttcgtctataggtcagatgttcgaaacaactatgaggggcgctaaacgcatggctatcttaggagacacggcatgggattttggcagtcttggcggcgtttttacgtccataggaaaggccctgcaccaagtctttggcgccatatacggagcagcattctcaggcgtgagttggaccatgaaaatactaataggagtagtcattacgtggatagggatgaactcaagatctacgtctctatcagtatcactcgtcctagtaggtgtcgtaacgctatatttaggagcaatggtacaagcggattctggatgtgtagttagctggaaaaataaagagttgaaatgtggtagtgggatctttatcacagataatgtacatacatggactgaacaatataaatttcaacccgagtcgccttccaaactagcttcggcaatacaaaaagcccatgaagagggcatttgtgggatacgtagcgttactagacttgaaaacctaatgtggaaacagataacacccgaactgaaccatattttaagtgaaaatgaggttaaactaacaataatgacaggagacacgaagggaattatgcaggcaggcaagcgttcactccgaccacagcccaccgaactaaagtactcgtggaagacgtggggaaaagcaaagatgctcagcactgagtcacacaatcaaacattcctgatagatgggccagaaaccgccgaatgtccaaacactaatagagcatggaatagtttagaggtagaagattatggttttggtgttttcactacaaatatctggttgaagctaagggaaaagcaagatgtgttttgtgattccaaactaatgagcgctgccattaaagacaatcgagcggtccacgcggatatgggatattggatcgaatcagcattgaatgacacatggaaaatggaaaaggcgagttttatcgaagtaaaaagttgtcattggccaaagagccatacgttgtggtcaaatggagtacttgaaagcgagatgataatccccaaaaatttcgctggaccagtatcgcagcacaattatagaccagggtatcacacccaaaccgcagggccgtggcatctcggaaaactagaaatggattttgacttttgtgaaggaacaactgtcgtagttacggaagattgcggaaacagaggaccaagtctgcgcactacaacagcatccggtaaattgataactgaatggtgttgcagatcgtgtacgctgccgccattaagatataggggagaggatggatgctggtacggaatggagattagaccacttaaagaaaaagaagaaaaccttgtaaactctctagtgactgcaggacatggtcaaatagataattttagcctaggagtattgggcatggctctctttctcgaagaaatgctcaggacacgcgtaggaacgaaacacgcaactttacttgtagctgctagctttgtaacactaataactggcaacatgtctttccgagatctaggaagagtcatggtcatggtgggcgcgacaatgactgacgatatcggaatgggagtcacatatctggccctactcgccgcattcaaggtcaggccgacatttgcagcagggttacttctgaggaagctaacctcaaaagaactcatgatggcaacaatcggtataaccctattgtctcaatcaacaatcccagaaaccatactggaacttactgacgctcttgcgttagggatgatggtcttaaaaatagttagaaacatggaaaaataccaactagcagtgacaattatggcgatctcgtgtgtacccaatgcagtaattctacgtaatgcttggaaggtatcatgcacaatattagctgctgtttcagtttcgcctctactcttgacatccagtcaacaaaaagcagattggattccgttggcactaaccatcaaaggcctgaacccaaccgcaatttttctcaccactctgagccgaacgtctaagaaacggagctggccgttaaacgaagctataatggcggtaggtatggtgtctatattggcatctagccttttaaagaatgatattcctatgacaggacctcttgttgccggcggccttctaactgtatgttatgttctgactggaagatccgctgacctagagttagagcgtgctgcagatgtgaaatgggaggaccaagcagaaatttcaggaagttctcccattttatcaataactatctcagaagacggaagtatgagtataaagaatgaagaggaagaacaaactctaactattctcattaggaccggattattagttatctctggcgttttcccagtaagcattccaattaccgcggctgcttggtacttatgggaagtaaagaaacaaagggccggtgttttatgggatgtcccttctccgcccccagttggtaaagctgaacttgaagacggagcgtatcggataaaacagagaggaatactaggttactcgcaaataggagcgggagtatataaagaaggcaccttccacacaatgtggcatgtgactcgaggagctgtacttatgcatagaggaaagaggatagaaccgagctgggccgatgtcaagaaagacctaataagctatgggggtggatggaaactggagggagaatggaaagaaggtgaagaggtgcaggtcctagcgcttgaaccaggcaaaaatccgagggctgtacaaacaaaaccaggtattttcaaaacaaatacgggcacgattggagcagtcagcctcgatttttctcctgggacatccggctcacccattgtagatcgaaaaggaaaggttgtgggtctgtacggaaatggagtggtaacgagaagtggagcatatgtaagtgcaatcgcacaaaccgagaaaagtatagaagataatccagaaatagaggacgacatatttaggaaaaagaggttaactatcatggatctccatccaggagccggaaaaacaaaaagatatctaccggcaattgtgagagaggcgataaaaagagggttacggacgctcatccttgctccgactagagtagtagctgcggaaatggaagaagcactaagaggtctccccattaggtaccagacaccagcaatcaaggcagagcacactggaagagaaatcgtagaccttatgtgtcacgcaacctttacaatgagattactatctccagtacgagtacccaattataacttgataatcatggacgaagcacacttcacagatccagcatctattgctgcgagaggttatatatcgacccgtgtggaaatgggtgaagctgccggaatatttatgacagccaccccaccaggcagcagagatcctttcccacagagcaatgcaccaataatggatgaggagcgcgagattcccgagagatcctggaatagtggccatgaatgggtgacagatttcaaaggaaaaacagtgtggttcgtgccatcgatcaaagcgggcaatgacattgctgcatgtttaaggaaaaacgggaagaaagtcatacagctttctcgcaaaacctttgattccgagtatgtcaaaacacgtgctaacgattgggatttcgtagttacgacagatatatctgagatgggggccaattttaaagcagaaagagtaatagacccgagaaggtgtatgaaacctgtcattctgacagatggagaagaaagagtaatactcgcaggtccaatgccagtgactcatagcagtgcggcacaaaggcgaggtcgtataggacgcaatcctaaaaacgaaaatgatcaatatatatacatgggtgaacccctagaaaacgatgaagactgtgctcattggaaagaagctaaaatgttattagataatattaatacgccggaaggtatcataccgtcaatgtttgaacctgagcgggaaaaggtagatgcaatagatggcgaataccgcctaagaggcgaagctagaaaaacgttcgtggatttaatgcgacgaggggacttaccagtatggttagcatataaagtagcagctgaagggattaactacgcagatagaaaatggtgtttcgacggaatcaagaacaaccaaatacttgaagaaaacgtagaggtggaaatatggacaaaagaaggagagagaaagaaattgaaaccaaggtggttagatgcgcgaatatactccgatccacttgcattgaaagaatttaaggagttcgcagcgggcagaaagtcgctaacattgaatttgattacagaaatgggaagactcccaactttcatgacacaaaaagcgagaaatgcattggataacctagcggttttgcatacggcagaagcgggaggtagagcgtacaaccacgccttatctgaattaccagagacactcgagaccctcctcttgctgaccctccttgccactgtaaccggcggtatctttttattcttaatgagtggtaagggcatcggaaaaatgactctcgggatgtgctgtataataacagcatcggtacttttatggtacgcacaaatacagccacattggatagcagcaagcataattttagagttctttctaattgtacttctgatcccggaacctgagaaacagagaaccccacaagataatcaattaacatacgttgtaattgctatactgaccgtagtagctgcaactatggctaacgagatgggatttctagagaaaaccaaaaaggacttaggattgggttctatcaccactcaagagtccgagtccaacattcttgatattgacttaaggcccgcgtcggcctggactttatacgccgtagcaaccacgtttgtaactccaatgttaagacatagtatagaaaactcttcagtaaatgttagcctaacggctatagccaaccaggccacagtacttatgggcttgggaaaagggtggccactctccaaaatggatataggtgtccccctgttggccattggctgttattcgcaagtaaacccgattaccctcacagccgcattactgctattagtagcccattatgctatcataggtccaggccttcaggcgaaagcgactcgggaagcccaaaaacgagcagcagcaggaattatgaagaacccgacggtcgacggtataaccgtcatagatctcgagcccataccctacgatcctaagttcgaaaaacaactaggtcaggtgatgcttcttatcttgtgtgttacacaagtcctgatgatgagaactacttgggctctatgtgaggctttaacccttgcaacagggccaatctctaccctttgggaaggtaatcctggtagattttggaatacaacgatcgcggtctctatggcaaacatattccgtggctcgtacctcgctggcgctggtctattattctcgataatgaaaaacacgaccaatacaagacgaggaacaggcaacattggtgaaactttaggagagaaatggaaatctagactcaatgctttagggaaaagcgaatttcaaatatataagaaatccggtatccaggaagtcgatagaaccctagcaaaagaaggaataaagagaggtgagacagatcaccacgcggtcagtcgaggttcggcaaaattgagatggttcgtagaaagaaacatggttactccagaaggcaaagtagtcgacctcggttgtggcagaggagggtggtcatattactgtggcggtcttaaaaatgttagagaagtaaagggactaacaaagggaggaccaggacacgaagaacctatcccgatgagtacgtacggctggaatctagtaagactccagtcaggagtagacgtatttttcactccacctgagaagtgcgacacgctattatgtgatatcggagaatcgtccccaaacccgactatcgaagccgggcgtacactaagagtgttgaacttagtagaaaactggttaaataataatacacaattctgtataaaagttttaaacccctatatgccatcagtcatagagaaaatggaaacactccaacggaaatatggtggagcacttgtacggaaccccttatcccgaaatagcactcatgaaatgtactgggttagcaacgctactgggaatatcgtttcatctgtaaatatgataagtaggatgttaatcaatcgcttcacaatgaagcacaagaaagcaacgtacgaaccggacgtagatcttggttccggcacaaggaatattggcatagaaagcgaaataccaaaccttgatatcattggaaagcgtatagagaaaatcaagcaagaacatgaaacatcctggcactacgatcaggatcatccatataaaacgtgggcctatcatggatcatacgaaactaaacaaacaggtagtgcatcctcgatggtaaatggtgtagtgagacttctcacgaaaccatgggatgttgtcccaatggtgactcagatggcaatgacggacactacaccattcggccaacagcgtgtgttcaaagaaaaagtagatactaggacgcaggaaccaaaggaggggactaagaaactaatgcggataacagcagagtggttatggaaagagttaggcaagaagaaaacgcctagaatgtgtaccagagaagaatttacacgaaaagtacgatctaatgcagcattgggagctatatttactgatgaaaataaatggaaaagtgcacgagaagctgtagaagatgggcgattttgggagcttgtggataaagagcgtaacctccacttagaaggaaaatgtgaaacttgtgtatacaacatgatgggtaaaagagagaagaaattgggagagttcggcaaagcgaaaggcagcagagccatttggtatatgtggctaggggctagattcttggagtttgaggctttaggtttcttaaatgaagatcactggttcagtaggggaaactccttaagcggagtagaaggagaaggactgcacagattaggatacatattaagagacgtcggcaagaaagaaggtggagcaatgtatgcggatgacacggcaggatgggatactcgaattacacttgaggacttaaagaatgaagaaatggtgaccaaccacatgaaaggtgaacacaaaaagctagcagaagcaatctttaaattaacctaccagaacaaagtagtaagagtacagagacctacgcctcgtggaacagttatggatataatatcaagaagggaccaaagaggctcaggccaggtgggaacctatggtttgaatactttcacaaatatggaagcacaattgatacgtcaaatggaaggagagggcatatttaagtcgatccagcaccttacagctacagaagaaatagcagtccaaaattggcttgctagagtaggaagagaaagactttctagaatggcgatctcaggtgacgattgtgtagtcaaaccgatagatgaccgttttgcctctgcactaactgctctaaatgacatgggaaaagttagaaaagacatacaacaatgggagccttcccgggggtggaacgattggacacaagtacctttctgttcacatcatttccatgaattagttatgaaagacggtagagtgctggtcgtaccctgtagaaatcaggatgagttgatcggtagagcgcgaattagtcaaggagcgggctggtcattaaaagaaactgcatgcttagggaaatcctacgctcagatgtggacattaatgtactttcatagaagggatttacggttagcagcaaatgctatatgtagtgcagtacctagtcattgggttccgacaagtcgtaccacatggtcaatccatgctaaacatgaatggatgacaactgaagatatgttagctgtatggaatagagtatggattcaagaaaacccctggatggaagataaaactccggttgaaagctgggaagaagtaccttacctcgggaagcgtgaagatcagtggtgcggatcactaatcgggttgacatctcgtgctacgtgggcgaagaacatccaaaccgcaataaatcaagtccggtcgctaattggaaacgaagaatatacagattacatgccaagcatgaaacgatttaggagagaggaggaagaggctggagtactttggtaa

SEQ ID NO: 22656 - RNA, 9876 nt, synthetic construct
  misc_feature 1..9876: note = derived and/or modified CDS sequence (opt6) from DENV-2__FJ850107__SS-prME
  source 1..9876: mol_type = other RNA
acagccggagtcattattatgttaataccaactgcaatggcgtttcacttaactacacgaaatggagaaccacacatgattgtcggtcgacaagaaaaaggtaaatccctattattcaagaccgaagacggggttaatatgtgtaccttaatggctatagacctaggagaactgtgcgaagacacaataacttacaagtgccccttattacgtcaaaacgaaccagaagatatagattgttggtgcaattcaacgtcgacctgggtcacatatggaacctgcacaactacaggtgaacacagaagagagaaaaggtcagttgcgctagtaccccacgtgggaatgggactagaaactaggacagaaacttggatgtcaagtgaaggcgcatggaagcatgtacaaaggatagaaacatggatactacggcacccggggttcacgattatggctgcaatactggcatatacaataggaacgacacatttccaaagagcattaattttcatactactaacggccgttgctccatctatgacaatgcgatgtataggtatatccaatcgcgattttgtggaaggtgtaagtggcggaagctgggtagacattgtattagaacacggtagttgtgtgactacgatggctaaaaataaaccgacgctagatttcgaattaataaagacggaagcaaagcaacccgccacactacgcaaatattgtatagaagctaagttaacaaatacaaccacagaaagtagatgcccgactcaaggtgaaccgagtttaaatgaagaacaggataaaagattcatttgtaaacattcgatggtagatagggggtggggtaatggctgcggcttatttggaaaaggaggaatagtcacatgtgctatgtttacctgtaaaaagaatatggaaggaaaagtcgtacaaccagaaaatttggaatatacgatcgtaattacgccacattctggcgaagaacatgctgttggaaatgatactggaaaacacggaaaagaaataaagattacaccacaatcatcgatcactgaagccgagctaaccggttatggaaccgttacaatggaatgttccccacgcacgggtttagattttaacgaaatggttctactacaaatggaagataaagcatggctagtacatagacaatggttcttggatcttcccctaccttggcttccaggagcggacacacaaggatctaactggatccagaaggaaaccttggtgacttttaaaaatccgcatgcaaagaaacaagatgtggttgttttaggttctcaagaaggtgcgatgcatacagcattgacaggtgcaactgaaatacaaatgagttcaggcaacttactattcactggccatttaaaatgcagattaagaatggacaaactacaactaaaagggatgtcttatagcatgtgtacaggcaaatttaaaatagtaaaggaaatagcggaaacgcagcacggaacaatcgtaattcgcatacagtatgaaggggacggttcaccatgcaaaatcccgtttgaaataacagatttagagaaacgccacgtacttggtcgcctaataacggttaatccgatagtaatagaaaaagatagcccagttaatattgaggctgagccaccattcggagatagctacataattatcggagtcgaaccaggacaattgaagctaaattggtttaagaaaggatctagtataggacagatgtttgaaacaacaatgaggggcgctaagagaatggcaattctaggagacaccgcatgggactttggttcccttggaggtgtatttacgagtattggcaaagcattacatcaagtgtttggtgctatttacggagcagcttttagtggagtcagctggactatgaagatacttataggcgtggttataacttggattggcatgaactctagaagcacttccctatccgtgtctcttgttctagtcggagtggtaacactatatttgggagcaatggttcaagccgattcaggttgcgtagtatcctggaagaacaaagaactaaagtgcggatccggcatctttattacagacaatgtgcacacatggacagagcaatacaaatttcaaccggaatcgccgagtaaattagcaagtgcaattcaaaaggcccacgaagaaggaatatgtggcataagatcagtaactaggctggagaatcttatgtggaaacagattacgccggagctaaaccatattctatcagaaaatgaggtgaaacttaccattatgacaggagacacaaaaggcataatgcaagctggaaaaagatcactaagaccgcagccaacggaattaaaatatagttggaagacatgggggaaagctaagatgctgtcgaccgaatcgcacaaccaaacatttttgatagacggaccggagaccgccgagtgccctaatacgaatcgcgcatggaactcactagaagtcgaagactacgggttcggcgtttttactacgaatatatggctaaagctgagggaaaaacaggacgtgttctgtgacagtaaactaatgtcagcagcaataaaagacaatagagctgtacacgcggatatgggttactggattgaatcagcactaaatgacacctggaagatggagaaagctagttttatagaagtaaaatcgtgtcactggccaaagtcacatactctgtggtccaacggcgtactagaaagtgagatgataatccccaaaaatttcgcaggtccagtcagtcaacacaattaccgtccagggtaccacactcagacggcggggccgtggcatctggggaaactggaaatggacttcgatttttgcgaaggcacgacggtcgtagtcactgaggactgtggaaaccggggcccgtcacttagaacgactacggcatctggaaagttaataacagaatggtgttgtaggagttgtactttgcccccgctcagatatcgaggagaagatggatgctggtatggtatggaaataagacctttaaaggagaaggaagaaaatttagttaatagcctagtaacagcgggacatggacagatcgataacttcagtttaggagtgttaggaatggcgttgttcctagaagaaatgttaagaactcgggtgggaacaaaacatgccatattactggtggcagtcagctttgttacgcttatcacaggaaatatgagctttagggacctgggacgtgttatggtaatggtaggcgcaaccatgactgatgacataggaatgggagttacatatcttgcgttgctcgcagcattcaaagtgagaccaacatttgcagcgggactattactaagaaaactaacctctaaagaattgatgatggcaactataggaataactctgttatcacagagtacaatacctgagacaattctagaactgacagatgcattagccttaggaatgatggttcttaaaatcgtacgaaatatggaaaaatatcaactagctgtcaccatcatggccattagctgcgtgccaaatgcagttatactgagaaacgcatggaaggtaagttgcactattctagcagctgtatcggtttttcctcttctactaacaagttcccaacaaaaggcggattggataccgttagctctcactatcaaagggctcaatcctactgctatattcctcactacattgtccagaacatcaaagaagagaagttggccactaaatgaggctataatggccgtaggaatggtgagcatattagcaagctcgctactcaaaaatgatatacctatgacgggaccccttgtagcagggggactcttaacggtttgttacgtgctaactggacgttccgcagatttagaattggaaagggcagcagatgtaaagtgggaagatcaggcagaaatcagtggaagtagcccgatattaagtatcacaattagcgaagacgggtcgatgagcatcaaaaatgaagaagaggaacaaaccctcacgatattaataagaacggggctactcgtaatatcgggagtttttccagtatcgattccaattactgcagctgcatggtatttatgggaagtaaagaaacaaagggccggtgtactatgggacgtccctagcccaccgccggttggcaaagcagaactagaagatggtgcctatcgtataaagcaaagaggcatacttggatattcacaaattggagctggagtttacaaggaaggaaccttccacaccatgtggcacgtcacaagaggagcagtactaatgcatagagggaaacgaatcgagcctagttgggctgatgtgaagaaagatcttatatcatatggaggtggatggaaattagaaggggagtggaaggaaggagaagaggttcaagtcttagctttggagccgggcaaaaatccgagggcagtacaaaccaaaccggggatttttaagacaaacacgggcactattggcgccgtatcactagacttcagcccaggtacatctggtagtccaattgtcgatcgtaaaggtaaagtagtaggcctttatggaaatggagtcgtcactaggtccggagcgtatgtatccgctatcgcacagaccgagaaatctatagaagacaacccagaaatcgaggatgacatattcagaaagaaacgactgacaataatggatctacatcctggagcgggaaaaaccaaacgatacctgcctgcaatcgttcgggaggccataaaaagaggattgagaacattgattctagcgcccacaagggttgtcgctgcagagatggaagaagcgctaagaggattgcctattagataccaaactccggcaatcaaagccgagcatacgggtcgcgaaatagtggacctgatgtgtcacgccacatttactatgcgacttctctctccggtgagggttccaaattacaatttaataattatggatgaggcccacttcacagatccagccagtatagccgctcgtgggtatatatctacaagggttgagatgggcgaggccgctgggatatttatgactgcgacaccacccggaagtagagacccttttccccaaagcaatgctccgattatggacgaagaacgagaaataccagagagatcatggaactcgggacatgagtgggttactgactttaaaggcaagacagtgtggttcgttccatcaattaaagcagggaacgatatagccgcctgtctaagaaagaatggtaaaaaggtgatacaactaagtcgcaaaacattcgatagtgagtacgtcaaaacccgggctaacgattgggactttgttgtgacaactgatatatcagaaatgggagctaattttaaggctgagagggtaatagaccccagacggtgtatgaaaccggtaatattaacagacggagaggaaagagtcatcctagcaggaccaatgccagtgacccatagcagcgctgcccaaaggagaggtaggattggaaggaatcccaaaaacgaaaatgatcagtacatctatatgggggagccattggagaatgatgaggactgtgcccattggaaagaggcgaaaatgttattagataacatcaatactccggaaggtataattccctcaatgttcgagccagagcgggaaaaagttgatgcaatagatggggaataccgcctgcgtggtgaggctagaaaaacatttgttgacttaatgaggcgaggggatctgcccgtgtggttagcctacaaagttgctgccgaaggaatcaattacgcagatagaaagtggtgtttcgatggaataaagaataatcagatccttgaggaaaatgttgaagtggaaatctggacaaaggagggcgaaagaaagaaattaaaaccgaggtggctagatgcccgcatttacagcgatccccttgccctaaaagaatttaaagagtttgcagcagggagaaaaagtcttacactaaatctaataacagagatggggaaactcccgacttttatgactcaaaaggcccgaaatgcattagacaacctagctgtactacatacagccgaggcaggaggaagggcctataatcatgcactatcagaactgccagaaactctagaaaccttattattgttgacactgttagcaacggttactggaggaatctttctatttttaatgtccgggaaaggtataggtaaaatgactttaggtatgtgttgcataataacagcatctgtactcttatggtacgcacaaatccaaccacactggatagccgcaagtataattctagaatttttcctcatcgtcttacttattcctgagcccgagaagcaacgaacaccgcaagataaccaattaacatacgtcgtaatcgcgatattaactgtcgtagcagcaacaatggcgaatgaaatgggatttctcgaaaagactaagaaagatctcggcttaggaagcataacaacacaagagagtgagagcaacattttagacatcgatctaagaccagcatcagcatggacattgtatgctgttgcaactacatttgtgacgcccatgttaaggcattcaatagaaaattcttccgtcaacgtatcattaacggctattgcaaatcaggctacagtactaatgggcttaggtaagggatggcccctatctaaaatggatatcggggtaccattactggctataggttgttatagccaagtgaaccctataacactaacggcagctctgctgctcctagttgcccattatgccatcatcggtccgggattgcaggcaaaagcgacgagagaagctcagaaaagggctgcagctggcataatgaaaaaccccacggttgatgggattacagtgatagatttagagccgattccttacgatccaaaatttgaaaaacaattagggcaagtaatgctacttatactatgtgtaacgcaagttttaatgatgagaacaacgtgggcactgtgcgaggctttgaccttagctacaggacctatttcaactctatgggaaggaaatcctggcaggttttggaatactacaatagcagtgtccatggccaacatattcaggggatcctatttggcaggagctggactgttattcagcattatgaaaaacactacgaatacgcgacgaggtacgggaaatattggtgaaacgctgggggaaaaatggaaaagtagattaaacgctttaggcaaaagtgagttccaaatctacaagaaatctgggatacaggaggtggaccgaactcttgcaaaggaaggtatcaaaagaggagagaccgatcaccacgcagttagccgaggaagcgcaaaattgagatggttcgtagaacgaaatatggtgactccggaaggaaaagtggttgatctaggatgcgggcgcggaggatggagttattattgtggtggtctcaaaaatgtcagagaggtcaaaggacttacaaaaggaggaccgggccacgaagaaccgattcccatgagcacatatgggtggaatttagtaaggctccaaagcggtgtcgatgtattctttaccccaccagaaaaatgtgacacattactctgtgatataggggaaagttcaccaaatcccaccatagaagcagggagaacacttagagtactcaacctagtagagaattggcttaacaataacacccaattctgtattaaagtccttaatccttacatgccatctgtcattgagaaaatggaaacacttcaaagaaaatatggaggagcactggttcgaaatccattgtcaagaaatagcactcatgaaatgtattgggtatcgaatgcaacagggaacatagtttcctctgttaatatgataagcagaatgctgattaacagattcacaatgaaacacaaaaaggcaacatatgaaccggatgtagatttgggaagtggaaccagaaatatcggaatagaaagcgagattccgaacctagatataattggcaagcgaatagagaaaatacgacaagagcatgagacaagttggcactatgatcaagatcatccttacaaaacctgggcctaccatggaagttatgagacaaaacaaacaggctcagcaagttccatggttaatggagttgttagactattaactaaaccctgggatgtcgtacccatggttacacaaatggcgatgaccgacaccacaccgttcggccaacaacgagtgttcaaagaaaaagtcgacacgagaacacaagaacccaaagaaggaacaaagaaactaatgcgaattacagctgagtggttatggaaggaattagggaaaaagaaaacaccacgtatgtgtactcgagaagagtttactagaaaagtaagatcaaatgcagcactaggagcaatttttacagatgaaaacaaatggaaatcggctagagaggccgtggaagatggcaggttctgggaacttgttgacaaagagcgaaacctacacctcgagggaaaatgtgaaacgtgcgtatataatatgatgggtaaacgagagaagaaattaggggagtttggtaaagctaaaggaagtcgtgcaatttggtatatgtggttaggcgcccggtttttagagttcgaagcattagggtttttaaatgaggatcattggttcagtaggggaaattcgttgagtggcgttgagggggaagggctccacagattaggatacattctaagggatgtagggaagaaggaaggaggagccatgtatgctgacgacacagccggatgggatactagaatcacccttgaagatctaaagaatgaagaaatggtcacaaaccatatgaaaggagagcacaagaaacttgcggaagcaatattcaaattgacatatcaaaataaagtagtacgggtacaaaggcccacccccagaggcacagttatggatattataagcaggagggatcaaagagggtctggtcaggttggaacatacgggctaaatacgtttacaaatatggaggcacaattaattcgacaaatggaaggagaaggcattttcaaatctattcagcacttgactgcaaccgaagaaatcgcggtgcagaactggctagcgcgagttggaagggaacgattatcaagaatggctatttcaggggatgactgcgtagtaaaaccgattgatgatcgtttcgcatctgctttaacagccctaaatgacatgggtaaagttagaaaagatatccaacagtgggaaccgtcccggggctggaacgactggacgcaagtaccattctgttcacaccatttccacgaattagtcatgaaagatgggagagtactggtggtcccatgtcgaaaccaagacgaactaatcggccgggcgcgaataagccagggagctggatggtcactaaaagagacagcctgcctcggaaaatcctatgcacaaatgtggacactaatgtacttccataggcgagaccttagactcgcagcaaatgcgatctgttcggcggttccttcacactgggttccaacaagtcgtacgacgtggtctatccacgcaaaacacgaatggatgacaaccgaagacatgctggctgtgtggaatcgcgtatggatccaagaaaacccatggatggaggataaaacgccggtagaaagctgggaagaggtaccgtatctcggcaagagagaggaccagtggtgcggttccttaatcggcctcacatcacgcgcaacctgggccaagaatatccagacagctataaatcaggtaaggtcattgatagggaatgaggaatatacggattacatgccctcaatgaaaaggttcagaagagaagaagaagaagcaggagtactttggtaa

SEQ ID NO: 22657 - RNA, 9876 nt, synthetic construct
  misc_feature 1..9876: note = derived and/or modified CDS sequence (opt6) from DENV-2__FJ850108__SS-prME
  source 1..9876: mol_type = other RNA
actgctggcgtgatagtgatgctaattcccaccgcaatggcattccatttaactacaaggaatggcgaacctcatatgatagtaggtaggcaagaaaaagggaaatcactgctgtttaaaacggaagacggagtaaatatgtgcaccctaatggcgattgatctcggagaattatgcgaagacactataacgtacaaatgccccttgctaaggcagaatgaaccagaagatatagactgctggtgcaattctacatccacttgggtaacttatggcacgtgtacaacgacgggggaacaccggagagagaaaagatcagtagcattggtaccacatgtgggtatgggtttggaaactaggacggaaacatggatgtccagtgaaggcgcttggaaacatgtacaaagaattgaaacatggatactccgtcatccgggtttcacaattatggcagctattcttgcatatacaattggaacaacacatttccaaagagcactaatattcatattgctaacagctgtagcaccatccatgacaatgagatgtataggcatttcaaatcgagacttcgtggaaggtgttagtggaggttcatgggtagatattgtacttgagcatggaagttgtgtgactacaatggctaaaaacaaacccacactcgattttgagctaataaaaacggaagcaaaacaaccagcaactttaagaaaatattgcatagaggctaaattaacaaacactacaacagagtcacgttgcccaactcaaggcgagccatctcttaatgaagaacaagacaaaagatttatatgtaaacatagcatggtcgatagaggttggggaaatggatgtggcctgtttggaaaaggcggcatcgtaacatgtgctatgtttacttgcaagaaaaacatggaagggaaagtcgtgcaacctgaaaatcttgaatacacaattgttattacacctcattcgggagaggaacatgcagtgggtaatgacaccggtaaacatggcaaagaaataaaaatcacgccacaatcttcaataacagaagcagaactaacgggatacgggacggtgactatggagtgtagcccacgcaccggattagattttaacgaaatggtactgctacaaatggaggataaagcatggctagtacacaggcaatggtttctggaccttccactaccgtggttaccaggtgctgacactcaaggatcaaactggatccaaaaagaaacgctcgttactttcaaaaatccacatgccaagaaacaagacgtagttgtcttaggtagtcaagaaggcgcgatgcatactgctctgacaggtgcaacagaaatccaaatgtcttcaggcaatctgcttttcacaggacacttaaaatgtagattaaggatggataaattacagctaaagggcatgagctatagtatgtgtacgggtaaatttaaaattgtcaaagagatagcagaaacacaacatgggaccattgtaataagagttcaatatgagggagatggctccccatgcaaaattccattcgagattaccgatcttgagaaaaggcacgtattaggaagattaataacagtaaatcctatcgttattgagaaagattcaccagtcaatatagaagcagaaccaccctttggcgattcatatataattataggggtagaacctggacaactaaaattaaactggtttaagaaaggttcaagtattggacagatgtttgaaactacaatgaggggcgcaaagcggatggctatactgggagacaccgcctgggactttggaagcctgggtggggtttttacaagtataggtaaggctctccatcaagtatttggagcaatatacggggctgcattttcaggagtaagctggactatgaaaattttaatcggagtagtaattacatggatcggaatgaactcaagatccacctctctatctgttagcctggttttagtaggagtagtgactttatacttaggggccatggtacaagcagattcgggatgtgttgtgtcttggaaaaataaggaattaaagtgcggctctggaatctttatcacagataatgttcatacctggacagaacagtacaagtttcagcctgagtcacctagtaagctagcgtcggcgatccagaaagcacatgaagaaggaatctgtggaatcagatctgtgactagactggaaaatttaatgtggaaacaaataacaccagaattgaaccatattctaagtgaaaatgaggtgaaattgacaataatgaccggagacactaaaggtattatgcaagcaggaaaaaggtcgcttagaccccaaccaacagaattgaaatatagctggaaaacttggggaaaagctaaaatgttgagtacagaaagtcacaatcaaaccttccttatcgacggacctgagacggctgaatgtcccaataccaatagagcatggaactccctggaagtagaagattacgggtttggagtgtttacgaccaacatttggttgaaactgagagaaaagcaagacgtattttgtgactccaaacttatgtcagcggccattaaagacaacagagcagtacatgcagacatgggatactggattgaatcagcgttaaatgacacgtggaaaatggaaaaagcctcttttattgaagtgaaatcgtgtcactggccaaaatcacacacgttatggtcaaatggtgtacttgaaagcgagatgataatcccaaagaattttgcaggaccagtatcacagcacaactatcgcccaggataccatactcaaatagcaggcccttggcatcttgggaaactcgaaatggatttcgatttctgtgaaggcacgactgtcgttgtaacagaggattgcggtaatcggggaccgtcgctgcgtacaacgactgcaagcggtaaattaattacagaatggtgctgtcgtagctgtactctgccgccccttagatatcgtggcgaagacgggtgctggtatggaatggaaataagaccattaaaagaaaaagaggaaaacctagtaaactcattggtgacggcaggacatggtcaaatagacaatttcagtctcggggtccttgggatggcactgttcctcgaggaaatgttgaggactagagttgggacaaagcatgcaatactactcgtagccgtaagtttcgtcactttgataaccggaaatatgagttttagagatttgggtaggatgatggtgatggttggtgcaacgatgacagacgatatcggtatgggagtaacttacctagcgctcttagcagcctttaaagtaaggccaacattcgtagctggcctattacttagaaaacttacatcgaaagagttaatgatggccactattggaataacattgctatctcaatccactattcccgaaacaatcttagaattaacggatgcgttagctttaggaatgatggtcctgaaaatagtacgaaatatggagaaatatcaactagctgtcactataatggccattagttgcgtgccaaatgcagtaatcctaagaaatgcatggaaagtgagctgtaccatactagcagccgtgagcgttagtccactactattaacatcatctcaacaaaaagcagattggattccattagcgttaacaatcaagggattaaaccccaccgccatattcttaacaactctctcacgtacgtctaagaaacgaagctggcctttaaacgaagccattatggcagtaggtatggtaagtatactagcgagcagcttattgaaaaatgatataccaatgacaggtccgttagtggccgggggtttactaaccgtatgttacgttctaacagggagatcagcggatcttgagttagaaagagcagcagatgtaaagtgggaagatcaggctgagatttcaggaagttctccgattttatcaattaccattagcgaggacggatcgatgtcaatcaaaaatgaggaagaggaacagacacttaccattttaattagaacagggttacttgtaataagtggtgtatttccagtgtcgatacctataactgctgccgcatggtacctctgggaagtgaagaaacaaagagccggcgtcctctgggatgtaccatcaccaccaccagtgggaaaggctgaactcgaagatggtgcttatagaatcaagcagcgcggaatcttgggttactcacaaattggagctggagtctataaggagggaaccttccacaccatgtggcatgtaacacgaggtgcagtcttaatgcacagaggtaaaaggattgaaccatcgtgggcagacgtcaagaaagaccttatatcctacggtggtggatggaagttggaaggggagtggaaagaaggggaggaagtacaagtattggcactggaaccgggtaaaaatcctagagccgtccaaacaaaaccaggaatttttaagacgaatacaggcactataggtgcagtttcactcgacttctcacctggaacatcagggtcccctatagtagacaggaaaggcaaagtggtaggtctttatggcaatggtgtcgtaacaaggtcaggggcatacgtaagtgctatagcacaaacagaaaagagtatagaagataatccagaaatagaagacgacatctttagaaagaaaaggttgacaataatggatctacatcctggtgcaggtaagaccaaacgctatctccctgctattgttcgcgaagcgatcaaaagaggactccgaacattaattctggcaccgacacgagtcgtcgctgccgaaatggaagaagcgctacgcggacttccaattcggtatcaaactccagcgattaaagcagaacatactggacgtgagatagtcgatttaatgtgtcatgcaacctttactatgcgtttactaagccctgtacgagtcccaaactacaacttaataataatggacgaagcccattttacagaccccgcttcgatagcagcacggggctacatatctacacgcgtcgagatgggtgaagcggcaggcatatttatgactgcaaccccgccaggaagccgagacccattccctcagtctaacgcgccaataatggatgaagagagagaaataccagaacgaagctggaatagtgggcatgagtgggttactgattttaaaggaaagaccgtttggttcgtcccttcaattaaagcaggtaacgatatagcagcgtgtttaagaaagaacggaaagaaggtaatacagctttcccgtaaaactttcgattcagagtatgttaaaacaagggcaaacgattgggatttcgtagtaactacagatatatcagaaatgggagctaattttaaagcagaacgggttatagacccaagaaggtgtatgaaacctgtgattttaactgacggagaggagcgagtaatcctcgcaggtccaatgccggtaacgcattcttcggcagctcaaagacgagggaggataggtcgtaatcccaaaaatgaaaatgatcaatacatatatatgggggaaccactggaaaacgatgaggattgtgctcattggaaagaggcgaaaatgctcctcgataacataaacaccccagaaggtattataccaagcatgtttgagccagaacgagagaaggttgatgctatagatggggagtatagattacggggagaagcaaggaagacgtttgttgacctgatgaggaggggagacttacctgtatggttggcttataaagtggccgcagaagggataaattacgctgataggaagtggtgctttgatggcataaagaataaccagatcctagaagagaatgtggaagttgaaatatggacaaaagaaggagaacgtaaaaagttaaaaccaagatggttagatgcaaggatttactcggatccattagctttaaaagagttcaaagagtttgccgccggccgtaaatctttaactttaaacttaataaccgaaatggggagactgcccactttcatgacacaaaaagcaagaaatgctttagacaacttagctgttttacacacagcagaggctggcggacgcgcttataaccacgctctgtcagaactgcccgaaacgctcgagaccctacttttattaactttactggcaacagtaaccgggggaatatttctattcttaatgtcgggaaaaggtataggaaaaatgactttaggcatgtgttgcataattacggcttctgtgttactgtggtacgcacaaatacaaccacactggatcgcagcgagtatcatactcgaatttttcttaatagttctactgatccctgaacctgagaaacaacgcaccccgcaagacaatcaactaacgtatgtagttattgcaatactaacggtagtagcagcaacaatggcaaacgagatggggttcttagagaaaacgaagaaagacctgggattaggatcaattactacccaagagcccgagtcaaacatactcgatatcgatctccgaccagcaagcgcttggacgctctatgctgtagcgactacttttgtaacaccgatgctgagacacagcatagaaaattcatctgtcaacgtatcattgacagcaattgccaaccaagccaccgtgttgatgggattgggcaagggttggccattgagtaaaatggatataggtgttccactgctagcaatagggtgctattctcaagtcaatccaataacacttacagcagctctcttactattagtggcacactatgctattataggccctggactgcaggcgaaagctacaagggaagcgcaaaaacgggccgcagccggtataatgaaaaacccaacggtagatggaataaccgtcattgacctagaaccgatcccttatgaccctaaattcgaaaaacagcttgggcaggtcatgctacttatattgtgtgttacgcaagtcttaatgatgcgtacaacctgggcattgtgtgaggcattgacactagcaacggggccaatatcaaccctttgggagggaaacccaggaagattttggaataccacaattgctgtatctatggcaaacatcttcagaggttcctatttagccggtgctgggttgctgttctcaataatgaaaaatacaacaaacacgagaagaggcacgggaaatatcggtgagacactgggagagaaatggaagtcaagacttaatgctctcggtaaaagtgagttccaaatttataagaaaagtggtatacaggaagtcgatcgaaccttggccaaagaaggaatcaaaaggggtgagacagatcatcatgcagtctcacgcgggtccgcaaaactaagatggttcgtagaacgaaacatggtaacacctgaaggcaaagtagtagatctcggatgtggccgaggagggtggagttactattgtggaggactaaagaatgtcagggaggtaaagggattaacgaaaggtggccctggccatgaagaacctataccaatgagtacttacggttggaacctagtgagactccaatcgggagtagatgtattctttacaccacccgaaaaatgtgacacactactttgtgacataggtgaaagctcaccaaatccaaccatagaggcgggtagaacgctgagagttttaaaccttgtagaaaattggttaaacaataatacacaattttgcattaaagtattgaacccttacatgccttcagtcattgagaaaatggaaacgttgcaacgcaaatatggaggggccctagttcgaaaccctttgagcagaaatagtactcacgaaatgtactgggtgtcaaacgccacaggaaacattgtcagttcagtaaatatgatatcccgaatgttaataaataggtttacgatgaagcataagaaagctacatatgaacccgatgtagatctcggtagtggcaccagaaatattggcattgagagcgaaatcccaaatctagatataatcggtaagcggatagagaaaataaaacaagaacacgagacgagttggcattacgaccaagaccacccatacaaaacgtgggcataccacggttcttacgaaacaaaacaaacgggatcagcatcatctatggttaatggtgtagtgcgactgttgacaaaaccgtgggacgtagtccctatggtgactcagatggccatgaccgacacaaccccatttggtcaacaaagagtatttaaagaaaaagtagacacaagaactcaagaacccaaagaaggaactaagaaattaatgaggataacagcggaatggctatggaaagaattggggaaaaagaaaacgccacgtatgtgcacacgcgaagaatttacaagaaaagtgagatctaacgccgcgttaggagcgatttttacagatgaaaataaatggaaatctgctagggaggcagtagaggatggaagattctgggaactggtcgatcgcgaacgcaacctacatttagaggggaaatgtgaaacatgtgtttataatatgatgggaaaaagagagaagaaattaggtgagttcggcaaagccaaggggtcacgcgctatctggtacatgtggttaggagccaggtttttagaatttgaagcattagggtttttaaacgaagaccattggttcagccgaggaaatagtttgtcaggggtggaaggagaaggacttcataggcttggatacattttacgagacgtaggaaagaaagaaggaggagcgatgtacgcggatgacactgcgggatgggatacacgtatcacattagaagaccttaaaaatgaagagatggtgacaaaccatatgaagggtgaacacaagaaattagcggaagcgatatttaaactgacatatcaaaataaagtagtgcgagttcaacgtccgacgccgcgaggaactgtgatggatatcatctcgcgaagagatcaaagaggtagcgggcaagtaggaacatacggtttaaatacattcacgaatatggaggcccaactaattcgccaaatggaaggcgaggggatcttcaaaagtattcaacacttgacagtaacggaggaaatagctgttcaaaattggttagcgagggtaggacgagagaggttgtcaaggatggcaataagcggagatgattgtgtagtaaaaccaatcgacgaccgattcgcatcagcccttacagcgttaaatgacatgggaaaagtgcgcaaggatattcaacagtgggaaccctcacgtggttggaatgattggacccaagtgccgttttgcagtcatcattttcatgaattagtaatgaaagatggaagggtattagtcgtaccctgtaggaaccaagatgaattaattggacgcgcgagaataagccaaggagcaggttggtcccttaaggagacagcctgcttaggcaaatcttatgcacaaatgtggacattgatgtatttccaccgcagagatttaagacttgcggctaatgcaatttgctcagcggtcccatcccactgggtaccaacaagtcgaacaacttggtcaatacatgccaaacacgaatggatgacaacagaagacatgttagcagtatggaaccgagtgtggattcaagagaatccctggatggaggacaagacgcccgtcgagagctgggaagaagtaccttacttaggaaaaagagaagatcaatggtgtggctcgctaataggtttaacatccagggctacatgggccaaaaatatacagacagccattaaccaagtcaggagcttaatcggtaatgaagaatatacagactatatgccctcaatgaaaaggttccgcagagaagaggaagaagccggggtcctatggtaa

SEQ ID NO: 22658 - RNA, 9876 nt, synthetic construct
  misc_feature 1..9876: note = derived and/or modified CDS sequence (opt6) from DENV-2__JN819407__SS-prME
  source 1..9876: mol_type = other RNA
actgcaggagttatagtaatgttgatcccaaccgcgatggcattccacctaactacacgtaatggagaacctcatatgatagtcggaagacaggaaaaaggaaaatcactgctttttaaaacagaagacggggtcaacatgtgtacactaatggcaattgatctcggtgaactttgtgaagacacaatcacatataaatgtccactactccgacaaaatgaaccagaagatatagactgttggtgtaatagtacttcaacttgggttacctatggtacatgcaccactaccggtgaacataggagagagaaaagatccgtcgctttagtccctcacgttggtatgggtctggaaactcgaacggaaacatggatgtcatctgaaggggcatggaaacacgtgcaaagaatagagacttggattttacgacacccaggattcacaataatggcagcgatattagcgtatacgataggcactacacatttccagcgtgcgctaatatttatattgctaacagcggtagccccgtccatgacaatgagatgcataggaatatcgaatcgtgacttcgtagaaggtgtatcaggaggatcttgggttgacatagtactcgaacacggaagctgtgttactacaatggccaaaaataaaccgacgctagattttgaattaataaaaacggaggcgaaacagccagcaaccttacggaaatattgcatagaagctaaattaactaatacaacaacagaaagtagatgtccgacacaaggtgaaccttcactgaacgaagaacaagataaaaggtttatttgtaaacactcgatggtcgacagaggatggggcaatggctgtggtttatttggtaaaggaggaattgtgacttgtgcgatgtttacctgcaagaaaaatatggaggggaaagtagttcagcccgaaaatcttgagtatactatcgtaattacgcctcattcaggggaggagcacgcggtaggtaacgatactggtaaacatggaaaggaaattaaaataacacctcagagttcgatcactgaggctgaactaacaggatacggtacagttaccatggagtgttcacctagaactgggttagattttaatgagatggttctactgcaaatggaagacaaggcctggttagtacatagacaatggtttcttgacttacctttaccttggctacctggagcagatacacagggtagcaactggatccaaaaagaaactcttgtcaccttcaagaatcctcatgcgaaaaagcaagatgtagttgtgttaggaagtcaagaaggtgcgatgcataccgctctaacaggagccacagaaattcaaatgagtctcggaaatctcttattcactggacacctgaaatgtagattaaggatggataaattgcaattaaaagggatgtcttacagcatgtgtaccggtaaattcaaaatcgtaaaagaaattgcggaaacacagcatggaactatcgtcatcagagttcaatatgagggtgatggaagcccttgtaaaataccattcgaaataacagacctcgagaaacgacatgtgctgggcaggttaatcactgttaatcccatcgtaatcgaaaaagactcaccagtcaatattgaagctgagccaccgtttggcgattcctacattataattggggtggaaccgggtcaattgaaacttaactggttcaagaaaggtagcagcataggacaaatgtttgaaaccacaatgcgtggtgccaaacgcatggcaattttaggggacacagcttgggactttggcagtttaggtggagtgtttactagcatcggaaaggcactacatcaagtttttggcgcaatttatggagcggcattttcaggagtcagttggacgatgaaaatactcattggggttgtaattacgtggataggtatgaactctcgaagtaccagtttgagtgtatctttagttttagtaggagtagtaactctctatctcggagccatggtacaagcggattcaggatgtgtagtgagctggaaaaataaagaactaaaatgtgggagtggaatattcataacagataacgtacatacttggaccgaacagtacaaatttcaaccggagagtccgtcgaaacttgctagcgctattcagaaagcccacgaagaagggatctgtggtataagaagcgttacccgccttgaaaatcttatgtggaaacagatcacacccgaattgaatcacatcttaagcgagaatgaagtaaaacttacaataatgacgggcgatactaaaggaattatgcaagctggaaaaaggagcttaagacctcaaccaactgaattgaaatacagctggaagacgtggggtaaagcaaaaatgttgtttacagagtctcataatcaaacatttttgatcgacggaccagagaccgcagaatgtccaaacacaaaccgcgcatggaactctttagaggtagaggactatgggttcggagttttcagcactaatatatggttgaagttgcgcgaaaaacaagacgtcttttgtgatagcaaactaatgtccgccgcaatcaaagataacagagctgtacatgcagatatgggttattggatagaaagtgcacttaacgacacctggaaaatggaaaaagcctcttttatagaagtcaaatcctgccactggcctaaatcacacacgctctggtctaacggcgtgctagaaagcgaaatgattatacccaaaaacttcgccggcccagtaagtcaacacaactataggccaggatatcatactcaaacagcaggtccttggcaccttggtaaactggaaatggactttgatttttgtgagggcacaaccgtcgttgtgacggaagattgtggaaatagaggtccatccttacgaacgactacagcatcaggaaaattaatcactgaatggtgttgtcgctcatgtaccctaccgcctctacgataccgtggagaagatgggtgttggtacggaatggagattagaccattaaaagaaaaagaagaaaacttagttaattcactggtaacagcgggtcatggtcaaatagataattttagtctaggtgtcttagggatggcattatttcttgaggagatgctaagaacacgtgtcggaacaaagcacgcaattttactggttgctgtatcatttgtgacgctaatcacgggaaatatgagttttcgcgacctgggtcgagtaatggttatggttggagcaacaatgactgatgatataggaatgggtgtaacttatttggcgcttctggccgcctttaaagtgagaccaactttcgccgctgggctcttgttacggaaacttacatccaaggaattgatgatggcaacgattggaataacattattaagtcaatctacaatacctgaaacaattttagaattgactgacgcattagcattaggtatgatggtactcaaaatagtcagaaatatggaaaaataccagctagcagttacaattatggcgatttcctgcgtcccaaatgcagtaatactacgaaatgcttggaaggtctcctgtacaatattggccgcagttagtgtatctcccctgctattaaccagttcacagcaaaaagcagattggataccattagccttaacaattaaagggctaaaccctacagcaatctttctgacaacacttagcagaacaagcaagaaaaggagctggcctctgaatgaagctataatggctgtgggtatggtgagcattctagcttctagcttactaaagaatgatataccgatgacgggacccttggtggcaggaggtttattaaccgtctgttatgtgttaacgggaagatccgccgacctagaattggagagagcggccgatgtaaagtgggaagatcaagccgagataagcggatcatctccaatcctctcaataacaatatcggaagacggaagtatgtctatcaagaatgaggaggaagaacagacactaacgatattaattcgaacaggtttgctagtcatatcaggagtgttccccgttagcataccaataacagctgcagcatggtatctatgggaagtgaagaaacaaagggcaggagtactttgggacgtcccatcgccacctcctgttggaaaagcagaactagaagatggtgcgtatcgaataaaacaaagagggatactaggatatagtcaaattggagccggagtatataaagaagggacctttcacacaatgtggcacgtcacgcgcggagctgttttaatgcatcgcggtaagcggatcgaaccatcatgggctgatgtgaagaaagaccttatatcatatggtgggggatggaaattagaaggtgaatggaaggaaggcgaagaagttcaagttcttgcattggaaccgggcaagaacccaagagctgtacagactaaaccgggtatattcaaaacaaacaccggtactattggcgcggttagcttagattttagcccaggtacctcaggttcaccgatagtggaccggaaaggcaaagttgtaggtttgtatgggaacggtgtagtcactagaagcggtgcatatgtatcagctatagcgcaaacagaaaaatcgatcgaagataatccagaaatagaagacgatatattcagaaagaaacggttaacgataatggacctacatccaggggcaggcaaaacaaaaagatatctacccgcaatagttagagaggcaataaagagaggattacgaacccttatcctagcacccacccgtgtggtagctgctgaaatggaagaggctttacgcggattacctatacgttatcaaactccagcaataaaagccgagcataccgggagagaaattgttgatctgatgtgtcatgctactttcacaatgcggttgttatcaccagtaagagttcccaattacaaccttataatcatggatgaagctcatttcactgaccctgcatcaatagcagctcgaggatatatatcaactagagtggaaatgggagaagcagctggcatattcatgactgccacgcctccaggatcacgcgacccgtttccccaaagtaatgcaccaatcatggacgaagaaagggagattcccgaaagaagctggaactcaggtcacgaatgggttacagactttaaaggtaagacagtatggtttgtcccgtccataaaagctggtaatgacatcgcagcctgtctccgcaaaaatgggaagaaagtgatacagctctcgagaaaaaccttcgattccgaatacgtaaaaactagagcaaacgactgggatttcgttgtgacaacagatatttcagagatgggtgctaactttaaagctgagcgagtcatagatcctcgtcggtgcatgaaacccgtaatcctcactgatggcgaagaaagagtgatcctagccggaccaatgcctgtgacacattcaagtgcagcacaacgtaggggccgaattggccgaaaccctaaaaatgaaaatgatcagtacatctatatgggagaaccattagagaatgatgaagattgcgcacattggaaagaagcaaaaatgttattagataatataaatacaccagaagggattataccatcaatgttcgagccagaaagagaaaaggtggacgctattgatggtgaatacagacttaggggagaggcacgtaaaactttcgttgatttaatgagaagaggcgatttaccagtttggttagcctacaaagtcgcggcagaaggtataaattatgcagataggaaatggtgttttgatgggattaagaataaccaaatcttagaagaaaatgttgaagtagaaatttggacgaaagaaggggaacgcaagaagttgaaaccacgctggcttgatgctcgcatatacagtgacccattggcactaaaggagttcaaagaatttgcagctggaagaaaaagtctgacactgaatctgataaccgaaatggggcggttaccaacgtttatgactcaaaaagccaggaatgcacttgataatttggcagttttgcatacagctgaggccggtggaagggcatataaccatgcgttaagtgaactaccggagacactagaaacactattactgctaacgctcctagccactgttaccggaggtattttcttattcttaatgagcggaaagggaatcggaaaaatgaccttaggaatgtgttgcattattaccgcaagcgttctactgtggtatgcacaaatacagcctcattggattgcggcgtccataatactggagtttttcctgatcgttctattgatacccgagcctgaaaagcaacgaacaccacaggataatcagttaacttacgtggtaatcgcaatacttacggttgtagcagcgacgatggctaatgaaatgggattcttggagaaaactaagaaggacttagggttaggaagtataacaacacaggaaccagagtctaacattttagatattgatcttcgtcctgcatcagcgtggacgctatacgcagtcgcaacaacttttgtgacacccatgctacgacattctatagagaatagtagtgtgaatgtatcgctaacagcaatagcaaatcaagcaaccgtgttgatgggattgggaaagggttggccacttagcaaaatggacataggagttccattactagctataggatgttattcacaggtaaacccaataacgttaacggctgcactcttactactcgtagctcattacgccattataggaccaggtctccaggctaaagcgacccgagaagcacaaaaacgagcggcggcaggaataatgaaaaatcctacggtggacggaataacagttatcgatttagaaccaatcccctacgatccaaaatttgaaaaacaactagggcaagttatgctcttaatactttgcgtcacacaagttcttatgatgcgcacaacatgggctttatgcgaagccttgacactcgcaactggtccaataagcacactatgggaaggaaaccctgggagattttggaacacaacaattgccgtatctatggcaaacatatttagaggaagttatctagctggagcaggtctactcttctcaattatgaagaacacgactaatactagaagaggtacggggaacatcggagaaacgcttggagaaaaatggaaaagtagattaaacgcacttggtaaatccgaatttcagatatataagaaatcagggatacaagaggtcgatcgaacactcgcgaaagaaggcataaaacgtggagaaacagaccaccatgcagtatctagaggttccgcaaaactgcgatggttcgtggaacgtaatatggttacaccagaaggaaaggtcgtagacctaggttgtggaaggggcggttggagttattactgtggaggtttgaaaaacgtacgagaggtaaaaggcttgacaaaaggaggcccaggacatgaagaaccaatacctatgtctacgtatggatggaacttagtacggcttcaatcaggcgttgatgtattctttacgcccccagaaaaatgtgacaccttactatgcgacataggagaatcctcacccaaccctactattgaagcaggtcgtaccttaagagtccttaacctagtagaaaattggttaaataataatactcaattctgtatcaaagtgttaaacccgtacatgcccagcgttatagagaaaatggagacgcttcagcgtaaatacggaggagcattagttcgaaacccactatcaagaaattcaactcacgaaatgtattgggtatctaatgcaaccggtaatattgtatcctcggtgaatatgatatcgaggatgctaataaaccgatttaccatgaaacacaaaaaggcgacctatgaaccggacgtagatttaggatcaggtactaggaatattggaatcgaatccgaaattcctaatcttgacataataggcaaaagaatagagaaaatcaaacaagaacatgaaacctcttggcattatgatcaagatcacccttacaaaacttgggcttaccatggatcctacgagacgaaacaaaccggaagtgcaagctcaatggtgaacggagttgtacgactactaactaagccctgggatgttgtgccaatggtaactcagatggcaatgacagatacaacaccatttggacaacaaagagtttttaaagaaaaagttgacactagaacccaagaacctaaagaaggcacaaagaaactcatgcgcataacagcagaatggctttggaaagagctaggaaagaagaaaacaccaagaatgtgtacaagagaagaatttacaagaaaagtcagatcgaatgccgcgttaggggccatcttcaccgacgagaataaatggaaatctgcaagggaagcagttgaggatggaagattctgggaacttgttgatagggaaagaaacctacatcttgaaggtaaatgcgaaacatgcgtatataacatgatgggtaaaagagagaagaaactgggagaatttggtaaagcaaaaggatcaagagcaatctggtatatgtggcttggagcgaggtttctggaatttgaagccttgggtttcttaaacgaggaccactggttctctagaggtaatagtctttcaggagtagaaggtgaaggattacataggttgggctatatattgagagatgtcggtaaaaaggaaggaggggccatgtacgcggacgacaccgcagggtgggatacccgaataacattagaagatctcaaaaatgaagaaatggtgacgaatcatatgaaaggcgaacataagaaactagccgaagcgatattcaaattgacctatcagaataaagtggtaagggtacaaagaccgacaccaagaggtacagttatggacataataagcaggagagaccagaggggatcaggccaagtaggtacatacggtttaaatactttcaccaatatggaggcacaattaattagacagatggaaggagagggtatatttaaatctattcagcacctgacagtaaccgaagaaatcgcagtacaaaactggctggcccgagtaggtagggaacgactatctagaatggctatatccggtgatgactgcgttgtaaaaccaattgatgataggtttgcatcagcgttaacagcattgaacgacatgggaaaagtacgcaaagatatacaacaatgggagccctctcgtggctggaatgattggacacaagtgcccttctgctctcatcattttcatgagctcgttatgaaagacgggcgagtcctagtagtgccttgcagaaaccaggacgaattaattggcagagcgcggatatcacaaggtgccggttggagtttaaaagaaacagcatgtctaggaaaaagctatgctcagatgtggacattaatgtactttcatcgaagagatttacgtttggctgccaatgcgatatgttcggctgtaccaagtcactgggtaccaacctcccggacaacctggagtattcatgctaagcatgaatggatgacaacagaagacatgttagctgtctggaaccgggtatggatacaagaaaacccctggatggaagacaagactccagttgaatcctgggaagaagtaccataccttgggaaacgagaagaccagtggtgcggttcattaataggattaacctctcgtgcaacatgggccaaaaatatacaaacagccattaaccaagttcgatcactcattgggaatgaagaatatacagattatatgccatcaatgaaaagatttcgccgagaagaagaagaggccggtgtactatggtga

SEQ ID NO: 22659 - RNA, 9876 nt, synthetic construct
  misc_feature 1..9876: note = derived and/or modified CDS sequence (opt6) from DENV-2__FJ898465__SS-prME
  source 1..9876: mol_type = other RNA
acggctggggtcattataatgcttatacctactgccatggcgttccacctcactaccagaaacggagaaccccatatgattgttggacgacaagaaaaaggaaaatctttacttttcaaaactgaagacggagtgaacatgtgtaccttaatggcaatagatttaggagaactctgtgaagatacaataacgtacaaatgccccctattacggcaaaacgaaccagaagatatagactgctggtgcaattcgacctctacctgggtcacttatgggacatgcacaaccacaggagaacataggcgtgaaaaacggagtgtagcattagtgcctcacgttggtatgggcttagaaacgcgcacagaaacatggatgagcagcgaaggggcatggaaacacgtgcagcgaatcgaaacttggatattacgacaccctggtttcgccataatggctgccatactagcatatactattggtactactcactttcaaaaagccctaattttcatcttactaacagccgtagcgccgtccatgacaatgagatgtatagggataagtaatagagattttgttgaaggagtctcaggaggatcatgggttgatatagtcttagaacacgggtcgtgtgtaacaacgatggctaaaaataaacccaccctcgattttgaacttattaaaactgaagcaaaacaaccagcgacactcaggaaatactgtatcgaagcaaaattgactaatacaactacagaatctcgatgccctacacaaggcgaaccaagtctgaatgaagaacaagataaaaggttcatctgcaaacactctatggtagatcgaggttggggaaatggttgcggattgtttggaaaaggcgggattgtcacgtgcgccatgtttacatgtaagaaaaatatggaagggaaagttgtcctaccggaaaatctagaatatacaattgtcataactccccattcaggagaagaacacgctgttggaaacgatacaggcaaacatggtaaagaaataaaaatcactccacaatcatccattaccgaagcagaactaaccggttatgggacagtaaccatggaatgttcaccaagaacaggactagacttcaacgaaatggtactccttcagatggaagaaaaagcctggctagtacatagacagtggtttttagacctcccgcttccatggctaccgggtgcggatacacaaggaagtaactggatccaaaaagaaacattagtcacatttaaaaaccctcatgcaaagaaacaagacgttgtagtactaggaagccaggaaggtgccatgcacaccgccctaacaggagcgacagaaatccagatgtcgagcggtaatttattatttacaggccacctaaaatgccgattaagaatggataaactccaattaaaaggaatgtcgtatagtatgtgcacggggaaattcaaaattgtaaaagaaatagccgaaacacaacatgggactatcgtaatcagggtgcaatacgaaggcgacggcagcccttgtaaaattcctttcgaaatcatggatttagagaaaagacatgtactcgggcgacttataacggttaacccaattgttacagagaaagacagcccagtcaatattgaagccgaaccaccctttggtgattcttatataataatcggagtagaacccggacaactcaaattgaactggttcaagaaaggatcaagcattgggcagatgtttgaaactacaatgaggggagcgaaacgaatggctatattaggagatacagcgtgggactttggcagtttagggggcgtgtttacaagtattgggaaagcactgcatcaggtttttggggcgatttacggagcagctttctcaggagtatcgtggactatgaaaatattgataggggtaattataacgtggattggaatgaatagtagatcaacctccctgtctgtgtctctagttctagtgggagtggtaaccctctatcttggagctatggtacaagctgattcaggatgcgtagtaagctggaaaaacaaagagttgaaatgtggtagcggcatattcatcactgataacgtccatacatggacagaacaatacaagtttcaaccggagtcaccttcgaaacttgccagtgcaatacaaaaagcgcatgaagaaggcatatgtggcataagatcggtaacgagattagaaaacttaatgtggaaacaaattaccccagaattgaaccacatactaagcgaaaatgaagttaaattaaccattatgactggagacattaaggggatcatgcaggctggaaagcgctctctacgcccgcaaccgacagaactaaagtactcttggaaaacgtgggggaaagcaaagatgctgagcactgaatctcacaaccaaacatttttaattgacggacctgagaccgcagaatgtccgaatacaaatcgggcttggaactcgttggaagtggaggactatgggttcggagtgtttagtacgaacatctggctcaaattaagagaaaaacaagatgtattttgtgactctaaacttatgtcggctgctataaaagataatagggctgtgcatgctgatatgggttactggattgaaagtgcactaaacgacacatggaagatggaaaaagcgtcgttcatagaagttaaatcttgtcattggccaaaatctcataccctatggtcgaacggagttctcgaatcagaaatgataatccccaaaaacttcgcgggtccagtaagtcagcacaattatcgaccgggctaccatacacaaaccgcaggtccttggcatttgggaaaattagaaatggactttgacttctgcgaaggcacgacagtggttgtaacagaagattgcggaaacaggggcccatcacttcgtacgactacagcatcgggtaaactcatcactgaatggtgctgtagaagttgtacgctaccacccttacggtatagaggcgaagatggatgctggtatggtatggaaattcgccctttaaaagaaaaagaagaaaatctggtaaactccctggtcaccgcggggcatggacaaattgacaacttcagcctcggagtattaggtatggccctattccttgaggagatgctgaggacccgagtaggaacgaaacacgccatgttacttgtggctgtttcattcgtcacactaatcacaggcaatatgtcattccgggatttaggtcgagttatggtcatggtaggcgcaactatgaccgatgatatagggatgggagtaacttacttagcactattagcagcatttaaagtaagaccaactttcgcagcaggactgcttctacgtaagctaacatccaaagaactaatgatggcaacaataggcatagctcttttatctcagagtacaattcctgaaacaatcttggaactaaccgacgcactagccctaggtatgatggttctgaaaattgtcagaaatatggaaaactatcagcttgctgtaacaataatggccatatcatgcgtcccgaatgcagttatcttattaaatgcctggaaagtcagctgtaccatattagcggctgtatcagtctctcccttgcttttaacgtcatctcaacaaaaagctgactggataccactggcgctaacaattaagggacttaaccccaccgcgatcttcctaactactttgtcgcgtacgtcgaagaaaagatcgtggcccttgaacgaagctgttatggcagtgggtatggtatccattctagctagtagcttacttaaaaatgacatacccatgactggacctctagtagccggcggtctactcactgtgtgctacgtacttactgggagatcagctgatttggaactagaaagagcagctgatgtaaaatgggaggaccacgctgagatcagcggttcttcgccaatactttcaattacaatatcggaagatggatccatgtctatcaaaaacgaagaagaggaacagacactaacaatccttatccgcactggcctattggttatctcgggagtatttcccgtcagcataccgataaccgccgctgcttggtatctatgggaagtcaagaaacaacgcgcaggcgttttatgggacgtcccaagtccaccacccgtggggaaggccgagctagaagatggagcatatcggataaaacaaaggggtatcctaggatactctcaaataggagcaggcgtatacaaagagggaacattccatacgatgtggcacgttaccagaggagccgttctaatgcaccgcggtaaaagaattgaaccgtcatgggcggacgtcaagaaagatttaatttcttacggaggaggctggaaattagaaggtgaatggaaagaaggagaggaagtgcaagtattggcactagaaccaggcaaaaatcccagagcagtgcaaactaagccaggactattcaaaaccaatacgggaacaataggcgcggtatcattagattttagtccgggaacatctggatcgccaatcgtagatagaaaaggaaaagtcgtgggtttatatgggaacggggtagtaacgcggagtggtgcatacgtatcagctatagcacaaacagagaaaagcattgaagataaccctgaaatcgaggacgacatatttcgaaagaaaagattaaccattatggatttacatccaggagcggggaaaacaaaacggtatttaccggctatagtcagggaggccataaaaagaggtttgcgtacattgatattagcgccaaccagagtggtagctgcagaaatggaagaggctctcagaggattaccaattcggtaccaaactccagccattcgagcggaacacactggtagagaaatcgtcgatctaatgtgtcatgctaccttcacaatgagactattaagcccagtgagagtcccaaattacaatctaataataatggatgaagcacattttacggatccagcttcaatagcagcaagaggctacatatccactcgggtcgaaatgggggaggctgctggtatatttatgacggcaactcctccggggtcacgtgatccgtttcctcaatcgaacgcacctatcatggatgaagaacgcgaaatccccgaaaggagctggaactccgggcatgaatgggtaaccgacttcaaaggaaaaacagtctggtttgttccctcaataaaagcagggaatgacatagcggcttgtttaaggaaaaacggtaagaaagtaatacaattaagcaggaaaacatttgattcagaatatgtcaaaacaagagcaaatgactgggactttgtcgtaacgactgacattagtgaaatgggagcaaacttcagggcagagagggtaatcgatccgagacgctgcatgaaacctgttattctaactgatggagaagaacgagtaatcttggccggtccaatgccagttactcatagttccgccgcccaacgccgtggacggatcggacgaaatccgaaaaatgaaaatgatcagtacatttatatgggagaaccgttagaaaatgatgaagattgcgctcattggaaagaagcaaaaatgttattggataatattaacactcccgaaggaattataccttcgatgtttgagccagaaagagaaaaagtagatgccatagatggtgaataccggttgagaggcgaggcccggaaaacattcgttgatttaatgagacgtggagatcttcccgtatggctagcatatagggtggcggccgaaggaattaattacgcagacagaagatggtgttttgacggtattaagaacaatcaaatactcgaagagaatgtagaagtggaaatatggacaaaagaaggagaacgaaagaagctaaaacccagatggcttgatgcaagaatatatagcgatcctctagcgttgaaagagttcaaagagttcgcagcaggtcgtaaaagtcttacgttgaatctaataacggaaatgggtcgcttgcccacttttatgacccagaaagcgcgagacgcgctcgacaacctcgccgtccttcatactgcggaagcaggaggtcgcgcgtataatcatgcactcagtgaactacctgagacactggaaaccctcctgttacttacattactagctaccgtgactggagggatattcctcttccttatgtcgggaaagggtattggtaaaatgacattaggtatgtgttgtataataactgcttccattctcctctggtacgcccaaattcagccacattggattgcagcttccataatcctcgagttcttcttaatcgtacttctcatacccgaaccggagaaacagcgtacaccccaagacaaccaattaacttacgtagtaatagcgattctcacagtggtagctgcgacaatggcaaacgaaatgggatttctagagaaaactaaaaaggatctcggccttggatctataacaacacaggaatcagaatcaaacattctggacattgatttgagaccagcatcagcttggacgctatatgccgtagcaactacattcgtaacacctatgcttagacatagcattgaaaatagctccgttaacgtaagtctaacagcaattgctaatcaagccacagttttaatgggattggggaaagggtggcccttatccaaaatggatataggagtccctttattagccataggatgttattctcaagtcaatccgataacactcactgcagctctactactccttgtagcacattacgccattattgggccaggactccaagcgaaggctacaagagaagcacaaaagcgcgcagcagcggggattatgaaaaaccccacagtagacggtataacagtaatcgatttggagccaattccgtacgaccctaaattcgaaaaacaattaggtcaagtaatgctactaattttatgcgtaactcaagtgctaatgatgcggacaacctgggcattgtgcgaagcccttacgttggcgacaggaccaatatctacactatgggaaggaaatccgggccggttctggaacacaacaattgcagtatccatggccaatatctttcgagggagttatcttgcaggagcgggtctactttttagcataatgaaaaacacaactaatacacgccgaggcaccggaaacataggagaaacactaggtgaaaagtggaaatcacgcttaaacgctctagggaaatcggagttccaaatatacaagaaatcaggtatccaggaagtagacaggaccctcgcgaaagaagggattaaaagaggtgagaccgatcaccatgcagtctctcgaggaagtgcgaaattacgatggtttgtagaacgaaatatggttacgccagagggtaaggtagtagatcttggctgtggacgcggtggttggtcatattattgcggcggtcttaaaaatgtacgtgaggtaaagggcctaactaagggaggtccgggtcatgaagaaccaatccctatgtccacttacggatggaacctagtaagactacaaagtggggttgacgtgtttttcacaccacccgagaagtgtgatacactattatgcgacataggtgaaagctcccccaatcccactatcgaagcaggaaggacgttacgagttttaaatttagtggaaaattggctaaataataatacgcaattttgtattaaagtactcaacccctatatgccatctgttattgagaaaatggagacgctccaacgaaagtatggaggggctctagtaagaaatcctttgtcccgcaattctacacacgagatgtattgggtatccaatgcaactggtaatatagtcagttctgtaaatatgatctcacgcatgctaattaatagatttactatgaaacacaagaaagcaacatacgaacctgatgtggacttaggtagtggtacgcgcaatataggaatagaaagtgagatcccaaatctggacataatcggtaaaaggatcgagaaaataaaacaagaacacgaaacatcttggcactatgatcaagatcacccatataaaacatgggcgtaccatggaagttatgaaacaaaacagactggaagcgcgagctcaatggtaaatggcgttgttagattactcaccaaaccttgggatgtagtccccatggtgacacaaatggcaatgactgatacaactccattcggacaacaaagagtattcaaggaaaaagtagatacgaggactcaggaaccaaaggaagggactaagaaattaatgcgaattacagcagaatggttatggaaagaattagggaaaaagaaaacaccccgaatgtgcacgcgcgaagagttcacacgaaaggtgagatccaacgcagccttgggtgctatctttacagacgagaataaatggaaatcagctcgagaagcagtggaagattccaggttttgggaactggtagatcgagagcgaaacctacatctggaggggaagtgcgaaacttgcgtatataatatgatgggtaaaagagagaagaaattaggtgaatttggaaaagcaaaaggcagtagagcaatatggtatatgtggcttggtgcgaggtttctagaatttgaggctttgggcttcttaaatgaagaccactggttttcacgtggaaattcactaagtggtgtcgagggggaaggacttcacagactaggatacatactacgcgatgttagtaagaaagaaggaggtgccatgtatgctgatgacacagcaggatgggacactcgaataacccttgaagacctaaagaacgaggagatggtgacaaatcatatgaaaggcgaacataagaaattagcagaagcaatcttcaaactaacgtaccaaaacaaagtagtaagagtccaaaggccaacgcccagaggtacagtgatggacataataagtaggcgtgaccaacgcggctctggacaagtagggacatatgggctaaatacattcacaaatatggaggcacaacttatacgacaaatggaaggagaaggaatattcaaaagcatacaacacttgacagtaaccgaagaaatagcagttcaaaactggttagcaagagtcgggagagaacgattaagtagaatggctatcagtggcgatgattgtgtagtaaaaccattagacgacagattcgcatctgcactaactgcgttaaatgatatgggcaaggtgcggaaggacatccaacaatgggaaccatcaagaggatggaatgactggacccaggtacccttttgttctcatcacttccacgagttggtcatgaaagatggaagagttctggttgtcccttgtcgcaatcaagacgaactaataggtagagcgcgcattagccagggggctggttggagcttaaaagaaacagcctgtctggggaagtcgtacgcccagatgtggacactaatgtacttccaccgtcgagacctaagactagctgccaacgcgatctgctccgctgtaccatctcattgggtaccaacatcaagaactacatggtctatacatgcaaaacatgagtggatgacaacagaagatatgctggctgtttggaaccgtgtatggatacaagaaaatccttggatggaagataaaacaccagtcgaatcatgggaagaagttccttatctaggaaagagagaagatcaatggtgtggaagtctaatcggacttacaagtagggccacctgggcaaagaatatccaaacagcaataaatcaggttaggtccctgataggcaacgaggaatacacagactacatgccatcgatgaaaagattccgcagggaggaagaggaggctggtgtattatggtaa

SEQ ID NO: 22660 - RNA, 9876 nt, synthetic construct
  misc_feature 1..9876: note = derived and/or modified CDS sequence (opt6) from DENV-2__FJ898466__SS-prME
  source 1..9876: mol_type = other RNA
accgcaggagttatagtaatgttaataccaactgcaatggcatttcatctaaccactagaaatggtgaaccgcatatgatcgttgggagacaagaaaaaggaaaatcactccttttcaaaacggaagacggggtaaatatgtgtacactaatggcaattgatttaggcgaactatgcgaagataccataacctataaatgcccattactaagacagaatgaacctgaagatatagactgttggtgtaattcgacaagtacttgggtcacgtatggtacatgcacgacaactggggaacacagacgagagaaaaggtcagtagcattggttccccacgtgggaatgggcttagaaaccagaacagaaacatggatgtcgagcgaaggcgcatggaaacatgtacaacgaatagaaacttggatactgcggcacccaggattcacaatcatggctgcaatacttgcatacacaataggtactactcacttccaaagagctttaatattcatcctattaacggcagtagccccctcaatgacaatgagatgtatcggaatttccaaccgcgactttgtcgaaggggtatctggaggctcatgggttgatattgtattagaacacggatcatgtgtgactacgatggctaaaaataaaccaactcttgattttgaattaattaaaactgaagcaaaacaaccggcgacattaagaaaatactgcattgaagcgaaattaacaaacaccactacggaatcaagatgtcctactcaaggagagccttctcttaatgaagaacaggataaaaggtttatatgcaaacactccatggtggacaggggttggggaaatgggtgcggattattcgggaaaggaggaattgttacatgtgcgatgtttacatgtaagaaaaatatggagggtaaagtagtgcagccagaaaacctggaatacacaatcgtaattacaccgcacagtggagaagaacacgctgttggaaatgacacaggcaaacatgggaaagaaataaaaattacacctcaaagtagtattacagaggcagagctcacaggatatggaacagtcacaatggaatgttcaccacgaacaggactcgattttaatgaaatggtactactacaaatggaagacaaagcgtggttggtacatagacagtggtttctagacctacccctaccatggctacccggggcagatacccaaggatccaattggatacaaaaagaaacattagtaacatttaaaaatccacatgcgaagaaacaagacgtagttgtgttaggaagtcaagaaggagcgatgcacacggctttgaccggtgctacagagatacaaatgagtagtggtaatttacttttcacaggccacttaaaatgtagactaaggatggataaattacagttaaaaggaatgtcatattctatgtgtaccggtaaattcaagatagtaaaagaaatagctgaaacgcaacacggaacaattgtaattagagtgcaatatgagggcgatggtagtccatgtaagatacctttcgaaataactgacctagagaaaaggcatgtgttgggcagacttatcaccgttaatccaatagtaaccgaaaaagattccccagtaaacatcgaggctgaaccaccatttggagattcctatataataatcggcgttgagcctggtcaactaaaactcaattggtttaagaaaggttcatcaattggacaaatgttcgaaacaacaatgagaggggcaaaacgcatggcgatacttggagacaccgcatgggatttcggttctctaggaggtgtttttacatctatcggaaaagccttacaccaagtctttggtgccatttatggagcagcattctcaggagtatcatggaccatgaagatcttaattggggtcataattacatggataggtatgaactctcggagtacttctctaagtgtgtctttagttctagtaggtgttgtaacgttatatttaggtgcaatggtgcaggcagattcaggttgtgtagtgagttggaaaaacaaagagttaaaatgcggatcagggatttttattactgataatgtacacacatggacagagcaatacaaattccaacctgaatcgccgtctaaacttgcctcagcgatccagcgagctcatgaagaagggatatgtggaataagatcggtaaccagactagaaaacttaatgtggaaacagattacaccagaactcaaccatatactaagtgaaaatgaggtgaaactaacaataatgacaggtgatacgaaaggtataatgcaggcaggtaaacgatcactgagacctcaacctactgaacttaagtattcatggaagacttggggaaaggcaaaaatgttgtcgactgaaagtcacaatcaaacttttcttatcgacggccccgagaccgcagaatgccctaatacaaatagagcatggaactcacttgaagtagaagactatggattcggagtattcacgaccaacatttggcttaaattgagagagaagcaggatatattctgcgatagcaaactcatgtccgcagccataaaggacaacagggcagtccacgcagacatgggttattggatcgagtcagccttgaatgacacgtggaaaatggaaaaggcttcattcattgaagtgaaatcttgtcactggccaaaaagtcatacactttggtccaacggggtcttagagagcgaaatgataatacctaagaactttgcaggtcctgtctctcaacacaactacaggcctggatatcatacgcagaccgccggaccgtggcatctaggaaagctagaaatggactttgatttctgcgaaggtacaaccgtcgtagtaactgaagattgtggcaacaggggcccatctcttcgaaccactactgcttcaggaaagctcataacggaatggtgctgtaggagctgcacattacccccacttcgataccggggcgaggatggttgctggtacggtatggaaattcgaccattgaaggagaaagaagaaaatttggtaaattcattagtaactgcaggtcatggtcaaatagataatttcagtttaggtgtgttgggaatggcactctttttagaggagatgttaaggacacgtgtgggaactaaacacgcaatactattagttgccgtaagttttgtaactcttatcacaggaaatatgtcctttagggatctgggtagggttatggtaatggttggcgctacgatgactgacgacattggaatgggagtgacatatttagctttgctcgctgcgttcaaggtgaggcccacgtttgctgctgggctattattacgaaagctgacaagtaaagaactaatgatggccacaattgggatagcactactcagtcaaagtactatacccgaaactatcctcgaactaacggatgcattagcgttggggatgatggcactaaagatagtaaggaacatggaaaaatatcaactagcagttacaattatggctattagttgcgtgccgaatgcagtcattcttcaaaacgcatggaaagtttcttgcacaattcttgcagctgtaagtgtttctccactgctattgacatcgtcgcaacaaaaagccgattggattccgcttgctttaactataaaaggtttgaatcccacagcaatctttctgactacactttcgcgcacgtcaaagaaacgtagttggccactgaatgaagcaattatggccgtgggaatggtgtccattttagcttcgtcactgctaaagaacgacatccccatgaccgggccgttagtggcaggcggtttacttacggtatgctatgttctaacaggacgttcagctgatcttgagctagaaagagctgcagatgttaaatgggaagatcaggcagagattagtggaagttcgccaatactgagtattactataagcgaagatggatcaatgtcaatcaaaaatgaagaagaagaacaaacactcaccattctgataagaactgggcttctagttatatctggcgtgtttccggtttcaattcctataacagctgccgcatggtacctttgggaggtcaagaaacaacgtgcgggagttttatgggacgtgccatcaccccctccagtcggtaaagcagaacttgaagatggcgcatatagaataaaacagcgtggtatcttagggtatagtcaaattggagccggggtttataaagagggtacattccatacaatgtggcacgtaacgagaggcgccgttctaatgcacaggggaaaacggatagaaccgagctgggccgatgtaaagaaagacctaattagctatggaggcggatggaaattagaaggggagtggaaagaaggggaagaagtgcaagtattggcactcgaacccggaaagaatcctcgagcagtgcagactaaaccgggtatatttagaacaaatacagggaccataggtgcagtgtctttagattttagtccaggaaccagcgggtcaccaatcgtagatcgcaaaggaaaagtagttggtctttacgggaatggtgtagtaacccggtctggggcttacgtcagtgctattgcccaaacagaaaaatcaatagaagacaacccagaaatagaagatgacatattcagaaagaaacgactaacaatcatggatctacacccgggggcaggaaaaactaaaagatacttacccgcaatagtgcgagaagcaataaagcgaggattgcggacattaatcttggcacctactagagtagtggcggctgaaatggaagaagcattaaggggactccctatcagatatcaaactccggcgattaaagcggaacacacgggaagagaaatagttgatcttatgtgtcatgctacatttacaatgaggttactaagtccagtaagagtgccaaattataatttaataatcatggatgaagcccacttcacagacccagcgtcaattgcggcaagaggatatatttctacaagagttgagatgggcgaagcagcaggtatatttatgacggcgactccccctggatctagagatccatttcctcaatctaacgccccgataatggatgaagaacgtgagatacccgagcgatcatggaactcagggcacgagtgggtcactgactttaaaggtaaaacagtgtggttcgtcccatcgataaaggcaggcaacgacatagcggcatgcttgaggaaaaatgggaagaaagttattcagctgagtagaaagacatttgacagcgaatacgtaaagaccagagcaaacgattgggattttgtagtaaccacagatattagcgaaatgggagcaaattttaaggctgaacgtgttattgatccacggcgttgtatgaaaccagtaattctaaccgacggagaagaaagagtaatactggcaggtccgatgccagtaacacattcaagcgctgcacagaggagggggagaattggtagaaaccccaaaaacgaaaatgatcaatatatatatatgggagaaccacttgaaaatgatgaagactgtgctcattggaaagaggctaaaatgctattagacaacataaatacacccgaaggaataattccttcaatgtttgaacccgaaagagagaaagtagatgcaatagacggcgaatatagactgcggggtgaggctaggaaaacctttgttgacctaatgagaagaggtgatttgcccgtatggctagcatataaagtagcagcagagggtataaattatgcggatcgtaaatggtgctttgacggtatcaaaaataaccagatactagaagagaacgtagaggtggaaatatggaccaaagagggcgagaggaagaaactcaagccaagatggttagatgcacgaatatatagtgatccgctagcacttaaggaatttaaagagttcgcggcagggagaaaatcattaacgctaaatctaataactgaaatgggccggttgccaacatttatgacacagaaagctaggaatgccttagataaccttgcagtcctacacacagcagaagctggaggcagagcatataatcacgccctcagtgagctacccgaaacgcttgagacgctgctgttactaacacttttggctaccgtaacaggaggaatattcctatttttgatgagtgggaaggggattggaaaaatgacattagggatgtgttgtatcataacagctagtatcttactatggtatgcacaaattcaaccccattggatagccgctagtattatactagagttcttcctaatagtgttgctaataccagaaccagaaaaacaacgaacaccacaagataaccaattgacatatgttgttattgcaattttaacagtggtagcagcaacaatggcaaacgagatgggatttctagagaaaactaaaaaggacctagggttgggatcaattactactcaagagagcgagagtaacatcctggacatcgacctccgtccagcctcagcctggacattgtatgcagtagctaccacctttataacgccaatgcttagacattctattgagaacagttcagtaaatgtctccctaaccgcaattgcgaaccaggccaccgttttaatgggattagggaaaggatggcccctaagtaaaatggacattggagtaccattactagctataggttgttacagtcaagtcaaccctattacactaaccgctgccttgttactgcttgtagcacattatgcaattattggaccaggtttacaagcaaaagcaacgcgtgaagcccaaaagcgtgctgcagcaggaattatgaaaaatccaacagtagatggaataactgtgattgacttagaacctatcccctatgaccctaaatttgaaaaacaactaggtcaagtcatgttattaatcctgtgcgtaacccaagttctcatgatgcgtacaacttgggcattatgtgaggcattaaccttagctacaggtcctatttccaccctttgggaaggaaacccaggtcgtttctggaatactaccattgctgtatccatggctaacatttttagaggctcatacctggcgggagccggtctattattctctataatgaaaaatacaacaaacactagacgaggaacgggcaatattggagaaacattgggggagaaatggaaaagcaggttaaatgctcttggaaaatcagagttccagatatacaaaaagagtggcattcaagaagtagacagaacattagccaaagaaggtatcaaaagaggggaaactgatcaccatgccgtcagtcgcggatctgcaaaattgagatggtttgtggaaagaaacatggtaacaccagaaggtaaggtcgtggatttaggctgtgggagagggggatggagctattattgcggaggtcttaagaacgtaagggaagtaaaggggctaacaaagggagggcccggtcatgaggaaccaatccccatgtctacctacggatggaacttagtaagattacagagtggagtcgatgtgttctttacacccccagagaaatgtgatactctcctatgtgatataggagagtctagcccaaacccaacaatagaagccggtcggacgttaagggtattgaatcttgtagagaactggctgaacaacaacacacaattttgtataaaagttttaaatccatacatgccctcagtaattgaaaagatggagacattacagaggaaatacggcggcgccctagtgaggaatccactttcacgaaactccacccacgagatgtactgggtttcgaacgctacagggaatatcgtctcatcggtaaatatgatatcgagaatgctaataaataggttcacaatgaaacataagaaagcaacctatgaaccagatgtcgatctgggctcagggacaagaaacatagggatagagtcagagataccaaatctcgatataatcggaaaacgaatcgagaaaataaaacaagagcacgaaacctcctggcattacgatcaagaccatccctacaaaacctgggcatatcacggtagctatgaaacgaagcaaacaggaagtgctagcagcatggtgaacggtgtggtaaggctgttaacgaagccttgggatgtagtacccatggtaactcaaatggcaatgacagatactaccccgtttgggcagcagagagtatttaaagagaaagtcgatactagaacgcaagagccaaaagaagggaccaagaaattaatgaaaatcaccgcagaatggctctggaaagagttgggaaagaggaaaacaccacgaatgtgcaccagagaagaatttactaaaaaggtaagatcaaacgctgcactaggagccatcttcacagatgagaataaatggaaaagcgcaagagaagcggtagaagacggaagattttgggaattagttgatagagaaaggaatcttcacctggaaggtaaatgtgaaacctgcgtatataatatgatgggaaaaagagagaagaaactaggtgagtttggtaaagcgaaaggaagtcgagctatttggtatatgtggctcggagccagatttttggagttcgaggctctgggatttctgaacgaggatcactggttctcaagaggtaactccctctcaggagttgaaggggaaggactgcatcgactaggctacatccttagggatgttgggaagaaagaaggaggggcgatgtatgccgatgacaccgccggttgggatacacgaattacacttgaggatctcaaaaatgaagagatggtaacaaatcacatgaaaggcgagcacaagaaattagctgaagcaatattcaaattaacttaccagaataaggtagtaagggtgcagaggcccacaccacgtggaacagtaatggacatcataagcagacgagaccaaagaggatcaggccaagtaggcacctacgggcttaatacctttacaaacatggaggcgcaactgataagacagatggaaggagagggaatattcaaaagtattcagcacctgacggctaccgaagagatcgctgttcagaattggctggctagagtagggagagagagattatcaaggatggcaatctccggagatgattgtgttgtcaaaccgatagacgataggtttgcaagcgccttaacagcattaaacgacatgggtaaagtacgaaaagatatccaacaatgggaaccctcaagaggatggaacgactggactcaagtacccttttgctcacatcattttcatgaattggtaatgaaagacggacgggtattggtagtaccctgcagaagccaagatgagctaattggacgtgcacgcatatctcaaggggcgggttggtccttaaaggaaaccgcctgtctggggaaatcgtacgcccaaatgtggactttaatgtacttccaccgaagagatttaaggttagcggctaatgcgatatgctcagctgttccaagccactgggtaccaacctcgaggacgacctggtcgatacacgcgaaacacgaatggatgaccacagaagatatgctagcagtttggaatcgggtgtggattcaagaaaatccgtggatggaggacaagaccccagtggaatcgtgggaagaagtcccttacctcggaaaacgtgaagaccaatggtgcggctcactaataggtctaacaagccgggcaacttgggccaaaaatatccagactgcaataaatcaagtcagatccttaataggaaatgaagaatacacagactatatgcccagcatgaaacgtttcagaagggaagaagaagaagccggagtactttggtga

SEQ ID NO: 22661 - RNA, 9876 nt, synthetic construct
  misc_feature 1..9876: note = derived and/or modified CDS sequence (opt6) from DENV-2__FJ898467__SS-prME
  source 1..9876: mol_type = other RNA
actgcgggggtaataattatgttaataccgactgcaatggcattccatctaactacacgaaatggggaacctcatatgatagtcggacgccaagaaaaagggaaatctctactattcaaaacggaagacggggtgaatatgtgtacacttatggccatagatctcggagaactatgcgaagatacgataacttataaatgtcctttactcaggcaaaatgaacctgaagacatagattgctggtgtaatagtacatctacatgggtgacttatggaacatgcacaactacaggtgaacacagaagagaaaaacgatcagtggcattagtgcctcatgtagggatgggtttagaaacacgcactgaaacctggatgtcatcagaaggcgcatggaaacacgtgcaacgtatagaaacctggatcctccgacacccaggcttcacaataatggcagccatactcgcatatacaataggaaccacacattttcaacgggccctgatattcatcttactaaccgcagtcgcaccatctatgacaatgcgatgcattggcatctcaaaccgggatttcgttgaaggcgttagcggaggatcttgggttgatattgttcttgaacatggaagttgtgtaacaacaatggccaaaaataaacccacacttgactttgaacttatcaaaactgaagcaaaacaaccagcaacattaaggaaatattgtatagaagccaaactaacaaacacaacaacggaatccaggtgcccaactcaaggcgaaccatcactaaatgaagaacaagataaaagatttatatgcaaacatagcatggtagacagaggttggggaaatggatgcggcttatttggcaaaggaggaatagttacatgcgcaatgtttacgtgcaagaaaaatatggaaggcaaagtagtccagccggaaaatcttgagtacactattgttataacacctcacagtggcgaagaacacgccgtgggaaatgacacaggcaaacatggtaaggaaattaaaattacacctcaaagctcgatcacagaagctgaattaacaggatacggcactgtaacaatggaatgctcccctaggacgggtctagattttaacgaaatggtgctactacagatggaagataaagcgtggttagtacaccggcagtggtttctagatttacctctcccgtggctgcccggagctgacacacagggatctaattggatacaaaaagaaacattagttacttttaaaaatccccacgccaagaagcaagatgtggtagtattaggaagtcaggaaggtgcaatgcataccgcattaaccggggccacagaaattcaaatgagttcaggaaatttgctttttacaggtcacctaaagtgtcgattacgaatggataagctccagttaaaggggatgtcgtatagcatgtgcacgggcaaatttaaaatagtcaaagaaatagctgaaactcaacatggaacaattgtgattagaatacaatacgaaggcgatggatctccctgcaagataccatttgaaattacagatctggaaaaacgacatgttctaggccgcttaatcacagtaaaccccatagtaatcgagaaagattctccggtaaatatagaagcagaacccccattcggcgatagctacataattattggtgtagaaccaggacaattgaagctcaattggtttaagaaagggtcgtcaatcgggcaaatgtttgaaactactatgagaggcgcaaaacgaatggcaatattaggagatacagcatgggacttcggaagcctcggaggggtttttacatcgatagggaaagctctccaccaagtctttggagctatttatggcgcagcattttcgggagtatcatggactatgaaaatcctaattggcgttgtaattacttggattggtatgaatagcagaagtacaagtctttcagtctctttggtgctcgtgggagtagtaaccctgtacttaggcgcaatggtgcaagcagattccggatgcgtggtatcatggaaaaataaagaactcaaatgcggatcaggtatcttcattactgataatgtacacacctggacagaacaatataagtttcagcctgagtccccttcgaaactggcatcagcaattcaaaaggcgcatgaagagggaatttgtggaataagaagtgtcacacgattggaaaacttaatgtggaaacaaatcaccccggagctgaaccacattctatcggaaaatgaagtaaagttaacaataatgaccggagacactaaaggtataatgcaagcagggaagcgcagcctaagacctcaaccaacggagctgaaatatagttggaaaacatggggtaaggcaaaaatgctaagtactgagagccacaatcaaacatttttaattgacggccctgaaacagcggaatgccccaataccaatcgtgcatggaactctttggaagttgaggattacggtttcggggtgttcactacaaatatctggcttaaacttagggaaaagcaagacgtattttgtgactccaaactgatgtccgcagcaattaaggataacagagctgtgcatgctgacatgggatattggatagaatcagctctcaatgatacatggaaaatggaaaaagccagttttatagaagtaaagtcttgtcactggccaaagtctcatactttgtggagtaatggagtattggaatctgagatgattatccccaaaaactttgccggaccagtgtcacaacacaattaccgaccgggataccacacacaaacggcaggaccttggcatcttggcaaacttgaaatggactttgatttctgtgaaggaacaacagtagttgttacggaggactgtggtaataggggtccatcactacggactacgactgcctcgggcaaactcataacagaatggtgttgtcgcagctgcactctaccacccctaagataccgaggagaagatggatgttggtatggaatggagattaggccactgaaagagaaggaagaaaatttagtaaactccttggtaacagccggacacggacagattgataatttctcactaggggtattaggaatggcactatttctcgaagagatgttacgaactagggtaggaacgaaacatgcaatattattggtcgccgtatcattcgttaccttaattactgggaatatgtcatttcgcgatttaggtcgggtgatggtaatggtgggagctactatgacagatgatataggtatgggagtgacatatcttgctttacttgcagcgtttaaagtaaggccgacatttgccgctggattactgttgaggaaattgacttccaaagaactgatgatggctactataggcataacactgctatcccaaagtacaatcccagaaactatactagaacttacagatgcacttgcattaggaatgatggttctaaagatcgtcagaaacatggaaaagtatcagctagcggtcaccattatggcaatttcgtgtgtccccaacgctgttatcttacggaatgcctggaaggtatcatgcacaatactcgctgctgtatctgtatcaccactattattaacgtccagtcaacaaaaagcggattggattccactggcactaaccataaaaggactgaaccccactgcaatctttcttactacgttaagccgtaccagcaagaaaagaagctggcctttaaacgaagctatcatggcagttggtatggtatcaatcctagcgagttcacttctcaaaaatgatattcccatgacgggtccattagtagcaggaggtttgcttactgtctgctatgtgcttacaggtcgtagtgctgatctagagctcgagcgtgcagctgatgtaaagtgggaagaccaagcagaaatttcaggctcaagcccgatactctcaattactatatcggaagatggatcaatgagtatcaaaaatgaagaagaagaacaaactttgactatcttgatccggacaggactcctagtcataagcggcgtatttccagtgagtatacctataactgcggcagcttggtatctatgggaggtcaagaaacaacgcgcaggggtattatgggacgtgccgagtcctccacctgtaggaaaagcagaattagaagacggagcctacagaataaagcaaagggggattcttggatacagccaaattggagccggcgtctataaagagggaacctttcacacaatgtggcacgtcacacggggtgcagtgttaatgcacagaggaaaaaggatagagccttcttgggcggacgttaagaaagacttaatatcttatggcggtgggtggaaattagaaggggagtggaaagagggagaagaagtacaggtattagccttagaaccgggtaaaaacccccgagcggttcagacaaaacctggaatttttaagacaaatacaggaactattggcgccgtcagtttggatttctcgcccggaacctcaggtagccccattgtagatcgcaagggtaaagtagtaggattatatggtaacggagtggtaaccagaagcggagcttatgtgagcgccatagcacaaaccgagaaaagtatagaggataaccctgaaatagaagatgatatattccggaaaaagcgactcacgataatggacttacatccaggtgctggtaaaacaaagaggtacctgccagcaatcgtaagggaagctatcaagagaggattgcgaacacttatattggcacccaccagggttgtggcagcggaaatggaagaagcattacggggtcttcccatacgctaccaaactcctgctattaaagccgagcatactggcagagaaatcgtagatcttatgtgtcatgcgacctttaccatgcggttactaagccctgtaagagtccctaattacaatctaataataatggatgaagcccactttactgaccccgcgagcatagctgcacgtgggtatatatccaccagggttgaaatgggagaggcagcaggaatatttatgactgctacaccaccaggaagccgtgatccctttccacaaagcaacgctccgatcatggacgaggagcgggaaatacctgagagatcatggaatagtggacacgaatgggtaacagacttcaaaggcaaaacagtttggttcgttccatcaattaaagctggaaacgatatcgcagcgtgcttaagaaagaacggaaagaaagttatacagctttccagaaaaacgtttgactcagaatatgtgaaaacacgagcgaatgactgggattttgtggttactacagatatttcggaaatgggtgctaatttcaaagcagaaagagttatcgacccaagacgatgcatgaaacccgttatacttactgatggcgaagaacgtgtaatactcgctggcccaatgccggtaactcactcatcagcagcacagagaaggggacgcataggtcgaaatcccaaaaatgaaaatgatcaatacatttacatgggggagcctttggagaatgacgaagattgcgctcattggaaagaggcgaaaatgttattggacaacattaatacaccagaaggaattatcccctcgatgttcgagccagaacgtgagaaagttgatgcaattgatggagaatataggttaagaggagaagcaagaaaaacattcgttgatctaatgagaagaggagacttacccgtatggcttgcgtataaagtagcagcagaagggataaattacgccgacagaaaatggtgttttgacggaatcaaaaacaatcagattctagaagaaaacgtagaggtagaaatttggacaaaagaaggtgaaagaaagaaactcaaaccacgctggttagatgccagaatatattcggaccccttggcgctcaaggaatttaaagagttcgcggcaggtaggaaatctttgacgctgaacctaataacggaaatggggaggctgcctacttttatgacacaaaaggcacgtaatgccctagacaacctcgctgtcttacatacagccgaggccggaggtaaagcatacaaccatgcgttatctgaactacccgaaacccttgaaaccttattgctattaacacttctagcaactgtcacaggaggaattttcttgtttttgatgtcgggaaaaggtataggtaaaatgactttaggtatgtgctgcataatcacagcatctgtgctgctctggtacgcgcagatacaaccccattggatcgctgcgagcataattctcgaatttttcttgatagtattacttatccctgagccagaaaagcagagaacaccgcaagataatcaattaacttatgtcgtcattgcaattttaacagtcgttgcggctacaatggcgaacgaaatgggtttccttgagaaaaccaagaaagatttaggtttaggatccattactactcaagagtcagaatcaaatatcctagacatagatctaagacccgcatctgcttggacactctatgctgtcgcaacaaccttcgtgaccccaatgctgaggcattcaatagagaatagctccgttaatgttagtttaacagctatagcaaatcaagcaacagtcttaatgggattaggtaaaggatggccattaagtaaaatggacatcggtgtgccactattagccatagggtgctactcacaagtaaatccgatcacactaacggctgctttattattactcgtggcacattacgctataataggacccggccttcaggcgaaagctacaagggaggcgcagaaaagagcagcagcgggaattatgaaaaaccctacagtggatggcataacagtaatagacctagaacccatcccctacgaccccaaatttgaaaaacagttgggacaagttatgctcttgatactatgcgtaacgcaagtcctaatgatgagaaccacgtgggctttgtgtgaggctttgacgctagctaccgggccaatatccaccctatgggaaggtaaccctggtagattttggaatacgaccatagctgtatcgatggccaatatatttcggggatcttatctcgcaggcgcgggactcctgttctctataatgaaaaatacaactaacacacgtaggggaactggaaacataggtgagactttaggtgaaaagtggaagtcccgtttaaacgcattaggtaaatcagaatttcagatttataagaaatcagggattcaggaagtagataggaccttggccaaagaaggtataaaacgtggggaaactgaccatcacgcggtttcacgcggatctgcgaaattacgttggttcgtagaaagaaatatggtaacgccagagggtaaagttgtggatcttggctgtggtcgtggcggatggtcatactattgcggcgggttgaaaaatgtccgagaggttaaggggctcactaaaggtggtccaggacacgaggagccgatacctatgagtacctatggttggaatctagtccggctacaaagtggagtcgacgtgtttttcacgcctccagaaaagtgcgatactttattgtgtgatattggtgaatcatcacctaacccgacaattgaggccggacgaacgttacgcgtattaaacttagttgagaactggctcaataacaacacacaattctgcattaaggttctcaacccctatatgcctagcgtgattgagaagatggaaacactacaaagaaaatatggaggtgcactcgtcagaaacccactatctcgtaatagtactcatgaaatgtactgggtcagcaatgccaccggcaatatagtgagcagtgtcaacatgataagtcgtatgctcataaatagatttactatgaaacataaaaaggcaacctacgaacctgacgttgatctcggatcaggtacaagaaatataggaatagaatcagaaataccaaatttagacattatagggaagcgcatcgagaaaataaaacaggaacatgagacttcatggcactacgaccaagaccatccctacaagacatgggcatatcatggaagttacgagacaaaacaaaccgggtctgcatcctcaatggtgaacggagtagttagattacttacgaagccatgggatgtcgtaccaatggtaacccaaatggcaatgacagacactaccccatttggacaacagagagtatttaaagaaaaagtagatacaagaactcaagagccaaaggaagggaccaagaaattgatgagaataacagcagaatggttatggaaggaacttggcaaaaagaaaacaccccggatgtgtacacgtgaggagttcacaagaaaagtaagatcaaacgcggcactaggggcaattttcacggatgaaaataaatggaagtcagctcgggaggcagtagaggatgggagattctgggagctagtagataaggaaagaaatctacatttagagggtaaatgcgaaacatgcgtatataacatgatgggcaagcgggagaagaaattgggagagttcggaaaagcaaaaggaagccgagcgatctggtacatgtggctcggagctaggtttctagaatttgaagcactgggtttcttgaatgaagaccactggtttagtagaggaaactccttaagcggagtagagggtgaaggattacatcgtctggggtatatcttaagagatgtagggaagaaagaaggaggggcgatgtatgctgatgatacggctggatgggatacaagaatcacactagaggaccttaaaaatgaagagatggtgacaaaccatatgaaaggcgaacataagaaactagctgaagcaattttcaaactgacatatcagaataaagttgttagagtacaacgacctacaccaagaggaacagtgatggatattatatctcgaagagatcagcgaggcagcggacaagtaggaacctacggactaaatacatttacaaatatggaagctcaattgataagacaaatggaaggagaaggtatattcaaatccattcaacatctaactgctacagaggagatcgcggtacagaattggttagctagagttggcagagaacgtcttagcagaatggcaataagtggcgatgattgtgtggttaaacccatcgacgatagattcgcttcggcactgacagcattaaacgatatgggaaaagtacgtaaggatatacagcagtgggaaccgtctaggggatggaatgattggactcaggtacctttttgctcacatcactttcatgagctagtaatgaaagatggtagagttcttgtggtcccgtgtcgaaatcaagatgagctgattgggcgagcgagaatttctcaaggagctggttggtcattaaaagaaactgcatgtcttggcaagagctatgctcagatgtggacccttatgtacttccatagacgagatttacgattagctgccaatgctatatgtagtgcagttccatcgcattgggtaccaacatcacggacaacttggtcaattcatgctaagcacgaatggatgacaacagaagatatgctcgcagtatggaatagagtttggattcaagaaaacccttggatggaagataaaacaccagtagagagctgggaagaggtgccttacttaggtaaaagagaagatcaatggtgtgggtcattaattggactaaccagcagagccacttgggccaaaaacatccaaacggctatcaaccaagtccgaagccttataggcaacgaagaatatactgactacatgccatcaatgaagcgtttcagaagagaagaagaagaagctggggtactatggtaa

SEQ ID NO: 22662 - RNA, 9876 nt, synthetic construct
  misc_feature 1..9876: note = derived and/or modified CDS sequence (opt6) from DENV-2__GQ868595__SS-prME
  source 1..9876: mol_type = other RNA
acagcgggagtaataataatgttaatcccgacggctatggcatttcacctcactaccaggaatggcgagccacatatgatagtttcacgacaggaaaagggaaaatctctcttgtttaaaacagaggatggagtcaatatgtgcacactcatggcgatcgacttaggagaattatgtgaggacacaatcacatataaatgcccattgttaagacagaacgaacctgaggacatagactgctggtgcaattctacttccacgtgggtgacatacggaacatgtacaacaacaggtgagcatcgtcgggagaaacgaagtgtcgcactcgttccacacgtcggtatgggactcgaaaccagaaccgaaacatggatgtcaagtgaaggcgcatggaaacacgtacaaagaatagaaacatggatactcaggcaccccggctttgcaattatggcagccattcttgcttacacgattggaacaactcactttcagagggccctaattttcatattattaaccgctgtagctccctccatgactatgcgttgtatcgggatatctaaccgagactttgtcgaaggagtatccgggggatcatgggtcgatatagtactagaacacggaagttgcgtgactacgatggcaaaaaataaacctacgctagacttcgagctaataaagaccgaagcaaaacagccggccacactgcggaaatattgtatagaagctaaattgaccaacacgaccacggagagcagatgcccaacacaaggagaaccatccttaaatgaggaacaggataagagatttatatgtaagcattcaatggtggatagaggatggggcaatggctgtgggttgttcggaaagggtggaatagttacctgtgcaatgttcacttgtaaaaaaaacatggagggaaaagtcgtgttaccagaaaatcttgaatacacaattgtcattacgccacactcaggcgaggagcatgcagtaggcaacgacacagggaaacacggaaaggaaattaaaataacaccgcaatcatcaattactgaagcggaactaaccggttacggaacagtaacaatggaatgtagccctaggacaggattagactttaacgaaatggtacttttacaaatggaagaaaaagcatggctagtacaccgacaatggttcttagacctccctttaccttggctgccgggcgcagatacacaaggcagtaactggatccaaaaggagacactagttacattcaaaaatccccatgcaaaaaaacaggatgtagttgtattagggagccaagagggagcaatgcatacagccctaactggggcaacagagatacagatgagttccggtaaccttctctttactggacaccttaaatgccgactaagaatggataaattacaactaaaaggaatgagctatagcatgtgcactggaaaatttaagatcgtaaaagagatagcagaaacacaacacggcactatcgtgatacgcgtccaatatgaaggagatggatcaccatgcaaaataccatttgaaatcatggatctcgaaaaacgacacgtgcttggaagactaataaccgtgaacccaatagtaacggaaaaagacagtccagttaatatagaagctgaacccccgttcggtgactcctacataataatcggagtggaaccgggacagttaaaactaaattggttcaagaaaggtagcagcataggccaaatgttcgaaaccacaatgcggggagcgaagagaatggcaatattaggcgataccgcatgggacttcggttcgctaggtggcgtattcacgtctatcggaaaagcattgcaccaagtttttggggcaatatacggtgcagccttctcaggagtgtcttggaccatgaaaatactcatcggtgtaataataacctggataggaatgaatagtagatccacttcgcttagtgtctctctcgttttagtaggagtcgtgacactttatttaggagctatggtccaagccgatagtggatgtgtagtatcttggaaaaacaaagaactaaaatgtggttcagggatcttcataaccgacaatgtacacacatggactgaacaatacaaattccagcccgagtcgccgtctaagctagcatcggcaattcagaaggcgcacgaagaaggtatatgcgggattcgatccgtaacacgtctcgaaaatctaatgtggaaacagattacaccagaactaaaccacatattaagcgaaaatgaagtgaaactgactatcatgacaggagacataaaaggaataatgcaagctggaaaaaggagtctcaggcctcagcctactgaattgaaatactcatggaaaacttggggaaaagcaaagatgctctcgacggaaagtcataaccagacttttcttatagacggtccagaaacagctgaatgccctaatacaaaccgtgcatggaatagtctagaagtcgaagactatggatttggagtattcacgacaaatatctggctaaaactaagagagaagcaagatgtgttttgtgatagcaagttgatgagtgcagcaataaaagacaacagggcagtccacgcggacatggggtattggatagaatctgcattaaacgatacctggaagatggaaaaggcatcctttattgaagtcaaatcatgtcactggccgaaaagccatacactttggtctaacggggttttagaaagtgaaatgataataccaaaaaattttgcaggaccagtaagtcaacataactacaggccaggataccatacacaaacagcaggaccatggcacctcggaaaactagagatggattttgatttttgcgagggcactacggttgtagtaaccgaagattgtgggaatcgtggtccaagtttaagaacgacgacagcttcaggcaaattaataacagaatggtgctgccgtagctgcacattgccaccgctaaggtatcggggagaggatggctgttggtacggaatggaaatacgacctttgaaagaaaaagaagaaaatttagttaattcactagtaacagctggacatggacaaattgataacttttctctaggtgtgttgggaatggccctatttctggaagaaatgttacgtacgcgagtaggaaccaagcacgctattctattggtagcggtcagctttgtgaccctaattaccggaaatatgagctttcgagatttaggaagggtaatggttatggtaggcgccacaatgacagacgatatagggatgggtgtgacttacttagcccttctggcggcattcaaggttaggcctacatttgccgctggacttttattaagaaaattgacctcaaaggaacttatgatggcaacaattgggatagcacttttgtcccaatctacaataccggaaaccattctggaacttacggatgcattagccctcggtatgatggtccttaagatagttcgtaatatggaaaagtaccaattagcagtaacgattatggctatatcttgtgtgccaaacgcagtcatattacttaatgcttggaaagttagctgtaccatactagcagctgtctcagtcagtcccctactacttacctcatcccaacaaaaagctgattggatccccttagcactaaccattaaaggtttaaatcccacagccatttttctcacaaccttgagcagaacaagtaagaagagaagctggcctcttaatgaagccgtaatggcagtaggaatggtatctattctagcctcaagtctcctcaaaaacgacattcctatgacaggaccactagtagcaggtgggttacttactgtatgttacgttctaacaggcagatctgcagatttagaacttgaaagggcggcagatgtaaaatgggaggatcaagcagaaatttccggaagcagtccgattctaagtatcacaatatccgaagatggatctatgtcgatcaaaaatgaagaggaagaacaaactttaacaatactaatacgtacaggtctactagtgatctctggagtattcccggttagcattcccataacggcagccgcatggtacctctgggaagtaaaaaaacaaagagccggtgttttatgggacgttccgagcccgccaccagtcggaaaagctgaattagaagatggagcatacagaattaaacaaagaggaatactgggatattctcaaataggagccggagtgtacaaggaaggtacctttcacaccatgtggcacgttactaggggggcggtcctaatgcataggggaaagaggattgaacctagttgggctgatgttaaaaaggacttaatttcttacggcgggggttggaaactcgagggtgaatggaaggaaggagaagaagtccaagtactcgcactagagccagggaaaaaccctcgagcagtccaaacaaaaccaggattattcaaaacgaacaccggaacgataggtgcagtatcattagattttagccctggaacctctggttccccgattgtggatcgcaagggcaaagttgtaggtctgtacggaaatggggttgtcacacgttccggagcatacgtatcggcaattgcacaaacagaaaaatctattgaagataatccggaaattgaagatgatatttttcgcaagaaacgcttaacaatcatggatttacacccaggggcaggaaagactaaaaggtatttacctgctattgtacgcgaggccattaaaaggggactacgtactttaatattggcacctacccgagtagtagctgcagagatggaagaagcactaagaggtctaccaattcggtatcaaacgccagcaattagagctgaacacaccggaagggaaatcgttgaccttatgtgccatgctactttcactatgaggctactatcgccagtaagagtccctaactataaccttataataatggatgaggcacattttactgatcctgcatctatagcagcaagaggttatatatcgacgcgcgttgaaatgggtgaagcggcaggaatctttatgacggcgaccccacctggcagccgagatccattcccacaaagcaacgccccgattatggatgaagagagagaaatacccgagaggtcgtggaattcaggacacgaatgggtgactgactttaaaggtaagactgtctggtttgttcctagcattaaagcagggaacgatatcgcggcttgtttgaggaagaatggtaagaaagtgattcaactatctaggaaaacatttgacagcgaatatgtcaaaactcgtgctaacgattgggactttgttgttacaactgatatctcggaaatgggcgccaattttcgagcagagagggtgatcgatccacggcgctgtatgaaacctgtaattcttaccgacggggaagaaagagtcatacttgctgggccaatgcctgtaacacatagtagcgccgctcagcgccgtggaaggatagggcgcaacccgaaaaatgaaaatgatcaatacatttacatgggtgagccgttggaaaatgatgaggactgtgctcattggaaagaagcgaagatgttacttgataatattaatacgccggaaggtattataccctcaatgttcgagcccgagcgggaaaaagttgacgcaatcgatggagaatatagattacgtggtgaagcaagaaaaacttttgtagacttaatgagaagaggtgacttaccagtatggttagcgtatagagtagcagcagaaggaatcaattatgccgacagaagatggtgtttcgacgggatcaagaacaatcaaatactagaagaaaacgtggaggtagaaatatggacgaaggaaggcgaacggaaaaagctcaagccaagatggttagatgcaaggatatactccgaccctcttgcgcttaaagaattcaaagagttcgcagcaggcaggaaatctctaactctcaacttaattacagaaatgggtagattacccacattcatgacgcagaaggcacgcgacgcattagacaatttggccgtgctacatacagctgaagcgggaggccgagcctacaatcatgcactatcggagctacctgaaactctagagactttgctactgttaaccctacttgcgacagtaacaggaggcatatttttatttcttatgtctggtaaggggataggaaaaatgaccctagggatgtgctgcataattactgcctcaatcctactatggtacgcacagatacagcctcattggattgcggcaagcattattctagagtttttcttgatagtcctactcatacccgaaccagaaaaacaaaggacacctcaagataaccaactaacttatgttgttatagctattctaactgtcgtggccgccaccatggctaatgaaatgggtttcctcgagaaaactaaaaaagatttaggcttaggatcaattacaacacaagagagcgaatctaatatacttgatatcgacttgagacctgcttcagcttggactctctatgccgtagcaacaacttttgtcacacccatgttgcgacacagcatagaaaattccagtgttaatgtaagcttgaccgccatagcaaatcaagcaacagttttaatgggactcggcaaaggatggccattaagcaaaatggatataggagtaccattactggctataggatgctatagccaagtaaacccaataactctgactgcggccctattgttattagtggcacattatgcaataataggcccgggattgcaggctaaggcaactagggaagcacaaaagcgcgcagctgctggaatcatgaaaaaccccacagtggatggaattacagttattgatctagagccaatcccttatgacccaaaatttgagaagcaattaggtcaggtcatgttactaattctgtgtgtgacccaagtactcatgatgaggacaacatgggcattatgtgaagcactaacgttagcaactggaccaatttcaacgttatgggaaggcaatccaggtcgattttggaatacaacaatagccgtaagcatggcgaacatcttccgaggcagttacttggcaggagccggcctacttttttcaataatgaaaaatacaactaatacacgacgaggaacaggaaatataggcgaaacattaggcgagaagtggaaatctaggttgaacgcacttggaaaaagtgaatttcaaatatataaaaagtcaggaatacaagaagtagaccgcactctagcaaaggaaggaattaagcgtggtgaaaccgatcaccatgcagtctcaagaggaagtgccaaattaaggtggtttgtcgaaaggaatatggtaacaccagagggtaaagtagtcgacttaggttgcggtagaggtggatggagctattactgcggaggattaaaaaatgttcgcgaagtaaaaggattaacaaaaggaggaccgggtcacgaagagccaatcccaatgtctacgtacggatggaaccttgttcgcttgcaatctggagtcgatgtattttttacacctcctgaaaaatgtgacacgttactgtgcgatataggtgaatctagtccaaatccaacgattgaagcaggacgtaccttaagagtactgaaccttgtggaaaattggttgaataacaatacccaattttgcataaaagtcttaaatccctacatgcctagtgtaatagaaaaaatggaaactttacaacgaaaatacggaggagcacttgtgcgaaatcctctctcacgaaatagcacacatgaaatgtactgggtcagtaatgcaacaggcaatatagtatcttcagttaacatgatttcacggatgttaataaataggtttacgatgaaacataaaaaagctacatatgaacctgacgtagacttgggcagtggaacaagaaacatcggaatagaatcagaaattcccaatctcgacataatcggaaaaagaatagaaaaaataaaacaggaacatgaaacttcttggcattatgaccaagaccatccatataaaacttgggcctatcacggaagctacgaaacaaaacagacaggctctgcgtcatcgatggttaacggtgtcgtacggttacttacaaaaccctgggacgtagttcctatggtaacacaaatggcgatgacggatacaactccgtttggacaacagagggtgtttaaagagaaagtagacacgagaacacaagagccaaaagagggaactaaaaaattaatgcgtataaccgcagaatggttatggaaagaactaggaaaaaaaaaaactccacgtatgtgtacacgagaagaattcacacgtaaagtacgaagtaatgccgctctaggtgccattttcacggatgaaaataagtggaagagtgcacgcgaagccgtcgaagatagtagattctgggaattagttgaccgagaacgtaatttacatctagaaggtaaatgcgaaacctgcgtatataacatgatgggaaagcgagaaaagaaattaggggaatttggaaaagccaaggggtctagggccatatggtatatgtggctgggagctaggtttttagagtttgaggctttgggttttcttaacgaagaccattggttctcaaggggtaattctttgagcggagtagaaggggagggactgcatcgtctgggctacatcctacgagacgtatcaaaaaaagaaggcggagcaatgtatgcggacgatactgcaggatgggatacgagaataacacttgaggatttgaagaatgaagaaatggttactaatcatatgagaggagaacataaaaaactagcagaagcaatatttaaactaacgtatcaaaacaaagtagtgagagtacaaaggccaacgccacggggcacggtaatggatattataagtagacgagatcaaagggggtcaggtcaagtagggacttacggtttaaatacgtttactaatatggaggcccaattaattagacaaatggaaggagaaggcatattcaaatcaataaaacatctgacagtaaccgaagagatcgccgttcaaaactggctagctagagttggaagggagaggctaagccgaatggcgataagtggcgacgattgcgtggtaaagccattagatgaccgttttgctagtgccttaactgctctgaatgacatggggaaggttcgtaaagacattcaacaatgggaaccaagtcgtgggtggaatgattggactcaggttcctttttgctcacaccactttcatgaactagttatgaaggatggtcgtgtattggtggtgccatgcaggaatcaagacgaattaattggtagggcacgtatttcgcaaggtgctggatggagtctcaaagaaacagcttgcttgggtaaaagctacgcacaaatgtggaccttgatgtacttccatagacgtgatttgagacttgcagcaaacgcgatttgttccgcagttccatcacattgggtacccacaagtcgtactacatggtcaatccacgcaaaacatgagtggatgaccacagaagatatgctggccgtttggaacagagtatggatacaagaaaacccttggatggaggataaaacgccagtagaatcctgggaagaagttccttatctaggaaaacgcgaagatcaatggtgtgggagtttgattggattaacctccagggcaacgtgggccaaaaacatccagactgcaattaaccaagtaagatccttaatcggtaacgaagagtatacagactatatgcctagcatgaaacgatttagaagagaagaagaagaggcaggagtactatggtaa

SEQ ID NO: 22663 - RNA, 9876 nt, synthetic construct
  misc_feature 1..9876: note = derived and/or modified CDS sequence (opt6) from DENV-2__GQ868540__SS-prME
  source 1..9876: mol_type = other RNA
acggcaggggtaattataatgttaataccaactgcaatggcatttcatctcaccactagaaatggggaaccccacatgatagtaggtaggcaggaaaaaggcaaatcgctcctttttaaaacagaggacggagtaaatatgtgtacgttgatggcaatagacttaggggaattatgtgaagacaccatcacttacaaatgtccgttactcagacaaaatgaacctgaagatattgactgttggtgtaacagtacaagcacttgggttacatatggaacttgtacaacaacaggtgagcataggcgtgagaaacgttcagttgcgttagtgccacatgtaggaatgggcttagaaacaaggactgaaacatggatgagttctgaaggggcatggaaacatgttcaaaggatagaaacttggattctgaggcatccaggattcgcaataatggctgcaatattagcatacactataggaaccacccacttccaacgagcattgatattcatactcttgacagcagtagctccctcaatgacaatgcgctgtataggaataagcaacagggatttcgttgaaggagttagtggcggctcctgggtggatatagtattggaacatggttcctgcgtgactacaatggctaaaaataagcccactttagattttgaattgattaaaactgaggcaaaacaaccggcgacattaaggaaatattgcattgaagccaaactaaccaatactacgactgaaagcagatgccctacacaaggagaaccttcactaaacgaagaacaggataaaagatttatatgcaaacattcaatggtagatcgagggtggggcaatggctgtggcctttttgggaagggcggaatagtgacctgcgccatgtttacatgtaaaaagaatatggagggaaaagtagtattgccagaaaacctagaatacacaatagtaattacaccccactctggagaagaacacgcagttggaaatgatacaggaaagcacggaaaggaaataaagattacccctcagtcatctataactgaagcggaattaactggttatggaacggtgacaatggaatgcagtccaagaaccggcctggattttaatgaaatggtcctactccagatggaggagaaggcatggttagttcacagacagtggttcctagatctccccctaccctggttgccgggagccgatacacaaggtagcaactggatccaaaaggaaacgttggtgacttttaaaaatccccacgcgaagaaacaggatgtggtagtactggggtctcaggaaggggctatgcatacggccttgaccggagcgactgagatacaaatgtcttcaggtaacttactctttacaggtcatctaaaatgtcgccttagaatggataaacttcaattaaaaggcatgtcctactcaatgtgtacaggcaagtttaaaattgttaaagaaattgcagaaacacagcacggtacaattgtcataagggttcaatatgagggcgatggaagtccatgcaaaatccctttcgaaatcatggacctcgagaaaagacacgtattaggcagactgatcaccgttaatcctatcgtcacagagaaggactcgcctgtgaacatcgaagcagaaccaccattcggagattcgtacataattatcggagtggaacctggacaattaaaacttaactggtttaagaagggttcaagtatagggcagatgttcgaaaccacaatgcgaggcgcaaagaggatggcgatacttggagataccgcttgggacttcggatctcttggaggtgtctttacatcaatcggcaaagcgttacaccaagtctttggagcaatatatggggcggctttttcgggagtatcctggacaatgaagatattaatcggagttataatcacttggattggaatgaattcaagatccacaagcttatcagtaagtttagtgctggttggagtcgtgacactctacttgggggcaatggtacaggccgacagtggatgtgtagtgagctggaagaacaaggaactcaaatgtggttcaggcatattcataaccgataacgtacacacatggacagagcaatacaaatttcagcctgaaagcccttcgaaactagctagcgcaattcaaaaagcacatgaagaaggcatctgcggtatcaggtcggtaactcgtctagagaatctgatgtggaaacagataacaccagaacttaatcatatattaagcgagaatgaagttaaactcacaataatgacaggagacataaaagggataatgcaagccggaaaacgtagcttaaggccacaaccaacagaactcaaatattcatggaaaacatggggaaaagcgaaaatgctaagtacggaaagccacaatcagacattcctggttgatggtccagagacagccgaatgccctaacactaatcgggcgtggaattcattagaagttgaggattacggatttggcgttttcacaacaaacatatggctaaaactacgggaaaaacaagacgtattttgtgattcaaagttgatgtctgcagccattaaggacaacagggcagtacacgcagatatgggctactggattgagagtgcattgaatgacacttggaagatggaaaaagcatcatttattgaggtaaagtcctgtcactggcctaagagccatacactttggtcaaacggtgtactagaatcagaaatgataatcccaaaaaatttcgcgggaccagttagccagcataattacaggccggggtatcatactcaaactgcaggcccgtggcatttgggcaaattagaaatggattttgatttctgcgaaggaacgactgttgttgtaaccgaagattgcggaaatagaggtccatcgttacgtaccacaactgctagcggtaagttgataacagaatggtgctgtcgaagttgcaccttaccacctctaaggtaccgtggagaggacggatgctggtatggaatggaaataaggccactcaaagaaaaggaggaaaacttagtaaactcactcgtaacagccggacacggccaaatcgataatttcagccttggagtcttaggaatggccttattccttgaagaaatgttaagaacacgtgtaggaaccaaacacgcgatcctattggttgcagtaagctttgtgacattaattaccggaaacatgtcgtttcgtgatcttgggagggttatggttatggtcggggctacaatgacggacgacattggaatgggagtgacatatttagcattattagcagccttcaaggttcgaccaactttcgccgcgggtctacttctgcgtaagttaacgagcaaagaactaatgatggccacaataggtattgcactattatcccaatcgacgataccagaaacaatactggaacttacagatgcactcgcgctgggaatgatggtactaaaaatagtgcgaaatatggaaaaataccagcttgcagtaacaataatggcgataagttgcgttccaaacgccgtaatattattaaacgcttggaaagtatcgtgtactatattggccgcagtctctgtgagtccattattgctaactagttcccaacaaaaagcggattggatacctttggcattaaccatcaaaggattaaaccctactgcaatatttctcacaacattatcaagaacatctaagaaacgaagttggcccttaaacgaagctgtaatggcagtaggtatggtttcaatactagcgagctctttactcaagaatgatatccccatgaccgggccgttggttgctggaggccttctcactgtgtgctacgtcctcacgggaagatcagccgatcttgagttagagagagcagccgatgttaagtgggaagatcaagctgaaatatccgggtcttcaccaatacttagtatcacaatttcagaagatggatcaatgtcaattaaaaatgaggaggaagagcaaactctaacaatacttattaggactgggttattagttatttcaggtgtatttccggtatcaatacccataacagcagcggcatggtacctatgggaagtcaagaaacagagagcaggagtactgtgggatgtacctagccccccacccgtggggaaagccgaactagaagacggtgcctacagaataaaacaaagaggcatattaggttatagtcagattggggcgggggtatataaggaaggtacctttcatactatgtggcacgtgactcgaggagcagtgctcatgcacagaggtaaacgaattgaaccgagctgggcagatgttaagaaagacctcatttcatatggaggtgggtggaaactagaaggcgaatggaaagagggagaagaagttcaagtattagcattagagccaggcaagaatcctcgcgcagtacagactaagccaggattgttcaaaacaaacacaggcacgataggggccgtgtcattagacttctcgccaggtacttctggcagccctattgtagacagaaaaggcaaggtagtcggcctttacgggaatggtgtagtaactagaagtggcgcatatgtgtctgccatagctcaaacggaaaaaagtatagaagacaatcctgagatagaagacgatatttttagaaagaagcgactaactataatggatttgcatccaggagcgggtaagacgaaaagatacctacccgctattgtcagagaagcaatcaaacgcggcttgcgaaccttgatactagcaccaaccagagttgtagcagcagaaatggaagaagcattaagagggttaccaattaggtatcaaacccctgctatacgagccgaacacacaggcagggagatagtagacttgatgtgtcatgcgaccttcaccatgcgattactttcgcctgtcagggtaccaaattataatctaatcatcatggacgaagcccacttcactgacccggcatcgatcgcagcgcgagggtacataagcacgagggtagagatgggcgaagctgcgggaatattcatgacagctactcctccaggttctagagatccttttcctcaatctaatgcaccaataatggacgaagaacgagagataccagaaagaagttggaactcgggccacgaatgggttactgatttcaaaggtaaaacagtttggtttgtaccaagtataaaggcaggaaatgatattgcagcatgtttaagaaagaacgggaaaaaggttattcaactatcacgtaaaaccttcgattccgagtatgtaaaaactcgagcaaacgattgggacttcgtcgtaactacagatataagtgagatgggcgctaatttccgagcggaacgagtgatcgatccaagacgatgtatgaaacctgtgattctaacagacggagaggaaagggtcatcctcgctggcccaatgccagtaacacacagtagtgctgctcaaagaagaggcagaataggacgtaaccccaagaacgaaaacgatcaatacatatatatgggtgaaccactggaaaatgacgaggattgcgctcattggaaagaagctaaaatgctgcttgataacataaacaccccagaaggaataataccttcgatgttcgaaccagaacgagaaaaagttgacgcaatagacggagagtacagactacgtggagaggcaaggaagacatttgtggacctaatgaggagaggcgacttaccggtctggctcgcatatagagtagcggcagaagggataaattacgcggatcggcgttggtgcttcgatggcataaagaataatcaaatacttgaagagaatatggaagtagaaatttggactaaagagggagaacgcaaaaagctgaagccacgatggcttgacgccagaatatatagcgaccccttagccttaaaagaatttaaggaatttgctgcaggtcgcaaatcgctaacattaaatctcataacagaaatggggagattgcccacatttatgactcaaaaagcacgggatgccttggataatttagccgtcttgcataccgctgaagcaggcgggcgtgcgtataatcacgcgcttagcgagctaccagaaaccctggagacactattacttttaacattattagctacagtaacgggtggtatattcctttttttgatgagtggaaagggtatagggaaaatgacactaggtatgtgttgtatcataacggcgagcatactcctgtggtacgctcagatacagcctcactggatagcagcttccatcatattagagttttttttgatcgttttactcattccagaaccagaaaagcaaagaaccccccaagacaaccagctgacttacgtagtgatagcgatcctaacggtggtggcagctactatggccaatgaaatgggctttttggaaaagactaaaaaagatctcggcctcggcagcataacaacccaagaaagtgaatcgaatatattggatattgatttaaggcccgcgagcgcttggacgttatatgccgtagccacgacatttgtaacgcccatgctccgacactcaattgaaaattctagtgtaaatgtaagcctgacagctatagccaatcaagccaccgtcctaatgggactagggaaggggtggccactatcgaaaatggacataggtgtacccctactggctattgggtgctattcccaagtaaacccgataaccctgacggcagcattgttactactagtagcgcactatgcaattataggtccaggattacaggctaaagcgacacgagaggctcagaaacgtgctgctgcaggaatcatgaaaaatccaaccgtagacgggataaccgtaatagatttggaacctataccatatgatccaaaatttgagaaacaattaggtcaagtgatgcttctaattctatgtgtaacacaagtcttaatgatgagaaccacttgggcgctatgcgaagcactaacactagcaacgggaccaatttcgactctatgggaaggtaacccgggaagattttggaatactacaatagcagttagcatggctaacatattcagaggtagttatctagctggagcgggtctgcttttttcaataatgaaaaacacaactaatactagacgagggaccggaaatatcggagaaacgcttggagaaaaatggaaatcccgattaaatgctctcggtaaaagcgaatttcaaatatataagaaatctgggatacaagaagttgatagaacccttgctaaagagggaataaaaagaggagaaaccgaccatcacgccgtctctaggggatctgctaaattaagatggtttgttgagagaaatatggtgacaccagagggaaaagttgttgatttgggttgtggaagaggtggatggtcttactattgcggaggtcttaaaaatgtccgcgaagtaaaaggactaacaaaaggaggtcccggacatgaagaacctatacccatgtcaacatacggctggaatttagtacggttacagtctggcgtagatgtgttcttcacacctccagaaaagtgtgatactctactttgtgacattggagaaagttcacctaacccgacaatagaagcaggtcgtactctccgcgtcctgaatttagtagagaattggctgaacaataatacccaattttgtattaaagtattgaatccatatatgccttccgttatagaaaaaatggaaacattgcaacgcaagtacggtggcgctctcgttagaaacccactgtctcgaaactctacacacgaaatgtattgggtgagcaatgcaaccgggaatatcgttagttccgtaaatatgattagccggatgttaattaacagatttacaatgaaacataagaaagcaacatacgaaccagatgtcgacttgggtagtgggacgcgaaatataggaatagaatcagaaatccctaatctagatatcatcggaaagagaattgaaaaaataaagcaggagcatgagacctcatggcactatgaccaggaccatccttacaaaacgtgggcatatcacggatcttatgaaacgaaacaaacaggatcggcttcgtcaatggtcaatggtgttgtgaggctgctcacaaagccttgggatgtcgtgccaatggtaactcaaatggctatgacggatacaacaccctttggacaacagagagtattcaaggaaaaggtcgataccagaacacaagaacctaaggaaggaacaaaaaaactaatgagaataacagctgaatggctctggaaagagctaggaaagaaaaaaaccccccgtatgtgtactagagaagaattcacaagaaaagtccgatctaatgctgcgttaggagcaatatttaccgacgagaataagtggaaatctgcacgagaagccgtggaggattctagattttgggagctagttgaccgggaaagaaatttgcatctggagggtaaatgtgagacttgcgtttacaacatgatgggaaaacgagaaaagaaattaggggaattcggaaaagcaaaaggcagtcgagctatatggtatatgtggctaggggctagattcctagagtttgaagcattaggttttcttaacgaagatcattggttttcccggggcaattctctctctggtgtcgaaggggagggactacatcggttgggatatatactgcgcgacgtctctaagaaagaaggtggtgctatgtatgcggatgatacagccggatgggatacaagaattactctagaagacttaaaaaatgaggaaatggtaaccaaccatatgaaaggagaacataagaaattagcagaagcaatattcaaattaacttaccaaaataaagtagtgcgagtccagcgcccaactcctcgaggaacagtgatggacatcatctctcgaagagaccagagaggaagtggccaagtaggcacatatggtctaaacacttttacgaatatggaagcacaactaattagacagatggagggagaagggatatttaagtcaattcaacacttgaccgtaacggaagaaattgcggtacaaaattggttagcaagagtaggaagagaaagattgagtagaatggcgatatctggagatgattgcgtggtcaagccactcgatgacagatttgcatcggccttaacagctcttaatgacatgggaaaagttaggaaggacattcaacaatgggaaccgtcaagagggtggaacgattggactcaagtaccattttgctctcatcattttcatgaactagtaatgaaggacgggagggtattagtagtcccatgcaggaatcaggacgaactaattggaagggccagaatttcgcaaggagccggttggagcctcaaagaaactgcttgcttaggaaagagttatgcacaaatgtggacgttgatgtattttcaccgacgggacttaagattagccgctaatgcaatttgctcagccgtaccaagccactgggtacctacatcgagaaccacatggtccatacacgcaaaacacgaatggatgacgacagaggatatgcttgcggtatggaaccgggtatggatacaagaaaatccctggatggaagataaaacaccagttgaaagctgggaagagattccatacttaggaaagcgagaagatcaatggtgtgggtctttaatagggttaacatcccgggctacgtgggccaaaaacatacaaaccgcaattaatcaagtaagaagtttaattggcaatgaggaatacacagattacatgccctctatgaaaaggtttagacgggaagaagaagaagcaggcgttttatggtaa

SEQ ID NO: 22664 - RNA, 9876 nt, synthetic construct
  misc_feature 1..9876: note = derived and/or modified CDS sequence (opt6) from DENV-2__GQ868541__SS-prME
  source 1..9876: mol_type = other RNA
actgcaggagtcataataatgctaattccaacagcaatggcatttcacctgactacgagaaatggggaacctcatatgatcgtcggaagacaagaaaaaggtaaatcgctgctgttcaaaaccgaggatggagtgaatatgtgcactcttatggcaatcgatttaggagagctttgtgaagacactataacctacaaatgtccattgttgcgacaaaatgaacctgaggatatagattgttggtgtaatagcacatcaacatgggttacatatgggacttgtacgacgacgggtgaacatagacgagagaaaaggtcagtagctctagttccacatgtgggaatggggttagaaacgagaacggaaacatggatgagctctgaaggggcatggaaacatgtgcaaaggattgagacatggattttacgtcacccgggctttgcaataatggcagcaattttggcatatacaataggaacaacacatttccaacgcgcacttatatttattttattaactgcagtggcacctagcatgactatgcgctgcatcggcatatcgaatagggattttgtagaaggggtctcaggaggcagctgggttgacattgtacttgaacatggtagttgtgtaacaactatggcgaaaaataaaccaactttagatttcgaattgataaaaacagaggccaaacaaccagcaacactaagaaaatactgtatagaagcaaaactaaccaacacaacgacagagtccagatgtccaactcaaggagaaccgtcactcaacgaagaacaagataaaaggtttatatgtaaacattcaatggtagaccgcggctggggaaacggttgtggattatttggtaaaggaggaatcgtaacatgcgcgatgtttacgtgcaagaaaaacatggaaggaaaagtagttttaccagaaaacttggagtatactattgtcataacaccacacagtggggaagaacacgctgtgggcaacgatacaggcaaacacggaaaagagatcaaaataacaccgcaatcttcaattacagaagcagaactaactggttacggaacagtcactatggaatgttcacctcgcacaggcctagatttcaatgagatggttctattacaaatggaagaaaaagcgtggttagtacatcgacagtggttcttagatcttcctttaccgtggttacctggcgctgacacacagggatctaattggatacaaaaagaaacgttagtcacttttaaaaatccacacgccaagaaacaagacgtggtagttctaggaagccaagaaggagcaatgcatacagcactaaccggagctactgagattcaaatgtcatctggaaatcttctgttcaccggccacctaaaatgccgcctcagaatggacaaactgcaattgaaaggtatgtcctactcaatgtgcactggcaaatttaaaattgtaaaagagattgcggaaacacaacatggtactatcgttattagggtacaatacgagggagacggttcaccttgcaaaataccatttgaaattatggatctagagaaaagacacgtattaggcaggttaattacagtaaacccgattgtaaccgagaaagactcaccagtgaatatagaagcagagccaccttttggagatagttatataatcatcggagttgaaccaggtcagctaaaattgaattggtttaagaaaggatctagtattggacaaatgtttgaaacaactatgagaggagctaaacgaatggcgattttaggagatactgcctgggatttcggaagtctcggcggagtatttacgtccataggaaaggcgttgcatcaagtattcggggctatatatggtgcagcattttcgggagtgtcatggaccatgaagatactaataggtgttataattacttggataggtatgaactctagaagtacgtcattatcagttagcctagtccttgtgggagtggtaactctttatttaggcgcgatggttcaggctgacagtggttgcgttgtcagttggaaaaataaagagttaaagtgtggatccggaatttttattaccgacaacgtacatacgtggacggaacagtataaatttcaaccagagagcccttcaaaattagcatccgctatccaaaaagcgcacgaagagggaatttgcggtatccgatctgtaacaagattagaaaacctcatgtggaaacagattactccagaattaaaccatatactgagtgaaaacgaagttaaactaactatcatgacgggagacataaaaggaataatgcaagccggtaaacgatccttacggcctcaacccacagaattaaaatatagttggaaaacatggggtaaagcaaaaatgttaagcacagaaagccataaccaaacattcctaattgatggtcccgaaaccgcggaatgtccgaacacaaatagggcatggaactctctcgaagtagaagactatgggtttggagtcttcacaacaaatatatggttgaaactcagagaaaagcaagatgtcttttgtgatagcaaactaatgtctgctgcaatcaaggataatcgtgcagtacatgctgacatgggctattggattgaaagcgccttaaacgatacttggaaaatggagaaagcatcatttatcgaggttaagagttgtcactggccgaaatcgcatacgctatggagtaatggagtactagaatcagaaatgataatccccaaaaatttcgccggtccagtaagccaacacaattatagaccaggctatcatacgcagactgctggtccatggcatctggggaaattggaaatggacttcgacttctgtgagggtacgacagtcgtagtaactgaggactgcggtaatagggggccatccttgaggaccaccacagcgagcggaaaactgattacagaatggtgctgtaggagttgcacactaccgccgctccggtatagaggggaagatggatgctggtacgggatggaaatccgaccattaaaagaaaaggaagaaaatcttgttaattcgttggtaacagcaggtcacgggcaaatagataactttagtctaggcgtgttaggaatggcgctctttttagaagagatgctgagaacgagagtcgggacaaaacatgctatacttcttgtggcggtatcctttgtaacattaataactggcaacatgtcctttagagaccttggacgggtaatggtgatggtaggggcaacaatgactgacgatattgggatgggtgtcacatatcttgctctgctagctgcattcaaggttcgtccaacgtttgccgccggtttactacttagaaaattaacaagtaaagaactaatgatggccactatcggaatagcgttgttatctcagtccacgattcctgaaactatacttgaactaactgatgccctggctctaggtatgatggtcctaaaaattgtaagaaatatggaaaagtatcaattggcggtaactattatggcgatatcttgtgtaccaaatgcagtgatactcttaaacgcatggaaagtatcttgtactatcctagcagcagtgagcgtttcgccattattactaacatcatcacagcagaaagcagattggataccactcgcacttacaataaagggactaaaccccacagcaatatttctgacaactctaagcaggacgtctaaaaagcgcagttggcctttaaatgaggcagtgatggcagttggcatggtatccattttagcaagttcattgttaaagaacgatattccaatgacgggacctctcgtcgctggtggtttactaacggtatgctacgtgctgacaggaaggtcagcagatcttgaattagaacgggcagcagacgttaagtgggaagaccacgccgaaatatctggaagctcaccaattttatcaataaccatatccgaagatggatctatgagcattaaaaacgaggaggaagaacaaaccttaactatattaatacgaacaggtctcctagtaatatctggggtgttcccagtttcaatacccatcacagcggcagcatggtatctttgggaagtcaagaaacaacgggcaggagtcctatgggatgttcccagcccacctccagtggggaaagcagaactggaagatggtgcctacagaattaaacaaagaggtattctaggctattctcaaatcggagcaggagtatataaggaaggtacgtttcacacgatgtggcatgtcacccgaggggcagtactaatgcatagaggcaaaaggattgagccatcttgggccgatgtaaagaaagatctaattagttatggaggtggctggaaattagagggcgaatggaaggagggcgaagaagtgcaagttttagctctcgaaccaggtaagaacccgagggcagtacaaaccaaaccaggcttatttaaaaccaataccggtacaataggagctgtatcactagactttagtcccgggacgtcaggctcgccgattgtagatagaaaaggaaaggtcgtaggactctacggcaatggtgtagtaactcgcagtggagcctatgtctccgcaatagcacagaccgagaaaagtatagaagataaccccgaaatagaagacgatatatttcgaaagaaacgtctaacaataatggacctccatcctggagcaggaaaaacaaagaggtatctaccagcgattgtaagagaagccataaagagaggactccgaacactaattctagcccccacaagagtcgttgccgcagagatggaggaagcattacgaggtcttccaataagatatcaaacaccagccataagagcggaacacacaggaagagagatagtagatctcatgtgtcatgccacatttaccatgagactactgtccccagttcgggtaccaaattataatctaattataatggatgaagcgcattttacagatccagcgtctatagcggcgcgaggttacatttcaacacgcgtagaaatgggagaagctgcaggtatcttcatgacggcaacaccaccaggttctagggatccctttcctcaatcaaacgcgccgataatggacgaagaaagagagattcccgagaggtcttggaatagtggacacgaatgggtaacagactttaaagggaaaacagtttggtttgtcccaagcataaaagcggggaatgatatagccgcttgtctacgtaaaaacggtaagaaagtaatccaactgtctcgaaaaacattcgactccgaatatgttaaaacccgcgcaaatgactgggatttcgtagtgaccacagacattagtgagatgggtgcaaatttcagggcagaaagagtaatagatcccaggcggtgtatgaaaccagtgattctaacagatggagaagaaagggttatactagcaggtcccatgccggtaacccactcaagcgccgcgcaaagaagaggacgcatagggcgcaatccgaaaaacgagaacgatcaatacatttatatgggagaacccctcgaaaacgacgaagactgtgcacattggaaagaagccaaaatgttactagacaacataaatacacccgaagggatcattccaagcatgtttgaacctgaacgagagaaagttgacgcaattgatggagagtaccgattaagaggtgaagcaaggaaaacattcgtagatctaatgagacgtggtgacctaccagtctggctagcctacagagttgctgctgaaggtataaattacgcagatagaaggtggtgttttgatggcatcaaaaacaaccaaatcttagaagagaatgtcgaagtagaaatatggactaaggaaggggaacggaagaaattaaaaccaagatggcttgatgcgcgtatctactcagaccctttagccctaaaggagtttaaagaatttgcagcagggagaaagagtcttacactgaatcttatcaccgagatgggaagacttcccacctttatgacacaaaaagctcgtgatgccctcgataatttagcagttttgcatactgctgaagcgggaggtagagcctacaatcatgcactctctgagttaccagaaactttagaaacgctcttactactaacgctcctagcgacagtgacgggaggaatatttctattcttaatgtctggcaaggggataggaaaaatgactctcgggatgtgctgtataataactgcgtcaattttgctgtggtacgcccaaatccaaccacactggattgcagcaagtataatccttgagttctttttgattgtattactcatccccgaacccgaaaagcaacgaacacctcaagataatcagctgacctatgttgttatcgcgatactaaccgtcgttgcggccacaatggctaacgaaatgggattcctagagaagaccaaaaaggatttgggtttgggaagcattaccacacaggaatctgaatcaaatatcttagatatagatttaagaccagcaagcgcttggacactatatgcggtagccacaacgtttgtaacacctatgctccgtcattcaatagaaaattctagtgttaacgtttcactaactgcgattgcaaatcaagctacagtactgatgggtcttggtaaaggttggccattatcaaaaatggatattggagtaccgcttttagccatcggatgctacagtcaggtaaaccccattacactcacggcagctctcctgttgctagtagctcattatgctataataggaccagggttacaggcgaaagccactagagaagcacagaaaagggccgccgctggtataatgaagaatccaactgtagatggtataactgtaatagatcttgaaccgattccatatgaccctaaatttgagaaacaattaggtcaggtcatgttactaattctttgcgtaacccaggtactaatgatgagaaccacgtgggctctgtgtgaagcactaacgctagcaacagggcctatttctacgctgtgggagggtaatccagggcgattttggaacactaccattgcagtatccatggccaacatctttcggggaagttatttagccggggcaggattactgttttcaatcatgaaaaacaccaccaatactcgaagaggtaccggaaacattggcgaaaccttaggcgaaaaatggaaatcaagacttaatgcattaggaaaatcagaatttcaaatatataagaaaagtggcattcaagaagttgatagaacattggcgaaagaaggtattaaaagaggggagacagatcaccacgctgttagtaggggttccgcaaagttaagatggttcgtcgagagaaatatggtaactcctgagggaaaagtggtcgatttggggtgtgggagaggcgggtggtcgtactactgcggaggcctgaaaaatgtcagggaggttaaagggttaaccaagggaggtccgggtcacgaggaacctataccgatgtctacttacggatggaacttagtaagattgcagtcgggcgtagatgttttcttcacgcctcccgaaaaatgtgatacattattatgtgatataggtgaaagttccccgaatcctaccatcgaagcaggacggacccttcgcgtattaaatcttgtcgaaaactggttgaataacaatacgcagttctgtataaaagttttgaacccgtacatgccgtccgtgattgagaagatggaaactcttcaaagaaaatatgggggagccctagtaagaaatccattgagcagaaattcaacacatgagatgtactgggttagcaacgcaacgggtaacatagtttcctcagtcaatatgatatcacgtatgctcataaatcggttcacgatgaaacataagaaagccacctatgagcccgacgtggatctgggatccggaactagaaacataggtatcgagagcgaaataccaaacctagacattatcggaaaaagaatagagaaaatcaagcaagaacatgaaacctcatggcatcatgaccaagatcatccatataaaacgtgggcttatcacgggagttatgaaacaaaacaaacgggatcggcctcatccatggtcaatggtgttgtcaggctgttgaccaagccctgggatgtcgtaccaatggtaacacagatggctatgaccgacacgacgccgtttggacaacaaagggtgtttaaggaaaaagtagatactagaactcaggagcccaaagaaggcacaaagaaattaatgagaataacagccgaatggctatggaaagaattagggaagaagaaaacccccaggatgtgcacgagagaggaatttaccaggaaagttcgaagtaatgccgcattgggggcaatttttacagatgaaaacaaatggaagtctgcacgagaagctgttgaagattcgcgcttttgggaattggtagatcgggaaagaaatttacacttagagggaaaatgtgagacatgtgtttacaatatgatgggaaagcgagagaagaaattaggagaatttggaaaggcaaaaggttcaagagcaatttggtatatgtggttaggggcaaggtttttagaatttgaagctcttggattcttaaacgaagaccactggtttagtagaggaaattctctgtccggcgtggaaggggaaggtctacatagactgggatacatacttcgagacgtgtccaagaaagagggaggcgcaatgtacgctgatgatactgctggatgggacactagaattacattagaagatcttaaaaacgaagaaatggtaacaaaccatatgaaaggcgaacacaagaaactggccgaggcaatatttaaactcacatatcaaaataaagtcgtgagagttcaaaggccaactccacggggaacagtcatggacatcattagtcgaagagatcaacgaggttccggacaagttggcacgtatggtctcaatacttttaccaatatggaagcacaacttattcggcagatggaaggtgaagggatattcaaatcaattcaacacctgaccgttacggaagaaatagctgtccaaaattggttggctagggttggacgagaacgactgagtcgcatggcaatatcaggagacgattgcgtcgtaaagcctcttgatgatagattcgcaagtgcactaacagcgttaaacgatatggggaaagtgcgaaaggacatacaacagtgggaaccatcgagaggatggaacgactggacacaagtacctttttgtagccatcattttcatgagctggttatgaaagatgggagagtcctagttgtcccttgtcgaaatcaagatgaactaatcggacgcgcacgtatatcacagggggcagggtggtcactaaaagaaacggcgtgtttggggaaatcatatgctcagatgtggacgcttatgtatttccaccgacgagacttaagattagcagccaatgcaatctgttctgcagtgcccagccactgggtgccaacttctaggaccacctggtccattcacgcgaaacatgaatggatgactacagaagacatgctagctgtatggaatagagtttggatccaagaaaacccgtggatggaagataagacaccagtagaatcttgggaagaagtaccatatctcggaaaaagggaagatcaatggtgtgggtcattaataggcctaacatcccgagcaacatgggccaagaatatacaaacagcgataaatcaggtaagaagcctgataggtaacgaagaatataccgactatatgccttccatgaaaaggttcagaagagaagaagaagaagccggtgttctatggtaa

SEQ ID NO: 22665 - RNA, 9876 nt, synthetic construct
  misc_feature 1..9876: note = derived and/or modified CDS sequence (opt6) from DENV-2__GQ868603__SS-prME
  source 1..9876: mol_type = other RNA
acagctggtgtaattataatgttaattccaacagcaatggcctttcatcttacaacaagaaatggagaacctcacatgatagtagggcgacaagaaaaagggaaatctctactattcaaaacagaagacggcgtcaatatgtgtactctaatggcaatagacctgggggaactatgcgaagatacaattacctataaatgcccgctactaagacaaaatgaaccagaagacattgactgctggtgcaattccacaagtacttgggttacatacggaacttgcacaaccacaggagaacatagacgagagaaacgatcagttgcgttggtaccgcatgttggtatgggtttagaaacaagaacggaaacttggatgagttcggaaggtgcttggaaacatgtgcagaggattgaaacctggattctacgacatccagggttcacgattatggcagctatattagcatatactataggaacaacacactttcagagagcattaatttttatactccttactgccgttgcgccatcgatgacaatgagatgcataggaatttcaaatagagattttgtagaaggagtgagcggagggtcatgggtagatatagtgttagaacacggtagctgcgtgacaacaatggctaaaaataaacccacgttggattttgaattaataaaaacggaagcgaaacaaccagccacgcttagaaaatattgcatagaagcaaaactaacgaatactacaacagaaagtcgatgtccaacacaaggtgaaccatcattaaatgaagaacaagataaacgattcttatgcaaacattctatggtagacaggggttggggaaatggttgtggtcttttcggaaaaggaggaatagtaacatgcgctatgtttacctgtaagaaaaatatggaaggaaaagtagtgttaccagagaatctggagtataccattgtgataacaccccactcgggtgaggaacacgcagtgggtaatgatactggaaaacacggtaaagaaataaaaataaccccacagagttctataacagaggctgaactaactggttatggcactgtcactatggagtgcagcccgagaacaggactagatttcaatgaaatggtacttctgcaaatggaagataaagcgtggctggtacaccgacaatggtttctggacttaccgctaccatggttacctggagcagatactcagggatccaattggatccaaaaggaaacgcttgtcacgttcaagaacccacatgccaagaaacaagacgtagtagtgttaggtagccaagaaggagcaatgcatacagcacttactggagcaacagaaatacaaatgagtagtggcaatttattgttcacaggacatctaaaatgtagattacggatggacaaactccagcttaaaggaatgtcgtatagtatgtgcacaggcaaattcaaaatagtcaaagaaatagctgaaacacaacatggaaccatagttattagagtacagtatgagggcgatggatcaccttgcaaaattccatttgaaataatggatttagagaaaagacacgtattgggtagactaataactgtgaatcccattgtaacagaaaaggattcaccggtcaacatcgaagcagagccaccgtttggcgacagttatataattataggcgtagaaccaggccaactgaagttgaactggtttaaaaagggatcaagtattggacaaatgtttgaaactacaatgagaggggcaaaaagaatggcgatcttaggggacaccgcgtgggattttggatcgctgggcggagtcttcacctcgataggaaaagctctacatcaagtctttggcgctatttatggagctgcattcagcggagtttcgtggaccatgaaaatcctcataggggtcatcataacctggatagggatgaactcaaggagcacctcactaagcgtaagcctagtcctagtgggggttgttacgctatatttaggagcaatggttcaggctgattcgggctgcgtggtatcatggaaaaacaaggaactcaaatgtggaagtggaatattcataactgacaacgttcatacttggactgaacaatataagtttcagccagaatctccatctaagctggcgtctgcaatccaaaaagcccatgaagaagggatatgcggtatcaggagcgtcactagattagaaaatttaatgtggaaacagatcacaccggaactaaatcatatactatccgaaaatgaagtaaaacttacgataatgacaggtgatataaaaggaatcatgcaagcgggaaaaagatcattacgacctcaacctacagagttgaaatactcgtggaaaacatggggcaaagccaaaatgctgtcaactgaaagtcacaatcaaaccttcctgatagatggaccagaaacagcggaatgtccaaataccaatcgtgcttggaactccctggaagtggaagactacggttttggcgtctttacaacaaatatttggttaaaattaagagagaagcaagacgtattgtgtgacagtaaactcatgagcgcagccattaaagataacagagccgtacatgcagatatgggttattggatagaaagtgcattaaacgatacctggaagatggaaaaggctagtttcatcgaagtaaagagctgtcattggccaaagtcgcatactctctggtcaaacggcgttttagaatcggaaatgataattcccaaaaattttgctggacctgtttcgcaacataattaccgtccaggataccatactcagacggcaggcccgtggcatctaggaaaactagaaatggacttcgatttctgtgagggtacgacagtagttgttactgaggactgcggaaatagggggccttctttaagaactacaacagcgagtgggaagttaattacagagtggtgttgtaggagctgcacattgcctcctttgagatacagaggagaagacgggtgttggtatggaatggaaatacgtcctttgaaagagaaggaagaaaaccttgttaactctttggtgactgcgggacacggtcaaattgataatttctccctaggcgttctgggaatggcattattcttagaggaaatgctacgtacgcgagtcggaacaaaacacgctatactattagcagctgttagtttcgttacactaatcacaggtaatatgtcgtttagagatctaggaagggtaatggtgatggttggggcaacaatgactgatgacattggaatgggggtgacttatttagctcttttagcggcattcaaagtacgcccgactttcgccgctggattactgctgaggaaattaacaagcaaggagttaatgatggcgacaatcggtatagcactacttagccaaagtacaatccctgaaacgatactggaactaacagatgcccttgcacttgggatgatggttcttaaaatcgttcgtaatatggaaaaataccagcttgtagtgacaataatggctatatcctgtgtacctaacgcggtgatcctacaaaatgcatggaaagtatcttgcacaatactagcggctgtgagcgtatccccgttattactcacctcaagcagacaaaaagcagactggataccactagcactgacaataaaaggactaaacccgacggcaatattcttaacaacattatcacgtacaagcaagaaaagaagttggccgttgaacgaggccattatggcagtaggaatggtaagtatactagcgtcgtcactattgaaaaatgatataccaatgacaggaccgttagtcgcaggaggactactaacagtatgttacgtcctaactgggcgttctgccgatctggagcttgaacgagctgcagacgtcaaatgggaagaccaagccgaaatctcaggctcaagccccatattgagtattactatctcagaagacggtagtatgtcaatcaaaaatgaagaagaagaacaaacattaacgattttaatacgtactgggcttctagttatttctggcgtcttccctgtcagtatccccatcacagcagctgcgtggtatttatgggaagtcaagaaacaaagagctggtgtgctatgggatgtaccgagccctcccccagttggaaaagcagaactagaagacggtgcctacagaataaagcaaagagggattttggggtactcacaaattggcgcgggagtgtataaggaaggtaccttccatacgatgtggcatgttacgagaggtgcagtactaatgcacaggggaaaaagaattgaaccatcttgggcagatgtaaagaaagacctcatatcatatggaggaggctggaaactagaaggtgaatggaaagaaggagaggaagtgcaagttttagcactagaaccgggtaaaaatccaagagctgtacagactaaaccaggtttattcaaaacgaacacaggaactataggcgcagtctcgttggacttctcgccagggaccagcggcagccctattgttgataggaaaggtaaagttgttggactctatggtaacggtgtggtaacgcgaagtggagcatatgtgagtgcaatagctcaaactgaaaaatccatagaggataaccctgaaattgaagatgacatatttcggaagaaaaggctaacaatcatggatttgcatcctggcgctggaaaaaccaaaagatacctccctgcaattgtacgagaggcgataaaacgaggacttcgcacattaatcttagctcctacacgtgtggtagcagcagaaatggaggaagcattaagaggattgccaataagataccaaacgcctgcaattcgtgcagagcatacaggcagagagattgtggacctaatgtgtcatgcaacgtttacaatgaggctgctgtctccagttcgtgtgccgaactacaatttgataataatggatgaagcgcactttacagatccagcatcaatagcagccaggggatacataagtactcgggtagagatgggtgaagcagccggaatatttatgacggcgacaccaccgggttcaagagacccctttccacaaagtaatgctcctataatggatgaggagcgtgaaattccggaaagatcatggaactccgggcacgaatgggttactgacttcaaagggaaaacagtctggttcgtaccatccattaaagcaggaaatgatatcgcggcatgtctaaggaaaaacggtaagaaagtaatacaactctctagaaaaaccttcgatagcgagtatgtaaaaacccgggctaacgactgggattttgtagtgactactgatatcagtgaaatgggcgccaactttaaggctgagcgtgttatagatccgagaagatgtatgaagcctgtcattttgactgacggggaggaacgagttatattagcaggtcccatgccagttacgcattccagtgctgcgcagcgacgcggccgtataggccgtaaccccaaaaatgaaaacgatcaatatatctatatgggcgaaccgctggaaaacgacgaagactgcgcacattggaaagaggcgaagatgttactagataatattaacaccccagaaggaattatcccaagtatgttcgagccagagcgagagaaagtagacgcaatagacggtgagtataggctaagaggtgaagcccgtaaaacattcgttgatttaatgcggcgaggagatttacctgtgtggttagcatacagagtggcagcagaaggaatcaattatgctgataggagatggtgttttgacgggataaagaataatcagatactagaagaaaacgtcgaggtcgaaatttggactaaagaaggggagagaaagaaacttaaacctagatggctagatgcaagaatatactcagacccattagctctgaaggaatttaaagaatttgcagcgggacgaaaaagtctcacgcttaatctgatcacggaaatgggtcgacttcccacttttatgacacaaaaagcgagagacgccctagataacctggccgttttacacactgcagaagcgggtggccgggcgtataatcacgctttaagtgaacttccagaaactttggaaactttattattactaaccttgttagcaactgtcactggaggaatcttcttgttcctcatgtccggtaaaggggtgggcaagatgaccttaggaatgtgttgtataataacggcatccatcctactttggtatgctcagatccaacctcactggattgcggcctcaattatactcgagttctttctaatagtgctcctaatacccgaaccagaaaaacaacgcactccacaggataatcaacttacttatgttgttatcgcaatactaactgttgttgctgccacgatggcgaacgagatgggtttcttggagaaaacgaagaaagatctcggattgggcagtattacgacacaagaatcggaatctaacattttagacattgacttgcgaccggcctcagcatggaccctgtatgccgtagcaactacgttctttacacccatgcttagacatagtatagaaaactcctcagtgaacgtttctcttacagcaatagccaatcaagctaccgttctcatgggccttggaaagggatggcctctgtcaaagatggatataggagttcccttactagcaataggatgttatagccaggtaaacccaattacccttactgcagccctactgctattagtggcacattatgcaattattggtccaggcttgcaggcaaaagctacccgagaagctcaaaaacgtgcagcagcaggtatcatgaaaaatccaaccgtcgacggaatcaccgtgattgatctcgaacccatcccctacgacccgaaatttgaaaaacaactaggacaggttatgttgctaatactctgcgttactcaagtattgatgatgagaacaacctgggccctttgcgaagcgctaaccctcgctacaggtccaataagtacgctatgggaaggtaatccaggtagattttggaacactactatagcagtaagcatggcaaacattttcaggggtagttatcttgccggagcggggttactctttagtattatgaagaacaccactaacacccgtaggggaaccggaaatattggagaaacattaggagaaaaatggaagtcacgtctaaatgcactcggtaagagtgagttccaaatatataagaaaagtggcattcaagaagttgatagaacattagctaaagaaggaatcaaacgaggcgaaacagatcatcacgcagttagcagaggaagtgctaaattaagatggttcgtggaacgtaatatggtgactcctgaaggcaaggttgtagacctaggatgtggacgtgggggctggtcatactactgtggtggattgaaaaatgtaagggaggtaaagggattaacaaaaggtggtcctggacacgaggagcctataccaatgagcacatacggctggaatctggtaagactacagtccggagttgacgtgttcttcacgcctcccgaaaaatgcgatacactcttgtgtgacattggcgaatcgagtccaaaccctactatagaggctggaagaacactcagagtcttaaatctagtagaaaactggttgaataataatactcaattttgtataaaagtgctcaacccctacatgccatcggttatcgagaaaatggaaactcttcagcgcaaatacggaggggccctggttaggaatcccttatcaagaaattcgacacacgaaatgtactgggtatccaacgcgactggaaatatagtcagtagtgtaaacatgatttcgagaatgctgatcaataggtttacaatgaaacacaagaaagccacatacgaaccagacgtcgatttaggaagtggtaccagaaatatcggaatagaatcagaaataccaaacctagatataattggaaagagaattgaaaagattaaacaagaacatgaaacaagttggcactatgaccaagatcatccatacaaaacatgggcgtatcatggcagttatgagacgaaacaaacaggctcggcttcctctatggtcaacggagtcgttagacttctgactaagccgtgggatgttgtaccaatggtaacacaaatggcgatgactgatacgacgccatttgggcaacaaagggtcttcaaagaaaaagtcgatacacgtacacaggaaccaaaagaagggacaaagaaattaatgaaaataactgctgagtggctttggaaagaactaggcaagaagaaaatcccaaggatgtgcactagagaggaatttactcgaaaagttaggagtaacgcggcgctcggagccatcttcacagatgaaaacaaatggaaatcagcacgcgaagctgtggaggatagtagattttgggagttagtagatcgagaacgaaatcttcacttagaagggaaatgcgagacctgtgtttataacatgatggggaaacgcgagaagaaactcggggaatttggtaaagcaaaaggttcacgagccatatggtatatgtggttaggggcacgtttcctagaatttgaagcattggggtttctgaatgaagaccactggttttctaggggaaattcactgagtggagttgaaggggagggacttcacagactaggctatatactaagagatgtcagcaagaaagaaggtggagctatgtatgctgatgacactgcaggatgggatactaggataactctcgaagacctcaaaaatgaagaaatggtaacaaaccacatgaagggtgagcataaaaagctagcagaagctatattcaaacttacttaccaaaacaaggtagtacgtgttcaaaggcccactcctagaggaacagtgatggatataatatctaggcgggaccaaagaggcagcggacaagtcggaacgtacggattaaacactttcacaaacatggaagcacaacttataagacaaatggaaggtgaaggaatattcaaaagtatacaacatttgaccgttacagaagaaatcgccgttcaaaattggcttgcccgagtaggcagagagagactttcgaggatggcgatatccggagatgattgtgtggtcaagcccttggacgataggttcgcttccgccttaaccgcgctaaatgatatgggcaaagttagaaaagacatacaacaatgggagccctccaggggatggaacgattggacccaggtacctttttgcagtcatcactttcacgagttagtcatgaaagatggacgcgttttagtagttccttgcaggaatcaagatgaattaattggcagggcccggatctcccaaggagcaggttggtcgcttaaggaaacagcttgtctcggcaaaagttatgcacaaatgtggactttaatgtattttcacagaagagatttaagactcgcagcaaatgcaatatgttctgctgttccaagccattgggtcccaactagcagaaccacctggagcatacatgcaaaacacgaatggatgaccacagaagacatgctggcggtttggaatcgtgtttggatacaagaaaatccttggatggaagataagacgcccgtagagtcatgggaggaagtcccttacctgggaaaaagagaagatcaatggtgtgggagtcttataggactaacaagtagggcaacttgggctaaaaacattcaaactgcaataaatcaggtaagaagtcttataggcaacgaggagtacacggattatatgccgagcatgaagcggtttaggagagaagaggaggaagcaggcgtactatggtag

SEQ ID NO: 22666 - RNA, 9876 nt, synthetic construct
  misc_feature 1..9876: note = derived and/or modified CDS sequence (opt6) from DENV-2__FJ898450__SS-prME
  source 1..9876: mol_type = other RNA
actgctggtgtaattataatgttaattccaacagcgatggcttttcacctaacaactcgaaatggtgaaccacacatgatagttggccgacaggaaaaagggaaaagtttattatttaaaactgaagatggcgttaatatgtgtactttaatggcgatagacttaggagaactctgtgaagatactataacatacaaatgtcctttactgagacaaaatgaaccagaagatatcgactgttggtgtaattcaacatctacatgggtaacatatggaacatgtactacgactggtgagcatcgacgagaaaaacgatctgttgcactggtacctcatgttggtatgggattagaaactagaactgaaacatggatgtcaagcgaaggagcatggaaacatgtacaacgtattgaaacctggatcttaaggcatccaggatttactattatggcagctatcctagcgtatacgatcggcacaacgcattttcaaagagcattgatatttattcttttgacagcagtagctcccagtatgacaatgcgatgtataggtatctcgaatcgcgattttgtggaaggagtaagcgggggtagttgggtggatattgtcctcgagcatgggagttgtgtgacaactatggccaaaaataaaccgacccttgactttgagttgattaaaacagaagcaaaacaaccagctacattaagaaaatattgtatcgaagctaagttaaccaacactacgacagaatcgaggtgtcctactcaaggtgagccctcgctcaatgaagaacaagacaagcgatttatttgtaaacattctatggtcgataggggatggggcaacggttgtggactcttcggtaaagggggaattgtgacatgcgctatgtttacgtgtaagaaaaatatggaagggaaagtggtactgcctgagaacctagagtatacaatcgtgataaccccgcattcgggtgaagaacacgcagttggtaatgatacagggaaacatggaaaagagattaaaataactccacagtcaagtattacggaagctgagctaacaggatacggtacggtgactatggagtgcagtcctaggacaggactggactttaacgaaatggtattactccaaatggaagataaagcatggctagttcacagacaatggtttttagacctaccactcccttggttaccaggtgcagatacccaaggttctaattggatccaaaaagagactctagttacctttaaaaatccacatgcaaagaaacaggatgttgttgttctaggaagccaagagggcgcaatgcacacagccctaacaggcgctacagaaattcaaatgtctagcggaaatcttctattcacaggtcatcttaaatgtcgcctgagaatggacaaactccaactaaaaggaatgtcttactccatgtgcacaggcaaatttaagattgttaaagaaatagcagaaacccagcacggcacgatcgtgatacgagtacaatatgaaggtgacggatctccatgcaagatcccatttgagataatggatctagaaaagaggcatgtattaggacgacttataactgtaaatccgatagtaacagaaaaagatagccctgttaatattgaggcagaaccacccttcggagactcatatataattataggagtcgaaccgggacaattgaaattaaactggttcaaaaagggcagtagtataggacaaatgttcgaaacaacgatgagaggtgctaaaagaatggctatactcggagacacggcttgggattttggatctcttggaggcgtgttcacatcaataggcaaggctttacaccaagtatttggtgcaatttacggcgcggccttcagcggggttagttggacaatgaagatactgataggagtaatcatcacgtggataggcatgaactcaagatcaacatctttgtcagtcagcttagttctcgtaggcgtcgtaacgctttacctcggagcaatggttcaggccgatagtggatgtgtcgtctcttggaaaaataaagaattaaaatgcggatcagggatattcattacggataatgtccacacatggacagaacaatataaattccaacctgaaagcccttctaaacttgcatcagcaatacaaaaagctcacgaggaaggaatatgtggtattagatcggttacaagactcgagaatcttatgtggaaacaaataactccggagctgaaccatattttaagcgaaaatgaagttaaattaacaattatgactggggacataaaagggattatgcaggccggtaaacggtcactaaggccgcagccaacagaactaaaatactcttggaaaacgtggggtaaggcgaaaatgttaagcactgaatcgcataaccaaacctttctaatagacggacctgaaactgctgaatgcccaaatacgaatagggcttggaactcacttgaagttgaagactatggtttcggtgtattcacaaccaatatatggttaaaacttagagaaaaacaagatgccttttgtgacagcaagttaatgagtgcggcaatcaaagataacagagcagtacatgcggatatgggttactggattgagtctgctctaaatgatacgtggaagatggaaaaggcatctttcattgaagtcaagtcgtgtcattggccgaaaagccataccctatggtcgaatggtgttttggaatctgaaatgataatacccaagaatttcgcgggtccggtgagccaacataattatcgacctggctatcatacacaaactgcgggaccgtggcacctaggtaaattggaaatggatttcgatttctgtgaaggtaccaccgttgtagtaaccgaagactgcgggaatcgaggtcccagcttaagaacaactacggcaagtggaaaattgataacagaatggtgctgccgaagttgcacattgcctccgttacgctaccgaggtgaagatgggtgctggtatggaatggagataagaccattaaaagagaaagaagaaaatttagtcaatagcttggttacagccggacacggacaaatagacaatttcagtttaggagtcttaggaatggctctattcctcgaagaaatgctaagaactagagtgggtacgaaacacgccatactattagtagcggtatcatttgtaaccctcataacaggaaatatgtcttttcgtgatctaggacgcgtcatggtaatggtaggagcaactatgacagatgatattggaatgggcgtaacgtatctggctctactcgcagcttttaaagttagacccacttttgcagctggtctcctcttaagaaaacttacatccaaggaactaatgatggcaactataggtatagcacttctctcacaatctactatacctgagacaatactggaactaacggacgccctggctctaggcatgatggtgttaaaaattgtacgaaatatggaaaaataccaactagctgtaacgataatggcaatctcatgcgtaccaaatgcagttatattacagaatgcatggaaagtatcatgtacgatattagcagcagtatctgtatcgccattgttgcttacatcatcacaacaaaaagcagattggatccccttagcgctaacaattaaaggactgaatccaacagcgatatttttaaccacgttgtcaagaacatcgaagaaaaggtcatggccattaaacgaggcagtaatggcggtaggaatggtgtctatattagcatcgtctctattgaaaaacgacattccaatgacaggcccattagtagcgggaggtttacttaccgtttgttatgtattaacgggacgatccgcagacctagagttagaacgggcagctgacgtaaaatgggaagatcaagcagagataagtggtagcagtccgatacttagtattacaataagtgaagatggatcaatgtcaattaaaaatgaagaagaagaacaaactttaacaatactaatacgaaccggacttttagttatcagcggggttttcccggtatcaataccaataaccgcagctgcatggtatctatgggaagtcaagaaacaaagagcaggggttctgtgggatgtgccatcaccacctcccgtagggaaagcggaactagaagacggagcttaccggattaaacaaagaggaatcctgggatactctcaaatcggagctggggtatacaaagaaggtacattccatactatgtggcatgtaaccagaggggcagttctcatgcatcgcggtaagcggatcgaaccttcctgggcagatgttaagaaagatctgatttcgtatggcggtggatggaaattagagggagaatggaaagagggagaagaggtccaagtcttagcattagaaccagggaaaaaccccagggcagtacaaactaagcccggtttgtttaaaactaatacaggaactataggagctgtttcactagatttttcaccagggacgtcaggttcaccgattgtggaccgaaaaggaaaggtagtaggactgtatggaaacggagtagtcacacgttcgggggcatatgtttcagcgatcgcacagacagaaaaatcaatagaagacaacccagaaatagaagatgatatattcagaaagaaacgtctcaccataatggatttacatcccggggctgggaaaactaaacgctacctgcctgctattgttagagaagctatcaaacgtggattacgtacccttattttagcgccaacacgagtagttgcagcagagatggaagaagcacttagaggactacccatacgatatcaaacccctgctatacgagcagaacatactggccgagaaattgtcgacctaatgtgtcatgcaacattcacaatgcggttattatcgccagtaagagtaccaaattacaacctcattataatggacgaagctcattttaccgatccagcttcaatcgcagctcgcgggtatatatccacacgagtcgaaatgggggaggccgcgggcattttcatgacagcaacgcccccggggtctagagacccatttccccaaagcaacgcccctataatggatgaagagagggagataccagaaagaagctggaactcgggacacgaatgggtgacagacttcaaaggaaaaacagtatggttcgtaccaagcatcaaagcgggtaacgatattgccgcatgccttaggaagaacggcaagaaagtcattcaattgagtagaaaaacatttgatagcgaatatgtaaaaacaagagcaaacgactgggattttgtagtaacaacagatataagcgaaatgggtgctaatttcagagctgagcgtgtaatcgatccacgtaggtgtatgaaaccagtaatactcacagacggcgaggaaagggtaattcttgcaggccctatgcccgtaactcattcttccgcagcgcagcgacgcggacgaataggtagaaacccgaaaaatgaaaatgaccaatatatttatatgggtgagcctctagagaatgatgaggactgtgctcactggaaagaagctaaaatgttattagacaatattaacacgccggagggcatcataccatccatgttcgaaccagaacgggaaaaggttgacgcaatagatggtgaataccggcttagaggcgaagcacgtaagacctttgtagacttaatgagaagaggagatttacctgtatggttagcgtaccgagttgccgcagagggtattaactacgcggatcgtagatggtgttttgacggaatcaaaaataaccaaatattagaggaaaatgtcgaagttgaaatttggaccaaggaaggagaaaggaagaagctaaagcccagatggttagatgctagaatatacagtgaccctcttgcactaaaagaatttaaagagtttgcagcaggtagaaaaagtctcaccttgaacttaattaccgaaatgggacgactaccaacattcatgacacaaaaggctcgcgatgccctggacaacctagctgttttacatactgcggaagctgggggacgagcatataaccatgcgctttctgagttgccagaaactttagaaaccctactgctactgacgttactagccacagttacaggaggaatatttttattcctcatgtcaggaaagggaattgggaaaatgactttaggaatgtgttgtataataacagcatctatattactatggtatgcacaaatacagccacattggatagccgcctccataatacttgaatttttcttgattgtacttctcattccggaacccgaaaagcaacgaactcctcaggataaccagttaacttatgtagtaattgccatattgacggtagtagcagccacaatggcaaatgaaatgggatttttagagaaaaccaagaaagatctcggtcttggtagtattactactcaagaatctgaaagcaatatattagatatagatctacgccctgccagtgcttggacactatacgcggttgctacaacattcgttacgccaatgttacgtcactccatagaaaattcatcagtcaacgtatcgctaacggctattgctaatcaagctaccgtattgatgggcctcggaaaaggatggcctttatcaaagatggatataggcgtcccattattggctattgggtgttattctcaagtgaatccaattaccctaactgcagcgcttcttctcttagtagcacattatgcaatcataggtccgggattacaagcaaaagccactagagaagcacaaaagcgagctgcagctggtataatgaaaaatccaactgtggacggaattacagttattgacctagaaccgattccatacgacccaaaatttgaaaagcaattaggacaagttatgcttttaatcttatgcgtaactcaagtacttatgatgaggacgacttgggcgttatgtgaggctttaactttagcgaccggtccaataagtactctatgggaaggcaacccaggaagattttggaatactacaatagcagtatctatggcaaacatatttcgcggctcttatctagccggggccgggttattgttcagcataatgaagaatactaccaatacacgacgaggcactggtaatataggagaaacacttggggaaaaatggaagagtaggttaaacgccctcggaaaaagcgaatttcaaatatacaagaaaagcggaatacaggaagtagatagaactttggcgaaggaagggattaaacgaggtgagaccgatcatcacgcagtatcgagggggtccgctaaattgaggtggtttgttgaaagaaacatggtaacccctgaaggaaaagtagttgacttaggatgtggaaggggaggatggagttactactgtggaggactaaagaatgtacgagaggtaaaaggactaaccaaaggaggacccggtcatgaagaaccaataccaatgtccacatatggatggaacttagtcaggctacagtccggagtggacgtgttctttacacctcctgaaaaatgtgacacactcctatgcgatataggggagagttctcccaacccaactattgaagcagggaggacgctgagagttcttaaccttgttgagaattggttgaataataacacccaattttgtattaaagtcctaaatccatacatgcccagtgtaatagagaaaatggaaaccttacagcgaaaatatgggggcgccttagtaagaaacccattatctagaaactcaacgcatgaaatgtattgggtaagcaatgctacgggaaacatagtatcttcagtcaatatgattagtaggatgctgataaatcgatttacgatgaaacataagaaggcaacatatgaacctgacgtcgatttaggatcagggacccgaaacataggaatcgaatcggagattcctaatcttgacattataggaaagagaatagagaaaataaaacaagaacatgaaacaagctggcattacgaccaagaccatccgtaccgtacctgggcatatcacggatcatatgaaaccaagcaaacgggttctgcgagcagtatggtaaatggtgtcgtgaggctattaacaaaaccatgggacgtcgtgcccatggttacgcaaatggctatgacagatactacgccgttcggacagcaaagagtgtttaaagaaaaagtcgacacacggacacaagagcctaaggaaggtactaagaaactgatgaggataacagcggaatggttatggaaggaacttggcaagaagaaaactcctcgaatgtgtactcgcgaagaatttaccagaaaagtgcgcagcaacgctgccttgggggcgatttttacagatgaaaataaatggaaatcagctagagaggccgtggaggacagcaggttttgggaattggtagatcgggagcgcaaccttcacttagagggaaagtgtgaaacatgcgtctacaatatgatgggaaagcgagagaagaaacttggtgagttcggaaaggccaaaggttcgcgagccatatggtacatgtggctcggggctagattcctcgagttcgaggctctcggatttttaaacgaagaccactggtttagtagagggaatagcctcagtggtgttgagggagaaggcttgcatcgcctcggctatatcctaagagacgtatccaaaaaggaaggaggggcaatgtatgcagacgacacagcgggatgggatacaagaatcacactagaagatttgaaaaacgaggagatggtaaccaaccatatgaaaggggaacataagaaactagcagaagccatattcaaactcacttaccaaaacaaagtcgtaagagtgcaacgaccaacaccccgaggaacagttatggacattatatcaagacgtgatcaacgaggatcagggcaagtcggtacatacggattaaacacctttacaaatatggaagctcaacttattcgacagatggaaggggaaggtatattcaagagtatacagcacttaacggtaaccgaggagatagctgttcaaaactggttagcaagagtcggaagagaaaggctatctaggatggctattagcggggatgattgtgtcgtcaagccactggatgatcgatttgcatctgcattgaccgcattgaatgacatggggaaggttagaaaagacatacaacaatgggaaccttctcgaggttggaatgattggacacaggtccccttttgttcccatcactttcatgagctagttatgaaggatggaagagtattagtcgttccctgcaggaatcaggacgaactcatcggacgagctcggatatctcagggtgcgggatggagcttaaaagaaacagcctgtctgggaaagtcctatgcacaaatgtggacactaatgtactttcatcgtagagacctaagactagcggcaaatgccatatgctcagcggttccaagccactgggtaccaacatccaggaccacttggagtatacacgcaaaacatgagtggatgaccactgaagacatgttagcagtttggaacagagtttggatacaagagaacccatggatggaagataagacaccagtagaatcgtgggaggaggtcccttacttaggtaagagggaggaccagtggtgtggcagcttaataggattaacctcaagggccacatgggccaaaaatattcaaaccgcaataaatcaagtgagatcattaatcgggaacgaggaatatactgactatatgccctcaatgaaacgttttcggagagaggaggaagaagcgggtgttttatggtaa

SEQ ID NO: 22667 - RNA, 9876 nt, synthetic construct
  misc_feature 1..9876: note = derived and/or modified CDS sequence (opt6) from DENV-2__FJ898453__SS-prME
  source 1..9876: mol_type = other RNA
acggccggagttatagttatgctcatacctacagcaatggctttccatctcactacccgaaatggtgaaccccatatgatagttggaagacaagaaaaaggaaaatccttattgtttaaaaccgaagatggtgtaaatatgtgcacactcatggcaatagatttaggggaactgtgtgaagacactatcacttacaaatgtccgttattaaggcagaatgaaccagaagatattgattgttggtgcaattccacatctacgtgggtcacatacggaacgtgtacaacgacaggagaacataggcgagagaaaagaagtgtagccttggtccctcatgtaggtatggggttagaaactcgaaccgaaacatggatgagctcagaaggcgcatggaaacacgtacaaagaatcgaaacatggattttgcgacacccaggatttacaattatggcagcaatattagcctacacgataggaacaacacacttccaaagagcattaatattcattttattaactgccgtcgcaccgtcaatgacaatgagatgcatcggaattagtaatcgtgattttgtagaaggagtcagcggcggatcctgggtagacatagtccttgaacatggctcttgtgtaacaactatggccaaaaataaaccaacattagactttgaacttattaaaactgaagcgaaacaaccagctactctacggaaatattgtatagaagcaaaactgacaaataccactactgaatctagatgtcctacacagggcgaaccgtcgttgaacgaagaacaagacaaaagattcatttgtaaacattcgatggtcgatagaggctggggcaacggatgtggtctgtttggtaaaggcggcatagtaacctgcgcaatgtttacatgcaagaaaaatatggaaggcaaaattgtgcaaccggaaaatcttgaatacactatcgtaataactccccactctggagaagaacatgcagtaggcaacgacaccgggaaacacgggaaagaaataaaaataacaccacaatcttcgactacggaagctgaacttaccggctatggtacagttactatggaatgtagcccccgtaccggcttagattttaacgaaatggtactgttacaaatggaagataaggcttggctagttcatcgacagtggtttttggatctccctctaccatggctgccaggtgcggatacacaaggttcgaattggatacaaaaagagacgttagttactttcaaaaatccacacgctaagaaacaggatgtagtggttttaggaagccaagaaggagcaatgcacacagcattaacaggcgcgactgaaattcagatgtcaagcggaaacctattgtttacgggacacttgaagtgtcgtctccgaatggataaattacaattgaaaggcatgtcatacagtatgtgcactggaaaatttaagatcgttaaagaaatagcagaaacacaacacggaacaatcgtaattcgcgttcaatatgaaggcgatggttcgccgtgcaaaataccttttgaaatcaccgatttggagaaaagacacgtactaggtcgcctaatcacagtaaaccctatagtaacagaaaaagattcgcctgtcaatattgaagcagagccaccttttggggatagttacataatagtaggtgtggagccaggccagctaaaacttaactggtttaaaaagggttctagcattggtcaaatgtttgaaaccacaatgcgcggcgcgaagagaatggcaattctgggagatacggcttgggacttcgggtcactagggggagtttttacatcaataggtaaggctttacatcaagtcttcggagcaatctacggtgctgcgttttccggtgttagctggactatgaaaatacttataggggtcataatcacgtggataggaatgaatagccgaagcactagcttatcagtatctcttgtattagtaggagtagtaaccttatatctgggagcaatggttcaagcagatagcggatgcatagtttcgtggaagaataaagaactaaaatgtggatctggaatatttataactgataatgtgcacacttggacagaacaatataaattccaaccagagtcgccaagtaaattagcaagcgccatacagaaagcacacgaagaagggatatgcggtatcagaagtgtgactcggttggaaaatttaatgtggaagcaaataaccccagagcttaaccacatactaagtgaaaatgaagtaaaactaacaataatgacaggcgacattaagggcataatgcaagcaggaaagcgaagtctaagaccacagccgactgagctgaaatattcttggaagacatggggcaaggcgaaaatgctatccacagaatcccacaatcaaacatttttaatagatggtccagagacagcggaatgtccaaatacaaatcgcgcgtggaactcattggaagttgaagattatggatttggagtgttctccactaatatatggcttaaactccgagagcgacaagatgtattttgtgattctaaattgatgagcgcagcaattaaagacaacagagcagttcatgccgatatgggttattggattgagtcagcactaaatgacacctggaagatggaaaaagctagttttatagaagttaaatcgtgccattggccaaaatctcacacactatggagcaatggcgttctagaatcagaaatgataattccgaagaactttgctggaccagtttctcaacacaattacagaccagggtatcacacacaaacagcagggccatggcatttgggaaaacttgaaatggattttgacttctgtgaaggcacaacagtcgtggtaacggaagattgcggaaacaggggcccatccctacgtacaacaacagcatcgggaaaattaattaccgaatggtgttgtcgttcttgtacgctcccgcctcttagatatagaggagaagatggatgttggtatggtatggaaatacgacctttaaaagaaaaagaagaaaacttagtaaactctttggtaactgcgggtcatggtcaaatagacaactttagcctaggtgttctaggaatggctttatttttagaagagatgttacgaacacgggtgggaacaaaacacgctatattacttgtagcactttcgtttgttacacttattaccggtaatatgtcatttcgggacctagggagggtgatggtcatggttggggcaacaatgacggatgacattgggatgggtgtcacatatctagctctactagcggcctttaaagttcgaccaactttcgcggcaggcttacttcttaggaaattaacttcaaaggaactaatgatggcaacaataggcatagctctacttagtcagtcaacgttacctgagacaattctggaactaacggacgcacttgcgttgggtatgatggtattaaaaatagttagaaatatggagaaatatcaacttgcggttacgattatggccatttcttgcgtaccaaatgctgtcatattacaaaacgcttggaaagtgagttgcacaatactagccgcagttagtgtcagtcccttgctactgacaagttctcaacaaaaggctgactggatacctttagcgctcaccataaaaggtctaaatcccaccgctatcttcttgacaacgttgtctcgtacaagtaagaaacggtcttggcctcttaacgaggctataatggcagttggaatggttagtatattggcatcttcgttactaaagaatgatattcctatgacagggccattagtagctggtggccttctcaccgtgtgttacgttcttactggccgctccgcagacttagagttagaacgagcagcagatgtaaaatgggaggatcaggcagagatatcaggaagttctccaatcttaagcattacaatatctgaagatgggtcaatgagcattaaaaacgaggaagaagaacaaacactgaccatacttatacgaactggtcttctagttatttcaggggtttttccagtttccataccgataactgccgctgcatggtacttatgggaagtaaagaagcaaagggcgggtgtattatgggatgtcccgtcaccaccacctgtagggaaggcagaactagaagacggtgtttataggataaaacagcgaggtattttaggatattctcaaataggagcgggcgtctataaggaaggtacgtttcacacaatgtggcatgttacaagaggtgctgtgcttatgcatcgaggtaaaagaattgaaccttcatgggcagatgtaaagaaggatcttatttcatatggaggtggatggaaattggaaggagagtggaaagaaggagaagaggtacaagtccttgcacttgaaccaggaaagaatcctagggccgtacaaaccaagccgggtatttttaagacgaatactggaacaataggtgcagtaagtcttgactttagccctggtacatctggtagcccaatagtagaccgcaaaggaaaagttgttggactctacgggaatggcgtagtgacaagatcaggtgcttatgtaagtgccatcgcacaaacggagaaaagcatcgaggataatccagagatagaagacgacatcttcaggaaaaagaggctaacaattatggacctccaccccggcgctggcaaaacaaagaggtatttgccggctatagtgagggaggctataaagaggggactaaggacgcttatcctagcgccaacgcgagtggtggcagctgaaatggaggaggctttaaggggactcccaataagatatcaaacgccagccatccgagccgaacacactggacgagaaattgtagacctaatgtgtcacgcaacatttacgatgcgacttctcagtccagttcgtgtgcccaattacaatttgataattatggatgaagctcatttcacagatcccgcttcaatagctgctagaggctacataagtacacgcgtggaaatgggagaagcggcagggatttttatgaccgccactccacctggaagtcgagatcccttcccgcaatcaaatgcccctattatggatgaagaacgtgagattcctgagagaagctggaacagcggtcatgaatgggttactgactttaaagggaagacagtgtggtttgttccgtctataaaagctggaaacgacatagcagcatgtctaaggaagaatggaaagaaggtcatccagctatcacgtaaaaccttcgatagcgagtatgtaaaaacacgtgcgaatgattgggacttcgtggtgacaacggacatctccgaaatgggtgcgaattttaaagcagaaagagttatcgacccaaggcggtgtatgaaaccggtcatccttacagatggtgaggaaagagtaatactagcaggtccaatgccagtaacccatagttccgctgcgcaacgaagaggccgcatcggtcgaaatcctaaaaatgagaacgatcaatatatttatatgggcgagccacttgagaatgatgaagactgtgcacattggaaagaggctaagatgcttctagacaatataaacactccagaaggcataatcccgtccatgttcgaacccgagagagaaaaggttgacgcaatcgacggagaataccgactaagaggagaagcaaggaagacctttgtcgacctcatgcgacgcggtgacttacccgtatggttagcatataaagtcgctgctgaaggtataaattacgcggacagaaaatggtgcttcgatggtattaaaaataatcagatattagaagaaaatgtggaagttgaaatatggactaaggaaggtgaacgaaagaaattaaaaccacggtggcttgacgctcgcatctattcagatccacttgcattgaaagaatttaaagagtttgcagcaggacgcaaaagcctcactttaaatttaattaccgaaatgggacgcttaccaacattcatgacacaaaaggcaagaaatgcgttagacaatctagcagtattacatactgctgaagtaggaggccgagcatataatcatgccctatctgagttaccagagacactagagacgctcctactgctaacattactcgctaccgtaacaggcggtatatttctctttctcatgtcgggcaaagggataggaaaaatgacactcggaatgtgctgtataataacagcgtccatactgctatggtatgctcagattcaaccacactggatagcagcctctataatacttgagttctttttaatagttctactcatcccggaaccggaaaaacaaagaacgcctcaggataaccaattaacttacgtagtcattgcaatacttacagttgtagcagcgaccatggctaacgaaatgggctttctcgagaaaactaagaaagatttaggttttggtagtattactacacaggaatcagagagcaatatcctagacatagaccttcgacctgcatctgcttggactctatatgcagtagccacaactttcgtcacccctatgttacgccacagcattgaaaatagctccgtcaatgtcagtctaactgccattgctaatcaagctacagtgttgatgggactgggtaagggatggcctttatctaaaatggatataggagtaccactattagctataggttgttattcgcaggtaaaccctattactttaacagcggcactattattactcgtcgctcattatgcaataataggaccagggctgcaggcgaaggcaaccagagaagctcaaaagagagctgccgcaggaattatgaagaaccccacggtcgacgggataacagtaatcgatctagaacctataccatatgatccaaagtttgagaaacagttaggccaagtcatgcttttaatattatgcgtcacacaagtactcatgatgcgaacaacttgggcgctttgtgaggctttaacgttagctacaggacctatcagtacactatgggagggaaaccccgggcgattttggaatacgacgatagctgtaagcatggcaaatattttccgaggatcatacttggccggagcaggactactcttctccataatgaaaaatacaacgaataccagaagaggtacaggaaatgttggggaaacacttggagaaaaatggaagtcaaggctaaatgcactaggaaaaagcgaatttcaaatatacaagaaatccgggatacaagaggtcgacaggactttagctaaagagggaataaaacgtggagaaacagatcatcatgccgtcagtcgaggcagtgcgaagctaaggtggttcgtcgaacggaatatggtcgcaccagaagggaaagtcgtagatctaggatgcggaagaggtggatggtcctattattgtggtgggctgaaaaatgtgagagaagtgaaaggactaacaaaagggggccctggccatgaagaacctatacccatgtcaacatatgggtggaatctagtacgactacagtcgggagtcgatgtgtttttcacacccccggagaagtgcgacacactactctgcgacataggggagtcaagcccgaaccctacgattgaggctggaaggacgttacgtgttctaaatttagttgagaactggcttaataataacactcaattctgtataaaagtactaaacccatatatgccatcggttatagaaaagatggagacactgcagagaaaatacggtggcgccttagtgcgaaatcctttatctcgaaactcgacccatgaaatgtattgggtcagtaacgccaccgggaatattgtcagttcagttaatatgatttctcgtatgctaataaacagatttacgatgaagcacaagaaagctacctatgaaccggatgtggatctcggttctgggacacgcaatatagggatcgaatcagaaataccgaacttggatataattggaaaacgtatagagaagatcaagcaagagcacgaaacttcgtggcattatgaccaagatcatccatacaaaacatgggcgtatcacggaagctatgagacaaagcagactggaagcgcctcaagtatggtgaatggcgtcgtaagacttttgactaaaccctgggatgtagtccccatggtaacacaaatggctatgacagatacaactccttttgggcagcaacgtgtttttaaagaaaaagtcgatacacgtacacaagagccgaaagaaggaacaaagaagctcatgaaaattacagccgaatggctctggaaagagcttggcaaagaaaagactccgagaatgtgcacgagggaggaatttaccagaaaagtcagaagcaatgcagcgctaggcgccatattcactgacgaaaataaatggaagtcagcccgtgaggcggtcgaagatggtagattttgggagttagtagatagggaaagaaatctacatctggaaggtaaatgtgaaacttgcgtctacaatatgatgggaaagagagagaagaaattaggcgaatttggaaaggccaagggaagtagagccatatggtatatgtggttgggggcacgttttcttgagttcgaagcattgggattccttaatgaagatcattggttttcaagagggaatagcctctctggcgtcgagggcgagggtctacatagattgggatacattcttagagaagtagggaaaaaggaaggaggtgcaatgtacgcggatgataccgcagggtgggacacaagaattacattggaagatttgaaaaatgaagaaatggtaacaaaccatatgaaaggagaacataagaaactagccgaagccatattcaaacttacttaccaaaataaagtagttcgggtacagagacccactccaagaggcacagttatggatataatatctagaaaagaccaaagaggatcaggtcaagtgggaacctatggactaaacacgtttacaaacatggaagcacaactaattcgtcaaatggaaggggaagggatatttaaaagcatacaacacttaacagtcactgaagaaattgcggtgcaaaattggcttgctcgtgtaggaagagaacgtctctcaaggatggcaattagcggtgacgattgtgttgttaagccgatagatgatcgattcgcaagcgctttaaccgcactgaatgatatggggaaagtcagaaaggacattcagcaatgggagccatcacgcggttggaatgattggacccaagttcccttctgtagtcatcattttcatgaacttgtgatgaaagatggcagagttctagtagtgccgtgcagaaaccaagatgaactaataggcagagcacgaatatcacaaggggccggttggagtttaaaggaaacagcttgcctaggaaagtcttacgcgcaaatgtggacacttatgtattttcatagacgtgacttaaggcttgcggctaatgcaatctgttctgcggtaccttcccattgggttcctacaagccgaactacttggtcaatccatgcaaagcacgagtggatgactacagaagacatgctcgctgtatggaatagggtctggatacaagaaaatccgtggatggaagataagacgcctgtggaaagttgggaggaagttccttatttaggaaaaagagaggatcaatggtgtggatcgcttattggtcttacatctcgagctacatgggctaaaaatatacaaacagcaataaatcaagtaagatctttgataggtaatgaagaatatacagactacatgccctccatgaagagattcagacgagaggaagaagaagcaggggtattgtggtag

SEQ ID NO: 22668 - RNA, 9876 nt, synthetic construct
  misc_feature 1..9876: note = derived and/or modified CDS sequence (opt6) from DENV-2__EU482445__SS-prME
  source 1..9876: mol_type = other RNA
agtgcagggatgataataatgttaattccgactgtaatggcattccatttgacaacaagaaatggggaacctcacatgatagtaggaatacaagaaaaaggaaaatcactccttttcaaaacagaagatggtgtgaatatgtgtacgcttatggctatggatttgggagaattatgcgaagatactataacttacaaatgccccttgttacgacaaaacgaaccagaagacattgattgttggtgtaatagcacatcaacctgggtaacttatggaacttgcacgacgaccggagagcatcgacgggagaaaagaagtgtagcattagtaccccacgtcggtatgggtttagaaaccagaacagaaacatggatgagctctgaaggagcttggaaacatgcacagagaatcgagacatggatccttcgacatccaggatttacaatcatggctgccatattagcttatactattggtaccacacacttccaaagagttctaatatttatactcctaacggccgtagcaccatcgatgacaatgagatgtataggaattagtaatagagattttgtagaaggcgtgtctgggggttcttgggtcgatattgttctagaacacggttcttgtgtaactaccatggctaaaaataaaccaactttagactttgagcttataaaaacggaagcaaaacaacctgcgacgttgcgtaaatattgcatagaagctaaactaacaaatactactacagagagccgatgcccaacccaaggcgagccatcattgaaagaagaacaagataaaaggttcgtatgtaaacactcaatggttgaccgtgggtggggcaatggatgtggcctgtttggaaaaggtgggatagtaacatgcgcaatgttcacctgtaagaaaaacatggagggcaaaattgtacagccagaaaatctcgaatacacaatagtagtcacacctcatagtggagaagaacacgcagtgggtaatgatacaggtaaacacgggaaagaaataaaagttacaccgcaaagtagcataactgaagctgaactaacgggatatggtacagtgactatggagtgctctcctagaacaggcttggatttcaatgaaatggtcttgctacaaatggaaaacaaggcttggttagttcatagacaatggttcttagatctacccctaccctggctgccgggagcggacaaacaagaaagtaactggatccaaaaagaaacgctagtaacatttaaaaatccacacgcgaagaaacaagatgtagttgttctggggtcccaagaaggcgcaatgcacacagcccttacaggagctacggaaattcaaatgagctcaggtaatctgttatttaccgggcacctaaaatgccgtctaagaatggataaactccaattgaaaggcatgagctatagcatgtgtacgggtaaattcaaagtagtaaaagagatagctgaaacgcaacacggtacaatcgttatacgagtacagtatgaaggagacggctccccgtgcaagataccatttgaaataatggacctggaaaaacgatatgttttggggaggctaataacagttaatccaatcgtaaccgaaaaagattcaccggttaatatcgaagcggagcccccgtttggagacagttacatcatcatcggagtggaaccgggacaattgaaacttaactggtttaagaaaggatccagcataggacaaatgttcgagacaacgatgaggggagcaaagcgaatggcaatactcggggatacagcatgggatttcggctcattagggggcgtatttacaagcattggaaaagccctacaccaagttttcggagcgatttatggagcggcattttcgggtgtatcgtggacattaaaaatacttattggagtcataattacatggattggtatgaactcgagatctacgagtttatctgtatctcttgttttagtaggcatcgtaacgttgtatctaggggtaatggtacaagcagattccggatgtgtagtatcctggaaaaacaaagaattaaaatgcggatcagggattttcataacagacaatgtacatacgtggacagagcaatacaaatttcagcccgaaagtccgtcgaaactcgcttctgcgattcaaaaggctcaagaagaaggaatttgtggtattaggagtgttacccggttagaaaacttaatgtggaaacaaataacacccgaattaaatcatattctggctgaaaatgaagtaaaactaaccataatgactggcgacataaagggaattatgcaggcgggaaagcggtctttacgcccacaaccgacagaactgaaatatagctggaagacgtgggggaaggcaaaaatgctgtcaacggagtcatacaatcagacattccttattgatggacctgaaactacggaatgtccaaacacaaacagagcttggaactcgttagaagtagaagattatgggttcggtgtctttacaactaacatttggctgaagttaaaggagaaacaagatgcattctgcgatagtaagctaatgtctgcggcaataaaagacaatcgagcagtccatgctgacatgggctactggattgaaagtgccttaaatgatacctggaaaattgaaaaagcgagttttatagaggtcaaaaactgccattggccgaaatcacatacactttggtccaatggagtattagaatccgaaatgatcatacctaaaaatctcgcaggcccagtatcacagcacaattatcgaccagggtaccacacccagattgcgggaccatggcacttaggaaaactcgaaatggacttcgatttctgtgatggtacaacagttatagtaaccgaggattgtgggaataggggaccttcacttaggacgacaacagcatcggggaaattaataacagagtggtgctgtagaagctgcacgcttccacctttaagatatcgtggagaggacggatgctggtatgggatggaaattcgaccgttgaaagaaaaggaagagaatctagtgaatagtctagtcactgcgggtcatgggcaagttgacaacttttccttaggcgtactaggaatggcattgttcttggaagaaatgctacgcactagagtcggaacaaagcacgcaatacttctcgtagccgtcagctttgtaacacttataaccggaaatatgtcctttaaagatctgggtagagtcgtagtgatggtcggggcaactatggcagacgatataggtatgggagtaacatacttagcacttttagcagcatttaaggtacggcctacctttgcagcaggtctactcctaaggaaattaacatcgaaagagttaatgatgacaacgatcggaatagtactattgagccagtcaacgatacccgagactgtattggagttaacggatgcgctagcgctcggtatgatggttttaaaaatagtacgtaacatggagaaataccagctggcagtgacaatcatggctatattatgcgttccaaacgcagttatactacagaatgcatggaaagttagctgtactatactagctgtagtatcggtatcccctttattgctaacctcaagtcaacagaaaacagattggattccgttagctttaaccattaaaggcttaaatccaacagctatattcctcacaacgttgagccgaaccaacaagaaaagatcatggccgttgaacgaagcaattatggccgtgggaatggtgtctatactagcctcctcactactgaaaaatgacataccgatgactggacctctagtagcaggagggcttttaacagtctgctatgtactaactggaaggtcagcggatctggagctggaacgagccacggatgtgaaatgggaggatcaagcagaaatcagcggctctagcccgatcttaagtataactatctcagaggacggatccatgtctatcaaaaatgaagaggaggaacaaactttaaccatattaataaggacaggtctgttggtgatatcgggactattcccaatcagtattcctattacagcagccgcctggtatctgtgggaggtgaaaaagcaacgagctggtgtgttatgggacgtaccaagccctcctccaatgggaaaggcagaattggaagacggagcatatagaataaaacagaaaggaatccttggatattcacaaataggtgctggggtttacaaagagggtacattccacactatgtggcacgttacgagaggggccgtactcatgcataaaggtaaaagaattgaaccaagttgggcagatgtcaagaaagaccttatatcatatgggggaggatggaagctcgaaggtgagtggaaagagggcgaagaggtccaagtgctggcattagagccaggcaaaaacccgagggcagtacagacaaagcccgggctatttaaaacaaacaccggtacaataggtgcagtatcgctcgatttttcacccggcacctcgggctcgccgataattgataagaaaggcaaggtagtaggactctatggcaatggtgtagttacacgctcaggagcctatgtaagtgccatagcacaaaccgagaaaagtatagaggataatccagaaatagaagatgatatatttagaaagagaagacttaccattatggatcttcacccaggggctggtaagacaaagcgttatctaccagccattgtccgagaagctatcaaacgaggtttgcgaacgttaattcttgcacccacaagagttgtcgcagcggaaatggaagaagcacttcgaggtttaccaataagatatcagaccccagcaattagggccgaacataccggcagggaaattgtagacttaatgtgtcacgctacattcacaatgagactattatcaccagtcagagttccaaattataacttaataatcatggacgaagcccatttcacagacccagcttcaattgcggctcgaggatatataagtactagggtagagatgggagaagcggcaggaattttcatgacagcgacaccaccaggatcacgagatccctttccacaaagcaatgcacctataatagatgaagaaagagaaatacctgagaggagttggaatacaggacacgaatgggttaccgatttcaaaggcaaaacagtatggtttgtcccctcgattaaagcaggaaacgacatcgctgcatgtttacgcaaaaacggtaagaaagtaattcaacttagcagaaaaacatttgactcagaatatgtaaaaacccgaaccaatgattgggatttcgtagtgactacagatatatcagaaatgggagctaatttcaaagcagagcgagttatagatccacgcagatgtatgaaaccagtcattctaacggatggagaagaaagagtcatactagctgggcctatgcccgttacccactcaagtgcagctcaaaggagagggagaattggtcggaatccgaaaaatgaaaatgaccaatacatctacatgggagaaccactcgaaaacgatgaagattgcgctcactggaaagaagcgaaaatgctattagacaacatcaacacaccagaaggaatcataccaagtatgttcgaaccggagagagagaaggtagacgcaatcgacggagaataccgcttgcgtggagaggcaagaaagaccttcgtagatcttatgcgcagaggagatttaccggtatggctagcatataaagtagcagccgaaggaataaattatgctgatcgtcgatggtgcttcgatggtatcaaaaacaaccagatactagaagaaaacgtcgaggtagaaatatggaccaaagaaggagaaaggaagaaactaaagcctagatggctggatgcaagaatttactcagatccattggcattaaaagagtttaaagaatttgcagcaggaagaaaatctttaaccttaaatttaataaccgaaatgggacgactaccaacattcatgactcagaaaacaagagatgcattagacaatttagccgtattacataccgcagaagcgggtgggcgagcgtacaatcatgctttatcagaacttccagaaactttagaaaccctcctactactgacactgctagctacggtgacagggggtatatttctattcctaatgagcgggagaggaatcggaaagatgacattaggcatgtgttgtatcataacggctagtatcttgttatggtacgctcagatacagcctcactggatagcagcaagcattatcctcgagttctttttaatagtactattgatcccagaaccagaaaaacaaaggacccctcaggataaccaactcacttacgttgtaattgctatactcacagtagtagcagcgacgatggccaatgaaatgggatttttagaaaagaccaagaaagatctgggcttaggctccatcgctacccaacaacctgaatcaaatattctcgatatcgacttgagaccagcctcagcttggacactgtacgcagtcgctacgactttcgtaacaccaatgttgagacattcgatcgagaatagtagtgttaacgtatcacttacagcaatcgcaaatcaagctacagttttaatgggactaggtaagggttggccattatcaaagatggacattggtgtacccctgctagcgatcggctgttattcacaagtaaaccccataacactcactgccgctctattactattagtggctcattatgcaattataggacctggactacaagccaaagcaacaagagaagcacaaaaacgagcagcggctggaataatgaaaaaccccactgtagatggtataactgttatcgatttagatccaatcccgtatgatccaaaatttgaaaaacaactaggccaggtaatgttacttatactgtgtgtgacccaggtattaatgatgagaaccacctgggctttatgtgaagcattgacgctagcaacaggacccatatcaactctttgggaagggaacccaggtcgattctggaacactacaatagcagtaagcatggccaacatatttagagggtcatatctagccggagccggtctattgttctccatcatgaaaaacacgacaaatactagaaggggtacaggtaatattggtgaaacattaggggaaaagtggaaatccaggttaaacgctctgggcaaatcagaatttcagatatacaaaaagtccggtattcaagaagtcgatcggacactggcaaaggaaggaataaaacgaggggaaactgatcatcatgcagtttctcggggttcagcaaaactaaggtggttcgttgaacgtaatatggtgactccagaaggaaaggttgtagatctgggttgtggaagaggagggtggagttattactgtgggggacttaagaatgtcagagaagtgaaaggtctaacgaaagggggaccgggccacgaagaaccaatcccgatgtcaacatacggctggaatctggtaagactccaaagcggagtggacgtattctttattcctccggaaaagtgtgacactctcctatgcgacataggcgaatcgagtccaaacccaactgtagaagccggacgtactttacgagtcctcaacctcgtcgaaaattggctgaacaacaatacccaattttgcataaaagtacttaatccgtacatgccgagtgttatcgagaaaatggaggcattacaaagaaagtacggaggggctcttgtaagaaatccactaagtcgcaactccacccatgagatgtattgggtgtcgaatgcaagtggaaacattgttagttcagtaaacatgattagcagaatgctgatcaatagatttactatgcgacacaagaaagctacatacgaaccggatgtggacctaggtagcggtacaaggaatattggtatagaatcagaaatccctaatttagatataataggtaaaagaatagagaaaataaaacaagaacatgaaacttcatggcattatgaccaagaccatccgtacaaaacgtgggcttatcatggaagttacgagaccaaacagacgggtagcgccagctcaatggtgaatggtgtggtcagattgctcacaaaaccatgggatgtacttcctaccgttacgcagatggcaatgactgatacaacgccatttggacagcaacgcgtttttaaggaaaaagtcgatacgcgaacccaggaaccaaaggaaggaacgaaaaagttaatgaaaataactgcagagtggttatggaaagaattaggcaagaagaaaacaccacggatgtgcactagggaggaatttacccgaaaggttcgaagcaatgcagcattgggtgctatattcactgatgaaaacaagtggaaaagcgcgcgcgaagctgtcgaggacagcaggttttgggaacttgtagataaagaacgtaacctacatctggaggggaaatgcgaaacatgcgtatataacatgatgggtaaaagagaaaagaaattaggcgaatttggtaaggcaaaaggatcacgtgcgatttggtacatgtggctgggcgcacggttccttgagtttgaggcactcgggtttctgaatgaggatcactggttcagccgagaaaattcgttaagtggagtcgaaggcgaagggctacataaacttggctatatcttacgagatgtgagcaagaaagaaggcggtgcgatgtacgctgacgatacagccggctgggatacacgcataacgcttgaagacctaaagaatgaggagatggtaactaatcatatggagggagagcataaaaagttagcggaggcaatatttaaactaacatatcagaataaggtcgtgagagtacaaagaccaactcctaggggaacggtgatggacattatctcacgccgcgaccaaagaggatcagggcaagtaggcacatatggattgaatacattcacaaatatggaagcccaactaatccggcagatggaaggagaaggagtatttaagaacatacagcacttgacagtcacggaagaggttgctgttcaaaactggcttgcgagagttggtagagaaagactgtcgagaatggcgataagtggcgatgactgtgtcgttaaacccctggatgatagattcgcgaacgccctcactgcattaaatgatatggggaagatacgtaaagatatacagcaatgggagccatcgaagggttggaacgattggactcaagttcctttctgtagtcaccatttccatgaactaataatgaaagatggaagagttctggtagtaccatgtagaaatcaagatgagttaattggtcgtgcaagaatctcacagggtgcagggtggtcattacgtgaaacagcatgcttgggtaaaagctatgctcaaatgtggtcattaatgtattttcatcgtagagatttgcgtttggcagccaatgctatatgcagcgcagttccatcacattgggtacctactagccgaacaacatggagtattcatgcaaaacatgaatggatgaccactgaagatatgcttactgtgtggaatcgtgtatggataagagaaaatccatggatggaagacaaaacccctgtagagagttgggaagaaataccttacctgggaaaacgagaagatcaatggtgcggatcactcatcggcctaacatctagagcaacttgggcaaagaacattcaagcagccataaatcaagttcggagcctcataggtaatgaagagtatacagactatatgccatcaatgaaacgttttagaagagaagaagaggaagctggagttctgtggtaa

SEQ ID NO: 22669 - RNA, 9876 nt, synthetic construct
  misc_feature 1..9876: note = derived and/or modified CDS sequence (opt6) from DENV-2__EU482446__SS-prME
  source 1..9876: mol_type = other RNA
agtgcagggatgataataatgctgatacccactgttatggctttccatctaactaccaggaacggagaacctcacatgatagtaggtatacaagaaaaaggaaaatcactactatttaaaacagaagatggagtcaatatgtgtacgttgatggcaatggacttaggtgaactctgcgaagacactataacatacaaatgccctcttctacgacaaaatgaaccggaagatatagactgctggtgcaatagcacttcgacgtgggtaacatatggtacgtgtacgacaaccggagaacatcgaagggaaaaacgatccgttgcattagtgccacatgtcggaatgggtctagaaacccgaacagaaacatggatgagttctgaaggtgcttggaaacatgcacaacgaatcgaaacatggattctaaggcatccaggatttacgattatggcggcaatcctcgcttacactattgggacaacacattttcagagagtattaattttcatcttactgactgcagtcgcaccttcaatgacaatgagatgtataggaattagtaatcgagattttgtcgaaggagtgtcaggaggaagctgggtggatattgtattagaacacggctcgtgtgtaacaacgatggctaaaaacaaaccgactctcgactttgagttaattaaaaccgaagcaaaacagccggctaccctgagaaaatattgcattgaagctaaacttaccaatacaactaccgaatctagatgtcctacacaaggcgaaccttcactgaaagaggaacaagacaaaagattcgtttgcaaacatagtatggtcgatcggggctggggaaatggctgcggattatttggaaaaggcggcatcgtaacatgtgctatgttcacatgtaagaaaaatatggaaggaaaaatagttcagccagaaaatttggagtatactatcgtagtcactccccattcaggagaagaacacgctgttggcaatgatacaggaaaacatggaaaagaaataaaagtaacaccacaatcgagtattacagaggctgaactcacaggttacggaacagttacaatggaatgttcgccaaggacaggtttagactttaacgaaatggttttattacaaatggaaaataaggcttggctagtacataggcaatggttcctggatctaccgttgccatggttgccaggagcagacaaacaggagagtaattggattcaaaaagaaacgcttgttacatttaaaaaccctcacgcaaagaaacaagacgttgtggtcctcggcagccaagaaggagccatgcatacggcattgacgggagcaactgagatccaaatgagctctggaaatttattattcacgggacacctgaaatgtcgacttagaatggataaattacaattaaaagggatgtcctactcaatgtgtacaggcaaattcaaagttgttaaagaaatagccgagacacaacatggtactattgtcattcgtgttcaatatgaaggcgatggatccccgtgcaaaatcccttttgagatcatggatttagaaaaacggtatgtcctaggtcgactcattactgtgaatccaattgtcacagagaaagactctcccgtaaatatagaggcagaacccccttttggggacagctacataatcataggcgtcgaacctggtcaattgaaactgaactggtttaagaagggaagcagtattggtcaaatgttcgaaaccacaatgcgtggagccaaacgaatggcaatattaggtgatacggcatgggatttcggaagcctcggtggagtatttacttcgattggtaaggctttacatcaggtatttggtgctatatacggcgccgccttcagtggcgtatcctggacgatgaaaattctaattggggtaattataacttggatcggtatgaatagtcgcagtacatctctttcggtatctctggtcttagttgggatagtcactctatatctaggagttatggtacaagcagacagtggctgtgttgtaagctggaagaacaaagaactcaagtgtggaagcggtatctttatcacagataatgtacacacatggacagaacaatataagtttcaaccggaaagcccatctaaattagcgagtgctatacaaaaagctcaagaagaaggaatctgtggtataagatcagtgacaagattggagaatttaatgtggaaacagatcacacctgagctaaatcatatactcgcagagaatgaagtaaaactcacaataatgacaggagatattaaaggaataatgcaggctggaaaacggagcttacggccgcaaccaactgaactgaaatactcctggaaaacatggggtaaagcaaaaatgctatcaacagaatcttataaccaaacctttctcatagacgggcctgaaaccacggaatgccctaacacaaacagagcatggaactccctggaagtagaagattatggctttggtgtatttacaactaacatttggttgaagctaaaagagaaacaggacgccttttgcgacagcaaacttatgtcagccgctataaaagataatagagctgtacatgctgatatgggctattggatagaaagcgcactaaatgatacttggaaaatagagaaagcatcatttatagaagtcaaaaattgccactggccgaaaagccacactctgtggagtaacggtgtactcgaatcggaaatgattatccctaaaaatttagcagggcccgtatcccaacataattataggcccggataccatacccaaattgcgggaccatggcatttgggtaaactagaaatggatttcgacttttgcgatggtactactgtcattgttacagaagactgtggaaacagagggccctcgctacgtactacgacggcgtcaggtaaattgattaccgaatggtgctgcagaagctgtacgttaccacccttaagatacagaggcgaagatggatgttggtatggcatggaaattagaccccttaaagaaaaggaagaaaatttggtaaatagtctggtaacggctggtcacggacaagtagacaacttcagtttgggagtcctcggaatggctttattcttagaggaaatgctaagaaccagagtaggcactaaacatgcaatactcttagtagcagtatcatttgttacacttatcaccggcaacatgtcattcaaggatctaggaagggttgtggtgatggttggggctactatggcggatgatataggaatgggcgttacctatctagctttactagcagcgttcaaggtgcggcccactttcgccgcgggtttgttactaagaaaactaacaagtaaggagcttatgatgacgacaattggaatcgtgttactgtcacaatcaaccatcccagagactgtcttggaactcaccgacgcgttagcactcggaatgatggtactgaagatagttcgaaacatggaaaaatatcaactagctgtaactataatggcaattctatgcgtgccaaatgctgtaatactgcaaaacgcctggaaagtgagctgtactattctggcagttgtgagtgtgtcgccgttactattaaccagcagccaacaaaagactgactggatacctctcgctttaacaatcaaaggcttaaatccaaccgcaatttttcttaccacattatcgcgcacaaacaagaagaggtcatggcctctaaatgaggccataatggctgttggtatggtgtcgattctggcttcatcattactcaaaaatgacataccaatgaccggacctttagtcgccggcggattactgacggtatgttatgtactgacgggtcgatccgcagacctcgaactagaacgggctacggatgtaaaatgggaagatcaagcagaaattagtggttcatcacctatattatctatcacaatttcggaagacggatctatgtcgatcaaaaatgaagaggaggaacaaacattaactattttaataagaactgggttattagtaatctctggtctgtttcctatctccattcctattaccgcagcagcctggtatctgtgggaagtcaagaaacaacgagccggtgtactttgggatgtaccctcgccgccaccaatgggtaaagcagaattagaagatggggcctatcgaattaaacagaaaggtatactggggtattcccaaataggagctggtgtatataaggagggaacgttccatactatgtggcatgtaacacgcggtgcagtcttaatgcataaaggaaaaagaatagaacctagttgggcagacgtgaagaaagatttgataagctacggcggaggatggaaattggaaggagaatggaaagaaggagaagaagttcaagttcttgcattagaaccaggcaaaaacccacgcgccgtacaaactaaacctggattattcaaaactaatacaggaacaattggtgcggtatctcttgactttagcccgggtacaagtgggtctccgataattgataagaaaggtaaagtagtcggactatacgggaatggagtcgttactagatctggagcttatgtctcagctattgcacaaacggaaaaatcgatagaagacaaccccgaaattgaagatgacatcttccgcaaacggcgtctgactatcatggatttacacccaggagcgggaaagactaaaagatatttgcctgccatcgtcagagaggcaataaaaaggggcttaagaacattaatcttagcaccaacacgagttgttgcggcggaaatggaagaggctttaagaggattacccatacgttaccaaaccccagccatacgtgcggaacacactgggagagagatcgtagatttaatgtgtcacgctactttcacaatgcgtttattatctcctgtacgagttccaaattataacttaataattatggacgaagcccattttactgatccagcaagcattgcggcaaggggatatataagcacccgtgtagagatgggtgaagctgcaggcatatttatgactgccacaccacccgggtctagggatccctttccacaaagtaatgccccaataatagatgaagaacgcgaaataccagagaggagctggaacacaggtcatgaatgggtaacagattttaaaggtaaaacagtatggttcgtgccatcaatcaaagcaggtaacgatattgcagcttgcttaaggaaaaatggcaagaaagtaattcaattaagtagaaagacgtttgactcggagtatgttaaaactagaacgaatgattgggactttgttgttacgacggatatatctgaaatgggagcaaatttcaaagcagagagggtaattgacccacggcgctgtatgaaacctgtaatacttacagatggggaagaaagagtaatcctagcaggtcctatgcctgtcacccattcatctgcggcgcaacgtaggggccggataggacgaaatcccaaaaacgaaaatgatcaatatatatacatgggtgaacccttagagaatgatgaggactgtgcacactggaaagaggcaaaaatgctactggataatataaatacaccagagggtataataccgagtatgtttgaaccagaacgagaaaaagtggacgcgatagacggagaatatcgcttaagaggagaagcgagaaagacgtttgtagatctgatgcgcagaggtgacttacctgtgtggctggcatataaagtagcagccgaaggtattaactatgcggacaggaggtggtgttttgatggaattaaaaataatcaaatattagaagaaaatgtagaagtagaaatttggacaaaggagggtgaacggaagaagttaaagccaagatggcttgatgcaagaatatatagcgatccactagctctcaaagaatttaaagaatttgccgcaggcagaaagagcttaactctaaatctaattactgagatgggtcgattacctacgtttatgactcaaaagacacgtgatgctctagacaatttagcagtattgcacacggcagaagccggcggaagggcttataatcacgctttgagtgaactgccagaaactctggaaacattattacttctcactctattagctacagtaacaggaggaatctttctatttttaatgagcggacgagggattggaaaaatgactctaggtatgtgttgtataataacagccagcattcttctgtggtatgctcaaattcaaccacattggatagcagcatctatcattctagagttctttttaatagttctcctaatccctgaacctgaaaaacagagaacaccccaggacaaccaactaacatatgtcgtcattgctattctgacagttgttgcagccacaatggcaaacgaaatggggtttctagaaaagactaagaaagacctaggtttaggatcaatagccactcaacaaccagagagcaatattttagatatcgatctacgacctgcaagcgcttggacattatacgccgtggcaactaccttcgttactccgatgttacgacattcaattgaaaacagcagtgttaatgtaagtttaactgcaatcgctaaccaagctactgtactcatgggtctaggaaagggttggcctctctccaaaatggatattggtgttccgttgctagcgattggttgctattcgcaagtaaatccaatcacactcacggccgccttgctcttattggtggctcattatgccataattggaccgggacttcaggcgaaagcgactagagaagcacagaaaagggcagctgcaggtatcatgaaaaatccaaccgtcgacggaattacagtaattgacttagaccccattccgtatgaccctaagtttgaaaaacaactaggtcaggtcatgcttttgatcctatgtgtgactcaggtccttatgatgcgaacaacctgggctttatgtgaagcgctaacactagcaacgggtccaataagtacattatgggagggaaatcctggaagattctggaatacaacaatagcagtctccatggcgaatattttcagaggctcttatttagctggcgcaggtctgttattctccattatgaaaaatacaactaacacccgacgaggaactggcaatattggagaaacattgggtgaaaagtggaagagtcgactaaatgccctcggtaaaagcgaatttcaaatatacaagaaatcaggaatccaagaagttgacaggactttggcaaaagaaggaataaagcgtggagaaactgatcatcatgctgtctcacgaggcagcgcaaaactgcggtggtttgtcgaacgaaacatggtaacgcccgaaggaaaagttgtagatctgggatgtggacgtggcggttggtcatattactgtggtggtctaaagaatgtaagggaagtaaaaggtctaacaaaaggtggaccaggacacgaagaaccaatcccgatgtccacctatggctggaacttagtaagattacaaagcggtgtagacgttttcttcataccacctgaaaaatgcgatacattgctgtgtgatattggagaaagttcaccgaacccaaccgtagaggcgggaaggacactacgtgttcttaatttagtagaaaactggctcaacaacaatactcagttctgtataaaagtacttaacccttatatgcctagcgtaatcgagaagatggaagcactacaaaggaagtacggcggcgcacttgttagaaatccactaagtcgaaacagcacgcacgaaatgtactgggtatctaacgcgagtggtaatatagtcagtagcgtgaacatgatatcgcggatgctaattaatcgatttactatgagacacaagaaggcaacttatgaaccggatgttgacttgggatcaggaacaagaaatataggaattgaatctgaaatacctaatttggatataattggaaaaaggatagagaaaataaaacaagaacacgagacatcgtggcactacgatcaagatcatccatacaagacatgggcatatcacggtagttatgagacaaaacaaactggttcagcaagtagcatggtgaacggtgtcgtacgtttactgacaaagccatgggacgtcttaccaacagttactcagatggccatgacagatactacgccctttggacaacaaagagtttttaaggagaaagtggatacacggacccaagaacccaaagaaggtactaagaaactaatgaaaattacggcagaatggttatggaaagaattaggcaagaagaaaactccccgaatgtgtactagagaggagtttacacggaaagtaagatcaaacgccgcactgggcgcaatcttcactgacgaaaataaatggaaaagcgctagagaggctgttgaagacagccgattttgggaactggtagataaagaaaggaatttacatctcgaagggaaatgtgaaacgtgtgtttataatatgatgggaaaacgagagaagaaactgggagagttcggaaaggctaaaggtagccgtgctatatggtatatgtggctaggagccagatttctagaatttgaagcgttaggatttctaaacgaagatcattggttcagccgtgaaaactcattatccggcgtcgaaggagaaggactgcataaactagggtatatattaagagatgttagtaagaaagaaggtggtgcaatgtacgcggatgacacagccggctgggacacaagaataacactagaagacttgaaaaatgaagaaatggtaacgaatcatatggaaggagaacacaagaaattagccgaagctatcttcaaacttacgtatcaaaataaggttgtaagagtccagcgccctacaccaaggggaacagtaatggacataataagcaggagagaccaacgaggctcaggccaagttggaacttatggattaaatacatttacgaacatggaagcacagttaattaggcagatggagggggaaggcgtgtttaaaaatatacaacacctcaccgtaacagaagaagttgctgtgcagaactggttagcaagagtaggtagagaacgtttgtcacgaatggctatctcaggggatgattgcgtagtaaaacccctagacgacaggttcgcaaatgccctaacagcacttaatgatatgggaaagattcgtaaggatattcagcagtgggaaccatcgaaaggatggaacgattggacgcaagtgccgttctgtagtcatcactttcatgaactaataatgaaagacgggagagtattagttgtcccatgcagaaaccaagacgagcttattggtcgagcacgaataagtcaaggagccgggtggtcacttagggaaaccgcatgtttagggaaatcttacgctcaaatgtggagtttaatgtactttcacaggcgggacctacgactagccgcaaatgctatctgcagcgctgtaccatcgcattgggtaccaacatcaagaacaacttggagcattcatgccaaacatgaatggatgactactgaagatatgcttacagtgtggaatcgagtctggataagagaaaacccgtggatggaagataagacgccagtcgagtcctgggaagaaattccctatctcggtaaaagagaagaccaatggtgcggatcactaataggcctaacaagtcgagcaacgtgggcgaaaaatatacaggcagcgatcaatcaagtacgctcattgataggaaatgaggaatatactgattatatgccaagtatgaaacgatttagacgggaagaagaagaagccggtgtcctctggtag

SEQ ID NO: 22670 - RNA, 9876 nt, synthetic construct
  misc_feature 1..9876: note = derived and/or modified CDS sequence (opt6) from DENV-2__EU482448__SS-prME
  source 1..9876: mol_type = other RNA
tcggctggtatgattataatgttgattccaactgttatggcttttcacttgacaacccgtaatggagaaccacatatgatcgttggtatacaagaaaaaggtaaatcactattattcaaaactgaagacggagttaatatgtgcacacttatggcaatggacttgggagaactgtgtgaagataccatcacatataaatgtccactacttagacaaaacgaaccggaagacatagattgctggtgtaattctaccagtacatgggttacctatggaacctgtaccacgacaggagaacatagacgagaaaaacgtagcgttgctctagtcccacacgtcggtatgggcctagaaacaaggacagaaacatggatgtcaagcgaaggggcatggaaacatgctcaaaggattgagacatggatattgcggcatccagggtttaccattatggctgctatattggcgtacacaataggaaccacccattttcaacgagtcttgattttcattttactaacagcagttgcaccgtcgatgactatgcgttgtataggaatctcaaatcgagattttgtcgaaggagtgagtggaggaagctgggttgacatagttttggaacacggcagctgtgttactacaatggccaaaaataaacccacgttagatttcgaattgataaaaacagaagctaaacaacctgctacactaagaaaatattgcattgaagccaaattgacaaatacaacgacagagtctagatgcccaacgcaaggtgaaccttcacttaaagaagaacaagataaaaggttcgtatgcaaacacagtatggtcgaccgcggatggggaaatggttgcggactatttggtaagggtgggatcgtaacctgtgcgatgttcacttgtaagaaaaatatggaagggaaaatagttcagccagaaaacttagaatacaccatagttgtgacgccccattctggcgaggagcacgctgtagggaatgataccggaaagcatggcaaagaaataaaagtcactccccagtcgtccataaccgaagccgagctaacagggtatggtacagttacaatggaatgcagtccacgaacaggactagattttaatgaaatggtgctattacaaatggaaaataaggcgtggctagtacacaggcaatggtttttagatctcccactaccgtggctcccaggagccgataaacaagagagtaattggattcaaaaagaaaccttagtgaccttcaaaaatcctcacgccaagaaacaggatgttgtagttctaggatcacaagaaggtgcaatgcatacagctcttacaggagctaccgaaattcaaatgtcgtcgggaaacttattatttactgggcatctgaagtgcagattgcgaatggacaagttgcaactgaaaggtatgtcttattcgatgtgtacaggaaagttcaaagtcgttaaggaaatagctgaaacacaacatggaacgatagttatacgcgtacaatacgagggagacggaagtccctgtaaaataccatttgagataatggatcttgaaaaacgatatgttttaggtagactaataacagtaaatccaatagttacagaaaaggattcgccggtgaatatagaggcagaaccaccatttggtgattcatatattatcataggagtagaaccaggtcaattaaaactcaattggtttaaaaaggggtcaagtataggtcagatgttcgaaacaaccatgcgtggtgcaaaaagaatggcgatcttaggggatacggcttgggatttcggatcactaggcggtgttttcacaagcatagggaaggcactccatcaagtatttggcgccatctacggtgcagctttttctggtgtatcatggaccatgaaaatcctaataggagtaattataacttggattggaatgaactctcggtcaacctcactaagcgtaagtcttgtgttggtaggcattgtaactctttatctcggagttatggtgcaagctgacagtgggtgcgtagtaagctggaagaataaggagttaaaatgtggtagtgggatcttcattacagataatgtccatacttggacagaacaatacaaatttcagccggaatcaccgagcaaacttgcaagtgccatccaaaaggctcaagaagagggtatctgcggaatcagatcagtaactagactcgaaaatctgatgtggaagcaaatcactccggaactaaaccatatactcgctgaaaatgaggttaaactaacgataatgactggagacattaaaggtataatgcaggcagggaaacgatcactacgtccccagcccactgaactaaagtattcgtggaaaacatggggaaaagcaaaaatgttaagcacagaatcttacaatcaaacatttttgattgacggcccggagacaactgagtgcccgaatacgaaccgggcatggaatagcttagaagtggaagattacggttttggagtattcactactaatatatggctcaagttaaaagaaaaacaggatgcattttgtgattccaagttaatgagtgccgcaattaaggataaccgtgctgtacatgccgatatgggatactggatagaatcagcattaaatgatacctggaaaatagaaaaagcctcatttatagaagtgaaaaactgtcattggcctaaatcgcacactctctggagcaacggcgtcctggaatccgaaatgatcatacccaaaaatcttgctggaccagtaagtcaacacaattatcgccctggttaccacacacagattgctgggccgtggcatcttggcaaattggagatggattttgatttctgtgacggaactacagttatcgttactgaagactgcggtaacagggggccttcattacgaacaactactgcatctggcaaattaataactgaatggtgctgtagaagttgtaccttaccacccttacgatatcggggcgaagacggctgttggtatggaatggaaatccgccccttaaaagagaaagaggagaatcttgttaatagtctcgtaaccgcaggacacggccaagtggataatttcagtttgggcgtactgggtatggcactgtttttagaggagatgttaaggaccagagtggggacaaaacatgctatacttctggttgcagttagttttgtaaccttaattactggaaatatgtcctttaaagacttgggacgagtagttgtaatggtaggtgccacaatggccgacgatatcggaatgggtgtaacttacttagcattactagctgcgttcaaggtaagacccacctttgctgctggattgttactacgtaaacttacatctaaagaacttatgatgacaacaataggaatagttcttttgagccaaagcaccattcccgaaacggtgttagagctaactgatgcactcgcactaggaatgatggttctcaaaatcgtaagaaatatggagaagtatcaactggcggtaacaattatggccatattatgtgtaccgaatgcagtgatattacaaaatgcatggaaagtcagctgcacgatactagcggttgttagtgtaagccccttattactgaccagctcacaacagaaaaccgattggatccctctggcgctaacgataaaaggtctaaatcctaccgccatatttttaaccacgttgagcagaacaaataagaaacgaagttggcctttaaacgaagccataatggccgttggaatggtatcaatccttgctagtagcttattgaaaaacgatataccaatgacaggccctctagttgctggagggctattgacagtatgctacgtcttaaccggaagatcagctgatcttgaattggaacgggcgaccgatgtaaaatgggaagatcaagcagaaatatcaggtagtagtcctatcttatccataacaatatctgaagacggtagcatgtcgattaaaaatgaggaagaagaacaaactttaactattttaattcgtacaggattgctggtcataagtggcttgtttccgatatcgattcccatcaccgccgccgcgtggtatttgtgggaagtgaagaagcaaagagctggtgtattatgggacgtgccatctcctcccccaatgggaaaggccgagctggaagatggtgcatatcgcataaaacaaaaagggattcttggttattcacaaatcggcgcaggagtctataaagaagggactttccatacaatgtggcatgtcaccagaggtgcagtcctaatgcataaaggtaaaagaatagaaccaagttgggctgacgtaaagaaggacttaatatcatatggaggaggttggaaactagaaggagagtggaaggaaggcgaagaggtgcaggtacttgctctagaacccgggaaaaacccaagagctgtacaaaccaaaccagggttatttaagaccaatacagggacaataggggcggtgtccctggacttcagtccaggaacttcagggagccctattatagataaaaagggaaaagttgtaggattatatggcaatggtgttgtaacacgatcaggcgcctatgtatcggccatagctcaaaccgaaaagagtatagaagataaccctgaaatagaagacgacatatttcggaagcggagattaaccataatggatttacacccaggggccgggaaaaccaaacgataccttccggcgatagtacgtgaagctattaaacgtggtctccgtaccctcatactagctcccactagagtagttgcagcagagatggaagaggcccttagaggcctcccaattaggtatcaaacaccagcaattcgagcagagcatacaggacgagagatagtcgatctgatgtgccacgctacattcacgatgagactattatccccagtacgagttcccaactacaacttaataataatggacgaggcccattttactgacccggcgtctatagctgcacgaggatacataagtacccgagttgaaatgggtgaagcagccggaatattcatgacagcaactccaccaggctcacgagacccatttcctcaatctaatgcacccataatagatgaagaaagagaaataccggaaagatcatggaatactggacatgaatgggtaacggattttaaaggcaaaacagtttggttcgtgcccagtataaaggccggcaacgacatcgcagcgtgtttgagaaagaacggcaagaaagtcatacaacttagtaggaaaacctttgatagcgaatatgtaaagacaagaactaacgattgggattttgttgttacaactgacatttccgaaatgggcgccaacttcaaagctgaaagggttattgacccacgccgatgtatgaaaccagtaattttaacagacggagaagaacgcgtaatactagccggacctatgcccgtaacacatagtagcgctgcacaacgacgaggtcgtattggcagaaacccaaagaacgaaaacgatcagtacatatacatgggagaaccacttgaaaacgatgaagactgcgctcattggaaagaggcaaaaatgctactagacaacatcaacacgcccgagggaataataccaagcatgtttgaacctgaaagagaaaaagtggacgcaatagatggcgaatataggttaagaggtgaagcacgtaaaacattcgtggatctaatgcgcagaggagatctacccgtttggctagcatacaaagtagctgccgaagggattaactatgctgatcgaagatggtgtttcgacggaattaaaaataatcagatcttggaagaaaacgttgaggtagaaatctggacaaaggagggagaaagaaagaaattaaagccaagatggctagacgcccgaatatatagtgatccattggcactaaaagagttcaaagaatttgctgctggacggaaatccttaacattaaatcttattacggaaatgggaagactacccacatttatgacgcagaaaactagagacgcgcttgataacctggccgtgctccataccgctgaggcaggcggtcgagcatataatcatgcgctttcagagttgccagagacactagagacactacttctgttgaccttgttagccaccgtcaccggcgggatatttttatttttaatgtcaggaaggggcatcggcaaaatgacattaggaatgtgctgtataataacagcgtcaatattattgtggtacgcacagatacaaccgcactggatcgcagcttcgataatattagaatttttccttatagttctacttattccggaaccggaaaaacaaagaacgcctcaagataaccaactaacctatgttgtaattgctatactgacagtagtagcagcgacgatggctaacgaaatgggatttctagagaaaacaaagaaagatctaggactcgggtcgatagcgacccaacaaccagaatctaacatactagatattgatcttaggcctgctagcgcatggacactatacgcagtggctacaacattcgttacgccgatgctaagacatagcatcgaaaactcaagtgtgaacgtgagcttaacggcgattgctaaccaagctacagtattaatgggactaggaaaagggtggccgttatctaaaatggatataggagtccctctacttgccattggttgttattctcaagttaatcctattacgctcacggccgctctattactattagtagcccactatgcaattataggtccaggcttacaagctaaagcaacacgtgaagctcaaaaacgagcagcagccgggatcatgaaaaatccaacggttgatgggataacggtaatagacttagatccaataccgtacgatcctaaattcgaaaaacaattaggccaagttatgctgttaatcttatgtgtcacacaagtcttaatgatgaggacaacttgggcgctttgcgaggctctaacactagcaactgggccaatatccactctatgggagggaaatccaggccgattttggaatacaacgattgcggttagtatggcaaatatattcagaggaagttatctagcaggagctgggctattattttcgataatgaaaaatactaccaacactcgaagaggtacaggaaatatcggcgagacccttggagaaaagtggaagtccagactcaacgctcttgggaaatcggagttccaaatatacaagaaaagcggcattcaagaggttgatcgcacactcgctaaagaaggaataaaacgtggagaaaccgatcaccatgcagtctcaagaggatccgccaaactacgctggtttgtcgaacgtaacatggttacccccgaaggcaaggttgtggacctaggttgtgggcgtggtggatggtcgtattattgtggtggcctcaaaaatgtcagggaagtgaaaggtttaacaaaagggggcccaggacacgaagaacctattcctatgagtacctatggatggaacctggtaagattacagtcaggggtagacgtattctttatcccaccggagaagtgcgatacattgctgtgtgacataggtgaaagttcacccaacccgaccgtcgaagcaggacgtactttgagggtactaaatctcgtagagaactggctaaacaataatactcaattttgtataaaagttcttaacccctatatgccatccgtaattgagaaaatggaagcacttcaaaggaagtacggcggcgctttagtgagaaatccactttcacgaaactcaacccatgaaatgtactgggtatcaaacgctagcggcaacatagtgtcaagtgtaaatatgatttctcggatgcttataaatcggttcacgatgagacacaagaaagccacttatgaaccagatgtagacctagggagtggcactagaaacattggtattgagtcagagattccaaatctagatataattggaaaaaggattgagaaaataaaacaagaacatgagataagttggcattacgatcaagaccacccatacaaaacatgggcgtatcacggttcatacgaaactaaacagacaggatcagcctcttctatggttaacggtgttgtccgtcttctaacaaaaccatgggacgttctaccaaccgtaactcaaatggcaatgacagatacaacaccctttggtcaacagcgagtattcaaagaaaaagttgatacacgtacacaagagccaaaagaaggaactaagaaattaatgaaaataactgctgagtggctctggaaagaacttggcaagaagaaaactcctagaatgtgtacaagggaagagtttactaggaaagtccgtagcaacgcagcactaggagcaatattcacggatgaaaataaatggaagtctgcaagggaagcagttgaagatagccgattctgggagttggtagacaaagaacgaaatctacatctagaaggaaaatgtgagacatgcgtatacaatatgatgggtaagcgagaaaagaaactaggtgagttcggtaaggcaaaaggatcaagagctatatggtacatgtggttaggcgccagattcctagagttcgaagcactaggatttcttaatgaagatcattggttctctcgagaaaattcattatcaggggtggaaggggaaggattgcataagttggggtacattttgagagatgtgagtaagaaagaaggcggggctatgtacgccgatgatacggcaggttgggatacacggataacattggaggatttaaagaacgaagaaatggttacaaatcatatggaaggagagcacaaaaagctggcagaagcaatcttcaaacttacgtaccaaaacaaagtcgtaagggtacaaaggccaacaccccgagggacagttatggacattatttctcgccgagatcaaagaggtagtggacaagttggaacatatgggctaaacactttcacaaatatggaagcccagcttataagacaaatggaaggggaaggagtgttcaagaatattcaacatctaactgtgacggaagaagtggctgtacaaaattggcttgctcgagtaggaagagaaagattgtcaagaatggcaatatccggtgacgattgtgtagtaaaacctcttgatgatcgatttgctaatgcattaacagcattaaatgacatgggaaaaataagaaaggatatacaacagtgggaacctagtaaaggttggaacgactggactcaagttccgttctgttcacatcattttcatgaattaatcatgaaagatggaagagtcttagtagtaccttgtagaaatcaagacgaattaataggtagagcgagaatatcgcaaggggctggatggagtttaagagaaacagcatgtcttgggaaatcctatgcgcaaatgtggagtctgatgtattttcaccgtagggatttacgattggcagcgaatgcaatctgctcggcggtacctagccattgggtcccgacaagcagaacaacttggagtatacatgccaaacatgagtggatgacgacagaagatatgttaacagtatggaatcgggtctggatacgagagaatccgtggatggaagataaaacgccagtagaatcctgggaagagattccttatttaggtaagcgtgaagatcagtggtgtggctcgcttataggcctgacctcaagagctacgtgggcgaaaaatatacaagccgcaatcaatcaagtgagaagtttaattggaaatgaagagtataccgactacatgccaagtatgaaaagatttcggagggaagaagaagaagcaggagtactctggtaa

SEQ ID NO: 22671 - RNA, 9876 nt, synthetic construct
  misc_feature 1..9876: note = derived and/or modified CDS sequence (opt6) from DENV-2__EU482449__SS-prME
  source 1..9876: mol_type = other RNA
acggcaggcgtcataataatgttaatccccactgctatggcttttcacttaacaactcgaaatggcgaacctcatatgattgtgggccgccaagaaaaaggaaaatcattattgtttaaaacagaagacggagttaacatgtgtacacttatggctatcgatttgggagaattatgtgaagacactataacatataaatgtcccttgcttcgacaaaacgaacctgaagacatcgattgttggtgtaattcaactagcacgtgggttacatatggaacatgtacgacaactggggaacatagacgtgagaaaagatcggttgcgttagtccctcatgtaggaatgggtttagaaactagaacagaaacctggatgagttctgaaggtgcatggaaacacgcacagagaatagaaacatggatattaagacaccccggttttaccataatggcagcgatcttagcctatacaatcgggaccacacatttccaacgagcattaatattcattttgttgacagccgtcgcgccttccatgacgatgagatgcatagggatctctaatagagactttgtagaaggagtttcgggcggaagctgggtggacatagtcctcgaacatggctcatgtgtgacaacgatggccaaaaacaaaccaaccttagatttcgaactaataaaaacagaggcaaaacaacctgcaacactccgcaaatattgcattgaagccaaactaactaatacaacaaccgaatctcggtgtccaacacagggtgaaccctcactaaacgaggaacaagataaacgatttgtgtgcaaacactcaatggtggaccgaggctgggggaacgggtgtggcttatttggcaaaggtggaattgtaacctgtgcgatgtttacttgtaagaaaaacatggagggaaaaattgtacaaccagaaaatttagagtataccatagttataacgccacactccggtgaggagcacgccgtagggaacgatactggaaaacacggaaaagaaatcaaaataacaccgcaaagtagcaatacggaggccgaacttactggatacggtactgtaactatggagtgcagtcctcgaacgggactggatttcaatgaaatggtattattacaaatggaagataaagcgtggctcgtccatagacaatggttcctagacctacctctaccgtggttaccaggagcagatacacagggatctaactggattcaaaaagaaactcttgtaactttcaaaaatccacatgccaagaaacaagatgtagtcgtattaggctcacaagaaggagctatgcacacagctctaaccggggctactgagattcagatgagctccggcaatctcttatttacaggccacttgaaatgtagattaaggatggataaactacaacttaaaggaatgagctatagtatgtgcacagggaaattcaaaatagtcaaagaaatagctgagacgcaacacgggactattgtaatccgtgtccaatacgaaggtgatggaagtccctgcaaaataccatttgagattatggatcttgaaaaacgacacgtattaggtagattgataaccgtcaatccaattgtaacagagaaagattcaccggtaaatatcgaagcggaacctccgtttggcgactcctatataataataggagtcgagcctggacagcttaaactaaattggttcaagaaaggtagttcaattggtcagatgttcgaaaccacaatgagaggtgcaaaaagaatggcaatactaggcgatacggcgtgggattttggttcattaggaggagttttcacaagtataggaaaagcattacaccaagtatttggagcaatatatggagctgcatttagtggtgtctcgtggacaatgaaaattttaataggagcaataattacatggataggtatgaatagtcggtcgacatcgttgtcagtaagtctcgttctcgttggagttattacgttgtatcttggagcaatggtacaagcagactcaggatgtgtagtttcctggaaaaataaagaattaaaatgcggttcgggcatatttataacagacaatgtacacacatggacagaacaatacaaatttcaacctgagtccccatcaaaactcgcttcggcaatacaaaaagcccatgaagagggtatttgcggtatccgaagcgtaacaagactcgaaaatttaatgtggaaacagataactcctgagctaaatcatatattaagcgagaatgaagttaaactaacaattatgacaggcgatattaagggaataatgcaagctggcaaaagaagcctgcgtccacagccaacagaattaaaatattcatggaaaacctgggggaaagcaaaaatgctctcaactgaaagtcataaccaaacgttcctgatagacgggcctgaaacagctgaatgtcctaatacaaaccgtgcctggaatagcctagaagtcgaggattacggatttggagtatttacaacaaacatatggctaaaacttagggaaaagcaggatgtattttgtgactccaaattaatgagtgcagcgattaaagacaatcgcgcagttcacgccgatatgggatactggatcgaaagtgctttaaacgacacatggaaaatggagaaagcatcattcatcgaagtaaaaagttgtcactggccgaaatcacatacgctatggtcgaacggagtattagaaagcgaaatgataatacccaagagctttgctgggcccgtgagtcaacacaattaccgccctggatattatacacaaactgctggaccatggcacctaggtaaattagaaatggattttgatttctgtgagggcaccactgttgtagttacggaagattgtgggaatagaggcccgagcctaagaacgacaacagctagcggaaaattaataaccgaatggtgttgtagaagttgtactttaccccctctaagatataggggagaagatgggtgttggtacggaatggaaataaggccccttaaagaaaaagaagaaaacttagtaaattcccttgtaactgcaggacacggacaaattgataatttcagtctaggagttttaggcatggcattattcttggaggaaatgttaagaacacgggtaggtacaaaacacgctattcttctagtagcggtatcctttatgacactaataactgggaacatgtctttcagagatttgggccgagtcatggtgatggtcggggctacaatgacagacgacatcggcatgggagtaacatacctagcattacttgccgccttcaaagttcgcccgaccttcgcggcaggactattacttcgaaagttaacctcaaaagaactaatgatggctactattggtatagccttactttcccaaagtactatacctgagaccatcttagagttaaccgacgccttggctctaggtatgatggtcttaaaaattgtgcgaaatatggaaaaatatcagttggcagtaactataatggcgatttcatgtgtacccaacgctgtgatactacagaacgcatggaaggtgagctgcactatattggcagcagtgagcgtttcaccattgctcctgacatcatctcagcagaaagccgactggataccactagcattaactatcaaaggtctaaacccaactgccatcttcctcactacgctatcgaggaccagtaagaagcgaagttggcccttaaacgaagctatcatggccgtgggaatggtttccattctcgctagctctctattgaaaaatgacatcccaatgacaggtccgctagttgcgggaggtttattgacagtgtgctatgtcttaacagggcgttcagcggatcttgaactagagagggcgacggacgtaaagtgggaggatcaagctgagattagtggaagcagcccaatactatcgattacgatttcagaagatggttcgatgagtattaaaaatgaagaggaagaacaaacactgacaatactaattaggactggtttattggtaatatcaggattatttcccgtcagtataccgattactgcggcagcttggtatctctgggaagtgaagaaacagagagctggtgtactatgggacgttccaagccctccacccgtcggaaaggcagaattagaggacggggcatatcgcatcaaacagaaaggcatactcggatactcacagattggggctggagtttacaaagagggcaccttccacacgatgtggcatgtaactcgaggtgcagttttaatgcatcgaggcaaacgtattgaaccaagttgggctgacgtaaagaaagacctgataagctacggagggggatggaaactagaaggggaatggaaggaaggggaagaagtccaagtattagcacttgaacccggtaaaaatccacgcgcagtacagaccaaacctggattattcaaaacaaataccggaacaattggtgcagtgagtttagatttcagccctggtaccagcggaagtcctattgttgatagaaaaggcaaagtagtgggtttatacggaaatggagtagtaactagatctggtgcatacgtatcagcaatagcacagacggaaaaatctatagaagataatccagaaatagaagacgacatatttagaaagaagcgtctaacaataatggacctacacccaggagcaggcaaaacgaaaagatacttgcctgccattgtaagagaagcaattaaaagagggctgaggacccttatattggcccctacacgcgtagttgcagccgagatggaagaagcactacggggcttgccgatacggtaccaaactcccgccatacgagctgagcatacagggagagaaatagttgatttaatgtgccacgctacattcacgatgagattactttcacctgtacgagtaccaaattataacctaattataatggatgaagcacacttcactgatcctgcttcgatagcggctcggggatatataagcacacgtgttgaaatgggagaagctgcaggaatattcatgacagcgacacccccagggagtagagacccatttccacaaagtaatgcacctattatagacgaagaaagggaaattccagaacggtcctggagctcagggcatgaatgggttacagattttaaagggaaaacggtatggttcgttccgtctatcaaagccggtaacgatatcgctgcgtgtctaaggaaaaatggtaagaaagtgatacaactatcaagaaagacttttgatagtgaatacgtaaaaacaagaacaaatgactgggactttgttgtaacaactgacatatcagaaatgggagcaaacttcaaagctgaacgtgttatagaccctcgtcgatgtatgaagcctgtgatactaaccgacggagaagaaagggttatcttagccggtccaatgcctgtaactcattcgagcgcggcacaaagaagaggaagaataggcagaaatcccaaaaatgaaaatgatcaatacatctacatgggcgaacctctggagaacgacgaagactgtgcacattggaaggaagccaaaatgctgctagataatatcaatacacctgaagggattataccctccatgtttgaaccagaaagagagaaagtcgacgctattgacggagaataccgtttgaggggcgaggcacgcaaaaccttcgtagatttaatgagacgaggagatctaccagtatggctagcataccgagttgcggctgaagggattaactatgctgatagaaggtggtgtttcgatggtgtgaaaaacaatcaaatattggaagagaacgtcgaagttgagatatggacgaaagaaggtgagaggaagaaactaaaaccgcgatggttggatgctagaatctacagtgatcctttggcgctaaaagagtttaaagagtttgctgccgggagaaaatctttaaccctgaatcttataactgaaatggggagattacctacatttatgacacaaaaggctcgggatgcattagataacttagctgtattacatactgcggaagccggagggagagcatataaccatgcactttccgagctacctgagaccttagaaacactactacttctaactttactagcaacggtaacaggtggtatattcctcttcctaatgagcgggaaaggcgtgggtaaaatgacactaggaatgttttgcataataacagcttctatcctattgtggtacgcacagatacaacctcactggatagctgcatctataatattagagttcttcttaatagtactgttaattcccgaaccagaaaaacaacgaacaccgcaagacaatcaactcacgtacgtagtcattgctatcttaaccgtggttgctgctacaatggccaatgaaatgggtttcttagagaaaacgaagaaagatcttgggctaggatctatagctactcaggagccagaaagtaatattttagacatagacctgcgcccggcgagtgcctggaccctatacgcagtagcaaccacattcgtaacacctatgctaaggcactctatagaaaatagctcagttaacgtaagtttaacagcgattgctaatcaagctacagttcttatgggattaggaaagggctggccgttatcaaaaatggatatcggtgttccactcttagccatcggatgttactcacaagtcaatcccatcaccctcacagcagcgttattactcttaattgcgcattacgcaataatcggaccaggactccaggctaaggccacacgggaagcacaaaagagagcagctgcggggatcatgaagaacccaacagttgatggcataacagtaatagatctagatcctattccgtacgatccgaagtttgaaaagcaattggggcaggttatgctattaatattatgtgtcacgcaagtcctaatgatgagaacaacatgggcgctctgtgaagcacttactttagctacaggtccaatcagtacactttgggaaggtaatccagggagattttggaatactacaatagctgtttctatggctaacatattcagagggagttatttggctggtgcaggcctattgtttagcataatgaagaataccacaaacaccaggaggggtacaggtaatattggggaaaccttaggcgaaaagtggaaatccaggttaaacgctttagggaaatccgagttccagatctataagaaatcgggaatccaagaggtagatcgaacattagcaaaggaaggaataaaaagaggagaaacggaccatcacgccgtttctagaggttcagcgaaattgcgatggtttgtagaacgcaacatggtaacgcctgaaggaaaggtagtggatctcggatgcgggcgtggaggatggtcttactattgcgggggactgaaaaacgttcgtgaagtcaaaggactaacaaaaggaggaccagggcacgaagaacctataccaatgtcaacatatggatggaatctagttcgactgcaaagcggagttgatgtattcttcacaccgccagaaaaatgtgataccctactttgtgatatcggggaatcgagcccgaatcctactatcgaagcagggcgaacactacgagtactatctttagttgaaaactggttaaataatgatacccaattctgtatcaaagtcttaaacccatatatgccatcagtcatcgagaaaatggaaacgttgcaacgaaaatacggaggtgccttagtccgaaatccactcagcagaaattcaacacatgaaatgtactgggttagcaatgcgacgggaaacatagtgagtagtgtgaatatgatttccaggatgttaatcaatcgctttacaatgaaacataagaaagcaacttacgaaccagatgttgatctaggaagtggtactcgtaacataggaatagagagtgaaattcctaatttggatattattggaaaacgcatcgagaaaataaaacaagaacatgaaaccagctggcattatgatcaggatcatccatacaaaacttgggcttatcacggatcttatgagactaaacaaaccgggagtgcatcatctatggttaacggtgttgtcagattactgacgaaaccttgggatgtcgtacctatggtcacgcaaatggcaatgacggatactacaccgttcggtcagcaaagagtgtttaaagagaaggttgacacccggacacaggagccaaaagaaggaacgaagaagctaatgaagataactgcagaatggctatggaaagaactaggtaagaagaaaacaccacgtatgtgtacaagagaagagtttactcgaaaagtgagatcaaatgctgcattgggcgctatattcacggacgaaaataaatggaaaagcgccagggaagcagtcgaagactcgcgcttttgggaacttgtagacaaagagagaaaccttcatcttgaaggcaaatgcgaaacctgcgtttataatatgatgggcaaaagggagaagaaactgggagagtttggtaaagccaaaggatcgagagcaatatggtacatgtggttaggagcaagatttttagagttcgaagccttaggatttcttaacgaagatcattggttcagtcgcgagaatagcctaagtggtgtagaaggggaaggactacataaattaggatacatacttagggatgtgagtaagaaagaaggtggagcaatgtatgcagatgacacggcgggatgggacacgagaattacattggaagatttaaagaacgaggagatggtgactaaccatatggaaggagaacataaaagactggcggaggcaatattcaaacttacgtatcagaataaagtagtccgcgtgcaacgaccaacacctagaggaactgtaatggacataattagcagacgcgatcagcgaggttctggtcaagtagggacttacgggcttaacacttttacgaacatggaagctcaactaattagacaaatggaaggagaaggtatttttaaatcaatacaacatttgaccgtaacagaagaaatagctgtgcaaaattggctagcacgagtaggaagggaaagattaagcagaatggccatttcaggagatgattgcgtcgtaaagccattggacgatagatttgcatctgcactgactgcactaaatgacatgggtaaagtacgaaaagatatacaacaatgggaaccctctaaaggatggaacgactggacacaggtgccattctgttcccatcattttcatgaattaatcatgaaggacggacgtgtcttggtagtcccgtgcagaaatcaagacgaattaattggtagagcccgtattagtcagggagcagggtggagcctaaaagaaactgcatgcctcggcaaatcatacgcacaaatgtggagccttatgtactttcacagaagagatttgagattagcagctaacgctatttgctcagcagtaccgtctcactgggtccctacaagtagaaccacgtggtcaatccatgcaaaacatgagtggatgacgactgaggatatgttaacggtgtggaatcgtgtatggatacaagaaaacccatggatggaagacaaaactcctgtcgaaagttgggaagaggtgccctatttaggaaagcgtgaagaccaatggtgtggtagtctaataggccttacatcacgagctacttgggccaaaaacatccaaactgctataaatcaggtccggtcacttatagggaacgaagaatacacagactacatgccaagcatgaaacgttttagaagagaggaagaggaagctggggttttgtggtag

SEQ ID NO: 22672 - RNA, 9876 nt, synthetic construct
  misc_feature 1..9876: note = derived and/or modified CDS sequence (opt6) from DENV-2__EU482450__SS-prME
  source 1..9876: mol_type = other RNA
tcggcagggatgataataatgttaattcctacggtgatggcattccatttaactactcgtaatggtgaacctcatatgatagtaggcattcaagaaaaaggcaaatctctactatttaaaactgaagatggagtaaacatgtgtaccttgatggcaatggacttaggtgaattgtgcgaagacactataacttataaatgtccattattaaggcaaaacgaacccgaagacattgactgttggtgcaatagcacgtcaacctgggtcacatatggtacatgtacaacaacaggcgaacacagaagagaaaaacgatcggttgccttagtaccacacgtcgggatgggcctagaaacaaggactgaaacttggatgagcagtgaaggcgcatggaaacatgctcaaagaattgaaacgtggatactaaggcaccctggtttcacaattatggcagctattttagcatacactatagggactactcatttccaacgagtcttaatatttatattactaaccgcagtagcaccatcaatgacaatgagatgtataggaatttccaatagggatttcgttgaaggagtctctggcggttcgtgggtagatatagtactcgaacatgggagctgcgtaaccacaatggccaaaaacaaacccacactggactttgaactaataaaaactgaagcaaaacaaccagcgacattacgtaaatactgtattgaagcaaaattaacaaacacgactaccgaaagtagatgcccgactcaaggagaaccgtcactaaaagaagaacaagataaaaggttcgtatgtaaacattcaatggtagacaggggctggggaaatggctgcggtctatttggaaaaggtggaatagttacttgtgctatgttcacatgcaagaaaaatatggaagggaaaattgtacaacctgaaaatctcgaatatacaatagttgtaacaccccattctggcgaagaacatgcggtaggcaacgatacggggaaacatggacaagaaataaaagttactccacagtccagcataactgaagcagagctgacaggatacgggacagtaacaatggaatgctctccaagaacgggactagattttaatgagatggtactactgcaaatggagaacaaggcttggctagtacaccgacaatggttcttagatctacctctcccatggctcccaggcgccgacaaacaagaatcgaactggatacaaaaagaaacgctagttactttcaaaaacccgcatgcaaagaaacaggatgtagtggtgctcggatcacaggagggggcaatgcacacggcacttacgggggctacagagatacaaatgtcaagcggtaatttattatttaccggccaccttaaatgtcgcttgagaatggataaactacaactcaaagggatgagttactcaatgtgtaccggaaaattcaaagttgtaaaagaaattgcagaaacacaacatggtacgatagtaataagagtccagtatgaaggagacggatcgccatgcaaaataccatttgaaattatggacttagagaaaaggtatgtactcggacgattgatcactgtcaatccgatcgttactgaaaaagatagcccagtcaatatagaagcggaacccccattcggcgactcctatataataatcggagtagaacctggtcaattaaaacttaattggtttaagaaaggttcatccataggacaaatgtttgaaacaacgatgagaggggctaaaagaatggcaattttaggagacaccgcgtgggacttcggttctttgggcggtgttttcacgtccatcggaaaagccttacaccaagtgtttggtgcaatttatggtgcagccttttcaggggtaagctggacgatgaaaatactgataggggtgatcatcacatggattggaatgaactcaagatcgacaagtctaagtgtatctctagttctagtaggtattgtaaccctatatctcggagttatggttcaagcagactcaggttgtgttgtatcatggaaaaataaagagcttaaatgtggaagtggtatctttataacagacaatgtacacacatggacagagcaatacaaatttcagccagaaagcccgtctaagctagcatcagccattcaaaaagcacaagaagaaggcatttgcgggattcgttcagtcactaggttagaaaatctaatgtggaaacaaataacaccagagcttaatcacatattggctgaaaatgaggtaaaacttacaattatgacgggtgacattaaaggaataatgcaagcaggaaagagatcattacgcccacaacctacggaattaaaatactcgtggaaaacctggggaaaagctaaaatgttgtcaacagaatcctacaatcaaacattcttgattgatggaccagagacggctgaatgccccaatacaaatagggcttggaactcattagaagttgaggattacggtttcggcgtattcacgacaaacatatggctaaaattaaaagaaaagcaagatgctttctgcgattcaaaattaatgtcagctgcaataaaagataaccgagcggttcacgccgacatgggatactggatagaatccgcgctcaacgacacgtggaaaatagaaaaggccagttttattgaagtaaagaactgtcattggccaaaatctcatacgctttggtctaacggagttttggaaagcgaaatgataattcccaaaaatcttgcaggaccagtgtcacaacataactacagaccgggataccatacgcaaatcgccggtccatggcacttaggaaaattggaaatggattttgatttttgtgatggtacaacagtagtggtgaccgaagactgtggtaacagaggtccttccctaagaacaaccacagcatcaggaaaactaataacggaatggtgctgcagaagttgtacacttcctcccctgagatacagaggtgaagatgggtgttggtacggaatggagattagaccattaaaggaaaaggaagaaaacttagttaactcattagtaacagcaggacacggacaggtagataacttctccttgggagtactaggtatggcacttttcctggaagaaatgttacggacacgtgtgggaacaaaacacgccattctgctagtcgctgtatcattcgtgactctaattaccggaaacatgagtttcaaagatttaggtcgcgtggttgtgatggtgggcgcaactatgacagatgatattggtatgggtgtaacgtatctagcacttctcgctgcttttaaggtcaggcccactttcgcagcgggtttgctattacgcaaactcactagcaaagaactaatgatgacaactatcggtatagtcctacttagccaaagcgccatacccgaaacggttctcgagctgacagatgctttagccctaggcatgatggttttgaagatagtacgtaacatggaaaaatatcaactggctgtaactatcatggcaatactgtgtgttcccaatgcagtaatattacagaacgcatggaaggtatcctgtacaatcttagcagtagtaagcgtctctccacttctactaacaagcagccagcagaaaacagattggattccattagcactaaccataaaaggcctaaatccaactgctatctttctcacaacgctttctagaacaaataaaaagcgaagttggccgcttaatgaagcgattatggcagttggtatggtaagcatcttagcatcctcacttcttaagaatgacatccccatgacaggtccacttgtagctggcggtttgttaaccgtttgctacgtactcacgggaagatccgcagatctcgaattagaaagagcaacagacgtaaaatgggaggaccaagcagaaattagcggatcatcccctattttaagtattactatatcagaagatgggtcaatgtcaataaagaatgaagaggaagaacaaacgctaaccatactgatcagaactggactacttgtaatttctgggttatttcccatttcgatacccataacggctgcggcatggtatctatgggaggttaagaaacaaagagctggcgttctttgggatgtccctagtccaccaccaatgggaaaggctgaactagaggatggagcttaccgcataaagcagaagggcatcttggggtatagtcaaattggcgctggtgtatataaggagggcacatttcatacaatgtggcatgtaacaaggggagctgttttaatgcacaaaggaaaaaggatagagcctagttgggcagacgtcaagaaagacttaatatcatatgggggaggatggaaacttgaaggggaatggaaagaaggtgaagaagtacaggttttagccctcgagcccggaaagaaccctagagcagtgcagaccaaacctggactttttaagactaacacaggtactataggagcagtaagcctagatttcagtccaggaacatccggaagtcccataattgacaaaaagggtaaagtagtaggattatacggtaatggggtagtgactagaagtggcgcttatgtcagcgcaatagcgcaaacagaaaaatctatcgaagataatccagagatagaagatgatatttttaggaaaaggcggcttacgatcatggacctccaccctggagccgggaagacaaaaagatacctcccagcgattgtaagggaagccataaagcgtggtctaagaacactgatattagcaccaaccagggtggtagcagcagaaatggaggaagctctacgaggtctcccaatacgctatcaaactcccgctattagagcagaacacacgggacgagagatagtggaccttatgtgccacgccactttcacaatgagactactctcaccggttagagtacctaattacaatctcatcattatggatgaagcacattttacggacccagccagtatagcagcaagggggtatataagtacaagagtagaaatgggcgaagcagcaggaattttcatgacggcaacgccacctggatcccgcgatccatttccacagagcaatgccccaataattgatgaagagagagaaattccggaaagatcgtggaactcaggacatgaatgggtaacagattttaaaggcaaaacagtatggtttgttccgtcaatcaaagcgggtaatgacatagccgcatgtttaaggaagaatggtaagaaagtgatacaactctcaagaaaaacttttgacagtgaatacgtgaaaacgagaacaaatgattgggattttgtcgtcactaccgacatctcggaaatgggtgcaaactttaaggccgaaagagtaatagatcctaggaggtgtatgaagcctgttattcttaccgacggagaagagagggtaatactagcagggccaatgcccgtcacccacagctctgcggcgcaacggcgaggtcgaattggacgaaatccaaagaacgaaaatgatcaatacatatacatgggagagcctctggaaaacgacgaagattgtgcacactggaaagaagcgaaaatgttactcgataatataaacacccctgagggaataataccaagcatgtttgaaccagaacgagagaaagtcgacgctatagatggggagtacagactaaggggtgaggctagaaaaactttcgtggatttaatgaggcggggagatcttccggtctggctagcttacaaagtagctgctgagggaataaactacgcggaccgcagatggtgtttcgatggaatcaaaaacaatcaaatcttggaagagaacgtggaagttgaaatatggactaaggagggagaacggaaaaagctaaagccccgatggttggacgcgcgtatttactcagaccctctagcactaaaggaatttaaggagttcgcggccggtaggaaaagtttaacattaaaccttatcacagaaatgggaagacttccgacttttatgacacagaaaacccgggatgcactcgacaatttggctgtcttacacactgcggaagccggtggcagagcatacaatcatgccctaagtgaactccccgaaaccctagaaacacttctactattaacgctattagctacagttacgggtgggatctttctatttctgatgtcaggaagaggcattggcaaaatgacactaggtatgtgctgtattataaccgcaagtattttactatggtatgcacaaatccaacctcactggatagcagcatctataatattggagttcttcttaatagtcttgctgatcccagaacctgaaaaacagagaacaccacaagataaccaactaacgtatgtggttatagcaatcttgactgtcgttgcagctaccatggctaacgaaatgggctttcttgagaaaacaaagaaggaccttggccttgggtcgattgctactcaacaacctgaatcaaatatcctcgacatagatcttaggccagcaagtgcatggacgctatatgctgtagccactacattcgttactccgatgttacgacattcaattgaaaattcaagtgtaaatgtttcattaactgcaatagcaaatcaagccactgtcttaatgggcttggggaagggatggcctctctcgaaaatggatattggggtgcctttactagccatagggtgttatagtcaagtaaacccaattacattgacagcggcgttgttactattggtagcacactatgcaattataggacccggcttacaggccaaggccacgagagaggcacagaaacgggcagcagcaggaatcatgaaaaacccaacggtagatggtataacagtaatcgacctagatccaattccatatgatccaaaatttgagaagcagcttggacaagtaatgttattaattctatgcgtaactcaagttttaatgatgaggactacatgggcattatgtgaggccttaacattggcaacaggccctatctcaaccctatgggaaggcaaccccgggaggttttggaacactaccattgctgtaagcatggctaatattttcagagggagttacttggcaggagcaggattacttttctcaataatgaaaaacacaacaaacacgcgcagaggtacgggaaatatgggagaaactttaggagaaaaatggaaaagcagattgaacgccttaggaaaatccgagttccaaatatataagaaaagtggaatccaagaagtagataggactcttgcgaaggagggaataaaacgaggggaaactgatcatcacgctgtgtcaagggggtctgctaagctaaggtggtttgtcgaacgtaacatggtaactcctgaaggtaaagtagtagacttgggatgtggaagaggaggttggtcatattattgtggagggctgaagaatgtgcgagaagtaaagggactaactaaaggaggtccaggacacgaagaaccaattcctatgagcacatacggttggaatcttgtaagacttcaatcgggagttgacgtattctttattccaccggaaaagtgcgatactttactctgcgatataggagagtcgtcaccgaatccaacagtagaagcagggcgaacactaagagtgctaaacttagtggaaaactggcttaataataatacccagttctgtataaaagtgttaaacccatacatgcctagcgtaattgagaaaatggaagcattgcaaagaaaatatggaggggctcttgtcaggaatccgctaagcagaaattcaactcatgaaatgtactgggttagcaatgcgagcggcaacatagtctctagtgtgaacatgattagccgcatgctaattaatagatttactatgagacataagaaagcaacctacgaacctgatgtggatctcgggtcagggacacgtaatataggtatagaatctgaaattccaaacttagacataattgggaagagaattgagaaaataaaacaagaacatgaaacgtcatggcactacgatcaagatcacccgtacaaaacatgggcttaccacgggtcatacgaaaccaaacaaacgggatctgctagctcaatggtgaatggggttgttaggctacttaccaaaccatgggatgttctaccaacagttacgcagatggcaatgaccgatacaactccctttggtcagcagagagtatttaaagagaaggtagataccagaacgcaagagcctaaagagggtaccaagaaattaatgaaaattaccgcagagtggttatggaaggaacttgggaagaagaaaacgcccagaatgtgtaccagggaagagttcactcgcaaggtccgaagtaacgcagctctcggcgcgatattcaccgatgaaaataaatggaaaagtgctcgtgaagcagtagaagacagtagattttgggaactcgtggataaagaacgaaacctacacctcgaagggaaatgcgaaacatgtgtttataatatgatgggtaaacgtgaaaagaaattaggagagtttggtaaagccaaaggaagtagagcaatatggtacatgtggcttggtgcccgatttctggaatttgaagcactagggtttcttaatgaagatcattggtttagtcgggaaaattcactaagtggagtagaaggtgaaggtttacataaattagggtatatattgcgggatgtaagtaagaaagaaggtggagctatgtacgcagatgatacagccggatgggatactcgcataactctggaagaccttaaaaatgaagaaatggtaacaaaccatatggagggtgagcacaagaaattagcggaagccatttttaaattaacttatcagaacaaagtggtgcgtgtacaacgaccgacgccaagaggcacagttatggatattatttcgcgcagggatcagaggggctcaggacaagtaggtacttatggcctaaacacatttactaatatggaagcgcaattgattcgccaaatggagggggaaggggttttcaaaaacatccagcatttaactgttactgaagaggttgcggtaaagaattggttggcacgtgtcggaagggaacgtctatcacgcatggcaataagcggcgatgattgcgtagtgaagcctttggatgacagatttgctaacgcattgacagctctgaatgatatgggcaaaatcagaaaagatatacaacagtgggaaccaagtaagggatggaatgactggacacaggtaccgttttgtagtcaccactttcacgaacttataatgaaagatggtagagtgttagttgtaccttgtcgtaaccaggatgaactaataggtcgagctaggataagtcaaggagcaggatggtccttacgtgaaacggcatgtcttggcaagtcctatgctcaaatgtggagcctaatgtactttcataggcgcgatctacgtttagcggcaaacgcgatatgttcggcggtcccgtcacactgggttcccacaagtcgaacgacgtggtcaatacacgctaaacatgaatggatgactaccgaagacatgttaaccgtctggaatcgagtctggataagggaaaatccatggatggaggataaaacacctgttgaatcatgggaagaaatcccctaccttggaaaacgcgaagatcaatggtgtggatccctcatcggattgacttccagagcgacctgggccaaaaatatacaggcagcaatcaaccaagttagaagtctcattgggaatgaggaatatgcagactacatgccatcaatgaaacgattccggagagaagaggaagaagctggagtattatggtaa

SEQ ID NO: 22673 - RNA, 9876 nt, synthetic construct
  misc_feature 1..9876: note = derived and/or modified CDS sequence (opt6) from DENV-2__EU569721__SS-prME
  source 1..9876: mol_type = other RNA
tctgcgggaatgattataatgttaatacctactgtaatggctttccatctcactactcgcaacggagaaccacatatgatagtcggaatacaagaaaaaggcaaatcgttattattcaaaactgaagatggagtgaacatgtgtacgttaatggctatggatttgggggaattgtgcgaagacacaataacttacaaatgcccgcttttacgtcaaaatgaaccagaagacattgattgttggtgcaatagtacaagtacatgggttacatatgggacatgtacaacaacaggcgaacatagacgagagaaaagatccgttgctcttgtaccacatgtaggaatgggattagaaactagaacagaaacctggatgagcagtgaaggcgcatggaaacacgcccaacgcatagaaacctggattcttagacatcctggctttaccatcatggcggccatactggcatatacgataggcacgacgcactttcaaagagtgctaatatttatactcctaacagcagtcgccccatcaatgaccatgagatgtatagggattagcaatcgcgattttgttgaaggagtaagtggaggcagttgggtggacattgtacttgaacatgggtcatgtgtcacgaccatggcgaaaaacaaaccaacactagatttcgaattgatcaaaacagaagcaaaacaacctgctacattaagaaaatattgcattgaagcaaagctgaccaacacaaccactgaatcaagatgccccacacaaggagaacccagcttgaaagaagaacaggacaaacgatttgtatgcaaacattccatggtcgacagagggtggggaaacgggtgcggtttatttggcaaaggaggaatagtcacatgtgccatgttcacatgcaagaaaaacatggaaggtaaaattgtacaaccagaaaatctggagtacactattgtagtaacacctcattcaggggaagaacatgcggttggtaatgatactggaaaacatggacaggaaataaaagtgactcctcagtcaagtatcacagaagcggaactgactggatacggtacagtaaccatggaatgttccccacgaacaggtctggacttcaatgaaatggtgctactgcaaatggaaaacaaggcatggctcgtacatagacagtggttcctagatctgcctctaccctggttacccggcgcggataaacaggaaagtaactggatacaaaaggaaactttagttacattcaagaatccacacgcaaagaaacaagacgtcgtagtactgggaagtcaagaaggagccatgcatacggccctaacaggtgcaaccgaaatacagatgtcaagtggcaacctattatttacgggccacctaaagtgtagattaagaatggataaattgcaacttaagggaatgtcatatagcatgtgcaccggtaaatttaaagtcgtaaaagaaattgcagaaactcaacatggtacaattgtgatacgagttcaatacgaaggcgatggctccccatgtaagattccattcgaaataatggacctagagaagagatatgtacttggccgattgattactgtaaatcctattgtaacagaaaaagactcaccagttaatatcgaagccgaaccacctttcggtgattcatacatcattataggagttgaacctggtcaactaaaactgaactggtttaagaaaggtagctcaatcggacaaatgttcgagactaccatgagaggggctaaacgtatggcaatcttaggcgatacagcttgggactttggttcactcggaggggtttttacaagtataggaaaagcattacatcaagtatttggagcaatctacggagcggcattctcaggagtgtcatggacgatgaaaattcttataggtgtcatcataacatggattggtatgaactctcggtcaacaagcctatcggtctctttagttctagtcggtatagttacactttatttaggagtaatggtccaagcggattcaggatgcgtagtaagttggaaaaataaagaattaaagtgcgggtcgggtatattcattactgacaacgtccatacttggacagaacaatacaaattccaacccgaaagtccttcgaaacttgcatcagcgatacaaaaagcacaagaggagggtatatgtggaattagatcagttacgagacttgaaaacttgatgtggaaacaaataactccagaactaaatcacatactggcggaaaatgaagtaaaacttacgatcatgactggagatataaaagggataatgcaagcaggtaagcgaagcctacgtccacaacctaccgaacttaaatactcttggaaaacctgggggaaagcaaaaatgttaagcactgaaagctataaccaaacattccttattgacgggcctgaaacggcagagtgccccaacaccaaccgtgcttggaactcattagaagtagaagattatggattcggtgtatttactacaaatatttggctcaagctaaaagaaaaacaagatgctttctgtgattcaaaattgatgtcagccgcaattaaggacaatagggcagtccacgcggacatgggctactggattgaaagcgcgctaaacgatacatggaaaatagaaaaagcgtcattcatagaagtgaagaactgccattggccgaaaagtcataccctatggtctaatggagtcctagaatctgaaatgataatccccaaaaatctagcaggtcccgtttcacaacacaactaccgcccaggatatcatacccagatagcaggtccctggcatcttggaaagctcgaaatggactttgacttttgtgatggaacaaccgtaatcgtcaccgaagactgcggcaacagaggtcccagcctccgaaccacaacggcatcaggaaaattaatcactgaatggtgttgcagatcatgcaccctacctccactaagatacagaggagaggatggctgttggtacggtatggagataagaccgctgaaagagaaagaagagaatctagtaaacagtctagtaacagccggccacggacaggtagacaacttctctttgggtgtattaggaatggccctattccttgaggagatgttaagaaccagagtaggtacaaaacatgctatacttctcgttgcagtgagtttcgtaactttgatcacaggaaatatgtcttttaaagatttagggcgggtcgtcgtgatggtaggcgcaacaatggcagacgacatcggaatgggtgttacgtacttagctttgttagcagcattcaaagtgcgaccaacatttgcagctgggctcctgcttagaaaactcacttcaaaagaactgatgatgacaacaataggtatagtattactaagccaatcaactatccccgagacggtgcttgagttaacagacgcattagctttaggcatgatggtattgaaaattgtacgcaacatggaaaaatatcaactagctgttaccattatggcaatactatgcgtcccaaacgcagtcatattacaaaatgcgtggaaagtctcgtgtaccatacttgcagttgttagcgtaagtcccctattgttaactagctcacaacagaagacagactggataccattagcattgactattaagggcttgaatccaacagctattttccttacaactttatcacggacgaacaaaaagcgatcttggccattaaacgaagctattatggcagtaggtatggtatcgatattagcgtcaagtctacttaaaaacgacatacccatgaccggtccgcttgttgccggtggtttactaactgtctgttacgttttaacagggagaagtgcagatttagaattagaaagggcaacagatgtgaaatgggaggatcaagccgagattagtggtagtagcccgattttgtctatcacaatttcagaagacggtagtatgagtatcaaaaatgaagaagaagaacaaacattaacaatactgatacggactggacttcttgtcattagtgggctattccctatatctatcccaattactgccgcagcctggtacctttgggaggttaagaaacaaagagccggagtattatgggacgtcccaagcccactaccgatgggaaaagcagaacttgaagatggggcatacagaataaaacaaaagggaatattaggatacagtcaaataggcgccggcgtgtataaagaaggaacattccacacaatgtggcatgttaccagaggcgcagttctaatgcacaaaggtaagcgaattgaaccaagttgggccgacgttaagaaagatttaatttcatatggtggagggtggaaattagaaggtgaatggaaagaaggggaggaagtacaggttttagccttagaacctggcaaaaatccgcgagcagtccaaacaaaaccaggactttttaaaaccaatactgggactatcggcgcagtttctcttgattttagtcctggaaccagcgggtctccaataatagataaaaagggcaaagtagtaggtctttatggtaatggcgtagttacaagaagcggagcgtatgtgtctgctattgcacagactgagaaaagtatagaggataatcccgaaatagaagatgacatattccgtaaaaagcgcttgacaataatggaccttcacccaggcgcggggaaaactaagagatatcttcctgctatagtacgagaagcgataaaaagagggcttagaacgttgatactagcgcctacaagggttgtagctgcagaaatggaagaagcgctaagaggattgccaataagatatcaaacgcctgccatcagagccgagcacacagggagggagatcgtagacctcatgtgtcacgccacttttacaatgcgtctactgagtccagtacgtgtaccgaactacaatcttataataatggatgaagcacactttacggacccagcttccatagcggcaaggggttacatttcaactcgagttgaaatgggagaagccgctggtatcttcatgacagcaaccccaccaggatcacgtgacccatttcctcaaagtaacgcaccaataatagacgaagagagggagatacctgaacgctcttggaactctgggcatgagtgggtgactgacttcaaaggaaagacggtctggtttgttcctagtattaaagcagggaatgatatagctgcttgcctgaggaaaaatgggaaaaaggtgatacaactaagcaggaaaacattcgatagtgaatatgttaaaaccagaacgaatgattgggacttcgttgtaaccactgatattagtgaaatgggggcaaattttaaagccgaacgtgtgatagacccgagacgctgtatgaaaccagtaatattgacagatggtgaagagagagtcattctcgcaggtccaatgccagttacacactcatctgctgcacagcgacgaggaagaataggaagaaaccccaaaaatgaaaatgatcaatacatctacatgggtgaaccattagaaaatgacgaggactgtgcacactggaaagaagcaaaaatgttactagataacataaacacacccgaaggaataataccctccatgtttgagccagagcgggaaaaagtagacgcgattgacggggaatatagacttcgaggagaggcaaggaaaacatttgtagacctaatgagacgtggagatcttccagtttggttagcatataaagtcgcagccgaaggcattaactatgccgatagacgatggtgttttgatggcataaagaataatcagatactagaagaaaatgttgaagtagagatctggacgaaagaaggagaacggaagaaattgaaaccaaggtggttagacgctcgaatatacagtgacccattagctttaaaggagttcaaagagttcgctgcagggcggaaatccctaacattaaatttgatcacagaaatgggaagattacctacattcatgacgcagaaaactagggacgctctcgataacttggcagttctacatacagccgaagcaggaggacgtgcatataaccatgccctgtcagaattgccagaaacactagaaacactactcctattaacactgttagcgacggtaacaggaggtatattcctattcttaatgtcaggacgaggaattggtaaaatgacattaggtatgtgttgtattattacagccagtattttattatggtacgcgcaaatacaaccacattggatcgcggcatcgattatacttgagttctttttaattgtcttactaataccagaacctgaaaagcaacggacacctcaagataaccagttaacctacgtagttatagcaatcttgacggtagtagcagccacaatggccaatgaaatgggatttttagaaaagacaaagaaggatttagggcttggtagcatagcaacccaacaacccgaatcgaatatcctagatattgacctacgtcccgcatctgcatggaccctatacgcagtcgcgacaacattcgttactcccatgttgaggcactcgatagaaaactctagcgttaatgtatcgttaacggctatagcgaaccaagcaactgtattgatggggctcggcaaaggatggccattatccaaaatggatataggagttccgctgttggcaataggttgttacagccaagttaatccaatcacactaactgctgccctactattacttgtcgcacactatgcgattataggtccaggtctacaagcaaaagcaacccgcgaagcacaaaagagagcggccgctggaatcatgaaaaatccaaccgtggatggcattacagttatcgacctggacccaattccctatgacccgaaattcgaaaagcagttgggacaagtcatgcttcttattctatgtgtcacacaagtattaatgatgcgcacgacgtgggcattgtgcgaggcattaacactggcgactggaccaatatcaactctatgggagggtaacccaggtagattctggaacacaacaatagcagtatcaatggcaaacattttccgtggaagttatctagcgggagctggactcctattttcaattatgaaaaatactactaatacacgaaggggaacaggtaacatgggagaaacgctcggtgaaaaatggaaatcgaggctgaacgccctgggcaagtctgagttccaaatatataagaaaagcggaatacaagaggttgaccgaacattggcgaaagaggggattaaaagaggggaaactgaccatcacgcggtatctaggggatcagctaaattacgttggttcgtggaacggaacatggtgacccctgaaggtaaagtagtcgacttagggtgtgggcgtggcggatggtcatattactgcggcgggcttaaaaacgttagggaggtgaaaggactgactaaaggaggtccaggacatgaggagcctataccaatgagtacatatggttggaatttggttcgacttcaaagcggagtagacgtatttttcataccgcccgagaaatgtgatacactgctttgtgacataggcgaatcttcacccaatccgacggtagaggcaggcagaaccttacgcgtattaaacctcgtagaaaactggctaaacaataatacacaattttgtataaaagtattgaatccatacatgccctcagtcattgaaaagatggaagcattgcaacgcaaatacggaggagcgttagtgagaaatccgctgagtcgcaattccacacatgaaatgtactgggtgtccaatgcttcaggtaacatcgtatcgtcggtaaacatgatatctcgcatgttaattaatagatttacaatgagacacaaaaaggcaacctacgaacctgatgtagacttaggcagtgggacacgaaatattggaatcgaaagtgagacacctaatctggatatcatcggaaaaaggattgaaaagattaaacaggaacatgaaacaagttggcactatgaccaagatcatccttacaagacttgggcatatcatgggtcatacgagaccaagcaaacggggtcggcaagtagtatggtcaacggcgtcgttaggttattgactaaaccatgggatgttttacccacagtcacccagatggcgatgacagacacaaccccttttgggcaacaacgagtattcaaagagaaagtggatacacgaactcaggagccgaaagaaggaaccaagaaactgatgaaaatcactgcagaatggctatggaaagaacttggcaaaaagaaaacacccagaatgtgcacacgcgaagaatttactcgaaaagtacgctcgaacgccgctttaggagctatatttacagacgaaaataaatggaaaagcgcaagagaggctgtagaagactcccgcttttgggagttagtagacaaagagcggaatcttcacctagaaggtaaatgtgaaacatgcgtgtacaacatgatgggcaaacgagagaagaaactaggagaatttggaaaagctaaaggatcccgcgctatatggtacatgtggttaggggctagattcttggaatttgaagctctgggattcttaaatgaagatcactggttttcgagggaaaatagtctatccggcgttgaaggcgaaggtttgcacaaattaggatacatcctaagagatgtgagtaagaaagaagggggagcaatgtacgcggatgacaccgccggctgggatacgcgcatcaccctagaagatctcaaaaatgaggaaatggtaaccaaccatatggaaggggaacacaagaaactagcagaagcaatatttaaactaacttaccaaaataaggtcgtccgtgtccaaaggcctacgccacgcgggacggtgatggatattatatcacgcagggaccaaagaggatcagggcaagttggtacctacggacttaatacatttacaaatatggaagctcaattaatcagacaaatggaaggagaaggggtctttaaaaatatccaacatcttactgtgactgaagaggtagcagtgcaaaattggctagcacgagtaggacgggaaagattatctcgaatggcaatttcaggggatgattgtgtggtaaagccccttgacgaccgctttgctaacgcattaaccgcccttaatgatatgggaaagatccgaaaagatatacagcaatgggagcccagtaagggttggaatgattggactcaggtacctttttgctcgcatcatttccatgaactaataatgaaagatggacgagttctcgtcgtcccatgtcgaaatcaagatgaattgataggacgagccagaataagtcaaggagccggatggtcgcttagagaaaccgcatgccttgggaaaagttacgcgcaaatgtggtcgttaatgtacttccatcgacgcgacttgaggttagctgctaatgctatctgttccgcagtcccttcacactgggtccctacatcacgcaccacatggtcgattcacgcaaaacatgaatggatgaccaccgaagacatgctcaccgtatggaatcgggtatggatcagagaaaatccctggatggaggacaaaactcctgtagaatcatgggaggaaattccatatttgggtaaacgtgaagaccaatggtgcggttcattaattggactaacaagtagggctacgtgggccaaaaacattcaagccgcaataaaccaagtaagaagtttgattggaaatgaggaatacacagattacatgcccagtatgaaacgattccgtagagaagaagaagaggcaggcgtactgtggtga

SEQ ID NO: 22674 - RNA, 9876 nt, synthetic construct
  misc_feature 1..9876: note = derived and/or modified CDS sequence (opt6) from DENV-2__EU482451__SS-prME
  source 1..9876: mol_type = other RNA
tcagctggaatgatcataatgcttataccaacagttatggcatttcacctaacaacacgaaatggagaacctcatatgatagtaggtatacaagaaaaagggaaatctctcctttttaaaacagaagacggcgtaaatatgtgcacgcttatggcgatggacctcggagaattatgtgaagacactattacttataaatgtccattgttacggcaaaatgaaccagaagatatagactgttggtgtaatagcacatcaacatgggttacctacggtacatgcacaacgactggggaacacaggcgcgagaaaagatctgtggccttagtacctcatgttggaatgggcttagaaacgagaaccgaaacctggatgtcttcggaaggtgcctggaaacacgcgcaaaggatcgaaacgtggatcttgcgacacccaggatttacaattatggcagcgatcttagcatataccattggaactacccattttcagagagtcctaatatttatcctcctaacagctgttgcaccatcaatgaccatgcgctgcattgggatatcaaatagagactttgttgaaggggtaagtggaggaagttgggtggatatagtgctcgaacatggatcatgtgtcacaacaatggctaaaaataaacctacattggactttgaattgataaaaactgaagcaaaacaacccgccacacttagaaaatattgtattgaagcaaaattaaccaatacaaccacagaaagtaggtgtccgacgcaaggagaaccgtccttgaaagaagaacaagacaaaagatttgtatgcaaacatagcatggtagatagagggtggggcaatggttgcggactatttggaaaaggcggaatcgttacttgtgccatgttcacatgcaagaaaaatatggaaggaaaaatagtacaacctgaaaatttggaatatactattgtggttaccccgcacagtggagaagaacatgcagtagggaatgatactggtaaacatggtaaagaaattaaagtgacaccccaatcatcaataaccggagccgaattaaccggatatggtacggtgacgatggaatgttcgccccgaacaggtctagatttcaacgaaatggtgcttttacaaatggaaaacaaagcatggttagtacaccgacagtggtttcttgatttacccctaccatggctaccgggagctgacaaacaagaatctaattggatacagaaagaaacattagtgacatttaaaaacccccacgccaagaaacaagacgttgtggtattaggaagtcaagagggagccatgcatacagcattgacaggcgccacggaaatacagatgtcaagcgggaaccttttatttacagggcatttaaaatgtaggttaaggatggataaactacagctcaaaggaatgtcatacagcatgtgcacgggtaaattcaaagtcgtcaaagaaatagctgagactcaacacgggacaatagtgattagagtacaatatgagggggatggaagtccgtgtaaaatccctttcgagattatggatctcgagaaacgctatgtgctcggaagattaattactgtaaatccaatcgtcacagaaaaagactctccagtaaacatagaagctgaaccaccttttggcgactcatatatcatcatcggtgtggaaccgggccaactaaaattaaattggttcaagaaaggatcgagtattgggcagatgtttgaaactactatgagaggagcgaaacgtatggcaatcttaggggacacagcctgggattttgggtccttaggaggagtattcacaagtataggtaaggcacttcaccaagtctttggggcgatttatggtgccgctttctcgggcgtaagttggaccatgaaaatactcataggcgtgattataacatggattggcatgaacagccgatccacaagtctttcagtaagtttggtgcttgttggaatagtaactctctatctgggcgtgatggtgcaagctgattcaggctgtgttgtttcatggaagaataaggaactcaaatgtggctctgggatatttgtgacagataatgtacatacatggactgaacaatataaatttcagccagaatcaccatcaaaattagcatccgccatccaaaaagcacaagaagaaggaatatgcggaatccggtctgtaacacgactagaaaatttgatgtggaaacaaataacgccagaattgaatcacatactggctgaaaatgaagtaaaattaaccatcatgacaggcgatataaaaggtattatgcaggctggaaaacgcagtttaagaccacagccgacggaacttaaatattcttggaaaacctggggcaaggcaaaaatgctgtcaacagaaagttacaaccaaactttcctaatcgatggcccagagacagcagaatgtccgaacacaaatagggcatggaactcgcttgaagtagaggactatggatttggtgtgtttacgactaatatttggctcaagttaaaagaaaaacaagacgcattctgtgacagtaagttaatgtcggcagcgataaaagacaatagggcagttcacgcggatatgggctattggatagaatctgcactaaacgacacatggaaaattgaaaaagcgtccttcattgaggttaagaattgtcattggccaaaatcacacactctatggagcaacggagttcttgaaagcgaaatgatcattcccaaaaaccttgcgggccctgtatctcaacataattatcgacccggatatcatacccagatagctggaccttggcatttaggaaagctggaaatggatttcgatttttgcgacggtacaacagtaatagtcaccgaggattgcggcaatcgaggtccttcattaagaactacaaccgcgtcaggtaaattaatcacggaatggtgctgtcgaagctgtacactcccaccactccgctaccgaggagaagatggatgctggtatggaatggagataagaccactaaaggaaaaagaggagaatttagtaaactctctagtgaccgcaggacatggccaagttgacaacttttctctgggagtcttgggcatggctttgtttttagaagaaatgctaaggacgagggtaggcacaaaacacgcaatattattggttgcggtgtccttcgttactttaattactggaaacatgagcttcaaggatttaggccgtgtagtagtaatggtaggggcaactatggccgacgatattggaatgggcgttacttatttggctctgctggcagccttcaaagttcgtccaacattcgctgcgggattactccttcggaagttaacaagtaaggaactaatgatgacaacgattggaatagtcttactatcacaatcaacaattcctgaaacagtgttagagttaacggacgcgttagcacttgggatgatggtgttaaaaatagttcggaatatggaaaaataccagttagcagttacaattatggctattttatgcgtccctaacgctgtaattctccaaaatgcgtggaaagtcagctgtacaattttggctgtagtttcggtttcgccacttttactaacttccagtcaacagaaaactgactggataccactggcgctaacaatcaaaggtctaaatccaacagcaattttcttaactacacttagcaggactaataagaaaaggagttggcctttaaatgaagcaattatggctgttggaatggtttcgatattagcatcatcattactgaaaaacgatatacctatgactgggcctctagtagcaggaggcttgttaactgtatgttatgttcttacagggcggtcggcagatttagaactggaacgggccacagacgttaagtgggaagatcaagcagaaatatcgggatcgtctccaatactaagcattaccatatcagaggatggaagcatgtcaataaagaatgaagaagaagaacaaacgctgacaattctaatacgaaccggtctcctagttatttccggtcttttcccgataagcatacccataacagcagcagcttggtatttgtgggaggtcaagaaacaaagagccggcgtgttatgggacgtaccttctccaccgccgatgggcaaagctgaattggaagatggagcttatcgtattaagcaaaaagggattctaggatatagtcaaattggagcaggagtctacaaagaaggaacgtttcataccatgtggcacgtgacaagaggggcagtcttaatgcacaaaggaaagcgcatagaaccatcgtgggcagatgtgaagaaggacttgataagctatggtggaggttggaaacttgaaggggaatggaaagaaggtgaggaggtacaagtcttggctctagaaccaggaaagaacccaagagctgtacagacgaaaccaggactattcaaaacaagtactggcacaatcggcgcagtaagtttagatttctcgcccggaacttcagggagtccaattattgataagaaaggcaaagtagtgggactatatggaaacggcgtagttacacgcagcggcgcctatgtgtccgcaatagcacaaacggagaaatcaatagaagataaccccgagattgaagacgatatttttagaaaacgtcgcttaactataatggacttacaccctggagccggcaaaacgaaaaggtatttaccggcaatagttagggaagcaattaaacgggggctaagaacattaatcttggcaccgacgcgggtagtcgcagctgaaatggaagaagccttgcgagggctaccgatcagataccagacgcctgcaataagagcagagcataccggtagagaaatagttgaccttatgtgccacgccacctttacaatgagattactatcacctgttagagttccgaactataatttaattattatggatgaggcacatttcacagaccccgcatctattgcagcgagaggttacatctcaacacgagtagagatgggagaagcagcagggatctttatgactgcaacaccacctggaagcagggacccgttccctcaaagtaatgcacccataatcgacgaagaaagagagatacccgaacgttcctggaatagcggccacgaatgggtgacagactttaagggtaaaacagtatggttcgtaccatctatcaaagctggcaacgacatagctgcatgtctaaggaaaaacggcaagaaagtaattcaactatccagaaagacatttgatagtgaatatgtaaagaccaaaacgaacgattgggattttgttgtaacaactgatataagtgaaatgggggctaactttaaagccgaacgggtaatagatcctagacgatgcatgaagcccgtgatcctaaccgatggagaggaaagagtgatactagctggtccaatgccagttacccattcatcagccgctcagaggaggggaaggattgggcgaaaccctaaaaatgaaaatgatcaatatatatacatgggtgagccactggaaaatgatgaagattgcgctcattggaaagaagccaaaatgctcttagacaacatcaacacgccggaaggtatcataccgtctatgtttgaaccagagcgagagaaagtcgatgcgatagatggagaataccgattaaggggagaggcaaggaaaactttcgtggatttgatgaggaggggcgatctacctgtatggctagcatataaggtcgcagcggaaggaataaattatgctgatagaaggtggtgtttcgacggaataaagaataatcaaattctagaagagaatgtagaagtggaaatttggaccaaggagggtgaacgaaagaaattgaaacccagatggttagacgctcgaatttattctgacccgttagcgcttaaagagttcaaggaatttgcagcaggaagaaaatcactaactctaaacctcataacggagatgggacgacttccgacattcatgacacagaaaacaagggatgcattggataacttggctgtgttacatacagcggaagcgggaggacgtgcgtataatcatgccttgtccgagcttcccgagaccttagaaacattactactactcactttactggctacggtaactggaggtatcttcctatttttaatgtcgggtcgaggcattggaaaaatgacattaggtatgtgttgtataataactgctagcatactattgtggtacgcacaaatacaaccacactggatagcagcgtcaatcatactagagttctttttaatagtcctacttatacccgaaccggaaaagcaaaggacaccccaagataatcagctcacgtatgtagtaatagcaattttaacagtagtagctgcaactatggcaaacgaaatggggttcttagaaaagactaagaaagacttaggattagggtcgatcgcgacacaacaaccagaatccaatatccttgatatagatctaagacctgcaagtgcttggacactatacgcagttgcaactacctttgttacgccaatgttacggcatagtatagaaaactcttcagtcaatgtttcactcactgctatagctaaccaggcaacagtattaatgggactcggaaaaggctggccactcagcaaaatggacataggcgtgcccttattagcaatcggctgttattctcaagtcaaccctataacattgactgcagccttgttactcctagttgcacactatgcgataataggacccggcttacaagcaaaagccaccagagaagcacaaaaacgagctgctgctggaataatgaaaaacccaacagttgatgggatcactgtaatcgatctagacccaatcccttatgaccccaaattcgaaaaacaattagggcaagttatgttgttaatcttatgcgtaacgcaagtattaatgatgagaactacatgggccctatgtgaggcgctaactttagccactggcccgatatcgactctatgggaaggaaacccgggaagattttggaatacaacaatagctgtctcaatggcaaacatatttagagggagttacctagcaggagcaggactcctattctccataatgaaaaataccactaacacaagaagaggcactggcaatataggtgaaacattaggtgaaaaatggaagtcgagattaaatgcattaggaaaatctgaatttcaaacatataaaaagtcaggcatacaagaagtcgatagaacgttggcgaaagagggtatcaagcgcggtgaaaccgatcatcatgcagtttcaagaggaagcgcaaaattacgctggttcgtagaaaggaatatggtaacccccgagggtaaggtagtagatcttggctgtggtcgtggagggtggagttattattgtgggggtttaaagaatgtgagagaagttaaaggactgacgaaaggcggccctggacacgaagaacctataccaatgtccacatatgggtggaacttggtacgactgcaatcgggagtggatgtgttcttcatacccccagaaaaatgtgacacgttactatgtgatatcggtgaaagttctccaaaccctacagtagaggcgggcagaacccttagagttctaaatttagtagagaactggttaaataacaacacacaattttgtataaaagttttaaatccttacatgccaagtgtaatagagaaaatggaagcactacaacgtaagtacggaggagcgttagtgcgaaatcctttgtcaaggaatagcactcacgaaatgtattgggtatcgaacgcgagcggcaatattgtttcgagtgtaaatatgataagcagaatgcttataaatagatttacaatgcgacacaagaaagctacatacgaaccagatgttgatctaggaagtggaacccgtaatattgggaatgaatccgaaattcctaacttagacatcataggcaaaagaattgagaaaattaaacaagaacatgaaacttcatggcactatgatcaagatcatccttacaaaacatgggcgtaccacggatcttacgagactaaacaaaccggcagtgcaagttccatggttaacggggttgtacgactgttgacaaaaccatgggatgtcctccccacagtaacccaaatggcaatgaccgacacaacccctttcggtcaacagagggtgtttaaggaaaaagtagatacccgaacccaggaacccaaagaaggaaccaagaaattaatgaaaatcactgcggaatggttatggaaagagttaggtaagaagaagactccacgaatgtgcacaagggaggagtttacccgcaaagtccgctcgaatgcagcacttggagctatattcacggatgaaaataaatggaaaagcgcccgagaagcagtagaagatagtcgattttgggagctagttgacaaggaaagaaatctccatctggaaggcaaatgcgaaacttgtgtctacaacatgatggggaaacgagagaagaaattgggagaatttggaaaagcaaaaggatccagagcaatttggtatatgtggttaggtgctagatttctggaatttgaagcgcttggatttctcaatgaagatcactggttcagcagggaaaatagcttaagcggggttgagggagaggggttgcacaaactaggatatatactaagagatgtaagcaagaaagaaggcggggcgatgtatgctgacgatacagctggttgggatacaaggatcactctggaggatctgaaaaacgaagaaatggtaacaaatcacatggaaggtgaacataagaaattagccgaagcgatattcaaattaacctatcaaaataaagtagttagagtacaacgccctacaccgagaggaacagtgatggacattatttcccgacgagatcagagaggatcaggacaagtgggaacatacggcttgaacacctttacaaatatggaggctcaactcatacgacagatggagggagaaggcgttttcaaaaatattcagcacctaactgtgacagaagaagtggccgtccaaaactggctggcacgcgtaggccgagaacgtctaagtaggatggcaatatcaggggatgattgtgtagttaagccactcgatgatagattcgcgaacgctctcaccgcattaaatgacatgggaaaaatcagaaaggatattcaacaatgggaaccctcaaaagggtggaacgattggactcaagtgccattctgcagccatcattttcatgaactaataatgaaagatggcagggttctagtcgtcccttgtagaaatcaagatgaacttataggtcgcgcccgtatctcacagggagcaggttggagtctgagagaaaccgcctgtttgggtaaaagttacgcacagatgtggtccttgatgtatttccacaggagggatttgagattagcagctaatgctatatgcagtgctgtaccctcgcattgggtcccaacgtcgcgtactacatggagtatccacgcgaaacacgaatggatgactacagaagatatgctgacggtgtggaaccgagtttggatcagagaaaacccctggatggaagacaaaacccctgttgaaagttgggaagaaatcccatatttgggtaagagagaagatcaatggtgcggtagtcttattggcctgacttccagggccacatgggcaaagaatatacaagtggcaataaaccaggtcaggtctttaattgggaatgaagaatatactgattatatgcctagcatgaaaagattccgaagagaagaagaagaagctggtgtactatggtaa

SEQ ID NO: 22675 - RNA, 9876 nt, synthetic construct
  misc_feature 1..9876: note = derived and/or modified CDS sequence (opt6) from DENV-2__EU660413__SS-prME
  source 1..9876: mol_type = other RNA
agcgcaggaatgataataatgctaattccgacagtgatggcattccatctaacaacaagaaacggtgaaccacacatgatagtagggatacaggaaaagggcaagagtctactcttcaagacagaagacggcgtaaacatgtgcacactaatggcgatggacttgggtgaactctgcgaagatacaattacttataagtgtccactacttcggcaaaacgaacctgaggacatagactgctggtgcaattcaacctcaacatgggtgacctatggaacttgcacgacaacaggagaacatcgaagagaaaaaagaagcgtagcacttgttccccacgtcggtatgggactagaaacacgtacggaaacttggatgagttcagaaggtgcgtggaaacacgcccagaggatagaaacgtggatcctaagacatccgggctttaccataatggcagcaatattagcgtatacaatagggacgacacatttccaaagagtgctaatatttattttgctgacagcagtcgccccatcaatgacgatgcgatgtataggaatctcaaatcgtgactttgttgaaggagtctcaggggggagttgggttgacattgtgttagagcatggctcatgcgttactacgatggcgaagaacaaaccaacactagattttgaactaattaaaactgaagcgaaacaacccgcaacccttaggaagtactgtatagaagcgaaactaacaaatacaacaacggaaagtcgttgcccaacacagggagaaccgagtttaaaagaagaacaagataaaagatttgtttgtaaacacagtatggtggacagaggatggggcaatggttgcggcctatttgggaaaggcgggatagtcacatgcgccatgttcacctgtaaaaaaaacatggagggaaagattgtacaaccagaaaatctcgagtacactatcgtagtcacgccacactcaggtgaagaacacgcggtgggaaacgacaccggaaaacatggaaaggaaattaaggtcacaccgcagtctagtatcaccgaagcagaacttacgggatatggtactgtgactatggaatgtagcccaagaacaggttttgattttaacgagatggtattactccaaatggagaataaagcgtggctggttcacagacaatggttcctagatcttccgcttccatggctcccgggagctgacaaacaggagtccaattggatccaaaaagaaaccctagtcacttttaaaaaccctcatgcaaaaaaacaagacgtagttatattagggtcacaagagggtgcgatgcatactgcattaacaggagccacagaaatacaaatgtcgtcgggtaatttattattcactggccacctcaaatgccgtttgcggatggacaagctacaacttaaaggaatgtcgtattccatgtgtactggtaaatttaaggtagtaaaggagatcgccgagacccagcacgggactattgttatccgggtacaatacgaaggagatggttcgccttgtaaaattccgttcgagatcatggatttggagaaaagatatgtactaggccgacttattacagtcaatcctattgttactgagaaggacagcccagtgaacatcgaggcggaacccccattcggtgattcatatataataataggtgttgaaccgggccaactaaagcttaattggttcaagaaaggaagttctataggtcaaatgttcgagactactatgcgaggagctaagagaatggcaatactgggtgatacagcatgggatttcggatctttaggtggagtctttacctctataggcaaagctttgcatcaagtttttggagccatatacggtgctgcattttccggcgtttcctggacaatgaaaatacttataggtgtcattataacctggataggtatgaactcccgttcgacgtcattatctgtttctttagtactggttggtatagtcacattatatctgggcgttatggtccaagcagattcaggatgtgttgtaagttggaaaaataaagaactaaaatgtggcagcggaatctttattactgacaacgttcatacatggactgagcaatataaatttcaacctgaaagtccgtcgaaacttgcatcagcaattcagaaagcgcaggaagaaggcatatgtggtatacgaagtgtcacaagattggaaaatttaatgtggaaacagataacgccggaattaaatcatattttagctgaaaatgaagttaaacttaccattatgactggcgatataaggggaataatgcaagctggaaaacgaagcctaaggccccaacccactgaacttaaatactcatggaaaacctggggtaaagccaaaatgctatccactgaatcttacaatcaaacctttcttatagacggtcctgagacggcagaatgtccgaatactaatagagcatggaatagtctagaagtagaagattacggatttggagttttcacaacaaatatatggttgaaacttaaagaaaaacaggacgccttttgcgattctaagctaatgtctgctgcgatcaaagacaacagagcagtacatgctgatatgggatactggattgagtcagcgctcaatgatacttggaagatcgagaaggcatctttcatagaagtaaaaaattgtcattggccaaaatctcacacattatggtctaatggcgtcctggaatccgaaatgatcatcccgaaaaacctagccggtccagtgagccaacataactacagaccaggttatcatacgcagatagccggcccctggcacttaggcaagcttgagatggattttgatttctgtgacggtacgactgtgatagtgacagaagattgtggaaacagaggtccctccttacgaacgacgacagcttcaggcaaattaatcacagaatggtgctgccgatcatgcacactcccacctttaagataccgaggcgaagacggatgctggtacggcatggaaataaggcccctcaaggaaaaagaggaaaacttggtaaatagcctggttacggctggccatggacaagttgacaatttttcattaggagttttggggatggcgttgttcctagaagagatgctgagaaccagagtgggtactaaacatgccatactactcgtcgctgtctcttttgtcacgttaattacagggaatatgtcctttaaggacttggggcgcgttgtcgtcatggtaggtgctacaatggcggatgacatcggaatgggagtcacatatctggcgttactggccgccttcaaagttcgcccaacatttgcagctggtttacttttaagaaaattgacctcaaaggaacttatgatgacgacaataggaatagtgctgctgagtcaaagcacgatacctgagactgtgctagaactcactgatgcacttgcattaggaatgatggttctgaaaatagtacggaacatggagaaatatcaattagctgtcacaataatggccatactttgcgtgcccaatgccgttatattacaaaacgcatggaaagtgagttgcacaatcttagcagtagtatccgtatctccattgttgctaacaagttcccaacagaaaacagattggatcccattggctttaacaataaaaggtctttcaccaacagctatatttttaacaacattaagcagaagcaataagaagcgatcatggccattaaacgaagcaataatggctgtaggtatggtctcaatattggcatctagcctccttaagaatgatataccaatgaccggccctctcgtcgcaggaggtttacttacagtatgttacgttctaacaggaagatcagctgaccttgagctagagagggctaccgatgtaaagtgggaagaccaagctgaaataagtggttcaagcccaatattgtcaattacaatttcagaggacgggtccatgagcataaaaaatgaagaggaagagcaaacgctgacaatcctcataaggaccggtctattagttatatcaggacttttccccattagtatcccgataacagctgcggcttggtatctttgggaggtaaaaaaacagcgggcaggagttttgtgggatgtaccgtcaccgccccccatggggaaagctgagttagaagatggcgcttatcggataaaacagaaagggatactaggatactcgcaaataggtgctggagtgtacaaagaaggaacatttcacactatgtggcatgttactagaggtgctgttttaatgcataaggggaaaagaatagagccatcatgggcagatgtgaaaaaagatctcatatcatacggaggcggttggaaactcgagggtgaatggaaggaaggggaagaagtacaagtactggcgttagaacctggtaaaaaccctagagccgttcaaaccaaacctggactattcaaaactaacactggtacaataggtgcagtgtccttagatttttctccgggaacatcaggcagtccaataatcgacaaaaaaggaaaagtcgtaggtctgtacggaaatggagtagtgaccagatcaggagcatacgtctcggcgatcgcacagacagaaaaatcaatagaggacaatccagaaatagaagatgacatatttagaaaaagacgtctaacaataatggatctacatcctggcgcgggaaaaacaaaaagatatctgccagcgatagttagagaagcaataaaacgtggtcttaggacattgatattagcacctacacgagttgttgctgcagaaatggaagaagcactcagagggctaccaatccgataccaaacaccagcaattcgagctgaacatactggccgagaaatagttgacttaatgtgccatgcaacattcacaatgcgcttattgagccctgtccgcgttcctaattacaacctcataattatggatgaagcacactttacggacccagcatcaatagctgctagaggatacatatcaacacgtgttgagatgggcgaagcggcaggaatattcatgacagcaactccaccaggttcacgtgatccgtttccacaatctaatgcgccaataatagatgaagaacgggaaatacctgaaagatcgtggaattctggccacgaatgggtaacggattttaagggaaaaacagtttggtttgtaccaagtattaaggccggtaacgatatagcggcatgtctaagaaaaaatggaaaaaaagtaatacagctttcccgaaaaactttcgactctgagtatgtaaaaacacgaacaaacgattgggatttcgtagtaactacagatataagcgagatgggtgcaaacttcaaagcagaacgagtaatagatccacgacgctgtatgaagccagtaattttaaccgacggggaagaacgagtgattctcgcggggccaatgccagttacacactcttcagcagcacaacgacgtggaagaataggccgcaacccaaaaaatgaaaatgaccaatatatatatatgggtgaaccgctagagaatgatgaggattgtgcacactggaaagaagcaaaaatgttactagataatatcaacacacctgagggtattataccaagcatgttcgagcccgagcgtgaaaaagtagatgctatagatggggagtaccgacttcgaggggaagcccgcaaaacatttgtagacctaatgcgtaggggtgacctgccagtatggcttgcttacaaagtagccgccgaaggcataaattatgctgatcgacggtggtgcttcgatggcatcaaaaataatcaaatattggaagaaaatgtcgaagttgagatatggactaaggaaggtgaacgaaaaaagctaaagcccagatggctggatgcacgtatttatagcgatcctctcgcgttgaaggaattcaaagaattcgcagcaggacgtaaatcattaactttaaatcttataacggaaatgggcaggctacctactttcatgacccaaaaaacgagggatgcacttgacaacctagctgtgttacatacggcagaagctggtggaagagcctataaccatgcactatcagagctgcctgaaacacttgaaaccctgctgttattgacgttactggcgacagttacaggaggaattttcttatttctaatgtccggccgtggtataggtaaaatgacgcttggaatgtgttgtattataaccgcgagcattctcttgtggtatgctcaaatacaacctcattggattgctgcatcaatcattctggagttttttttaatagtgctgttaataccggagccggaaaagcagcgaacccctcaggataaccaactaacatatgtagtaatcgcaattctaaccgttgtggcagcaacaatggcaaatgaaatgggtttcttagaaaaaaccaaaaaggatttaggtttaggaggaatcgctactcaacaaccagaatcaaatattcttgacattgatttacgacctgcgagtgcatggacattatatgcagtagctacaacatttgtaacacctatgcttcgacattcaatagagaactcaagtgtcaacgtttctttgacagctattgccaaccaggcaactgtgttaatgggcttaggaaaaggctggccgttatcaaaaatggacatcggcgtgccactccttgcaataggctgttactcacaggtaaatcctatcactctaacggctgctttattactactcgttgctcattacgcaataattgggccaggtttacaagccaaggctactagagaagctcaaaagcgagcagccgccggaataatgaaaaatcctacagttgacggaataaccgtcatcgatctagacccgataccctatgacccgaagtttgagaaacaattgggacaagtgatgttattaatcttatgtgtaactcaagtattaatgatgagaacaacctgggcactttgcgaggcattgactctcgcaactgggcctatatctaccttatgggaaggtaacccaggtaggttctggaataccactatagcggtttcaatggcaaacattttcagaggtagttacttggcaggtgccggattactatttagcataatgaaaaacaccactaacacacggcgggggacaggtaacataggagagacgcttggagaaaaatggaaatctagactcaacgccctgggcaagagtgaattccagatctataagaaaagtggaattcaggaggtagataggacattagccaaggaaggaataaaaagaggggaaactgatcatcacgctgtttccaggggttctgcaaaattaagatggtttgtagaacgaaatatggtgacgcccgaaggaaaggtcgtagacttaggctgtgggaggggaggctggagctactactgtgggggattaaagaacgtgagagaggtaaagggcttgacaaaaggaggtcctggacacgaagaacccattccaatgtctacatatggttggaatctggtgcgactccaatctggagtagatgtcttctttattcctcctgaaaagtgtgacacacttctgtgtgatattggggaaagcagtccaaatccaacagtagaagcgggccgcacacttcgcgtcctcaacctcgtagagaactggctgaataacaatacacaattttgcattaaagtgctaaatccttacatgccgtctgttattgaaaaaatggaagcattacaacgcaaatacggtggtgcactcgtaagaaacccactaagtcgaaattcgacgcatgaaatgtactgggtttctaatgcttcaggaaatatagtaagttcggtcaatatgatttcacgaatgttaattaatagatttacgatgagacacaaaaaagcaacttacgaaccggacgttgatctaggaagtggcacaaggaacatcggtatagaaagcgagaaacccaatcttgacattatcggcaaacggatagaaaaaataaagcaggaacatgaaacttcctggcactatgaccaggatcatccctataagacatgggcatatcacggtagttatgaaactaaacaaacaggttcagcttcttcaatggtaaatggggttgtcagattattgactaagccatgggacgtgctccctacggtgacgcagatggcaatgactgatacaacaccttttggacaacaacgagtcttcaaggaaaaagtggacaccaggacccaagaaccaaaagaaggaacaaagaaactaatgaaaataaccgccgaatggttatggaaagagcttggtaaaaaaaaaacccctagaatgtgtactagagaggagtttactaggaaagtacggtcaaacgctgcactaggagcgatcttcaccgacgaaaataaatggaagagtgctcgggaagcagtcgaagatagtaggttctgggaactcgtagataaggaacgtaaccttcatttggaaggaaaatgtgaaacttgcgtgtataatatgatgggaaagagagaaaaaaagcttggggaatttggtaaggcaaaaggctcgcgggcgatatggtacatgtggttgggcgcaagatttctagaatttgaagcgcttggcttcttgaacgaagaccattggttttcaagagaaaacagtttatcaggcgtagaaggggaaggcttacacaaattaggatatatattacgggatgtttctaagaaagaagggggagctatgtatgcagatgacaccgctggttgggacactcgtataaccctggaggatttaaaaaacgaagaaatggtaacaaaccatatggaaggagaacataaaaaattagcagaggcgatctttaaattaacataccaaaacaaagttgtaagagtgcaaagaccaacaccacgcggaacagttatggatatcatttcaagacgcgatcaacgcggatctggacaagtggggacgtacggtttgaatacatttacaaatatggaggctcagttaattagacagatggagggtgaaggtgtatttaaaaatatacaacacttgactgtaaccgaagaggtagcggtgcacaactggcttgctcgagtgggacgggaacgattgtcacgtatggcaatctccggagacgactgcgtggttaaacccctggatgatagatttgctaacgcattaacggcacttaacgatatgggaaaaatcagaaaagacattcagcaatgggaaccaagtaaaggatggaatgactggactcaagttccattctgtagtcatcattttcatgaattaataatgaaagacggccgtgttctggtagtaccgtgtagaaatcaagatgaattaatcgggagagccagaatatcccaaggcgcgggatggtcgctcagggaaacggcatgtcttgggaaatcgtacgcacaaatgtggagtcttatgtattttcatcgtagagatttaagactggcagcgaacgcaatttgtagtgcggtgccttcccactgggtacctacatctcgtacaacatggtcaattcatgcgaaacacgaatggatgactactgaagacatgctcacagtatggaatagagtatggataagagaaaatccatggatggaggataaaacaccagtggaaagttgggaagaaattccttatttgggaaaaagagaggaccaatggtgcggaagcctaatagggcttacatcacgtgctacttgggctaaaaacatacaagcagcaataaaccaagttaggtcactaatagggaacgaagaatacactgattacatgccatccatgaagcgatttaggcgggaggaagaagaagcaggagtactctggtaa

SEQ ID NO: 22676 - RNA, 9876 nt, synthetic construct
  misc_feature 1..9876: note = derived and/or modified CDS sequence (opt6) from DENV-2__EU660414__SS-prME
  source 1..9876: mol_type = other RNA
tctgctggaatgataataatgcttattccaactgttatggcttttcatttaaccacaagaaacggagaaccgcacatgattgtaggaatacaagaaaaaggtaaaagtttactatttaaaacggaagacggagtaaacatgtgcactctaatggcgatggacttgggagaactttgtgaagatacgatcacttacaaatgtccgttacttcgacaaaacgaaccagaagatatagattgttggtgtaatagcacgagtacctgggtaacgtatggaacttgtactactacaggggaacatcgtagagagaaacgaagtgttgcattggtaccacatgtagggatgggtttagaaactcgtactgaaacttggatgtcatcagaaggcgcatggaaacatgcacaaagaatagaaacctgggtattgagacacccaggttttacaataatggctgctattttagcctacacgatcggtacaacacatttccaaagagttttaatattcatactacttactgcggtagcaccttcaatgaccatgagatgcatcggtattagtaatagggatttcgtagaaggagtgagtggcggaagttgggttgatatagtacttgaacatggttcctgtgtcaccaccatggccaaaaataaaccgacacttgacttcgaactaattaaaacggaagcgaaacaaccagcaacattaagaaaatactgcatagaagccaaattgacgaatactaccacggaatctcgctgccctacacaaggagaaccctctctaaaagaagaacaagataaaagatttgtttgtaaacacagtatggttgaccgagggtggggtaatggttgcggcctgtttggaaaaggaggaatagtaacgtgtgcgatgtttacatgtaagaaaaatatggaaggtaaaatagtacaacctgaaaacttagaatacacaatagtagtcacaccccattcaggagaagaacatgcagtagggaacgatacaggcaaacacggtcaggaaataaaagtaacaccacagtcaagtataaccgaagctgaacttacgggatatggaaccgttactatggaatgttccccacgaactgggttggattttaatgaaatggttcttttgcaaatggaaaacaaagcatggcttgttcataggcagtggttcctggaccttccattaccgtggctgccgggtgcggataaacaagaaagtaattggatacaaaaagaaacactggtaacctttaaaaaccctcatgcaaagaaacaagatgtggttgttttaggttcgcaagaaggcgcgatgcacacagctttaacaggagctacggagatacaaatgagcagtgggaatcttctcttcactggtcatctaaaatgtagactacgaatggacaaattacaattaaaaggcatgagctatagcatgtgtacaggtaaattcaaagtggttaaagaaattgctgagacacaacacgggacaattgtaataagagtacaatacgaaggagacggaagtccctgtaaaattccctttgaaattatggatctagaaaaacggtatgttctaggtagactgataactgtgaaccccatagttacagaaaaagactctccagtgaatatcgaagcagagcctccattcggagactcctatattattattggcgttgaacctggccaattaaaattaaactggttcaagaaaggatcctctattggacaaatgtttgaaactacaatgagaggagccaaaaggatggccattcttggcgacacagcctgggactttggctcacttggaggtgtcttcacaagtataggcaaagcattacaccaagtattcggcgcgatttacggagctgcctttagtggcgttagctggacgatgaaaattttaatcggggttatcataacatggattggaatgaatagcaggtcaaccagtttatcagtgagtcttgtattggtcggaatagttactctatatttaggagtcatggtacaggcagatagcgggtgtgtagtgtcgtggaaaaataaagaactcaaatgtggaagtgggatttttattaccgataatgttcatacatggacggaacagtataaatttcagcctgaatcaccatctaaactagctagtgcaatacagaaagcccaagaggaaggtatatgtggtataaggtccgtcacaagactggaaaatttaatgtggaaacaaataactccggaactcaaccatatattagccgaaaacgaggtcaagctaacgattatgacaggagatataaaaggaattatgcaggcaggaaagaggagcttacgtccacaaccaacagaactaaaatattcttggaaaacatggggaaaagcaaaaatgctctcaacagaatcgtataatcagaccttcctgattgatggaccggagactgctgaatgccctaatacaaacagggcttggaactcgcttgaagtggaagattacggtttcggcgtctttacaaccaacatatggcttaaactcaaggagaaacaagacgcattctgtgactcaaaacttatgagtgctgctataaaggacaatagagccgtccacgctgacatgggttattggatagaaagcgccctcaatgacacttggaaaatagagaaagcaagttttattgaagttaaaaactgccactggccaaagtcccacacattatggtctaacggcgtactggagtctgagatgatcatcccaaagaatttagccggaccagtgtcacaacacaactaccgacctggctatcatactcaaattgctggtccatggcatcttggtaaactagagatggattttgatttttgtgatggcacaacagtcatcgtaacagaagattgtggaaatagaggtcccagcttgaggacaactaccgccagcggtaagctaattactgaatggtgttgccgaagctgtacacttccacctctccgctacagaggcgaagacggatgttggtatgggatggagatcagacctttaaaagaaaaggaagaaaacttagtcaatagtctggtcactgctggtcacggtcaagttgacaatttttcattaggtgttttaggtatggcgttgtttctggaggaaatgttaagaacacgagttggcactaaacatgctatactcttagtagccgttagttttgtcactctcattactggaaatatgtcctttaaggacctggggcgggtggtagtaatggtgggagctactatggcagatgacatcggaatgggtgtaacatatttggcattactagctgcctttaaggtaagaccgacctttgcagcaggcctcctgctacgaaaactgacttccaaggaacttatgatgaccacgattggaatagtattacttagtcagtctaccattccggagaccgtactagaacttacagatgctctagcactgggaatgatggtactaaaaattgtaagaaatatggaaaaatatcaattggcagtgacgattatggcaatactttgtgtaccaaatgcagtaatattgcaaaacgcgtggaaagtatcatgtaccattttagccgtggtgtcagtaagtcctcttctactaacttcttcacaacagaaaaccgactggatacctttagcactaacaatcaagggtttgaacccaaccgcaatatttttaacaacactatcgagaaccaataagaaacgatcgtggccactaaatgaagcaattatggcagttggaatggtaagtattcttgcttcctccttattaaagaatgatattccaatgaccggtcctttagtagcaggaggtcttttaactgtgtgttacgtactcacgggtagaagcgccgacctcgagttagaaagagcgacagatgtcaagtgggaagaccaagccgaaattagcggaagcagtccgatactctccataacaatatctgaagacgggtcaatgagcataaagaatgaggaagaagaacaaacattaaccattctaattaggactggcttattagtaattagcggcctgtttccgataagcatcccaatcactgcggcggcttggtatttgtgggaagtgaagaaacaacgagctggcgttttatgggacgtgcctagtcctccgccgatgggcaaggcagaattggaagatggcgcttatagaataaaacagaaaggcattctcgggtacagtcaaataggagctggcgtgtataaagaaggcacgttccacacaatgtggcacgttactcgaggggcagtgttgatgcataaaggaaaacgaattgaaccgtcttgggcggacgtcaagaaagatcttatttcatacgggggaggttggaaattagagggcgaatggaaagagggtgaagaagtacaagttctcgccctagaaccaggtaagaatccacgtgcagttcaaacaaagcctgggttattcaaaacaaataccggtaccataggcgctgtaagcctggatttttctccggggacatcggggagtccaatcatagataagaagggcaaggtcgtgggtttgtacggaaacggagtcgtcactagatctggagcatatgtctccgcgatcgctcaaacagaaaaatctatagaagataatcctgagattgaggatgacatttttcgcaaacgaagactaaccataatggaccttcatccgggagccggaaaaacaaagcggtacttgcctgcaattgtaagagaagcaattaaaaggggtcttagaacgctcattttagcgccgaccagagtcgttgcggctgaaatggaggaagccttgcggggcttgcccatacgttatcagacaccagcaatacgtgcagagcatacgggcagagaaattgtagatctcatgtgccacgccaccttcaccatgcgacttttatcgccggtaagagttcccaattataatttaataataatggatgaagcccattttaccgatcctgcatcgattgccgctcgaggctacatttcgacacgagtagaaatgggagaagctgctggaatttttatgacagcaacacctcctggaaatcgagatccattcccccaatctaatgcacctataatagatgaggaacgtgagatacccgaacgttcctggaactctggtcatgaatgggtaaccgacttcaaaggtaaaactgtttggttcgtaccatctataaaggcagggaatgatatagctgcctgcttaaggaaaaatggcaagaaagtgatacaactgtctagaaaaacgttcgactcagaatatgttaagacacgtataaatgattgggactttgttgttaccacagatatctctgaaatgggagcaaatttcaaggcagaaagagtaatagaccctcgaagatgtatgaaacctgtcatcttaacagatggtgaagaacgtgttatactagcagggcccatgcctgtaacccactctagcgcagcccagagacgaggcagaataggtaggaatccaaagaatgaaaatgaccaatatatttacatgggcgaacccttggaaaatgacgaagattgtgctcattggaaagaagctaaaatgttgctcgataacattaacaccccagaaggcatcatcccatccatgtttgaaccagagagagaaaaagtagatgccatagatggcgaatatagattgagaggagaggcaagaaaaacattcgtagatcttatgcggaggggagacctgcccgtgtggttggcatataaggtggcagcagaaggcataaattatgcagaccggcgttggtgtttcgatggaatcaagaataaccagattttagaggagaatgtggaagttgaaatttggactaaagaaggtgagaggaagaaattaaaaccaagatggcttgatgcacgtatttactctgacccgttagctctaaaagaatttaaagagttcgctgcaggaagaaaaagtctgacccttaacctaattacagaaatggggagactaccgacttttatgactcagaaaactcgtgatgcgctagacaacctagcagtcttacacactgcggaagcagggggcagagcatataatcatgcactaagtgaactgcccgaaaccctagaaacattattacttctcacactattagcaacagttacgggaggtatctttctattcctgatgtctggaagaggtatagggaaaatgacacttggaatgtgctgtataataactgcgtctatattgttgtggtatgcccaaatacaaccacattggattgctgcctctataatactagaatttttcctgatcgtacttctaatccccgaaccagaaaaacaaagaacaccacaagataaccaattaacatacgtggtaatagcaattctaacggttgtcgcagcaactatggccaatgaaatggggttcttagagaaaacgaagaaagatcttggattaggatctattgccactcaacaaccggaatcgaatatactcgatattgatttaagaccggcgtcagcatggacgttatacgcggtagctacaacctttgtcacccccatgctaaggcacagtattgagaatagttctgttaatgttagcctcacggcaatagcgaaccaagccaccgttttaatggggctaggtaaagggtggcctttatccaaaatggacatcggtgtgcctctattagcaataggatgttattcgcaagtgaatcctataaccctcaccgcggcgttattacttctcgtcgcacactatgcgataatagggccaggactacaagcaaaagcaactcgcgaagcacagaaaagagctgcagcaggtatcatgaaaaacccgacagtagatggtataacagttattgacttagatccaattccctatgaccctaaatttgaaaagcaactcggtcaagttatgttattgattttatgcgtaacacaagtactaatgatgcgtactacgtgggcactatgcgaggccttaacactggctacaggaccaattagtaccctctgggagggatcaccaggtaggttttggaatactaccatcgctgtaagtatggcgaacatcttccgtggatcatatcttgcaggagctggactattattcagcataatgaagaatacaaccaacacgaggagaggaacaggtaatatgggagaaacactcggagaaaaatggaaatctagattaaatgcccttggaaaatctgaatttcagatatataagaaatcaggaatacaagaagttgatagaacattagcaaaagaagggattaagagaggggaaactgatcatcacgccgtatcaagaggaagcgcgaaattacgctggtttgtcgaaaggaacatggtgactccagaaggaaaagtagttgatctaggatgcgggagaggtggttggtcatattattgtgggggcctaaagaatgtcagagaagttaaaggattaactaaaggtgggccagggcatgaagaacctattcctatgtcgacctatgggtggaatttggtgcgcctgcaatcaggcgtagacgtcttctttataccccctgaaaaatgtgatacactcttgtgtgatattggggaaagtagccccaatcctacggttgaagccggcaggactcttcgagtcctgaatctggtcgaaaactggttaaataataatacacaattctgtataaaagtactcaatccttatatgccaagtgtcatagagaaaatggaagcattacagagaaaatatggaggcgcattagtgagaaaccctttaagtaggaacagcactcacgaaatgtattgggtgtcgaatgcttccggaaatatagtatcaagtgtgaatatgataagtaggatgcttattaaccgattcacaatgcgccataagaaagcaacctatgaacctgatgttgatctaggaagcggtactagaaatataggaattgaatccgaaacgccgaacttagatataatagggaaacgaattgagaaaatcaaacaggaacatgaaacttcctggcactacgaccaagatcacccatataagacttgggcatatcatgggagttacgaaactaagcaaactgggtcggcctccagtatggtaaatggcgtagtaaggttgctaacaaagccctgggatgtgcttccaacagtaacacagatggctatgactgatacaaccccctttgggcaacaaagagtatttaaggagaaagtagatacgcgaacgcaagaaccaaaagaagggacaaagaaactcatgaaaattacagctgaatggctatggaaagaacttggcaaaaagaaaactccgcgtatgtgtacacgggaagagttcacaagaaaagtaaggtctaacgcagcattgggagcaatatttactgacgagaataagtggaagtccgctcgtgaagccgtagaagatagccgattttgggagttagttgacaaagagaggaacttgcatctagaagggaaatgtgaaacatgcgtttataatatgatggggaaacgagagaagaaacttggtgagtttggtaaagccaaaggaagccgtgccatatggtatatgtggctcggtgcacgtttcttagaatttgaagctctaggctttcttaacgaggatcactggtttagccgtgaaaactctttatcgggagttgaaggggagggtcttcataagttgggttacatcctgagagatgtatcaaagaaagaagggggcgccatgtatgccgatgataccgctgggtgggacacaagaataacactagaagacctaaagaacgaagaaatggttacgaaccatatggaaggagagcataagaaattagcggaagctatatttaaactaacatatcaaaataaagtagtcagagtccaacgtccgacccccaggggaacggtgatggatattatcagtagaagagaccaaagaggaagcgggcaagtcgggacatatggattaaatacttttacgaatatggaagcacaattaataaggcaaatggaaggagaaggcgtgtttaaaaacattcaacatcttaccgtaacagaagaagtagcggtgcaaaattggcttgcacgagtagggagggaaaggttaagtagaatggcaataagcggagatgattgtgtggtaaaaccattagatgataggttcgcaaacgccttaacagctttaaacgatatggggaaaatcagaaaagatattcaacaatgggaaccaagtaaaggatggaacgactggacgcaagtaccattttgtagtcaccattttcacgaattgataatgaaagatggaagggttttggtagtgccttgtcgaaatcaagatgaattaatcgggcgggcacgtattagccagggagccggttggtcacttcgggaaacggcatgtttagggaaatcctacgcacaaatgtggtcactaatgtatttccaccgtcgagacctccgacttgcggcgaacgccatatgttccgcagtacccagtcactgggtaccaacttcaagaactacatggagcatccatgccaaacacgaatggatgacaaccgaggacatgcttactgtttggaaccgagtctggattcgagaaaacccatggatggaagataaaacacctgtagaaagctgggaggaaatcccttatctgggaaagagagaagatcaatggtgtggaagcctaataggactcacaagtcgagcaacatgggccaaaaatattcaggttgcaattaaccaagttagaagtctaattggtaacgaagaatacactgattatatgccgagcatgaaacgatttcgtcgcgaagaagaagaggcaggagtactttggtga

SEQ ID NO: 22677 - RNA, 9876 nt, synthetic construct
  misc_feature 1..9876: note = derived and/or modified CDS sequence (opt6) from DENV-2__EU660415__SS-prME
  source 1..9876: mol_type = other RNA
tcagcaggaatgatcataatgcttataccaaccgtcatggctttccatctaacaactagaaacggcgaacctcacatgatcgtgggaatacaagaaaagggaaaaagtctactttttaaaacagaggacggagttaacatgtgtactcttatggccatggacctaggggaactttgtgaggacactataacatacaaatgtccactcctccgacaaaatgagcctgaagatatcgattgttggtgtaattcaacttcaacttgggtaacgtatggtacttgcacaacgacaggggaacacagacgggaaaaaaggtctgtcgcactcgtaccccatgtaggaatgggattagaaacaagaacagagacctggatgagcagtgagggcgcgtggaagcatgctcagagaatagaaacatggatccttaggcatccaggattcacgataatggccgcgattttagcatacacaattggcacgacacatttccaaagagtattaatatttatcctccttactgctgttgcaccatcaatgaccatgaggtgcattgggatttcgaacagagattttgtagaaggcgtatccggaggcagttgggttgatatagtcctagagcatggttcttgcgtaaccactatggcaaaaaataaacctactttagactttgaacttataaaaacggaggctaaacaaccagcgacactgagaaaatactgcatagaggccaaactaacaaacactacaacggagtcacgatgtccgacacagggggaaccaagcctaaaggaagaacaagataagagatttgtctgtaaacatagtatggtcgacagaggctggggaaatggctgtggtttgtttggcaaaggaggtattgtgacatgtgcgatgtttacgtgtaaaaagaacatggaaggaaaaattgtccaacccgaaaatctagagtacacaattgtagtaacgccacactccggagaagagcacgctgttggcaacgatacgggtaaacacggcaaagaaataaaagtgactccacagtcatcaatcactgaagcagaattgactgggtatggaaccgtaacgatggaatgtagcccaagaacaggacttgactttaatgaaatggtcttgttacaaatggaaaataaagcatggttagtacatagacaatggtttctagatctgcctttgccatggctgccaggtgccgacaaacaggaaagtaactggatacaaaaagaaacgctcgtcactttcaaaaaccctcatgcaaaaaaacaagatgtcgtggtactaggatcacaggaaggggcaatgcatacggctcttactggagcaaccgagatacagatgagcagtggcaatctgttattcactggtcatttaaaatgtcgtctaagaatggacaagttacaacttaaggggatgtcatattcaatgtgtactgggaaatttaaagtagtaaaagaaatagcagaaactcaacatggcacaattgtgataagagtccaatatgaaggggacggttcgccttgcaaaatacccttcgaaataatggacttagaaaaacgatatgtcttaggtaggttaataaccgttaatccaatcgtaacagaaaaagattccccagtaaatatagaagcggaaccaccgttcggtgatagttatattattataggagtgggaccaggacaattgaagctcaactggttcaaaaaagggagcagtattggacagatgttcgaaaccacgatgagaggggctaaaagaatggcaatcctgggtgacactgcatgggattttggtagcctaggcggtgtatttacaagtatagggaaggcgttacatcaagtatttggagcaatctacggtgccgccttctctggtgtgtcatggaccatgaagatattgataggcgtcattattacatggatagggatgaactctcgctctacatctctaagtgtaagcctagttctcgtaggtatagtgacattatacctaggtgtaatggtccaggccgatagtggatgcgtcgtatcttggaagaataaagagctaaaatgtggctcaggaatctttataacagacaacgtgcatacttggacagagcaatataaattccaacccgagtcaccaagcaaattagcttccgctatacaaaaggcacaagaagaaggaatttgcggaataagatctgtcacaagactggagaatttaatgtggaaacaaataacacctgaattaaatcatatcctagcagaaaatgaggtcaaattgacgattatgactggtgatattaaaggcataatgcaggcaggcaaaagaagcttacgaccgcaacccacagaactaaaatacagctggaaaacctgggggaaggctaaaatgctttccaccgaaagttacaatcaaacatttctcatcgatgggcctgaaacagctgagtgccccaatacaaacagagcatggaattccttagaagtagaagactacggatttggagtttttactactaacatctggctaaaactaaaagaaaaacaagatgctttttgcgactcaaaattaatgagcgctgctataaaagacaatagagcagttcacgctgatatgggctattggatagaatcggcactaaatgacacatggaagattgaaaaagcgtcgtttattgaagtaaagaactgtcattggcccaaaagccacacgctatggagcaatggagtcttagaaagtgagatgataataccaaaaaatttagcgggtccagtatctcaacataattataggctaggataccacacgcaaattgcgggaccatggcatttaggcaaattagagatggatttcgatttttgcgatggcacaactgtcatcgtgaccgaagattgtggaaacagaggaccttcactaagaacaacaactgcgagtgggaaactgattacagaatggtgctgtaggtcatgtacactcccgccactcagatatagaggcgaagatggttgttggtatgggatggaaattagaccactgaaagagaaagaagaaaatttagtaaactccctcgtaacagctggacatggccaggttgacaacttttctttaggtgttctaggtatggcattattcctagaagaaatgctaaggacacgagttggaaccaaacatgccatactgttggttgccgtcagttttgtcacactaattactgggaatatgagttttaaggatctgggccgagtggtagtcatggtaggtgcaactatggcagatgatatcgggatgggagtgacctacttagctctattagccgcgttcaaagtgagacccaccttcgcagcaggcttattactcaggaaattaacatcaaaggaattaatgatgacaaccataggcatagtactcctaagccaatctacaattccagagacggtattagagttaactgatgcattagctctaggaatgatggtattaaaaatagtacgaaatatggaaaaataccaactagcagttaccataatggcaatactatgtgtaccaaatgcggtaattttacaaaatgcctggaaagtaagctgcacgattttggccgtggtaagtgtctctccacttcttctaacgtccagtcagcaaaaaacagattggattcccctggcattaactatcaaaggacttaatccaacagcaatttttttaactactctttcgcgcacaaataaaaaaagatcatggcccctcaacgaagcaatcatggccgttggaatggtgagtatactagcctccagccttctaaaaaacgatataccaatgactggtccgttagtagctggcggacttttaacggtatgttatgtccttacaggacggagcgcggatttagaacttgaaagggcaacagacgttaaatgggaggatcaagcagagataagtggctcctcgccgatcttgtccatcactatatcagaagatggatcaatgtcaataaagaatgaagaagaagaacaaacactaacgatattaatcagaacaggacttttagttataagcggattgtttccaataagtatccctattaccgcggccgcttggtatctatgggaagtaaaaaagcagcgggcaggggtactctgggacgtacctagcccgcctccaatgggcaaggccgaactagaggacggggcatacagaataaaacaaaaagggattctagggtatagccaaataggtgcaggtgtttataaagaagggacatttcacacgatgtggcatgtaacccgaggcgctgtattaatgcataaaggtaagcgcattgaaccttcctgggcagatgtaaaaaaagatttgatatcttatggaggagggtggaagttagaaggcgaatggaaggaaggagaagaagtgcaagtactggccctagaaccgggtaaaaacccccgtgccgtccaaaccaaaccaggtcttttcaaaactaatacaggaacaattggggcggtgtccttggacttcagcccaggtacatctggcagcccgataatcgataagaaggggaaagtcgtaggtctctatggaaacggggtcgtcactagatctggtgcttatgtttctgcgattgcccaaacggagaagggtattgaagataacccagaaatagaggatgatatctttcgaaaaagacgtttaactattatggatttacatccgggggccggaaaaaccaaaaggtacttgccagcgatagtgcgggaagctataaaaagaggactacgcactttaatattggcccccacacgggttgtagctgcggaaatggaagaagcactaaggggcttacctataagataccaaacgcccgcgattagagcagagcatacaggaagagaaatagtcgatctcatgtgccatgctacgttcacgatgaggctactatcccctgtacgtgtacctaactacaacttaattatcatggatgaggctcatttcacagatcctgcatctatagctgcgcgtggatatatttctacaagagttgaaatgggagaagctgcagggatattcatgacagcaacacctccggggagccgagatcctttcccacaaagtaatgcccctataatcgatgaagaaagagagattccggagagatcttggaattctgggcatgaatgggtcacagattttaaaggcaagactgtttggttcgtacctagtattaaagccggcaatgatatagccgcgtgcttaaggaagaacggaaaaaaagtcatacaactatcgcgtaaaacatttgactccgaatacgttaaaacaagaactaacgactgggattttgtcgtaacaactgacatttctgagatgggggcaaattttaaagcagaaagagtaattgatccacgccgatgtatgaaaccagtcatcttaacggatggagaagagagagtaatcctagccggtccgatgcctgtaacccacagtagtgcagcccaaagaagaggtaggataggtcgtaatcctaaaaatgaaaatgaccaatacatatacatgggagaacccttggaaaacgatgaagattgcgctcactggaaagaggctaaaatgcttctagacaacataaataccccggaaggtatcattccttcaatgttcgaaccagagcgcgaaaaagtggatgcaatagatggcgagtatcggttgagaggtgaagcaagaaaaacttttgtagacttaatgcgtagaggtgacctaccagtgtggttagcgtataaagttgcggcggaaggcataaattatgcggatcggcgatggtgttttgatgggataaaaaataaccaaattctagaagaaaatgttgaagtggaaatttggacaaaggaaggagagaggaaaaagttgaaacctagatggctggatgcaaggatatacagtgatccactcgcgctcaaagagtttaaagaatttgcagcaggaagaaaaagtttgacattgaacttaataacggaaatggggcgtctccccacttttatgactcaaaaaacccgtgatgccttggataatttggcagtcctacacacagcagaagccggtggtagggcatataatcatgcactcagtgaattaccagagacccttgaaactctactattactaacgttacttgctaccgttactggagggatattcttattccttatgtctggacgtggcataggaaagatgacgcttggaatgtgttgtataattactgcgagcatcttgttatggtacgcacaaatacaacctcactggatagctgcgtccataatcctagaattttttctaatagtattattgattcccgaacctgaaaagcaaaggactccacaggacaaccaattaacctatgttgtaatagccatcctaacagtggttgccgcaactatggccaacgaaatgggattcttagaaaaaaccaaaaaagattttggcttaggatctatcgcgacgcaacaaccagaaagtaatatattagatatagacctacgcccagcatccgcatggactctatatgcagtagccaccacatttgtcacgccaatgctacgtcactcaatagaaaattcatcggtaaatgttagtctaacggccatagctaaccaagctaccgtattgatgggactaggcaaaggctggcccttaagtaaaatggacataggagtcccactattggcaatagggtgttatagccaagtcaacccaataacactcacggctgcattactcctattagtggcacattacgcaattatcggaccaggtcttcaagcaaaagcgacaagggaagcacaaaaaagggcagcagctggaattatgaagaacccaactgttgatggtataacagtgatagacctagacccgataccttacgatccaaagttcgaaaaacaactaggtcaagtcatgctacttattttatgtgtaacacaggtcttaatgatgagaacaacatgggctctttgcgaagcactaactttagctactgggccgatttcgacactttgggagggcaatcctggacgattttggaatactactatagcagttagcatggcaaacatcttccgaggcagctacctagccggggcaggcctgttatttagcattatgaaaaacacaacgaacacacggaggggaaccggtaacatcggcgagacgctcggggagaaatggaaatcaagactaaatgctctgggtaaatcagaattccaaatttataaaaagagcggaatccaagaagttgacagaacattagctaaagaaggtataaaaagaggagaaaccgatcaccatgccgtgtctagaggatcagccaagttgagatggttcgttgaaagaaacatggttacaccggagggtaaagttgtggacttaggttgtggcagaggcggttggagctactactgtggaggtttgaaaaacgttcgagaagtgaaaggcctgacaaaaggtggtcctggacacgaggaaccaataccgatgagcacatatggctggaacttggtcagattacaaagcggcgtagacgtattctttatcccacctgaaaagtgcgatacgttattatgcgatataggtgaaagctcgccaaaccctacagttgaagctggaagaacgttacgcgttctcaatcttgtggaaaattggttaaataacaatacgcagttttgtattaaagtgctcaacccttatatgccaagcgtaatagaaaaaatggaggctctacaaaggaaatatggaggagctctggtaaggaaccctctatcaagaaacagtacacacgagatgtactgggtctcgaacgcttccggaaatatcgtttcaagtgtcaacatgatttcgagaatgcttataaatagatttacgatgcggcacaagaaagctacatacgaacctgacgtagacttaggaagtggaacccgcaacataggtatagaatctgaaatcccaaacctagacattataggaaaacgaatcgagaaaattaaacaggaacacgaaacgtcatggcattacgaccaagatcacccatataaaacttgggcctaccatggaagctatgaaacaaaacaaacagggagtgcaagttctatggttaacggagtagttcgattactaacgaaaccgtgggacgttttacccacagtcacacaaatggcaatgaccgatacaactccttttggacaacaacgagtattcaaagagaaagtagacactaggacacaagaacctaaggagggtacgaagaaactgatgaaaataactgcagaatggctatggaaagaactaggcaaaaagaaaactccgcgcatgtgcactagagaagagtttactaggaaagtaaggtcaaacgcagcgctcggtgcaatatttactgatgagaataagtggaaatccgctcgcgaagcagtagaagactcaagattttgggaattagtggataaagaacgtaatttacacctagagggaaaatgcgagacctgtgtatataacatgatgggaaaaagagaaaaaaaattaggcgaatttggaaaagccaaaggatcacgcgctatatggtatatgtggctcggagctagattcctcgaatttgaagctttaggctttctcaacgaagaccattggttcagtcgagaaaactccctatcaggagtagaaggtgaaggtttacacaaattaggatatatacttagagacgtgagcaaaaaagaaggaggggctatgtacgccgacgacactgcgggctgggatacaagaataacattagaagacctcaaaaatgaagagatggtaacgaatcacatggaaggcgagcataaaaaacttgccgaagccatatttaagctaacatatcagaacaaagttgttagagtgcaaaggccaacgcctcggggcactgtcatggatataatttctcgaagagaccaaaggggttctgggcaagtaggaacatacggactaaatacatttactaatatggaggcgcaattgatacggcaaatggagggcgagggagtctttaaaaatattcaacatctgactgtcaccgaagaggtcgcagtgcaaaattggttagcgagagttggtcgtgagagattaagtcgaatggccatatcgggggacgattgcgttgttaagcctctggatgatcgattcgcaaacgcgttaactgccttaaacgatatgggtaaaatccgaaaagacatacaacagtgggagccaagtaaggggtggaacgactggactcaagtgccattctgcagccatcactttcatgagctaatcatgaaggacggcagagtattagtagttccatgcagaaaccaagacgaactgatagggcgagctcgaatatctcaaggagctgggtggtcacttcgcgaaactgcttgcttaggtaagtcctatgcccaaatgtggtctctaatgtacttccaccgccgtgacttacgactagctgcaaatgtcatttgctctgcagttccctctcattgggtaccaactagtagaactacatggagcatacacgcaaaacacgaatggatgaccaccgaagacatgctaactgtctggaatcgcgtttggataagagaaaacccctggatggaggataaaactcctgtagaaagctgggaagaaatcccttatttgggtaaaagagaggatcagtggtgtggatctctaataggcctcacgtcaagagcaacgtgggcaaaaaatatacaagccgccatcaaccaagtcaggtctttgatcggtaatgaggagtacaccgactatatgccaagcatgaaaaggttccgtcgtgaagaagaagaagcaggtgtcctttggtga

SEQ ID NO: 22678 - RNA, 9876 nt, synthetic construct
  misc_feature 1..9876: note = derived and/or modified CDS sequence (opt6) from DENV-2__EU687249__SS-prME
  source 1..9876: mol_type = other RNA
agtgcagggatgattatcatgctaattccgactgttatggcatttcacttaacaactagaaacggggaaccacacatgatagttggtatccaagaaaaaggcaaatcacttttgtttaaaacagaagacggtgttaacatgtgtacactcatggccatggatctaggggaattgtgtgaagacactatcacatataaatgccctctattacgacagaatgaaccagaagatattgattgctggtgtaattcgacatcaacttgggtaacgtatggaacatgcaccacaacgggggaacatagaagagagaaaaggtccgtggctttggttccgcatgtaggcatgggcttagaaacaaggaccgaaacatggatgagttcagaaggtgcttggaaacatgctcagagaatagaaacttggatcttacgacacccgggcttcactattatggcagccatactggcttacacaataggtacaacgcactttcaaagagtgctaatttttatcttgttaacagcagttgcacccagtatgactatgagatgtataggaatcagcaatcgagacttcgtagaaggagtaagcggagggtcatgggttgatatcgtgctagaacatggttcatgtgtaacgactatggctaaaaataaacctacgctagattttgaattaataaaaaccgaagcaaaacagccggcaaccctgaggaaatattgtattgaagctaaactgaccaatacaacaacagaaagccggtgtcccacacaaggcgaaccatctcttaaagaagaacaggacaaacgcttcgtatgtaaacatagtatggtagaccgaggatggggtaacggttgcggcttgttcggcaaaggaggaatagttacttgtgcaatgtttacatgcaagaaaaacatggaaggtaaaattgtacaaccagagaatttagagtataccatagtcgtaacacctcacagtggagaggaacatgcagtaggtaacgacacgggaaaacacggcaaagaaataaaagttaccccacaaagctccattacggaggccgaactgaccgggtatgggacagtaactatggagtgttcccctcgtacaggccttgatttcaatgagatggtcctgcttcaaatggaaaacaaagcctggttagtccacagacaatggttccttgacttaccacttccgtggttaccaggtgcagacaaacaagaatccaattggattcagaaagaaaccttagtaacattcaaaaatccccatgcgaagaaacaggatgtcgtcgtacttggctcccaggaaggagcaatgcatactgcccttacaggagcgaccgagatacagatgtcttcgggaaacctcctcttcacaggtcacttaaaatgcagattaagaatggacaaactacagttaaaaggaatgagctacagcatgtgtacaggaaaatttaaagttgtaaaagaaatagccgaaactcaacatggaacaatagtaattcgggtccaatacgagggtgatggaagtccgtgtaaaataccatttgaaattatggatctagagaaaagatatatattagggagactaattacagtgaatcccatagttaccgaaaaagactcgccagttaacatagaggccgaacccccatttggagactcttatatcattattggcgtagaaccgggacaacttaaattgaattggtttaaaaaggggagttcaataggacaaatgtttgagacgacaatgcgaggagcgaaaaggatggctatattaggcgacactgcctgggactttggctctctcggtggcgtatttacaagcataggaaaggctttgcatcaggtctttggggctatatacggagcagctttcagtggagtatcatggacgatgaaaatattgatcggagtcatcattacttggataggtatgaatagcagaagtacttcactaagcgtaagtctagttctagttggaattgtcacgctgtacctaggcgtaatggtacaagcagattcaggctgtgtcgtaagttggaagaataaagagttgaaatgcgggagtggtatattcataaccgacaacgtccacacgtggacagaacagtataaatttcagccagagagtccatccaaacttgcgagcgcaatacaaaaggcaagggaggaaggaatatgcgggattcgctctgtaactaggttagaaaatttaatgtggaaacagataactccagaattaaatcacatcttagctgaaaatgaagtaaaactaacgattatgacgggcgatataaaaggtataatgcaagctggaaaaaggagcctgcgacctcaaccaacagaattgaaatattcctggaagacatggggtaaagccaaaatgctaagcaccgaatcatataaccaaacgtttttaatagatggacctgaaactgcggagtgtccaaatactaatcgagcatggaactccctagaagttgaagactatggtttcggcgttttcacaacaaacatatggcttaaactaaaagaaaagcaagatgcattctgtgacagcaaattaatgagtgccgccataaaagacaacagagcagttcatgccgacatgggatattggatagaatcagcgttaaatgatacatggaaaatagaaaaagcatcgttcatagaagtcaaaaactgtcattggcctaaaagccacaccctgtggtcaaacggagtattagaatcagaaatgatcattcccaaaaatctagcagggccagtttcacaacataattaccgccccggataccacacgcaaatagctggaccttggcatttgggaaaattggaaatggacttcgatttttgcgacggcaccaccgttattgttaccgaagattgcggaaacaggggtccatctctacgtacgaccacggcaagtgggaagttgattacggaatggtgctgcagaagctgcacactaccaccattgcgttatagaggagaagacgggtgctggtacggcatggaaattagaccactaaaggaaaaagaagagaacctcgtgaactcattagttaccgctggacacggacaggttgacaatttttcgttgggtgtattaggtatggccctatttttagaagaaatgctgcgtacaagggtaggcactaagcatgcaatactgctggtagctgtatcatttatgaccttgataaccggtaatatgagttttaaagatctaggtcgagtagtggttatggtaggagccacgatggcagacgatataggaatgggcgtaacgtatttggcacttttagcggctttcaaagtaagaccgactttcgccgctggtttattattaagaaagctcactagcaaagaacttatgatgactactattggcatagtattattatcccaatccacaataccggagacggttttagaattaacagatgctctcgcattaggtatgatggtcttaaagattgtaaggaacatggaaaaataccagttagcagttaccataatggcgatcttatgtgttccaaacgctgtaatacttcagaatgcttggaaggtctcatgtacaatactagcagtcgtatcggtttcacctttattactgacctcttcacaacagaagacagactggattccgcttgccctgacaatcaagggattaaatccaacagcaatattcctaacaaccttaagtagaactaacaaaaagagatcgtggccactaaatgaagccattatggcagtcggaatggtatctatattagcatcatctctccttaaaaacgacattccgatgacaggaccattggtagctggagggctcctaacagtttgttatgtactaacaggcaggagcgcggatttagaactcgaacgtgcgactgacgtaaaatgggaggaccaagcggagataagtggaagctcgccgatactctccataacaatttccgaggatggctctatgagtattaaaaatgaagaggaagaacaaacattgactatactaatccgaacaggtctcctagtgatcagcggactgtttccaatatcaatccccataacggccgctgcctggtatctgtgggaagtcaaaaagcaaagagctggagtgttgtgggacgtaccgagcccgcctccaatggggaaggctgaacttgaagatggagcatatagaattaaacaaaaaggaatattaggatattctcagataggcgccggtgtttacaaagaagggacgtttcatacaatgtggcacgtgacaagaggagcagtgctgatgcataaaggaaaacggattgagccatcatgggccgacgtaaagaaagacttaatctcctatggaggaggatggaaattagaaggtgaatggaaagaaggggaagaagtccaggtattagccctagaacctggtaaaaaccccagagctgtccagacaaaacctggactatttaaaacaaacacgggcacaattggggcagtgtcacttgacttcagccccggaacgtctgggtcccccattatagataagaaaggaaaagtagtcgggttatacggcaacggagtagtaacgagatctggtgcctatgttagtgcgatagctcaaaccgagaaaagtattgaggataatcctgaaattgaagatgatatattcagaaaaaggcgcttaacaataatggatctccatccgggcgcgggtaaaaccaaacgatatttacctgcaatcgtgagagaagccatcaaaagaggtctgaggactctaatcctagccccaactcgagttgtggctgcagagatggaagaagctctaagagggttaccgattcggtatcagacaccggcaattagggcggaacacactgggcgagaaattgttgacctgatgtgtcatgcaacttttacgatgagattactaagccccgtacgcgtgccaaattataacctaattataatggatgaggcacacttcacggaccctgcatcaatagcagcacgaggctatatttcaacaagagtggaaatgggagaggcggctggtatttttatgacagcaacccctcccggttcaagggatccatttccacaatcgaatgctccgataatagatgaagaacgggaaattccagagcgctcatggaactcagggcacgaatgggtcactgacttcaaaggtaagaccgtttggtttgtacctagcattaaagctggaaatgatatcgcagcctgtcttcgcaaaaatggaaagaaagtaatacaactatcaagaaaaactttcgacagtgaatatgtaaagacaaggactaacgattgggatttcgtagtaactacggacatatcagaaatgggagcaaattttaaagccgaacgggtcattgaccccagacgatgtatgaaaccagtaatacttactgacggggaagagagggtgatcctcgcaggtcccatgccagtaacacatagttcagccgcgcaacgaagaggtaggatcggacgaaaccctaaaaatgaaaacgaccaatacatctatatgggagaaccactcgaaaatgacgaagactgcgcacattggaaagaagctaaaatgttactagacaatatcaacacaccagaaggaataatacctagtatgtttgaaccagaaagagaaaaagtggacgccattgatggggaatatagactacgaggtgaagcacgaaagacatttgtggatttaatgagacggggagacctaccagtatggctagcttataaagtcgcagcagaaggaattaattacgctgaccgtaggtggtgtttcgatggtattaagaataaccaaatactcgaagaaaacgtagaagtcgaaatctggacgaaagaaggcgaaaggaagaaattgaaacctcgttggcttgatgcgcgcatatatagtgatccattagctttaaaagaatttaaagaatttgcagcagggagaaaaagtctaacgctgaatttgataactgaaatgggacggctaccgacgtttatgacgcagaaaactcgagacgcgttggataatctggcagtcttacacactgctgaagcaggaggcagggcatataatcacgctttatccgaactacccgagacgctagaaacgttactcctactgacactacttgccacggtaacaggaggcatattcctgttcctaatgagcggaaggggcataggaaaaatgacattaggaatgtgctgtattatcacggccagcatcctcctgtggtatgcgcaaattcaaccccattggattgctgcatctattatactcgagttcttcttaatagtgctactgataccagagcccgaaaaacagcgaacaccacaagataatcaattaacttacgttgtcatagcaatactaactgtggtagccgccacaatggcgaatgaaatgggtttcctagaaaagacaaagaaagatcttggattagggtcaatcgccacacaacagcccgaatctaatatcctagatatagatttaagaccagcatctgcatggacgttatatgcggtcgcaactacattcgtcacaccgatgttaagacattcgatagagaactctagcgttaatgtaagtctgactgcaatagcaaatcaagccacagttttaatgggactagggaaagggtggccattgtcgaagatggacataggcgttcctttactagccattggatgctacagtcaagttaatccgattacgttaactgctgcgctattgcttttagtagcccactacgcaataattggtccgggtctccaagctaaggcgactagagaggctcaaaagcgagcagcagcaggaataatgaaaaatccaactgtcgacggtatcactgtaatagatctcgatccaataccatatgatcctaaattcgaaaagcaattagggcaagtaatgctattgatcctttgtgtcacccaggtactgatgatgagaaccacttgggcgctctgcgaagctcttactcttgcaacaggaccaattagtactctctgggaggggaacccagggagattctggaacacaactatcgcggtgagtatggccaacatatttagaggtagttatctggccggtgccggcctcctgttctctataatgaaaaacacaacaaacacacgtagaggtactggaaacataggagaaaccttgggtgaaaaatggaaatcaaggttgaacgcattgggaaagtcggagttccaaatatacaagaaaagcggaatacaagaagtcgatagaacactagctaaagagggaatcaaacgaggcgaaacggaccatcatgctgtatcacggggttctgcaaaactgcgttggtttgtagaaagaaacatggttacacccgaaggacgtgtggtagaccttgggtgcggaaggggtggatggtcttattattgcggaggccttaaaaacgtgagggaggtaaagggattaacaaaagggggacccggacacgaggagcccatacccatgagtacctatggatggaatctcgtaagactccaatcgggagtagatgtatttttcataccgcccgagaaatgcgacacattactttgcgatataggggaaagtagtcccaacccaacggttgaggctgggagaacattaagagtactaaatctagtggaaaattggttaaacaataatacgcaattttgtataaaagtcttaaacccttatatgccgtcagtaatagaaaagatggaagctctccagcgtaagtatgggggagcattagttcgaaatcctctgtcgagaaacagtactcatgagatgtactgggtatcaaatgccagtggaaatattgtatcatcagtaaatatgataagtagaatgttaatcaatcgcttcaccatgagacacaagaaagcaacatatgaaccagacgttgacttaggatccgggactagaaatataggtatcgaaagtgaagtcccaaatttggatataatcggcaaaagaattgaaaagatcaagcaagaacacgaaacgagttggcattacgatcaggatcacccatataagacttgggcataccatggttcttatgaaacaaaacagaccggatcagcctcatctatggtaaatggtgtagtacgactattaaccaagccatgggatgtactcccgacggtcactcaaatggccatgactgataccactccatttggacagcaaagggtcttcaaagaaaaagtagatacaagaactcaagagccaaaagaaggcactaagaaattgatgaaaatcaccgcagaatggttatggaaagagctaggcaaaaagaaaacccccagaatgtgtactagagaggaatttacgcgcaaagtcagatcgaacgcagcactcggagcaatattcactgatgaaaacaaatggaaatctgcccgagaagctgtagaagactccagattctgggaattagtggataaggaaaggaatttgcacctcgagggcaaatgtgaaacttgtgtctataatatgatgggtaagcgtgagaagaaactaggagagttcggtaaagcaaaaggctccagagcaatttggtacatgtggctaggtgctcggtttttagaatttgaggctttgggattcttaaatgaagaccactggtttagcagagaaaatagtttgtcaggtgtagagggtgagggactacataagctcggctacattctcagagatgtaagtaagaaagaaggaggggcgatgtatgcggatgacacagcaggatgggatacaagaataacactagaggacttgaaaaatgaagaaatggtgacaaatcacatggaaggcgagcataagaaactcgcagaagctatctttaaactaacataccaaaataaagtagtccgtgtgcagcgacccacccctcgagggacagtcatggatatcatatcccgcagagatcaacgagggtcaggtcaggtaggaacatatggactaaacacatttacaaatatggaagctcaactaataaggcaaatggagggagaaggagtgttcaaaaacatacaacacctcactgtgacagaagaagtagccgtacaaaactggctggcgcgcgtgggtcgagaacgtttatcacgaatggctataagcggagatgactgcgtagttaaacctttggatgacagatttgctaatgccctaaccgccttaaacgatatgggcaaaataaggaaagatatacaacagtgggagcctagcaaaggctggtcagattggacacaggtacctttctgtagccatcacttccacgaactaataatgaaagacggaagggttcttgtcgtaccctgtcgcaatcaggatgagttgatagggagagcaaggatttcacagggcgctggttggtctctgagagaaaccgcatgcttgggcaaaagttacgctcaaatgtggtctctaatgtattttcaccgtcgagatctgcgtcttgcagccaatgcaatatgcagtgcagtaccatcgcattgggtacctacatcacgaactacctggtccatacatgccaagcacgaatggatgactacagaagatatgcttacagtctggaacagggtctggatcagggagaacccatggatggaagataaaacaccagttgaaagctgggaggaaattccgtacctgggtaaacgagaagatcaatggtgtggatcattaatcggtttaacaagtagagccacatgggcaaagaacatccaggcagcaatcaaccaagtgcgcagtctaataggaaatgaagaatacacagactacatgcctagcatgaaacgctttaggagggaagaggaggaagctggagtcctatggtaa

SEQ ID NO: 22679 - RNA, 9876 nt, synthetic construct
  misc_feature 1..9876: note = derived and/or modified CDS sequence (opt6) from DENV-2__EU660416__SS-prME
  source 1..9876: mol_type = other RNA
tctgcaggtatgataataatgctaatacccacagttatggctttccacctgactacgagaaatggagaacctcacatgattgtaggtatacaagaaaaaggaaaaagtctattatttaaaaccgaagacggagtaaacatgtgtacattaatggcgatggatcttggggaactgtgtgaagatactattacatacaaatgtcctctgctgcgacaaaatgaaccagaagacatagattgttggtgtaatagtacaagcacatgggtaacctacggaacatgtactacgacaggggaacacagaagagagaaacgatcggtagctctagtgccacacgtagggatgggacttgaaacaagaactgaaacgtggatgtcaagtgaaggagcatggaaacatgcacaacgaatagaaacatggatattaaggcacccgggatttactataatggcagctatattggcatatacaataggaactacacattttcaacgtgtgctaatattcatactgttaactgcagtagcaccatcaatgacaatgaggtgtataggcatttcaaatcgagatttcgttgaaggtgtctctggcggcagttgggtcgacatcgttctagaacacgggtcatgcgtaactacaatggctaaaaacaaacctacattggactttgaactaataaaaactgaggcaaaacaacccgctacattgagaaaatattgtatagaagcaaaactcacaaatactacaactgagtcgcgttgtccaacacaaggtgaaccttcattaaaagaagaacaggacaaacgattcgtctgtaaacactctatggtagatcgaggatgggggaatggttgcggactttttggaaaagggggaatagtgacatgtgcaatgtttacgtgcaagaagaatatggagggaaaaattgtccaaccggagaatctggaatatacaatagtagtaacaccgcactcaggtgaagaacatgcagtgggaaacgatactggcaaacacggaaaagaaattaaagttaccccacaatcgtcaataacggaagcggaattaactgggtatggaacagtcaccatggaatgttctccgaggacaggactcgattttaatgagatggtgttattacagatggaaaataaggcttggcttgtacatcgacaatggtttctagatttgcctttaccatggcttccaggtgcagacaaacaagaatccaattggatacagaaagaaacactcgtaacttttaaaaacccacacgccaagaaacaagacgtggtcgtccttggcagccaagaaggtgcaatgcacaccgccttaacaggagcaacggaaatacaaatgagttcgggaaatcttttgtttacaggacacttaaaatgtcgactcagaatggacaaattacaactcaaaggaatgagctatagcatgtgcaccggcaaatttaaagtagtcaaagaaattgcagagacacaacacggaaccattgttataagggtacaatatgaaggtgacggcagtccatgcaaaataccttttgaaataatggacttggaaagaagatacgttctaggaagactcataacagtaaatcctattgtcacagaaaaagattctcctgtaaacattgaggcagagccgcctttcggcgactcttatataattataggtgtagaacccggacagctaaaattaaactggtttaagaaaggtagttcaattggacaaatgtttgaaactacaatgcggggtgcgaaaagaatggcaattttaggggatacagcgtgggatttcgggagcttagggggtgtatttacgagtataggtaaggctttacatcaagtatttggtgcaatctatggtgcggcattcagtggtgtatcgtggaccatgaaaattctcataggtgttatcataacttggataggtatgaactctagaagtactagcctatcggtgtcacttgtattagtgggaattgtgactctataccttggggtgatggtgcaagcagacagcggatgcgtggttagctggaaaaacaaagaactaaaatgcggaagtgggatattcataacagataatgttcatacatggaccgaacaatataaattccaacccgaatctccatcaaaactagctagcgctattcagaaagctcaagaagaaggtatttgtggtataagatcagttacacgtttagagaatttaatgtggaaacaaattacccctgaattaaatcacatattggccgaaaacgaggtaaaactgactataatgacaggagacatcaaaggaataatgcaagctggaaaaagatcattaagacctcaaccgacggaattaaaatattcatggaaaacttggggaaaagctaaaatgctcagcacagaaagctacaatcaaacttttctaatagacggcccagaaacagccgaatgcccaaatacaaatcgcgcttggaatagtctagaagtagaagattacgggttcggagttttcacaacgaatatttggttgaaattgaaagaaaaacaagacgccttctgcgacagtaaattaatgagtgcggcgataaaagataaccgagcagtccatgctgacatgggatattggatagaaagcgcattaaacgacacgtggaaaatagaaaaagcgagctttatcgaagtcaaaaattgtcattggccaaaatctcatactctatggtctaacggagtcttggaatccgaaatgataatacctaaaaatctggcaggtccagtctctcagcataattatcggcccggatatcacactcaaatagcagggccctggcatttaggaaaattagaaatggacttcgatttttgtgatggaacaactgtaatagtaactgaagactgtggaaatagggggccatctttgagaacaaccaccgccagtggaaagttaataaccgaatggtgttgccgcagttgtacattaccgccattgagatatagaggagaagatgggtgctggtatggaatggaaatacggcccctaaaagagaaagaagaaaatcttgtaaattcgcttgtaaccgcgggccatggacaggttgacaacttcagcctaggagttctaggcatggccttgttccttgaggaaatgctgaggacgagagtaggaatgaagcacgcaatacttttggtggcagtcagttttgtgacattaattaccggaaatatgtcatttaaagacttgggacgagtcgtcgtgatggttggggctacaatggccgacgatatcgggatgggtgtaacatacttagctctactggcagctttcaaggtccggcccactttcgcagcaggcttactcctgcggaaactgacaagcaaggagcttatgatgactacaataggtatcgtactcttatcacaatcaaccattcctgaaacggtattagagttgacagatgcattagcactgggaatgatggtgctaaaaattgtgcgcaacatggaaaaatatcaactagcagtgacgatcatgaccatactctgtgtacctaatgctgtcatacttcaaaatgcatggaaggttagttgcacaatactcgcagtagtgtcggtatctccactcctgcttacgagcagtagacagaaaaccgattggataccattagcgttaactatcaaaggcttaaacccgacagctatattcctgacaacgttatctagaacaaataaaaagaggagctggccattaaatgaagcaattatggctgtcggaatggtcagcattttggcctcttctttattgaaaaatgatattcccatgaccgggcccttagtagctggaggactgcttaccgtatgttatgtattaacaggacgaagcgcagaccttgaactagaacgagctactgatgttaaatgggaggaccaagcagaaatctcaggatcatcaccaatactatcaattacaataagtgaggatggttcaatgtctatcaaaaatgaagaagaagaacaaacgttgactatactaataagaacaggtcttcttgttatatcaggattattcccaatatcaatacctatcactgctgcagcttggtacttatgggaggttaagaaacagagagcgggcgtattgtgggacgtacccagtcctccacctatggggaaagcagagctagaagacggggcgtacagaataaaacaaaaaggcattctaggctattcgcaaataggagcgggagtatacaaggagggaacgtttcatacgatgtggcacgttactcgtggggccgttctaatgcacaaaggaaagagaattgaaccaagttgggctgacgttaagaaagatctcatatcttatggaggaggatggaaactagaaggagaatggaaagaaggtgaggaagtacaagttttagcgttagagcctggcaaaaaccctcgcgctgtccagaccaaaccaggactatttaagacaaacacaggcacaataggtgcagttagcttagacttcagtccaggaacctccgggtcgccgataatcgataagaaaggtaaggtggtaggattgtacggaaacggggtcgttacccgaagtggtgcatatgttagcgcaatagcacaaacagaaaagagtatcgaagataacccagaaatagaggatgatatatttcgaaaaaggagacttacgataatggacttacacccaggcgcgggcaaaactaaaagatacctaccagcaatagtaagagaagccataaaacggggactgaggactttgatattagcacctactagggttgtagcagcggaaatggaggaggcacttcgaggtctaccgatacggtaccagactccagcgataagggctgaacacacaggcagggaaatcgttgacctgatgtgccatgcaacttttacaatgagactattgtcaccagtcagggtaccgaactacaatcttataataatggatgaagcacattttactgatccggcgtcaattgccgcacgaggttatatttcaacccgtgtagaaatgggagaagcagccggaattttcatgactgccactccgcctggatctagagatccatttcctcagtcaaatgcaccaattatagatgaggagagagaaatccctgagagaagttggaactccggacatgaatgggtaaccgacttcaagggaaaaactgtatggtttgttccatcaattaaagcaggtaacgacatagctgcctgtcttaggaaaaacgggaagaaagtaatacaactatcaagaaaaacttttgacagcgaatatgttaaaacacggacaaatgactgggacttcgtagtgacaaccgatatttctgaaatgggtgcaaatttcaaggcagagcgagtaatagatcctcgacggtgtatgaagccagtgatactcaccgatggtgaagaaagggtaatcttagctggacccatgccagttactcattcatcagctgctcaacggcgcgggagaataggccgaaaccccaaaaacgagaatgatcagtacatatacatgggggagccattagaaaatgatgaggactgtgcacattggaaagaagctaaaatgctccttgataacattaatacaccagagggaattattcctagtatgtttgaaccagaaagagaaaaagtcgatgctatcgacggcgaatataggctccgcggagaagcaaggaagacctttgtagaccttatgcgaagaggagacctgcccgtttggcttgcttacaaagttgccgctgagggcattaattatgctgatagacgatggtgtttcgacggcatcaagaacaaccaaatattggaggaaaatgtcgaagttgagatatggacgaaagaaggagaaagaaagaaactgaagccccgatggttagatgcacgaatttactcggatccattggcactgaaggagttcaaagaatttgctgcgggccgaaaatcgttaactcttaatctgattaccgaaatgggaagactacctacgtttatgacgcagaagactagggacgcattagacaacctggcagttctccatactgccgaagctggtggtcgtgcttacaatcacgccttatcagaactccctgagacgttagaaacacttttgttgttaacattgcttgcgaccgtaactggaggaatatttttatttcttatgagcggtcggggcataggaaagatgacactaggtatgtgttgcataataaccgcctcaatcttattatggtatgctcaaatacaaccccattggatagcagcgagcataatactagagttctttttaatagtgctgctgattcccgaaccggaaaaacaacgtactccacaggacaaccaactaacatatgttgtaatagcgatattaactgttgtagccgcgaccatggcaaatgaaatgggattccttgagaaaaccaagaaagatcttggtctagggtctattgccacacaacagccagaatctaacatactagatatcgatttacgaccagcatctgcatggactctgtacgcagtagcaacaacgttcgttacgcctatgttgcgacatagcattgaaaattcttcagttaacgtatcattgacggcaattgctaaccaagcaacagttctcatgggactaggtaaaggatggcctctatctaaaatggacattggagtccctttgttagcaattggatgctacagtcaagtaaatccgataactctaactgcagctctattgctattagtagcacattatgccatcataggtcctgggctacaagcgaaagccaccagagaagcgcaaaagcgggcagctgccgggattatgaaaaaccctacggttgatgggataaccgttatagatctggatccaatcccatatgacccaaaatttgaaaaacaactaggtcaggtaatgctgctaattctgtgcgtgacgcaagtgttaatgatgagaacaacatgggctctctgcgaagctctgaccctagccacgggaccaatctctacattgtgggaaggaaatcccggaagattctggaatactacaatagctgtaagtatggctaatatattcagaggctcgtaccttgcaggcgcaggattgctgttttccatcatgaaaaataccacaaacacgagacgcggtaccggtaacatgggcgaaacgctaggagaaaaatggaagtcgagacttaatgctttaggaaagtcagaatttcaaatatataagaaatcaggcattcaagaagttgaccgaacactcgcaaaagaagggataaaaagaggggagacagaccatcatgcagtctctaggggttcagcaaaactcagatggtttgtagaaagaaatatggtaaccccagaaggaaaagttgtagatttaggatgcggacgtggcggttggagctattattgtggaggactaaagaacgtcagagaagtaaagggattgacaaaaggcggcccgggtcacgaggagccaatacctatgtccacatacggttggaatcttgtcagattacaaagcggtgtagacgtattctttataccgccagaaaagtgtgatactcttctctgtgacataggagagtctagtccgaatcccactgtagaagccggtagaactctgcgggtattgaacctagtagaaaattggttaaataataacacccaattttgtataaaggtactaaatccgtacatgccgagtgttatagaaaagatggaagcccttcaaagaaaatatggaggcgcacttgttagaaatccactaagtagaaattcaactcatgaaatgtactgggtaagcaacgcatctggaaacattgtttccagcgttaatatgatttctagaatgcttataaatagatttacaatgaggcataagaaagcaacgtatgaaccagacgttgaccttggatcgggaacaagaaacataggaatcgagtcggagatccccaatttggacattatagggaaaagaattgagaaaataaaacaagaacacgaaacttcttggcactacgaccaagaccatccatataagacttgggcgtatcatggctcctatgaaacaaaacaaacaggctcagcatcatcaatggtgaatggagttgttcgattattgacgaaaccatgggatgtattacctacggtaactcaaatggcaatgaccgacaccacgccttttggccaacaacgagtattcaaagagaaagtcgacactcgtacacaagaaccgaaagaaggtacgaagaaactaatgaaaataacggccgagtggctttggaaagaattaggaaagaagaaaacacccaggatgtgtacccgagaggaatttacacgaaaagtacgatccaatgcagcattgggagctatttttaccgacgagaataaatggaagagtgctcgggaggcggtagaagacagtaggttctgggaattggttgacaaagaaagaaatctacatctggaaggtaagtgcgaaacttgtgtctacaatatgatgggaaagcgagagaagaaattaggtgaatttgggaaagctaaaggaagccgagctatatggtacatgtggttaggagctcgattcttagagtttgaggctttaggatttttgaacgaggatcattggtttagtagagaaaatagcctgtcaggcgtagaaggtgaagggctgcataaacttggctacattttaagagacgtatcgaagaaagaaggaggagcaatgtatgcagacgatacagcaggatgggatactaggatcacattagaagatctgaaaaacgaggaaatggtcacaaatcacatggaaggagaacacaaaaagctagctgaggctatctttaaacttacttaccaaaacaaggtcgtacgagttcaaagaccgactccacgagggacagtgatggacattatttcaaggcgcgaccagagaggttctggacaagtaggaacatacggcttaaacacgtttactaatatggaagctcaacttattcggcaaatggagggtgaaggagtgtttaaaaacatacagcatctaacggttacagaggaagtagcagtccaaaattggcttgcgcgagttggccgtgagaggttgagcagaatggccatatctggcgatgattgtgttgttaaacctctagatgacagatttgcaaatgcattgacagcattgaatgatatgggaaaaatacgaaaagacattcaacagtgggaacccagtaagggttggaatgactggacgcaagtccccttttgttcgcatcattttcacgaactaataatgaaagacggccgtgtccttgtggttccatgcaggaatcaggacgaattaatagggagagccaggatttcgcaaggagctgggtggagtctgagagaaacggcttgtttgggcaaaagttacgcgcaaatgtggagcctaatgtattttcatagacgagatctaagactggcagcgaacgcaatatgttcagcagtcccatctcactgggttcctactagccgtacaacgtggtcaatccatgctaagcatgaatggatgacaactgaagacatgctcacagtttggaataaagtctggatcagggaaaatccatggatggaagacaaaacacccgtggagtcatgggaagagatcccctacttaggtaagcgcgaggatcagtggtgtggctctctcataggcttgactagccgggcaacctgggcgaaaaatatacaagcagctatcaatcaagttagaagtttaataggaaacgaagaatatactgattatatgccatcaatgaaacgttttcgccgcgaagaagaagaagccggagttctctggtaa

SEQ ID NO: 22680 - RNA, 9876 nt, synthetic construct
  misc_feature 1..9876: note = derived and/or modified CDS sequence (opt6) from DENV-2__EU660417__SS-prME
  source 1..9876: mol_type = other RNA
tctgcaggtatgataattatgcttataccaacggtaatggcatttcacttaaccacaagaaatggtgaaccacatatgatagtaggtatacaagaaaaaggtaaatcactgttattcaaaacggaagatggggtaaacatgtgtacgctaatggcaatggatctcggtgaactttgcgaagatacgataacatataaatgtccacttctacgacaaaatgaaccagaagacattgattgttggtgcaactcaacaagtacgtgggtgacatacggtacttgtacaacgacaggagaacaccgacgagagaaaaggagcgtcgcgctggtcccacacgtgggaatgggactagaaacacgtactgaaacatggatgagtagtgaaggagcgtggaaacatgcacagagaatagaaacatggatcctgagacaccccgggtttactattatggcagctattttagcatacactataggaaccacccatttccaaagagtactaattttcattttactaacagctgtcgctccaagtatgactatgagatgtataggtatatctaaccgagactttgtagagggagttagcggtggaagttgggtggacatcgtcttagaacatggaagttgtgtaactaccatggccaaaaataaaccaacattggacttcgaattgataaaaactgaagctaaacaacccgcaacattaaggaaatattgtatcgaggcaaaacttactaatacaactacggaaagcagatgtccaacgcagggagaaccgagcttaaaagaggagcaagataaaaggtttgtttgcaaacattccatggttgaccgcggttggggaaatgggtgcggactgttcggtaaaggaggaattgttacatgcgcaatgtttacctgtaagaaaaatatggaaggaaaaatagtacaacccgagaacttagaatatacgatagtcgtcaccccacacagcggagaggaacatgcagtaggtaacgatacaggaaaacacggcaaagaaattaaagtcacgccccaaagttcaataactgaggcagaactaactggttacgggactgtgaccatggaatgttctcctagaaccggcctcgactttaatgaaatggtcctacttcaaatggagaacaaagcgtggttagttcataggcaatggtttttggacctaccactcccgtggctacctggtgcggataaacaagagtcaaattggatacaaaaagaaacattagtgacatttaaaaatccacacgccaagaaacaagatgtagtagtgttaggtagtcaagagggagcaatgcatactgcattaaccggagcgaccgagatacaaatgagttcgggaaatctacttttcaccggtcatctaaaatgtcgccttcgaatggacaaacttcaattaaaaggaatgagttactcaatgtgtacaggcaaatttaaagttgtaaaagagattgcggagacgcaacacggtactatagttatccgagtacagtatgaaggggacggttcaccatgtaaaattcctttcgaaataatggacttagaacgaaggtatgtgctaggacggttgattacggtgaacccaatagtaactgaaaaagattcaccagtaaatatagaggcagaaccgcctttcggagacagctacataatcatcggagtagagcccggtcaattaaaactcaattggttcaagaaaggatcttctattggccaaatgtttgagaccacaatgagaggagcgaaacgaatggctatacttggcgatacagcttgggacttcggaagcctaggaggagtattcacatccatcggcaaggctttacatcaagtgtttggcgcaatatacggagcagcgttctcaggtgtaagctggacgatgaaaattttaatcggggttataatcacatggattggaatgaatagtagaagtacgagtctaagcgtttcgctggttttggtcggcatcgtgacattatacttaggtgtcatggtacaagcagattctggatgcgttgtgagctggaaaaacaaggagttaaaatgcgggagtgggatttttattacagataacgtacatacctggaccgagcagtataagtttcaacccgagagccctagtaaacttgcatcagcaatacaaaaagcccaagaggaagggatatgcggaattaggtcagtaacacgtttagaaaacctaatgtggaaacagatcactccggaattaaatcatattttagcagaaaacgaagtaaaactaacgattatgaccggggatattaaggggataatgcaggcaggaaaaagaagtttgagaccacaacccacagagctaaaatatagttggaaaacttggggaaaagcgaaaatgctgtcaacagaaagttataaccagacatttctgatcgatgggccagagacagctgaatgtccaaacactaatagagcttggaacagtttggaagtagaagattacggttttggcgtattcacaacaaatatatggctgaagttgaaggagaaacaagatgcgttttgtgactccaaattaatgagcgcagctattaaggataatcgcgcagtacatgcagatatgggatattggattgagagtgctttgaacgacacatggaaaattgaaaaagcgagtttcatagaagtaaagaactgtcattggccaaagtcgcacacattatggtcaaacggtgttttagagtcggaaatgattatccccaaaaatcttgctggaccagtcagtcaacataactaccgaccaggctaccatacccaaatagcaggcccttggcacttaggaaaactagaaatggacttcgacttttgcgatggaacgacagtaatcgtaacagaagattgcggtaacaggggaccctctttaaggaccactacagcctcgggtaaattaattacagagtggtgctgtcgttcttgtacactgccacccctcagatatcgaggagaagatggatgttggtacggcatggagataagaccactaaaagagaaagaagaaaatcttgttaatagcttggtaactgccggccacggacaagttgacaactttagtttaggagtattaggtatggctttatttctagaggaaatgcttcgtacacgggttggcacgaagcacgcaattttacttgtagctgtctcgtttgtaacactaataacaggcaacatgtcatttaaagacctaggacgagtcgtcgttatggtaggagccaccatggccgatgatatagggatgggagtaacgtacctagctctactagcggctttcaaagtccgcccgacgttcgctgcaggtttgctgcttcgaaagttaacaagcaaagaactaatgatgacaacaattggcatcgtattactaagccaaagtaccatacctgagactgtgctagaactaacggatgcacttgcattaggcatgatggtcttaaagatagttcggaacatggaaaaatatcaattggcagtcactatcatgacaatcctctgtgtgcccaacgctgtaatacttcaaaacgcctggaaagtaagttgcacaatactggcggtagtctctgtatccccacttttgctgacaagtagtagacagaaaactgactggataccattagcattgactataaaaggcttaaatcctactgcaatatttttaacaacactttcacgtactaataagaaaagaagctggcccttgaatgaagcgataatggctgtaggtatggtaagcattttagctagcagtttactgaaaaatgatatacctatgaccgggcctctagtagcgggtggactcctaacagtttgttacgtcttaacaggtagatcagcagacctggaactggagcgagcaaccgatgtgaaatgggaagatcaagcggaaatatcaggtagtagtccaatactttctataacaataagcgaagacggaagcatgagcataaagaacgaagaggaggaacaaacactgacaatattaataaggacgggacttctggtaatatcaggacttttcccaattagtattcctataaccgccgccgcctggtatctgtgggaagttaagaaacaacgagcaggcgtactatgggacgtaccaagtccgcctccgatgggaaaagcagaattggaagatggtgcataccgaataaaacaaaagggcattctgggttacagccaaataggggctggggtatacaaggaagggacattccatacaatgtggcacgtcactagaggggcagtattaatgcataaaggtaaaaggattgagcctagttgggcggacgtgaagaaagacctcatatcgtacggaggtggatggaaattagaaggagagtggaaagaaggggaagaagttcaagtgctagctttagaaccaggcaaaaatccaagagcggtccagacaaaacccggacttttcaaaacaaacacaggtaccataggggcggttagcctggacttttcacccggaacaagtggaagtccaatcattgacaagaaaggaaaagtagtaggactatatggaaatggtgtagtgactcgatcgggcgcatacgtatctgcaatagcccaaacagagaagtcaatagaagataaccctgaaatagaggacgatatattcaggaagcgtagattaacgataatggacctacaccctggcgcaggcaaaacaaaaaggtacttacccgcaatagtaagagaagcaataaaaagggggctacgaacccttattctcgcaccaaccagggtagttgcggcagagatggaagaggctttaagaggattaccaataaggtatcaaacgccagcgatacgagcagaacacactgggcgcgagatagttgatctaatgtgtcacgcaacatttacgatgagactgctgtcgcctgtgcgagtcccgaactacaatctgattataatggacgaagctcatttcaccgacccggcttcaatagctgctcgaggatacattagtacaagagtagaaatgggtgaagctgcaggcatctttatgacagctactccacctggatcaagagacccgtttccccaatccaacgctcccatcattgacgaggagcgtgagatacctgagagatcatggaactccggacatgaatgggtaaccgacttcaaaggaaaaacggtatggtttgtgccaagtataaaagccggtaatgatattgcagcttgtctacggaagaatggcaagaaagtaatccaacttagtagaaaaacttttgactcagaatatgtaaaaactagaacgaatgattgggattttgttgtaacaacagacatctctgaaatgggggctaattttaaagcagaacgcgtaatcgacccaagaagatgtatgaagcctgtgatactaacggatggtgaagaacgtgtaattctagcgggtccaatgccagtgacacattcgagtgcagcacaaagaagaggtagaataggaagaaatcccaaaaacgagaacgatcaatacatttacatgggagaaccactggaaaatgatgaggactgcgctcattggaaagaagccaagatgttactagataatataaacacacctgaaggaattataccctcaatgtttgaaccggaaagagaaaaagtagacgcgatagacggtgagtatagactaaggggtgaagcgagaaagacatttgtagatctaatgcgaagaggcgatttacctgtatggttggcgtacaaggttgcagccgaaggaataaattacgccgataggcggtggtgttttgatggaatcaaaaataaccaaattttagaagagaacgttgaagttgaaatatggacaaaggaaggtgaaaggaagaaattgaagccgagatggttggacgcccggatttattctgacccattggcattaaaagaatttaaggagtttgcagccggacgaaaatctctaacactgaatcttatcacagaaatgggaaggttacctacgttcatgacccaaaagactagagatgctctagataacctcgcggttctacacacagctgaggctggtggacgtgcatacaatcacgccttatctgaactgccggagacattagaaacattattactactaacattactggcaacggttactggcggtatatttttatttcttatgtcaggaagagggattggtaagatgacattaggcatgtgttgcatcataacagcatctatactgttatggtatgcccaaatacaaccccactggattgctgcctcaatcatcttagagttctttttgatagtcctactaattcctgaaccagaaaagcaaagaactccccaagacaatcaactgacgtacgtagtcatagccattcttacggttgtcgcggcaacaatggcaaatgaaatgggtttcctggagaaaactaaaaaggatctcggattgggaagtatagccacgcagcaacctgaaagtaacatattagatatagatctacgaccagcgtcagcttggactctctatgcggtcgcgacaacttttgtcacgccgatgttgaggcacagtattgaaaatagctctgtaaacgtatcattgacagctatagcaaaccaagccacagtattaatggggcttggaaaaggttggccactatccaaaatggacataggagttccattgcttgcgattggctgctatagtcaagtaaatccaataactctaactgcagccttgttactattagtcgcacactatgctataataggaccaggactgcaagccaaagcaaccagagaagcccagaaaagggctgcagcagggataatgaaaaatccgacagtcgatggaataacggttattgatctcgaccccataccctatgatcctaagttcgaaaaacaactgggacaggtaatgcttttaatcctatgtgtaacacaggtactaatgatgcgcacgacatgggcattatgtgaagcactaacactagccactggtcctatctctacattgtgggaaggaagccctggcagattctggaacacgaccatagcagtttcaatggccaatatttttcgaggatcttatctcgctggtgcaggactactattttcaataatgaaaaatactactaacactagacgcggtactggaaatatgggtgagacgttgggagagaagtggaagtccagattaaatgccttaggcaagtcagaatttcaaatatataagaaaagtggcatccaggaagtagataggaccttagccaaagaagggatcaaaagaggcgaaacagatcaccatgcagttagtcgaggtagcgctaaattaaggtggttcgtagaacgcaatatggttacgccggaggggaaagttgtagatttgggctgcggacgtgggggttggagctattattgtgggggactaaagaatgtgcgagaggtcaaggggttgactaagggcggacctggacatgaagaaccaatccccatgagcacatatggatggaacttagttagactacaatcaggtgttgatgtgtttttcattccccctgagaaatgtgatacgctactttgtgatataggtgaaagtagtcccaatccaacagtggaagcaggtcgaacgctccgggtactgaatctagtagaaaattggctaaataataatacacaattttgtatcaaggttcttaacccatatatgccttcagtaatcgagaaaatggaggcccttcaacgcaagtacggaggtgcgcttgttcggaatccattatctcgtaactctacgcatgaaatgtattgggtttccaatgcctctgggaacatagtaagttcagtcaacatgatcagccgtatgttgattaatagatttacaatgcgccacaaaaaggctacatacgaaccagacgtagacctcgggagcggaacaagaaacataggaatcgaaagcgagatacctaacttagatataatagggaaaagaattgagaaaataaaacaggagcatgagacaagttggcattatgaccaggaccatccttataaaacgtgggcctatcacggatcatacgagacaaaacaaacgggctctgcctcaagtatggtcaatggtgttgtgcgtctattaacaaagccttgggatgtcttacctacggtaacccaaatggccatgacggatacaactccgttcggtcagcaaagggtgtttaaagagaaagtagatacgagaactcaagaaccaaaagagggaactaagaagctaatgaaaattactgctgaatggctttggaaggaactaggcaagaaaaagacgccacgtatgtgcacacgggaggagtttacacgcaaggtgcgaagcaacgcggcattgggagcaatatttaccgacgaaaataaatggaaaagtgccagagaagcagtcgaagacagccgtttttgggagctagtagacaaagaaaggaatttacacttagaaggcaaatgtgaaacgtgtgtatataatatgatgggtaaacgtgagaagaaattaggagaatttggtaaggcaaaaggaagtcgagcaatatggtacatgtggctaggggctcggtttcttgaatttgaagcgctcggatttttaaacgaagaccattggttctcacgggaaaactctttgtcaggtgtagaaggggaaggcctacataaactcggctatatcctacgagatgttagcaagaaagagggcggggcgatgtacgccgatgacacagcaggatgggatacacggatcacactcgaagacctcaaaaacgaagaaatggtgacaaaccatatggagggagaacataagaaactagcagaagctatttttaaactaacatatcaaaacaaggtagtccgggtccaacggcctaccccaaggggcaccgttatggatattataagtcggcgcgatcagcgagggagtggacaggttggaacctacgggctaaatactttcacaaatatggaagcccaattaattcggcaaatggaaggggagggtgtcttcaagaatatacagcacctgactgttacagaagaagtagcagttcaaaattggctcgctagagttggacgcgagcgtctatcccgaatggcgatatcaggagacgattgtgtagtcaaaccattagatgatagattcgctaatgctttgacagccttaaacgatatgggtaagataagaaaagatatccaacaatgggaaccgtcaaaaggctggaatgactggacacaagttccattttgctcccatcattttcatgagttaatcatgaaagacggtagagtattggtcgtcccctgccgaaatcaagacgaattaataggacgtgcacgcatatcacaaggtgcaggatggagtctgcgggaaaccgcatgcctaggcaaaagctacgcacagatgtggagtctgatgtattttcatcggagagacttacgattagccgcgaatgcaatctgcagtgcagttccatcgcattgggtgcccacaagtaggactacatggtccatacacgcaaaacatgaatggatgactacggaagatatgctcaccgtttggaataaagtatggatacgtgaaaatccctggatggaggacaaaacccccgtagagtcatgggaggaaataccatacctaggtaaaagagaagatcaatggtgtggatccctcattggattaacctcaagagctacgtgggccaaaaacatccaagcagcaattaaccaagttaggtctcttatagggaatgaggaatatactgattatatgccgtcaatgaaaagatttagaagggaggaagaagaagccggtgtactatggtag

SEQ ID NO: 22681 - RNA, 9876 nt, synthetic construct
  misc_feature 1..9876: note = derived and/or modified CDS sequence (opt6) from DENV-2__EU677137__SS-prME
  source 1..9876: mol_type = other RNA
agtgctggaatgataatcatgttaattccgacagtaatggcattccacttaactacacgaaacggagaaccgcatatgatagtaggcatacaagaaaaagggaaatccctgctgttcaaaactgaggatggagttaacatgtgcacacttatggcaatggacctaggcgaactatgtgaagataccatcacatacaaatgtccgctattacggcaaaacgaacccgaagatatagattgttggtgtaattctacctcaacttgggtgacctacggtacttgtaccacaactggtgagcatcgccgagagaaaagatccgtcgcattagtaccacacgtcggtatgggactagagacaagaaccgaaacttggatgagttcggaaggcgcatggaaacacgctcaacgaatagaaacatggatactacgacaccctggctttacaattatggcagcgatactagcatacacaatcggcacaactcacttccaacgcgtacttatattcattcttctgacagcagtagctccaagtatgacaatgcgatgcataggcataagtaatagagatttcgttgaaggcgtaagtggtggtagttgggtagatatagttttagagcacggtagttgtgttacaacaatggctaaaaacaaaccaacattagatttcgaattaataaaaacagaagcaaaacaaccagcaacactacgaaaatactgcattgaggcaaaactgaccaacacaacaactgagagccgatgtcctacacaaggggaacctagccttaaagaagaacaagataaaaggttcgtatgtaaacattcaatggtagatagaggttggggaaacgggtgtgggttatttggaaaaggtgggatcgtaacatgtgcaatgtttacgtgcaagaaaaatatggaaggaaaaattgtccaacctgaaaacctagaatatacgatagtggtaacaccacacagcggtgaagaacatgcggtaggaaacgatactggaaaacatggacaagagattaaagttacgccacaatcgagcataacggaagctgagttgactggttatgggacagtaactatggaatgttcacctcgtactggactagattttaacgagatggtactattacaaatggaaaacaaagcatggctggtccataggcaatggtttctagacctaccgcttccgtggttaccgggagcagataaacaagaaagtaactggattcagaaagaaacattagtcacatttaagaacccacacgccaagaaacaagacgtagttgtactgggatcccaagagggggctatgcacaccgcactgaccggagcaaccgaaattcaaatgagctccggcaacctacttttcactggtcacttaaaatgtcgtttacgtatggataagctacaactgaaaggtatgagctatagcatgtgcactgggaaatttaaagtagtcaaagaaatcgcagaaacacaacatgggaccatagtaattagagttcaatacgaaggagacggaagtccttgtaagatacctttcgaaataatggacctcgaaaaacggtatgttttaggtcgattaatcacggtgaaccccattgtcacggaaaaagacagtcccgttaatatcgaggcggaaccaccattcggagattcatatataataataggagtggagcctggacaacttaagctcaactggttcaagaaaggttctagtatcgggcaaatgtttgaaaccacaatgaggggtgctaaaagaatggctatactaggggatacagcgtgggattttggatccttaggtggcgtcttcacaagtataggaaaagcactgcatcaggtctttggggcgatatatggtgcggctttcagcggtgtatcgtggacaatgaagatcttaataggagtaattatcacatggataggaatgaacagccgatctacctccttatctgtatcattagttctcgtgggcattgtaacattatatttgggggttatggtgcaagctgactctggttgtgtagtatcctggaaaaataaagaattaaaatgcggctctgggatattcatcaccgataatgttcacacgtggacagagcaatataaatttcaacctgaatccccaagtaaattagcttcagctatacagaaggcgcaagaagaaggtatttgtggtatacggtctgttacgaggctagaaaacttaatgtggaaacaaatcacacctgaactaaaccatatcctggccgaaaacgaggtaaaactaacaattatgacgggagatataaagggaataatgcaagctggaaagcgttcactaagaccacagccaactgagttaaagtattcctggaaaacatgggggaaagccaaaatgcttagtacagaatcatacaaccaaacattccttattgatggcccagaaacagcagaatgcccgaacacaaatagggcttggaactcattggaggttgaggattacggttttggggtattcactaccaacatatggttaaaactcaaagaaaaacaagatgcattctgcgattcaaagttaatgagtgctgcaataaaagataacagagcggtccatgccgacatgggttactggatagaatcagcactaaacgatacttggaaaatagaaaaagccagcttcattgaagttaaaaattgccattggcccaaaagccacacactttggtcgaacggagtactcgaaagcgaaatgataatccccaaaaatttagctggcccagtatcccaacataattatagaccggggtaccacacccagattgcgggaccatggcatctgggaaagttggaaatggatttcgatttttgcgacgggacaacagttaccgtcactgaagattgtggtagtagaggtccatctctgaggacaaccacagctagtgggaaattaatcacagaatggtgttgtagaagttgtacattgcctccactacgatatagaggggaggacggatgctggtacggaatggaaatacgaccgcttaaagaaaaggaagaaaatctggttaacagcttagtaactgcggggcatgggcaagtcgacaacttttccctcggagtgttgggaatggcgctatttttggaagaaatgttacgtactagagttggtacgaaacatgctattcttctcgtagctgtctcattcgttaccttaattacagggaacatgtcattcaaagatctcggtagagtcgtggtcatggttggtgcaaccatggccgacgatataggaatgggagttacataccttgctctgttagctgcttttaaagttcggccaacgtttgcagcaggtctgctattaagaaaattaacctcaaaagaattaatgatgacgacaattggcatagttctgttaagtcaaagtacgattccagagaccgtactggaactgacggacgccctggctttagggatgatggtcttaaagatcgtgcgaaatatggaaaagtatcaactagctgtcaccataatggcgatcctatgcgttccaaacgccgtaatactccaaaatgcgtggaaagtctcgtgcacaattctggctgtagtcagtgtatcccctctgttactcacctcatcgcagcagaaaacagactggataccgttggcacttactgtaaaaggtttaaatccaacagctattttcttaacaacactgagtagaaccaataagaaaagaagctggccgctgaatgaagcaataatggcagtagggatggtctctattctagcaagcagcttacttaaaaacgatatacccatgacaggaccgttagttgctggagggctattaactgtgtgttacgtcctaacggggcggtcagcggatctagaactcgagagagcgactgatgtgaaatgggaggaccaggcggaaatatcaggttcgagtcctatcttgagtatcaccatcagtgaggatggtagcatgtcaatcaaaaatgaagaagaagaacaaactttgactattttaataagaacaggacttctagttataagcggactattcccaatctccataccgatcacagctgcagcgtggtatttatgggaagtgaagaaacagcgtgcgggagtcttgtgggacgttccctctccaccaccgatggggaaggctgagctagaagatggtgcatatcgaattaaacaaaagggtatattaggatacagccagattggagccggggtatataaagagggcacatttcatacaatgtggcatgtgacacgaggagctgtgctaatgcacaaaggaaaaagaattgaacctagctgggctgacgtaaagaaagatctaatctcctatgggggcggatggaagttagagggtgaatggaaagaaggagaagaagtacaggttctcgcactggagcccgggaagaacccacgagctgttcaaactaaacctggactcttcaagacgaacactggaaccataggtgcagtatcattggactttagccctggtacgtcagggtcaccgataattgacaagaaaggaaaagttgttggtctatatggaaacggagtggtcactcgaagtggcgcgtatgtgagcgcaattgcgcaaacagagaaatccatcgaagacaatcctgaaatcgaagatgacatattcaggaagcgaagactcacgattatggacctacatccaggagcagggaaaacaaaacggtacttaccagccatcgtcagagaagcgatcaaacgaggtcttagaacactaatactagcacctacgagagtagtagcggcagaaatggaagaagctctaagaggccttcccattcgctaccagactcctgcaatcagggcagaacatacaggtagagaaattgtagatctgatgtgtcatgcaacatttaccatgagactcctttcgccagtacgagtgccaaactacaacttgattattatggacgaagctcactttaccgaccccgcgagtatagctgcgagaggttatatctccacaagagttgaaatgggagaagcagctggaatttttatgaccgcgacaccgcctgggagcagggacccgttcccgcaatcaaacgcacccattattgatgaagaacgtgaaattcccgaacgatcctggaatagtggccatgaatgggtgaccgattttaaaggaaagacggtatggtttgtaccatctattaaagcgggtaatgatatcgcggcttgcttaaggaagaatggcaagaaagtaattcagttatcaagaaagacctttgactccgagtacgtcaagactagaaccaatgattgggattttgttgtaacaactgatatatcagagatgggggcaaacttcaaggccgagcgagtgatagacccacgtcggtgtatgaaacctgtaattctaacggacggagaggagagagttatactagcgggaccaatgcccgttacacacagttccgctgcacaaagacggggtagaatagggagaaatcctaaaaacgagaatgatcaatatatatacatgggcgaaccattggaaaacgatgaagactgcgcccattggaaagaggcaaaaatgttactcgataatattaatacaccggagggtataattccaagcatgtttgaaccggaaagggagaaggtagatgcaattgacggcgaatacagactaagaggagaagctagaaagacattcgtagatttaatgcgcagaggagatctcccagtgtggctggcctataaagtagccgctgaaggcataaactacgcagataggaggtggtgttttgacggcattaaaaataatcaaatattagaagaaaatgtagaggttgaaatttggacgaaggaaggcgagagaaagaaattaaaaccacggtggttagacgcccgaatatactcagatcctcttgcattaaaagaatttaaagaatttgccgccggccgtaaatcactgacactaaacttaattacagaaatgggcagactacctacttttatgacacagaaaacaagggatgcattagacaacttggcagtactacatacagctgaagcaggaggacgggcctacaaccatgcactctcggagctcccggagacactagaaaccttacttctgttgactcttttggcaacagtgacaggtggtatcttcttatttttgatgtcaggcaggggtattggaaaaatgacattaggaatgtgttgtatcattacggcaagcattttactttggtacgcccaaatacaaccacactggatagcagcttctatcattcttgagttctttctcatagtactattgattccagaaccagaaaaacagagaacaccacaagacaatcagttaacttacgtagtgattgcaatactaactgtggttgctgcaaccatggcaaacgaaatgggatttctcgagaaaactaagaaagatttgggattaggaagcattgcaacccagcaacctgaatctaatatacttgacattgatttaaggcccgcatcagcgtggactctttacgcagtagctaccacgttcgtcacacctatgctgagacatagcatagaaaatagcagcgtaaacgtatcgttaaccgccatagctaatcaagctactgttcttatgggattgggtaaaggatggccactgagcaaaatggatataggagtaccactattagcgataggatgctatagccaagtaaatccaattactctgacagccgcccttctcttgttagtagctcattatgcaataataggaccaggattacaagcaaaagcaaccagggaagctcagaaaagagccgcagctggaataatgaaaaatcctacagtagatggaataactgtaatagacttagatcctataccatatgacccaaaatttgaaaaacaattgggtcaggttatgcttttaatattgtgtgtaacacaagttctaatgatgcgtactacttgggctttatgcgaagcactaactcttgcaactgggccaatttcaacactatgggaaggcaatccaggaagattttggaatacaacaatcgcggtcagtatggctaatatctttcgggggtcttatctagcaggagctggactcttatttagcataatgaaaaatacaacgaatacaagaagaggtacaggaaatatgggagaaactctcggggaaaaatggaaatcaaggcttaacgcacttggcaagagtgaatttcaaatttacaagaaatcagggattcaagaagtagacagaacactagcgaaagaaggaatcaagcgaggagagactgatcaccacgcggtatctcgaggaagtgccaaattaagatggtttgtagaacggaacatggtcactcccgaagggaaagttgtagatttaggatgcgggcgaggtggatggagttattattgcggcgggcttaaaaatgtcagggaggtaaaggggcttactaagggtggtccaggacacgaggaaccaatacctatgagcacatatggttggaatcttgtaaggttgcaaagtggagtagacgtatttttcatcccaccagaaaaatgcgacaccctactatgtgatataggagaatcgagtcccaaccctacagtagaagcaggaaggactttacgagtcttaaacctagttgaaaactggctcaataataatactcagttttgcataaaagttctcaatccttacatgcctagcgtaatagaaaagatggaagctatgcaaagaaaatacgggggtgcgttagttaggaaccccctgtcaaggaactcaacccacgaaatgtattgggtatcaaatgcttcaggtaacatagtatcatcagtaaatatgatcagtagaatgttgataaacaggtttacgatgagacataagaaagcgacttatgaaccagacgtagatctgggatcagggacaagaaatataggcatagaaagcgaaatccctaatctggatataataggaaagagaatcgaaaagataaaacaagaacatgaaacaagttggcattatgatcaggatcatccgtacaaaacatgggcatatcatggaagctatgaaacaaagcagactggcagcgcatcttcgatggttaatggagttgtcaggctactgactaaaccctgggatgtattaccaacagtcacgcaaatggcgatgacagatacaacgccctttgggcagcaaagggtttttaaagaaaaagtagatactcggacacaagaacccaaagagggaacaaagaaactaatgaaaataacagcagaatggctgtggaaagaactaggtaaaaagaagacgccgcgaatgtgtactagagaagaatttacaagaaaagttaggtctaatgcagcgttgggagcaatattcacagatgaaaataaatggaagtccgcacgcgaagccgtcgaagattcccgattctgggagctagttgacaaggagcgtaacctgcatctagaggggaaatgtgaaacctgtgtatataatatgatgggaaagcgcgagaagaaactgggggagtttggaaaagccaaaggaagtagagctatttggtacatgtggttaggtgcaaggttcctagaatttgaagcattaggattcctaaatgaggaccattggttttcacgggaaaactctttgagcggggtagaaggtgaaggactacacaaactcggctacatattacgagatgttagcaagaaagaagggggtgcgatgtatgcagatgacaccgctggttgggatacacgaataacacttgaagacctgaaaaacgaagaaatggtaactaatcatatggaaggtgaacataaaaagctcgcggaggctattttcaaactaacatatcagaataaagtggttagggttcagaggcccacccctagaggaacggttatggacataatctcccgtcgcgatcaaaggggtagtggacaagtaggtacatacggactgaatacatttacaaatatggaagcgcaattgattcgtcaaatggagggtgaaggcgtattcaaaaacattcagcatttaacggtgacagaggaagtagctgttcagaattggctggcgagggttggacgtgaaagactatcgagaatggcaattagcggagatgattgtgtcgttaaacctttagacgaccgttttgcgaatgcactaacagcattaaacgacatgggaaagattagaaaagatatccagcagtgggaacccagcaaaggatggaatgattggacacaggtgccattttgctctcatcattttcacgaactgataatgaaagatggtcgagtcctagtcgtaccgtgtagaaaccaagacgaattaattggacgggcacgaatatcacagggcgcgggatggagcctccgtgagacagcatgtcttggcaagtcatacgcacaaatgtggtctcttatgtacttccatcgacgggacctacggctcgcagcgaacgcgatctgttctgcagtcccgtcacattgggtcccaacgagcagaaccacgtggagtatccacgcaaagcatgaatggatgacaacagaagatatgttaaccgtctggaaccgcgtttggatacgagaaaatccttggatggaagataaaacaccagtcgaaagctgggaggaaatcccgtatttgggtaaacgtgaggatcagtggtgtggatcgctgattggcttgactagccgggctacttgggcgaaaaacattcaagctgccataaaccaagtccgttcccttattgggaacgaagagtataccgattatatgccaagtatgaaaagattcagaagggaagaggaagaggcaggagtactatggtaa

SEQ ID NO: 22682 - RNA, 9876 nt, synthetic construct
  misc_feature 1..9876: note = derived and/or modified CDS sequence (opt6) from DENV-2__EU677138__SS-prME
  source 1..9876: mol_type = other RNA
agtgcaggcatgattataatgcttataccaacagttatggcatttcacctaactactaggaatggggaaccgcacatgatagttgggatacaagaaaaaggaaaatctctactattcaaaactgaagatggtgtaaacatgtgtaccttgatggctatggatctaggtgaactatgcgaagacacgataacatataaatgcccattattgagacaaaacgaaccggaagacattgattgttggtgtaactctacttcgacatgggtaacatacgggacttgcacaaccacgggtgaacatagaagagagaaaagaagcgtcgctttggttccccatgtagggatgggactagaaactagaacagaaacatggatgagcagcgaaggagcatggaaacatgctcaacgaatcgaaacatggatacttaggcatccaggatttactattatggcagcgatattagcttatactataggaacgacacatttccaacgtgtactcatattcattttactaaccgctgtcgcaccgagcatgaccatgagatgtataggaatatctaatcgagattttgtcgaaggagtctctggaggtagctgggtagacatcgtattggaacacgggagttgtgtaactacaatggcgaaaaacaaaccaactttggattttgaacttattaaaacagaagcaaaacaacccgcaactctgaggaaatactgcatcgaagccaaattaaccaatacaactactgagtcccgttgccctactcaaggcgaacccagcctaaaagaggagcaagataaaaggttcgtgtgtaaacactcaatggtggaccgaggttggggaaacggatgtgggttatttggcaaaggcggcatagtaacgtgtgcgatgttcacttgtaagaaaaatatggaaggaaaaattgtccaacccgagaatttagagtacacaattgttgtaacaccacattccggggaagaacatgccgtaggtaatgatacgggcaaacacgggcaagaaattaaagtcacaccacaaagctcaatcacagaagcagaactgacaggctacggaacggttactatggaatgttcccctcgcacaggcttagatttcaatgaaatggtcttattacaaatggaaaataaagcgtggttagtacatcgacaatggtttcttgacctacctttaccatggctcccaggagccgataaacaagaatcaaactggattcaaaaagagaccttggtaacattcaaaaacccccacgcaaagaaacaggatgtagtagttctcggtagtcaggaaggtgcaatgcatactgcattaactggagcaacggaaatacaaatgagtagcggtaatctgcttttcacggggcatctgaaatgccgattacgtatggacaaattgcaactaaaaggtatgtcatatagtatgtgtaccggaaaatttaaggtggtcaaggaaatcgcagaaacacaacacggaacgattgttattcgcgtacaatacgagggtgacggtagtccatgtaaaataccattcgaaataatggatctagaaaaacgctatgtactaggacgtcttatcacggtaaatcccatagtcactgaaaaagattcacccgtaaatatcgaagcagagccgcccttcggagattcttatattattattggggtagaaccaggacaattaaaactcaactggtttaagaaagggtcatctataggccaaatgttcgaaaccaccatgcgtggagcaaaaaggatggctattctcggggacacggcttgggatttcggaagcctaggcggggtatttacaagtattgggaaagcgctacatcaggttttcggggcaatatatggcgctgcattctcgggggttagctggacgatgaagatcctcataggtgtcatcataacatggataggaatgaatagtaggagtacatcattgagcgtttcactggtgttagttggaatagttacactatatctgggcgttatggtacaagctgattcagggtgtgtagtaagttggaaaaacaaagaacttaagtgtggatcagggatcttcatcacagataacgtacacacgtggacagaacaatataagtttcagcctgagagcccatccaaattagctagtgcaatacagaaagcacaggaagaaggcatatgtggtattcgatcagtaacaagattagagaatctcatgtggaaacaaataactcccgagttaaaccatatacttgcggaaaatgaagttaaattaacaatcatgacaggcgacataaaaggaataatgcaagccggcaaaagaagtcttagaccgcaacccaccgagttaaagtactcgtggaaaacctgggggaaagcaaaaatgttgtctaccgagtcttacaatcaaactttccttattgacgggcccgaaacagcggaatgccccaacacgaatagggcttggaactcattggaagtggaggattatggatttggggtttttactacgaatatttggttaaagctcaaggaaaaacaagatgcattttgcgatagcaaactcatgtcagctgctataaaagataatagagcagttcatgctgatatggggtactggatcgaaagcgcgctcaatgatacgtggaaaatcgaaaaagcaagtttcatagaggttaaaaattgccattggccaaagtctcacacactttggagtaacggagtattagaatctgaaatgataataccgaaaaacttggcaggaccggtctcccaacataattatcggccggggtatcatacacaaatcgctgggccttggcacttgggtaaactagaaatggatttcgatttttgtgacggtacaacagtaatagttacagaagactgtggaaacagaggaccaagtttaagaaccacaactgcctcaggtaaattaataacagaatggtgttgtagaagctgcacacttccaccgttgagatatagaggcgaggacggatgttggtacggaatggaaattagacctttaaaagaaaaggaggaaaacttggtgaacagccttgtgacagctggacatggacaggtagataattttagtctaggtgtacttggaatggcactgtttctggaggaaatgctacgcacacgggttggtacaaaacatgccatcctattagtggcggtatccttcgttactctcataactggcaacatgtcattcaaggatctaggccgagtcgttgtaatggtaggggcgacgatggctgatgacataggcatgggtgtgacctatctagctttactagcggcatttaaagtgagacctacatttgctgcggggttattattaagaaaactgacttcaaaagaacttatgatgacaactatcgggatcgttctactatcgcaaagtacaatccctgaaactgtgctagaattaacagatgctctagcactaggaatgatggtactaaaaattgtacgcaatatggagaaatatcaactggcagtgacgattatggccatactgtgcgtccctaatgctgtaattttgcaaaatgcatggaaagtaagttgcacgattctcgctgtagtttcagtatcacccctgctgctaacatcgtcccaacagaaaacggactggatacccctggctcttactataaaaggcctaaacccgacggctatatttctaacaacgttatcacgtactaataagaaaaggtcatggccacttaacgaagctattatggccgttgggatggtatcaatactggcaagcagtttactcaaaaacgatatccctatgaccggacctctagtagcgggtggattactgacagtttgctatgttttaacggggcgttcagcagatttagaattagagagagcgacagatgtaaaatgggaagaccaggctgaaattagcggatcgagccctatactaagtatcacaataagcgaggacggatcgatgagtatcaaaaatgaagaagaggaacagactttaacaatacttattagaaccggactcctagtgataagtggattattccccattagtataccaataacagcggctgcatggtatttgtgggaagttaagaaacaaagagcaggggtgttgtgggacgtcccctctcctcctcctatggggagagcagaattagaagacggagcttacagaataaaacaaaagggaatacttgggtatagccagattggagcaggagtttataaggaaggaacgtttcatacaatgtggcacgttacacgtggagccgtactaatgcataagggaaagcgaatcgaaccaagttgggcggacgtaaagaaagatttaataagttatggcggcggatggaaacttgagggtgaatggaaagaaggagaagaagttcaagtattagcactagagcctggcaaaaatccaagagccgtccagactaaaccaggtttatttaaaacaaatacaggcacaataggagctgtcagtttggacttctcacctgggacatctggttctccaataatagataagaaaggtaaagtcgttggattatatggaaacggagtagttactagatcgggagcatatgtaagcgcgattgctcaaacggaaaaatcgatcgaagataatccagagatagaagatgacatattcagaaaaagaagactgaccataatggacctacatcctggggcgggaaaaaccaaaaggtacctaccagccatcgtaagggaagcgataaaacgcggactaagaactttaattttagccccaacgagagtggtagctgcagaaatggaggaagcactaagaggacttccaattcgctaccaaacaccagcaataagagcggaacatacaggtagagaaattgtcgatctaatgtgtcacgcgacctttaccatgaggctactaagtcctgtaagagttccaaattataacctcataataatggacgaagcccattttactgatccagctagcatagcggctcgtggatatatatctactcgcgtagagatgggagaagcagcaggcatattcatgacggcgacaccgccgggctctagggatcccttcccccagagcaatgcacctattattgatgaagagagagaaatccccgagaggtcttggaactccggtcacgaatgggtaaccgactttaaggggaaaactgtgtggtttgtaccttcaataaaagccggaaatgatattgcagcctgcttgagaaagaatggcaaaaaggtgattcaattgtcgcgaaaaacattcgatagtgagtatgttaaaacccgaacgaatgactgggattttgtcgttacaacggatatatcagaaatgggagctaatttcaaggcagaaagggttatagaccccagaagatgtatgaagccagtaatattaacagatggagaagaacgagtgattctggcaggtccgatgccagttacacattccagcgcagctcaacgaagaggtagaataggtcgaaatcccaaaaacgaaaatgatcagtatatatatatgggagagccgctggagaacgatgaggactgcgcacactggaaagaggcgaaaatgcttcttgataatatcaatacacccgaaggcattatcccaagtatgtttgaacccgagcgtgaaaaggtagacgctattgacggagaatatagattgagaggagaagctaggaaaacttttgtggatctcatgaggcgtggtgatcttcctgtttggctagcttataaagtcgctgctgaaggtatcaactacgcagatagaaggtggtgttttgacggaatcaaaaataatcaaatactcgaagaaaacgtcgaagtagagatttggactaaagaaggcgaaaggaagaaactgaagccccggtggctagacgcacgaatatattcagacccactggcgcttaaagagtttaaggagttcgcagcgggcagaaaatctttaacactcaaccttataacggagatgggacgccttccaacattcatgacacagaaaactagagacgctttagataacttagcagttttgcacactgccgaggccggcggtcgcgcatataaccatgcgctctcagaattaccagaaacactagaaactctattactgctaacattacttgcaactgtcacagggggaatattcttgtttttaatgagtggaaggggcatcggtaaaatgacattgggtatgtgttgtataataacagcttcgattttactatggtacgcccaaattcaaccacattggatcgcagcaagcattatacttgagttctttttaatcgtcttgttaattcccgaaccagaaaaacagagaactccccaggacaatcagctgacatatgtcgttattgcaatcctcacagtagtggcggccactatggcaaatgaaatgggatttttagagaaaacaaagaaagacttaggtctgggatcgatcgccacgcaacagccggaatcaaatatcctggacatagatttaagacctgctagtgcctggactctctacgcggttgccaccacttttgttaccccaatgcttagacacagtatcgagaacagtagtgtaaacgtctcattgacggcgatagctaatcaggcgacagttctaatggggctcggaaaaggttggccattgagcaaaatggacataggagttcctctcttagcaataggatgttactcacaggttaacccgatcacgctaacagcggcactattgttgctagtcgcccattatgcaataataggcccaggccttcaagcaaaagcaacgagagaggcacaaaagagagcagctgcaggtataatgaaaaatccaaccgttgatggcataacagtcatagacctcgatcccattccgtatgacccaaagtttgaaaagcagttaggccaggtaatgctcctaatcttatgcgtgacacaagtactaatgatgcgaacaacatgggcactatgtgaagcgttaacactagctactggaccgatttcgacgttatgggagggcaacccaggaagattctggaacactacgatagcagtgtctatggctaatatattcagaggaagctacttggccggtgctggcttgttattttccattatgaaaaacacaacaaacacacgtcgaggtacaggtaatatgggtgaaacacttggagagaaatggaaatcaagactgaacgctttaggaaaatcggagttccaaatttataagaaaagcggcattcaagaagtagatagaacgcttgcaaaggaggggataaaaagaggagaaacagatcatcacgcagtatcaagaggatctgcaaaactacggtggttcgtcgaacggaatatggttaccccagaaggcaaggtagtggatctaggatgtgggaggggcggttggtcgtattactgtggtggtctaaagaacgtcagggaagtaaaagggctgaccaaaggcgggccagggcatgaagaaccgattccaatgtcaacctacggttggaatttagtaagattgcaaagcggcgtagacgtcttcttcatacctcctgagaaatgtgacacgctactgtgtgacattggagagtcgtcaccgaacccgacagttgaagctggccgaaccttacgagtgcttaacttggtagaaaattggttaaacaacaatactcaattttgtataaaagttcttaatccctacatgccaagtgttatagagaaaatggaagcgctacagagaaaatatggaggggccctagtgaggaatccactctctagaaattcaacccacgaaatgtattgggtatcgaatgcatccggaaacattgtcagctcagttaatatgatatcacgtatgttaatcaacagatttacgatgaggcataagaaggccacgtacgaacctgatgtggatcttggatcaggtacacgaaatatagggatagagtcggaaactcctaacctagacatcataggtaaacgcattgagaaaattaaacaagaacatgagacaagctggcactacgaccaggaccatccttataaaacttgggcttaccatggaagctacgaaaccaagcagacgggatctgcatcttcaatggttaatggcgtagtacgtttactcacaaaaccttgggatgtactaccgacggtaacacaaatggccatgacagatacaacaccattcggacaacagcgtgtattcaaagaaaaagtagatacaagaacacaagagcctaaagaaggcactaagaaattgatgaaaattactgcggaatggctctggaaggaattaggtaagaagaaaacgccacggatgtgcacacgcgaggaatttactagaaaggtgaggagtaacgccgcgttaggagcgattttcaccgatgaaaataaatggaagtctgcaagagaagcagttgaagacagccgtttttgggagctagtagacaaagaacgtaatctgcatcttgaaggtaagtgcgaaacctgtgtctataacatgatgggcaaacgagaaaagaaactaggggaatttggtaaagctaaaggcagtcgtgcgatctggtatatgtggctcggtgcaaggttcttagaatttgaggcgctgggtttcttaaatgaagaccattggttttcaagggagaactctctgagtggcgtagaaggagaaggcctacataaattaggatatatattgcgtgatgtgtcaaagaaggaaggcggagcaatgtatgctgatgataccgcaggttgggatacgcggataaccttagaggatctgaagaatgaagaaatggttacaaaccatatggagggagaacacaagaaactcgcagaggctatctttaagttgacgtatcaaaataaagtagtcagagtccaaagaccaacacctcggggaactgtgatggacataatatctcgacgtgatcagagaggtagcggccaagtagggacatatgggttaaatacatttactaatatggaagcacagctaatccgtcagatggaaggcgaaggggtatttaagaatatccaacatttaacagccacggaagaagtagcggtacaaaattggcttgcgagagtcggtcgtgaacgactatctaggatggctatatcaggagatgattgtgttgttaaaccgctggatgatagatttgccaatgctcttaccgcgctcaacgatatgggaaaaattcgaaaggacatccaacaatgggaaccttccaaaggatggaatgactggacacaagttcctttttgctcacatcatttccacgaacttataatgaaggacggtcgtgttctggtcgtgccttgtcgaaaccaggacgagctaataggtcgtgcgcgaatcagtcaaggagctggctggagtcttcgggaaacggcatgtttgggaaaaagttatgctcaaatgtggtctcttatgtactttcaccgcagagacctaagactcgcggcaaatgcaatctgttcggctgtaccatcacactgggtgcctacatcacggacaacttggagtatacatgctaaacatgaatggatgacaacagaagatatgttaaccgtgtggaatcgagtatggataagagaaaatccatggatggaagacaaaacaccagtagaaagttgggaggagataccttacttaggcaaaagagaagatcagtggtgtggaagcctgatcggattaaccagtagagcaacatgggccaaaaacatacaagtagccataaatcaagtaagatcactcattgggaacgaagaatacacagattatatgccttcgatgaaaagatttaggcgcgaagaagaagaagcaggagtactatggtaa

SEQ ID NO: 22683 - RNA, 9876 nt, synthetic construct
  misc_feature 1..9876: note = derived and/or modified CDS sequence (opt6) from DENV-2__EU677149__SS-prME
  source 1..9876: mol_type = other RNA
tccgctgggatgataattatgctaatacccactgttatggcattccatctaactactagaaacggagaacctcacatgatcgtaggtattcaagaaaaaggaaaaagtttactattcaaaacggaggatggggttaatatgtgtacattaatggctatggatttgggagagctttgtgaggatactataacatataaatgcccattgcttaggcaaaatgagcccgaagacatcgattgctggtgtaactcgacttcaacttgggtaacatatggcacttgcacgactacaggggaacataggagagaaaaacgatcagtagcactggtacctcatgtgggaatgggtttagaaactcgcactgaaacatggatgagctcagaaggagcatggaaacacgcgcaaagaattgaaacgtggattttacgacatccaggatttactatcatggcggctatactcgcatacacaataggcaccacacacttccaaagagtactaatctttatacttttaacagctgtagcacctagtatgaccatgaggtgtataggaatatcgaatagagactttgtggagggagtgagcgggggttcgtgggttgatatcgtcttggaacatggaagttgcgtcaccacgatggctaaaaataaacccacactagattttgaattgattaaaacagaggcaaaacaaccggcaacattacgaaaatattgtatagaggcgaagttgacaaacacaacaacagaatcacgttgccctacacaaggagagccatcacttaaagaagaacaagacaaaagatttgtatgcaaacacagtatggttgacagaggttggggaaatggatgtggattatttggtaaaggcgggatcgttacatgtgccatgtttacctgtaaaaagaatatggaagggaaaatcgttcaaccggaaaacttggagtataccattgtagtaacaccgcactcgggagaggaacatgcggtaggaaatgatactgggaagcatggaaaggaaataaaagtaaccccacaatcaagcattacagaagccgaattgacaggatacggcacagtaacgatggaatgcagtccaagaacagggctagatttcaatgaaatggtattattacaaatggaaaataaggcttggctcgtacacagacaatggtttttggacttaccattaccgtggttacccggggcagataaacaagagagcaattggatacaaaaagaaaccttagtaacatttaagaatcctcacgccaaaaagcaagatgtcgtagtcctaggttcacaagaaggtgcaatgcatacggcgctaacaggcgcaacggaaattcaaatgagctccggtaacttacttttcaccggtcacctcaaatgtagattgcgaatggacaagttacaattaaaaggaatgtcgtattcaatgtgcacaggaaaatttaaagtagttaaagaaattgctgaaacgcaacatggaaccattgtcataagggtacaatacgaaggtgatggaagcccgtgtaagattccatttgaaattatggatcttgaacgtagatatgtccttggacgattaattactgtaaatccaatagtgacggagaaggatagtcctgtaaacattgaagcagaaccaccctttggcgattcatatattattatcggggtagaaccgggacaactgaaacttaattggtttaagaaaggtagtagtataggtcaaatgtttgagacaacaatgcgaggagcaaaaaggatggcaattctcggagatacggcctgggacttcggaagtctaggcggggtatttaccagcatcggtaaagcgttacaccaagtattcggggctatctatggagcggctttcagtggagtcagctggactatgaaaatacttattggagtaattataacttggataggcatgaacagtcgctctacaagtttaagtgtaagtttagtgcttgttggaatcgtaacactatacttgggtgtaatggttcaagccgacagtggttgtgttgtctcgtggaaaaataaagaattaaaatgcgggagtggtattttcataactgataatgtacacacctggacagaacaatataaatttcaaccagaaagcccgagcaaacttgccagtgctatacagaaagctcaagaagaaggaatttgcggtattcgatcagtaacaaggctagaaaacctaatgtggaaacagataaccccggaacttaatcacatactagctgaaaacgaagtaaagttaaccattatgacgggtgatatcaaagggataatgcaggctggcaaacgaagtttgcggccgcagccaacagaactaaaatatagttggaaaacgtggggcaaagcgaagatgctatcaactgaatcatataatcagacattcttaatagacggtccagagaccgcagaatgccctaacacaaacagagcgtggaactcattggaagtagaagactatggattcggcgtttttactacaaatatatggctgaaacttaaagaaaaacaagacgccttctgtgatagtaaattaatgagtgctgccatcaaagacaatagagctgttcacgcagatatggggtactggatagagagtgctttgaatgacacttggaagatagagaaagcatcgtttattgaggttaagaactgccactggcccaaaagtcacacactgtggtcaaatggagtattggaaagtgaaatgataataccgaaaaatttagcgggaccggtatcgcagcacaattacagaccaggatatcatacacaaatagctggcccatggcacctagggaaactagaaatggattttgacttctgtgatggaacgacggtaatagtaactgaggactgcggtaaccgcggtccatcgttgagaactacaactgcttccggaaaactcatcacggaatggtgttgccgttcgtgcaccttacccccattgaggtatagaggtgaagatggctgttggtatgggatggaaataagacccctcaaagaaaaagaagaaaacctggttaactctttagtcactgctggtcacggtcaggtagataactttagcctaggagttctgggaatggccctatttttagaagaaatgttaaggacacgagtaggtactaagcatgcaattcttcttgtggcagtctcttttgttactcttatcacaggaaatatgtcattcaaggatctagggagggtggttgtaatggtgggcgcaaccatggcagacgacataggtatgggcgtgacatatctcgcgctactcgccgcctttaaagtccgccccacatttgcagcggggctattgttgcgcaaacttacttcaaaagaactaatgatgactaccataggcatcgtcctgttatctcaaagcacaatacccgaaacggttctggaactcacagatgctctagcactcggaatgatggtactgaaaatcgtcagaaacatggaaaaataccaactcgcagtaacaattatgactattttatgcgtgcctaacgccgtgatcttgcagaacgcatggaaagttagttgtacgatactcgcagtcgtcagtgtttcaccacttctattaacatcatcccgccagaaaacagattggatacctttagcgttaacaataaaaggacttaacccaacggcgatcttcctcaccacactttccagaacaaataagaaacgatcgtggccactaaatgaagctataatggcagtaggaatggtatctatactcgcatcttccctactcaaaaatgatattccaatgacaggcccactcgtagcgggaggtttgctaacagtgtgttatgtgctaacaggaaggtcggcagacttagaattagaacgtgcgacggatgtcaaatgggaggatcaagcagaaatttcaggtagcagccctatcttgagcattactatttcagaggacggttcaatgagtatcaaaaatgaagaagaagaacaaactctaacgatattaattagaacgggcctgttagtgatatcggggttgttcccaatatcgatcccaattaccgctgcagcatggtacctgtgggaagtcaagaaacaacgggcaggagttttatgggacgtgccaagccctccaccaatgggaaaagccgaattggaagacggcgcttatcgtataaaacaaaagggaatattgggatatagccagataggtgcaggggtgtacaaagaaggtacattccatacaatgtggcacgttacaagaggagcggttctaatgcataaagggaaacggatcgaaccatcatgggctgatgtaaagaaggacttaatttcatacggaggaggatggaaactagaaggtgaatggaaagagggagaagaggtacaggtattagcattggaacccggtaaaaatccaagagcggttcaaactaaacctggactgttcaaaacaaacaccggtacaatcggtgccgtgtccctcgatttttcacctggtacaagtggtagtccgataattgataaaaagggtaaggttgtcgggctgtatggcaacggtgtcgttacaagatctggtgcatatgtctcagctatcgcccaaactgagaaatctatagaggacaaccccgagattgaagatgacatattcagaaaaagacgtttaactataatggatctacatccaggagcaggcaaaaccaaaagatacttaccagcaatagttagagaagcaataaaacgaggactgcgcaccctaattcttgcgcctactcgagttgtagcagccgagatggaagaagcgctccgtggattgccaataagataccagaccccagcaatcagggcagaacatacgggacgggaaattgtagaccttatgtgtcatgctacatttacgatgagattactctcgccggttcgtgtaccgaattataaccttataattatggatgaagcacattttacggatccagcttcaattgcagcgcgaggatatatcagcacaagagtagaaatgggagaagcagcgggaatatttatgaccgccacgccaccagggtcacgagatccctttccacagtcaaacgcaccaatcattgatgaagaaagggaaatcccagaacgtagttggaactctggacatgaatgggtgaccgattttaaagggaaaacggtctggtttgtcccctcgatcaaagctggaaatgacatagcagcatgcttaagaaagaatggcaagaaagttatccaactaagccgaaaaacattcgattctgaatatgttaaaaccagaactaatgattgggactttgtagtaacaaccgatatttcagagatgggggcaaattttaaagccgagcgtgtaattgaccctagaagatgtatgaaacccgtgatactcacggacggcgaagaaagagtgatcttagcaggaccgatgccagtcacacattcgagtgcagctcaaagaagaggcaggataggtcggaatcccaaaaatgagaatgatcaatacatttacatgggtgaaccgttagaaaatgatgaggattgtgctcactggaaagaggcgaaaatgttactagacaacattaacactcctgaaggaataataccaagtatgttcgagccagaaagagaaaaggtagatgcgatagacggagagtaccggctgaggggcgaagcacgaaagacttttgtagatttaatgagaagaggagatctcccagtatggcttgcctataaggtagcagcagaaggaataaattacgcagatagacgctggtgttttgacggaatcaaaaacaatcaaatcctggaagagaatgtagaagtagagatctggactaaggaaggtgaaagaaagaaattaaaaccaaggtggttagacgcaaggatttattcggacccattagctctcaaggagttcaaggagttcgcagcaggtagaaagtcacttacccttaaccttattacagaaatgggccgacttccgacttttatgacacagaaaacaagagatgcattagataacttggcggtcctacatacggcagaagcagggggcagggcttataaccatgccctatccgagctacccgagactctagaaacattattgctgttaacattgttggccacggtaacaggtggaatatttttattcttgatgtcaggtagggggatagggaaaatgactttgggtatgtgctgcatcataaccgctagcatattgctctggtacgctcaaatacaacctcactggattgcagcaagcataatcctagagttcttccttatagtgctcctgataccagaaccggagaaacaacgcaccccacaagacaaccagcttacttatgtagttatagctatactcacagtagtagcagccacaatggcaaacgaaatgggatttttagagaaaaccaagaaagacttaggcctgggatcaatagctacacagcagccagagagtaatattctagacattgacctaagaccggcatcagcttggactctatatgcagtagctacgacctttgttactccgatgcttaggcactctatagaaaattcatctgttaacgtttcactaacagcaatagctaatcaagctacagtacttatgggactaggaaaaggatggcccttaagcaaaatggatataggagtccccttgttagccataggatgttatagccaagttaacccaattacattgacagcagcattactcctacttgtggctcactacgcgataatcggccctggtctccaggcgaaagccacgcgtgaagctcaaaaacgagctgccgcaggcattatgaagaacccgactgtagatggtataacagtgatagatttagaccctataccatacgatccaaaattcgaaaaacagctcggtcaggtaatgctcttgatactatgtgtaacgcaagttttgatgatgcgaacaacatgggcattatgtgaggctttaacactcgcaacgggaccaatatcaacgctatgggagggaaacccaggacgcttctggaacactacgattgcagtatcgatggccaacatctttagagggtcttatctcgcaggagcaggactgctattttccatcatgaaaaatactacgaacacacgtagggggacaggaaacatgggggaaacattaggcgaaaaatggaaaagccgcctcaatgcgttaggtaaatctgagtttcagatttacaagaaatcaggcattcaagaagtagacaggacattagcaaaagaaggtattaaaagaggggaaactgaccatcatgccgtttccaggggttctgctaaactaagatggttcgtagaaagaaatatggtcacacccgaaggaaaagttgtagatcttggctgtggtcgaggaggatggtcatattactgcgggggtttaaagaatgtacgtgaggtcaagggtcttaccaaaggtgggcctgggcatgaagaacccataccaatgtctacgtatggatggaacctcgtgcgattgcaatcaggagtagacgtattctttatcccgccagaaaaatgtgatacactattatgtgatattggagaaagttctcctaatccgactgtagaagcaggacgcacattaagagtattaaacctcgtggaaaactggttgaacaataacacacaattttgcataaaagttctcaacccctatatgccaagcgtaatagagaaaatggaagcccttcaaagaaagtacggcggtgctcttgtgagaaatccactgtcgagaaactcaacgcatgaaatgtactgggtctctaatgcatctggcaatattgtatcatcagttaatatgataagtcgaatgttaataaaccgatttactatgcggcacaagaaagctacatacgagcccgacgttgacttaggctcaggtacaagaaatatagggattgaaagcgagatacccaatctagacattataggtaaacggatagaaaagataaaacaggaacacgaaacatcttggcattatgatcaggaccatccctataaaacatgggcgtaccatggttcttacgaaacaaaacaaaccggaagcgcttcgtcaatggttaacggtgtagtcagattgctcacaaaaccatgggatgtcttacctaccgttacacagatggccatgactgatacaacacccttcggccaacaaagagtatttaaagagaaggtggacacgagaacacaggaaccaaaggaagggactaaaaagctaatgaaaatcacagcggagtggttatggaaagaactaggcaagaagaaaactcctaggatgtgtacaagagaagagttcactcgtaaagtgaggagcaacgctgctctgggagcgatattcacggatgaaaataaatggaaatcagccagagaagccgtagaagacagcagattttgggaacttgtggacaaagagagaaacttacacttagaaggtaaatgtgaaacttgtgtatataatatgatgggtaaaagagaaaagaaattgggtgaatttgggaaagcgaaagggtcacgcgctatttggtacatgtggttaggagcaagattcctagaatttgaagcactgggattcttaaacgaagatcattggtttagccgtgaaaattcgctctcgggggtagagggagagggtctccataaacttgggtatatccttagagatgtatcaaagaaagaaggaggagcaatgtatgccgacgatactgcgggttgggacacgagaattactctagaggatctaaagaatgaagagatggtaactaaccatatggaaggcgaacataagaaattagcagaagcaatatttaaactaacatatcagaataaagtagtacgcgtacagcgcccaacgcctcggggaacagttatggatattatctcaagaagagaccagcgaggatcgggccaagtaggaacctacggactaaacaccttcactaacatggaagcacaactaattagacaaatggagggggaaggggtatttaaaaatattcagcacctgaccgtcacggaagaagttgctgttcaaaactggctcgcacgagtgggacgagaaagattaagcaggatggctataagtggggacgattgtgttgtaaaaccattagatgatagattcgcaaatgccttaactgctcttaatgacatgggcaaaattaggaaagacattcaacaatgggaaccttcaaaaggatggaatgactggacccaagttcccttctgttcccatcattttcacgaactaataatgaaagacggtagggtactcgtagtaccatgcagaaatcaagatgaattaattggtcgagcacgaattagtcaaggggctgggtggtccttgcgagaaacagcgtgcttgggcaagtcgtatgcgcaaatgtggtccttaatgtacttccacagacgtgacctcaggttagcagcgaatgcaatttgtagtgcagtcccttctcattgggttccaacatcccgaactacatggtcaatccacgcaaaacatgagtggatgacaactgaggatatgttaactgtttggaataaagtatggataagggaaaatccatggatggaggataaaactcccgttgaaagttgggaagaaattccatatctaggaaagcgcgaagatcagtggtgtggctcacttattggtttgacgtcacgagcaacgtgggcgaaaaacatacaggcagcaatcaatcaggtaagatccttaataggaaatgaagaatatactgattacatgccaagtatgaagcgattcagaagagaagaggaagaagcaggagtactttggtaa

SEQ ID NO: 22684 - RNA, 9876 nt, synthetic construct
  misc_feature 1..9876: note = derived and/or modified CDS sequence (opt6) from DENV-2__FJ024452__SS-prME
  source 1..9876: mol_type = other RNA
agcgcagggatgatcattatgttaataccgacggtcatggcattccacttaacaaccagaaatggggaacctcatatgatagttggaattcaagaaaaaggaaagagtctacttttcaagacggaagatggcgtaaatatgtgcactctaatggcaatggacttgggagaactatgcgaagacacaatcacctataaatgcccgcttttaagacagaatgaaccagaagacattgactgctggtgtaactctactagtacatgggtaacttatgggacgtgtactacaactggtggacacagaagagaaaaacgctctgtagcattagtaccacatgtaggcatggggctagaaacaagaacagaaacatggatgagcagcgaaggggcgtggaaacacgcgcagagaattgagacttggatcttacggcatccaggcttcactataatggcagcaatcttagcgtacactatagggacaacacacttccaaagggtattaattttcatacttctaactgcagtggctccatcaatgacaatgaggtgtataggtatatcaaatcgagatttcgtcgaaggtgtgagtggcggctcatgggtagatattgtactagaacatgggagttgtgtaactactatggcgaagaacaagccgacactagattttgagcttattaaaacagaggcaaagcaacctgcgacactaagaaagtactgcatagaagcgaaattgacgaataccactacggaaagccgctgccctacccaaggagaacctagcctgaaggaggaacaagacaaaaggttcatttgtaaacattcaatggtcgaccggggatggggaaatggatgtggtctttttggcaaaggcggcatagtcacatgcgctatgttcacatgtaagaaaaatatggaggggaagatagttcaaccagagaatttagagtataccatcgttgtcacacctcactcgggagaagaacacgccgtcggaaacgatacaggcaaacatgggaaggaaataaaggtgactccgcagtccagcattaccgaagcagaattaacagggtatgggacagttacaatggagtgtagtccaagaactggcttggattttaacgaaatggtcttacttcaaatggagaacaaagcatggctcgtacaccgacaatggtttctggatctaccattaccatggttacctggcgctgacaagcaagaaagcaattggatccaaaaggaaacactagttaccttcaaaaatccacacgcaaaaaaacaagatgtcgtggtactagggtcacaagagggagcgatgcacactgctttaacaggagctacagaaattcaaatgtccagtggaaatctactattcactggacatctgaagtgtagactgagaatggacaaattgcaattaaaagggatgtcatactctatgtgtacaggtaaatttaaggttgtaaaggagattgccgagacacaacacggaacaatcgtaatcagggtacaatatgagggagatgggtcaccgtgcaagataccatttgagattatggacttagaaaaaagatatgttctaggaagattgataacagtcaacccgatagtaactgaaaaagactcaccagtgaacatagaagcagaacccccttttggagatagctacataataataggcgtggaacctggtcagctaaaactaaattggtttaagaaaggaagttcgataggacaaatgtttgaaacaacaatgagaggtgctaaaagaatggccattctgggagatacggcttgggattttggatcattaggcggcgtcttcacgtcaataggtaaggccctccatcaagtatttggggcaatttacggagcggcgttttctggagtcagctggacgatgaaaatactgataggggtaatcatcacatggatcggcatgaactccagatctacgtctctcagcgtaagcttggtgctagttgggattgtaactctgtacttaggagtcatggtccaagcagatagcggttgcgtagtgagttggaaaaataaggaattaaaatgtggatcaggaatatttattacagataacgtacacacctggactgaacaatataagtttcagcctgaaagtccttcaaagctcgcatcagccatacaaaaagcccaggaagaaggtatttgtgggatacgaagcgttacacgtctcgaaaatctaatgtggaaacaaatcacccctgaattgaaccatatcctcgcggagaacgaagtaaagttgacgataatgacgggagatataaaaggaataatgcaggcgggtaaaagatcacttcgtcctcaaccaactgaacttaaatattcctggaagacttgggggaaagctaaaatgttaagcacagagtcttacaaccagacgttcctaattgatggtccagaaacagccgagtgtcctaatactaatcgagcttggaacagcctggaagttgaagattatgggttcggggtgtttaccacaaatatttggcttaagctaaaagagaagcaagacgctttttgcgactcaaagttgatgagcgccgcaataaaagataatagagctgttcacgcagatatggggtactggatagagtcagcattaaatgatacttggaaaatagaaaaggcctccttcatagaagtcaagaattgtcattggccaaagtcacatacattgtggtcaaatggggtattagaatcagagatgataatacccaagaacctagcgggcccagtctcccaacacaattacagaccgggatatcatacacagattgcaggcccttggcacctagggaagctagaaatggattttgacttttgtgatgggactacagtcatagtcacggaagattgtgggaaccgaggccccagtttacgcacaaccacagctagtggaaaactgataactgaatggtgctgtaggtcgtgcacattaccccccctaagatacagaggtgaagacggctgctggtatggtatggaaatcagacctcttaaggaaaaagaagaaaacttagttaattcactggttactgctgggcatgggcaagttgacaattttagtctaggagtactgggcatggcgctatttcttgaggaaatgttgaggaccagagtgggaaccaaacatgcgatcttactagtggcagtgagttttgtcacgttaatcactggcaacatgagttttaaggatttaggccgagtcgtggtaatggttggggcgacaatggcagatgacataggtatgggagtcacgtacttagcactcttagcagcgttcaaagtacgtcccacattcgctgctggtctactcttacgaaaattaacgtcaaaagaactgatgatgacaacaatcggaatagttctactaagtcagtcaacaatccctgagacagtactggagttgacggatgctttagcactaggtatgatggtgctgaaaatcgttaggaatatggagaaataccaactagcagtaacaataatggcaatactctgtgttcccaatgcagtcattttacaaaacgcttggaaagtatcatgcacaattctcgctgtcgtcagtgtgagccctctcttattgacaagttctcaacaaaaaacagattggatcccattagcattaaccataaagggtcttaatcccactgccatttttctgactaccctaagcagaactaacaagaagagatcgtggcctttaaacgaagctataatggctgttggtatggtttcgatactcgcatccagtctgttaaagaacgacattccaatgacaggtcccctagtggcaggtggactattaacagtatgttatgtgctaaccggacgaagtgcagacctagagctagaaagagcgactgatgtaaaatgggaagatcaggcagagatatcaggaagctcgcctatattatcaatcacgatatctgaagacggaagtatgagtattaaaaatgaggaggaagaacaaactctaacaattttgataagaactggcttattagttatatcgggattatttccaatatcaataccaataactgcggcggcctggtatctatgggaagtgaaaaaacaacgcgcaggtgtcttatgggacgttccttccccgcctccaatgggaaaagctgaactcgaagacggagcgtatcgcattaagcaaaaaggtatattaggatatagccagataggagctggagtatataaggaaggcacatttcacacaatgtggcacgtgacacggggagcagttctaatgcataaaggaaaacgaatagaaccatcgtgggccgacgtcaaaaaagatttaatatcatatgggggaggctggaaactagagggcgaatggaaagaaggcgaggaagtccaagttttggcactagaacccggaaaaaatccacgtgcagtccaaaccaagccaggtctatttaaaaccaatacagggacaattggggctgtgtctcttgatttttcacccggcacgtcaggctctccaataatcgacaaaaaaggtaaagtagtcggcctctacggaaacggagtagtaacacgaagtggagcatatgtcagcgccatcgcacaaacaggtaaatcgattgaagataacccggaaattgaagacgatatattcagaaagagacgacttacgattatggacctccacccaggagcaggaaaaacaaaaagatatttgccggcaatcgtgagggaagcgataaagagaggactgcgtaccttaattttagcaccaacaagagtagtcgctgcggaaatggaagaagctctacgaggtctaccgattaggtaccaaacaccagcgataagggctgaacatacgggaagggaaatagtagatctcatgtgccatgcaacgtttaccatgagactgctatcccctgtacgcgtaccaaattacaatctaattataatggatgaagctcactttacagacccggcgagcatagcggcaaggggatatataagcacacgagtagaaatgggagaggcagcgggaattttcatgacagcaacaccaccgggatctagagacccattcccccaaagtaatgcacctataatagacgaagaaagagaaattccagaaagaagttggaacagtggccatgaatgggtgacagacttcaaaggtaagacagtttggtttgtcccaagtataaaggcaggcaatgacatagcagcatgtttgcgaaaaaacggaaaaaaagttattcaactctcaagaaaaacttttgactcggaatatgtaaagacacgaataaatgactgggattttgtagtaaccaccgatattagtgaaatgggagcaaacttcaaagcagagagagtaattgaccccagaagatgtatgaaaccggtgatcttaaccgacggcgaagaaagagtaatactggcaggaccaatgccagtaactcattcttcggccgctcaacgacgtggaaggatagggcgaaaccctaaaaacgaaaacgatcagtacatttacatgggagaacctttagaaaatgacgaagactgtgcccactggaaagaggcgaaaatgcttttagacaatataaatacaccagaagggataataccctcgatgtttgaacccgagcgagaaaaggttgacgcgatagatggggaatatagattaagaggtgaagcaagaaaaacgttcgttgatctgatgagacgcggtgaccttccagtatggctagcatataaagtagccgctgaaggtataaattatgcagatcgaaggtggtgcttcgatggaattaagaataaccagatcctggaagaaaacgtagaagtagagatctggacaaaggagggagaacgaaaaaaattaaaaccgcgatggctcgatgcaagaatctattcagaccctttagcactaaaagagtttaaggagttcgctgccggaagaaaatcattgacacttaatctaattacagagatggggagactaccaaccttcatgacgcaaaaaacgagggacgccttggacaatttagctgttcttcatactgcggaagcaggcggtagagcatataaccacgcgctctccgaactccctgaaacactggaaacgttattactcctaaccctattagcgacagtaacaggaggaatattcctattcttaatgagtggaaggggtataggtaaaatgacattaggaatgtgctgtataataacagcgagcattctgctatggtatgcacaaatacaacctcattggatagcggcatctataatattagagttttttctgatagtgttactcatcccagagccggagaaacaacgtacgcctcaggataatcagttaacgtatgtcgtaatagcgatactaacagtagttgcagccacaatggcaaatgagatgggattcttggaaaagactaagaaagatttgggtctgggatcaatagctacgcaacaaccggagtccaatatcctcgacatagacttacgtccagcctctgcgtggactttatacgcagttgcaacgacttttgtaactcctatgttgaggcactcaatagagaattcaagtgttaatgtctccttaaccgctatagcaaaccaagccacggttcttatgggcctaggaaagggttggccattgtcgaagatggatatcggagtcccactacttgcgattggttgctatagtcaagtaaatcctataactttgactgcagctctgttattactagttgcacactacgctataataggtcccggattacaagctaaagccactagggaggcacaaaagcgagctgccgctggaataatgaaaaaccccactgtagatggaataacagttattgatttagatccgataccgtatgacccgaagttcgagaaacagctagggcaagtcatgctccttattttatgcgtaacgcaagttctaatgatgagaacaacttgggcgctatgtgaagcactcacactagcaacggggcctattagcaccctatgggaaggaaacccggggcggttctggaacactaccatagccgtaagtatggcaaacatatttagaggctcatacttggccggagcaggattattgttcagtataatgaaaaatacaactaatactcgaagaggcacaggaaacataggagaaacacttggagaaaaatggaaaagccggttaaatgctctaggcaaatcggaatttcaaatttataagaaatcaggtatacaagaggtagataggaccttagcgaaagaagggataaaaaggggagaaacagatcatcatgcagtgtcaagaggatctgctaaactgcgatggttcgttgaaagaaatatggtaactccggagggaaaagtagtagatctcgggtgtggtcgtggtggttggtcatactactgtgggggcctgaaaaatgtgcgagaagttaagggtttgacaaagggtggaccgggccatgaggaaccgataccaatgagtacttacggatggaatctggtaaggttacaatcaggcgttgacgttttcttcatacctcctgagaaatgtgatactcttttgtgcgacataggagaaagtagtccaaacccgactgtggaagccggacgaacactacgagtattaaacttagtagagaattggcttaacaacaatacccagttctgcattaaagtgttgaatccatatatgccaagcgtgatagaaaaaatggaagctctgcaacgaaaatacggtggagcgctagttcgcaatcctctatctcgtaacagtacgcacgaaatgtattgggtttcaaacgcctcggggaacatcgtaagcagtgtaaacatgatttccagaatgcttattaaccgttttacaatgaggcataagaaggctacatatgagcctgatgtagacctaggatccggcacgagaaacatagggattgaaagcgaaatcccaaatctagacattataggaaaacggatagaaaaaataaaacaagaacacgaaactagttggcattatgatcaagaccatccctacaaaacatgggcttatcatggatcgtatgaaacaaaacaaaccggtagtgcttcaagcatggtaaacggtgtagtccgtttattaacaaaaccttgggatgttctaccgacggtaactcaaatggcaatgacagacacaactccgtttggacaacaaagagtatttaaagagaaggtcgacacaagaactcaagaacctaaagaaggaacaaaaaagttgatgaagataacagcagaatggctatggaaggaactagggaaaaaaaaaactccaagaatgtgcacacgggaggaattcactagaaaggtcagaagcaacgcagcactgggcgctatatttaccgacgaaaataaatggaagagtgcaagagaagcggttgaagattctagattctgggagctaattgacaaagagcggaacttacatttggaggggaaatgtgagacgtgtgtttataatatgatggggaaacgcgaaaaaaagttaggggaatttggaaaggccaaaggtagcagggccatatggtatatgtggctaggtgcacgtttcctggaatttgaagcactcggatttctaaatgaagatcattggttcagccgggaaaatagtttgagcggcgtagaaggagaagggctacacaagctaggctacattctacgagatgtgtcaaaaaaagagggaggagcgatgtatgcagatgacacagctggttgggatacgcgtataaccttagaggacctcaagaacgaagaaatggttaccaatcacatggagggtgaacataaaaagctagcagaagccatcttcaaattgacataccaaaacaaggtcgtacgagtacaaaggccaactccaaggggaactgtaatggatattatctccaggcgtgaccaaagaggaagcggacaagtaggaacttatggactcaacacattcacgaatatggaggctcaacttattaggcagatggaaggtgaaggagtattcaagaacattcaacatctaactgttacagaggaggtggcggtccaaaattggctagcacgggtgggaagagaaagactaagcaggatggctatcagcggcgacgattgtgttgtaaaacctttagacgataggtttgccaacgcgctcacagcgttaaatgatatgggcaaggttaggaaagatatacagcaatgggaacccagcaagggttggaacgattggactcaagtacctttttgttcacaccattttcacgaactaataatgaaagatggaagagttttagtggttccttgtcgtaatcaagatgagctaattgccagagcaaggatttcacaaggagctggatggagtttacgtgagacagcctgtctcggaaaaagttatgctcaaatgtggagtcttatgtattttcaccgacgtgatctaaggttggccgctaatgctatatgctcagctgtgccatcacactgggtacctactagtcggacaacatggtccatacatgcgaagcatgaatggatgacaactgaagatatgttgaccgtctggaacagggtatggatacgagagaacccatggatggaagacaaaacgcctgtagaaagctgggaagaaattccctacctggggaaacgggaagaccaatggtgtggatccttaataggactcacaagccgagccacatgggcgaaaaatattcaagctgcgatcaatcaagtaagatcactaataggaaatgaggaatacacggattacatgccaagcatgaaacgatttagacgcgaagaagaagaagcgggtgtactttggtaa

SEQ ID NO: 22685 - RNA, 9876 nt, synthetic construct
  misc_feature 1..9876: note = derived and/or modified CDS sequence (opt6) from DENV-2__FJ205877__SS-prME
  source 1..9876: mol_type = other RNA
agcgcaggcatgataattatgttaataccaacagttatggcattccacctaactacacgaaacggtgaaccgcacatgattgtagggattcaagaaaaaggtaaatcattgttgttcaaaacggaagatggtgtaaatatgtgtaccctaatggccatggatcttggagaattatgtgaggataccattacgtacaaatgtcctttactacgacaaaatgaaccagaagacatagattgctggtgcaattctacatcgacctgggtaacgtacggcacatgtacgactacaggggaacatcggagggaaaaacgatccgttgctcttgtacctcatgtaggaatgggtttagaaactaggacagaaacatggatgtcgtccgaaggagcatggaaacacgcgcaaaggattgaaacctggatattaaggcatccagggtttacgataatggcagccatattggcgtatactataggtacgacacatttccaacgtgtattaattttcattctactaactgcggtagcgccgtcaatgactatgagatgcattggaatcagcaacagggactttgtggaaggcgtatcaggagggagttgggtagacatagtactagaacatggtagctgcgtaacaactatggcgaaaaataaaccaacattagatttcgaactaataaaaacagaagcgaaacaaccggcgactcttcgaaaatattgcattgaagctaaattaacgaataccacaacggaatcccggtgtccgacacaaggtgagccaagtctaaaagaagaacaagacaaaaggttcgtatgtaaacactcgatggtagacaggggatggggaaatggctgcggtttgtttggtaaaggaggaatcgtcacatgtgctatgtttacctgtaagaaaaatatggagggtaaaattgtacaacctgaaaacctagagtacactatagttgtaacgccacattccggagaagaacatgctgtaggaaatgatacgggtaaacacggtaaagaaattaaagttacaccacaatcgagtataactgaggcagaattaacgggttacggtacggtaaccatggagtgctctccaagaacaggactggactttaacgaaatggtgctactacaaatggagaacaaagcatggttagttcatagacaatggtttcttgatcttccccttccatggctaccaggagcggataaacaagaatctaattggatacagaaagagacgctagttacttttaaaaatccacacgccaagaaacaagacgtggttgtgttgggatctcaagaaggcgcaatgcatacagcacttacgggggcaacagagatacaaatgtcatctgggaatcttctttttaccggccatttaaagtgtagactaagaatggacaaactacaactaaaaggcatgagctactccatgtgtactggcaaatttaaggtagtcaaagaaatagctgaaacacaacatggtactattgtcattagagtacaatatgaaggagatggctcaccatgtaaaattccattcgagatcatggacctagaacggagatatgtactcggcagactaatcacagtgaatcctatcgtaactgagaaagacagtccggtgaatatagaagcagaaccaccatttggtgactcttacataataatcggcgttgagccaggacaactgaaacttaattggtttaaaaaggggtctagcataggtcaaatgtttgaaactacaatgcgaggagcaaagcgtatggccatattaggagatactgcgtgggactttggttcattaggtggcgtctttacctccatcggcaaggctttgcatcaagtttttggagccatatatggtgctgcattttctggggtcagctggactatgaaaatcctaattggagtcattataacttggattggaatgaacagtcgatccaccagtttatctgtttcacttgtattagtaggaatagtaaccctttacctcggcgtgatggtacaggcagacagcggatgtgtagtgagctggaagaataaagaattgaaatgtggaagcggaatctttattacagataacgtgcatacttggaccgaacaatataaatttcaacccgaatctccctccaaattagcatcagccatacagaaggctcaagaggaaggaatttgcgggatcaggagcgtgaccagattagaaaatctaatgtggaagcagattacgccagaacttaaccacatattagcagaaaacgaagtaaagctcacgataatgaccggagacattaaagggataatgcaggccggtaaacgttcgttacgacctcaaccgactgaactaaagtattcttggaaaacctggggaaaagcaaaaatgctgtccacggaatcatataatcaaacattcctgatagacggtcccgagaccgcagagtgtccaaatactaatcgcgcttggaatagtctagaagtcgaggactacggatttggtgtttttacgactaatatatggttgaaacttaaagagaagcaagacgcgttttgcgactcaaaattgatgtctgccgctataaaagataaccgagctgtgcatgccgatatgggatattggatcgaatccgcattaaacgatacatggaaaattgaaaaagctagtttcatcgaggtcaaaaattgtcattggccgaaaagccacacattatggtcaaatggagtattagaaagtgaaatgataattcccaaaaacctagcgggacctgtttcacaacacaattatcgccctggatatcatacacagatagccggtccatggcatctggggaaattagaaatggacttcgatttttgtgatggtaccacggtaattgtaacagaagattgtggaaacagaggcccatccttaagaaccaccacggcttctggcaagttaataacagagtggtgttgtagatcctgtacattacctccattaagatatcgaggagaagacggttgctggtatgggatggaaataaggccacttaaagaaaaagaagaaaatctagtcaattctctagtcacggcgggacatggacaagtcgataatttcagcttgggtgtactaggtatggctttgttcctagaagagatgctacgtacccgcgtgggtacgaaacatgcaattctcttagtagcagtcagttttgtgaccttaataactggaaatatgagttttaaagatctcgggagagtggttgtaatggtgggcgcaaccatggcggacgatatagggatgggggtaacttatttagccttacttgccgcatttaaggttcgtccaacattcgcagcaggactcttgttaagaaaacttacatcaaaagaactgatgatgacaaccattggcatcgtattactttcgcaaagtacaatacctgaaacagtgctggagttaacagatgccctagccttgggaatgatggtattaaaaatcgtgcgaaatatggaaaaatatcaactagctgttaccatcatgaccatcctatgtgtacccaatgcagtgatcctacagaacgcatggaaagtctcatgcacaatattagctgttgtaagcgtgagcccgttgctgctaaccagtagtcgtcagaaaacagattggatccctctcgcccttaccatcaagggtctaaacccaaccgcaatctttctaacaactctaagtcgaacgaacaagaaacgaagttggccacttaatgaagctataatggcggtaggcatggtgtcgatcctcgcaagttcattactcaaaaatgacattccgatgacaggtccgctcgtagcagggggcctattaacggtttgttatgtcctaacgggaagatcagcagatttagaactcgaacgcgctacagatgtaaaatgggaagaccaagcagaaatttctggaagctcaccgattctatctataacaatatctgaagatggatccatgtcaattaaaaatgaggaagaagaacaaacactaaccattcttataagaacagggctcctagttatctcaggtcttttccccatatccataccgatcactgctgccgcatggtatttgtgggaggtcaagaaacaaagagctggagttctatgggacgtgccctcaccgcctccgatgggaaaagctgaattagaagatggagcatacagaataaaacagaaaggaatcttagggtatagtcaaataggtgccggagtttacaaggaaggaacatttcataccatgtggcatgttaccagaggtgcagtcctgatgcataaaggtaaacggatagagccttcatgggcggatgtcaagaaagacctgatctcatacggcggaggatggaaattggagggggaatggaaggagggtgaagaagttcaagtgctcgcgctagaacctggtaaaaatccacgagctgtgcaaacgaaaccaggattatttaaaacaaatacgggaacgataggtgccgttagtttagatttttccccgggtacctccggatcccctattatagacaaaaagggtaaggtggtgggtttatatggaaatggtgtagtaactagatcgggagcttatgtaagcgcaatagcgcagacggagaaaagtattgaagataatccggaaatagaggacgatatatttagaaaaagacgtctcacgataatggatttacacccaggagccggaaagacaaaaagatatttgccagccatagtcagagaggcaatcaaaaggggactgagaacattgatactggcacctacgagagtagtagcagcagaaatggaagaagccctcaggggccttcccatcagatatcaaacgccggcaattcgggcggaacacaccggcagagaaatagtcgacctaatgtgccacgctaccttcacgatgaggctcctgtcccctgtaagagtgccgaattacaatcttataattatggacgaagcccattttactgaccccgcaagcatcgcagcacgaggatacatctcaactagggtcgaaatgggcgaagccgcaggtatctttatgacagcaactccacctggttcaagggacccatttccccaaagcaatgccccgattatagatgaagaaagggagatacctgagaggagttggaactctggacatgaatgggtaacggattttaaaggaaagactgtctggtttgtgcccagcataaaggctggtaatgacattgccgcctgtctccgaaagaatggtaagaaagtaattcaactaagccgaaagacttttgactcagagtacgttaagacgagaaccaatgattgggattttgtagttacaaccgatattagcgagatgggagccaattttaaggcagaaagagtaatcgatcccaggagatgtatgaaacctgtcatactgacagatggagaagaaagagtaatattagcaggtccgatgcccgtaacgcattcaagcgctgcgcagaggaggggtcgaataggaaggaacccaaagaatgaaaatgatcaatatatctacatgggggagccactggaaaatgacgaggattgtgcacactggaaggaagcaaagatgttactagataacattaatacaccagaaggtattataccaagtatgttcgaaccagaacgcgaaaaagtagatgcaatagacggagaatacagattgagaggcgaggcacgtaaaacattcgtcgatcttatgagaagaggggatctccccgtttggttagcttacaaggttgccgcagaaggaataaattaccctgatcgtcgatggtgcttcgatggaataaagaacaatcaaattttggaggaaaacgtggaggtagaaatctggcccaaagaaggagaaaggaagaaattaaaacctcggtggttagatcccagaatttattccgagccccgtgcattaaaagaatttaaagagtttccacccggacgtaaaagccttactttaaatctaataaccgagatgggcagactaccaacgtttatgactcagaaaacaagagacgcactggataatttggcaggactacatacggcggaagcgggtggtagagctgacaatcacgccttaagcgaattggctgaaacgctcgaaacattgctcctcttaacgttgttggccactgggacaggcggaatatttctctttctaatgtcaggaagaggtataggaaagatgactttaggcatgtgttgcattattaccgcttctattcttttatgggacgcacagattcaaccgcattggattgccgccagtataatactagagttctttctaatcgtattgctcatacctgaacctgaaaaacaaaggacgccccaagataatcaactgacatatgtcgtcattgcaatactcactgtcgtcggtgcgacaatgcccaacgaaatggggttcttagagaaaacaaagaaagatctgggactcggatcgatagctactcaacaacctgagtcgaacatactagatattgacttaagacccgcatccgcgtggacgttatacgcagtagcaaccacatttgtgacacctatgcttagacatagtatagaaaattcctctgtaaacgtgagtctaacagctatagcgaatcaagccacagtattaatgggactagggaagggatgggccttagctaaaatggacattggggtgcctctactaggtatagggtgttattctcaagttaatcctatcacgttgacaggggccctactattgctaggcggacattacgcaataataggaccaggcttacaggccaaggcgacaagagaagcacaaaaacgcgctgcgcccggaattatgaagaacccaacagtagatggtattactgttatcgatttggacccaataccttacgatcccaaattcgaaaagcagctaggacaggttatgttattaatattatgcgtaacccaagtcttgatgatgagaactacgtgggccctttgtgaagcgttgacactagcgaccggaccaatttcaactctttgggaaggtaacccgggacgtttctggaatacaactatagcagtaagcatggctaacatttttagggggtcatacctggcaggggccggcctattgttttctattatgaaaaacacaacaaacactcgaagaggaacgggaaatatgggagaaactcttggtgaaaagtggaaaagtagactaaacgctcttggaaaatcagaatttcagatttacaagaaatcaggcatccaagaggtagaccggactctagcaaaagaaggaatcaagcgtggtgaaaccgaccaccatgcagtatcaagggggagtgctaaactgcgttggtttgtcgaacgtaatatggtgactcctgaaggaaaggtagtagaccttggttgtgcaagagggggatggtcatattactgtggtggccttaagaatgtaagagaagtaaagggattaacgaaaggaggacccggacatgaagaaccaatccctatgtccacgtacggttggaacttagttagactccaaagcggagtagacgtcttctttattcctcccgaaaaatgtgatactctactgtgtgacatcggagaatccagtcccaatcctacagttgaagcaggacgaacactccgtgtgcttaatctcgtagaaaattggttaaacaataacacacaattttgtataaaagtattaaatccatatatgccaagtgtaattgagaagatggaggcactccagaggaaatatggaggtgccctagtaagaaaccctctatcaagaaacagtacccatgagatgtactgggtaagtaacgcaagtgggaacattgtctcatcagttaacatgataagtaggatgctaataaatcgtttcaccatgaggcataagaaagcaacatatgaacctgatgttgacctcggttccggaacaagaaatataggtatagaatcagaaattccaaacttagatatcattggaaaacgtatagagaaaataaaacaagaacacgaaacatcgtggcattacgatcaagaccatccatataaaacatgggcatatcatggaagttacgagacaaaacagacaggttcagcaagcagtatggtaaatggcgtagtgagactacttacaaagccctgggatgtcttacctacggtgacacaaatggctatgacagacacgaccccttttggtcaacaaagagtattcaaagagaaggtggatacgcggacccaagatccaaaagaagggactaagaaattgatgaaaataactgctgagtggttatggaaggaactaggaaagaaaaagacaccaaggatgtgcacaagggaagaatttacgcgcaaggttagaagtaacgccgcgctaggtgctatatttacggatgaaaataaatggaaaagcgcacgtgaagctgtagaagactcaaggttctgggaattagtagataaggagcgaaatttacatctggaagggaaatgtgaaacctgtgtttataatatgatgggtaaaagagagaagaaactcggtgaatttggcaaagcgaaagcatcgcgagctatatggtatatgtggttaggcgcaagattccttgagtttgaagccctaggatttctgaacgaagatcactggttttctcgagagaactccttatctggcgtagaaggagagggactacacaaactgggatacattcttagagatgtaagcaaaaaggaagggggagctatgtacgcagacgatacggcgggatgggatacaagaataactcttgaagatcttaaaaacgaggaaatggttactaaccacatggaaggcgagcacaagaaactagcagaagccatattcaaactcacttaccaaaacaaagttgtacgggtacaaagacccactccaagaggtacagttatggatattatctcgagaagagaccagagaggctctggacaagtagctacatatggcttgaatacatttacaaatatggaggcacaactaataagacaaatggaaggcgaaggcgtgtttaaaaatatacaacatttgaccgttaccgaagaagtcgcagtacaaaattggttggccagggtcggccgagaacgtctgcccagaatggcaatttcaggcgatgattgcgtggtgaaaccgctagatgcacgttttgccaatgctctgacagccttgaacgcaatgggtaagataagaaaagatatacaacaatgggagcccagtaaaggttggaacgattggacgcaagttcccttctgtagccatcactttcatgaattaataatgaaagatgggagagttctagtagtaccgtgtcgcaaccaagacgaactcattggtcgtgcgaggatttcacaaggagccggctggagtctccgagaaacagcctgtttaggcaaaagctatgcgcaaatgtggtcgctaatgtactttcatagaagagatctcagattagcagcaaatgcaatatgcagtgcagttccatcacactgggtccccacaagcagaacaacatggtcaatacatgccaagcatgaatggatgacaacagaggatatgttaacagtttggaacaaggtatggataagggaaaatccttggatggaggacaaaacaccagtcgaatcatgggaagaaatcccatatctcggaaaacgtgaagaccaatggtgtggtagccttattggcttaacaagtcgagccacatgggcaaagaacattcaagcagcaataaaccaggttaggtctcttatcggcaacgaggaatatacagactacatgccatcgatgaagcgtttccgaagagaggaggaagaagcgggtgtattatggtag

SEQ ID NO: 22686 - RNA, 9876 nt, synthetic construct
  misc_feature 1..9876: note = derived and/or modified CDS sequence (opt6) from DENV-2__FJ024454__SS-prME
  source 1..9876: mol_type = other RNA
agcgcgggaatgataataatgctaatccctactgtaatggcgtttcatttaacaacacgtaatggggagccccatatgattgttggaattcaggagaagggaaagtcgttactgtttaagactgaggatggagtcaacatgtgcaccctcatggctatggatttaggagaactttgtgaggacacaatcacatacaagtgtccccttctccgacagaatgaaccggaggacatagactgttggtgtaattcaacgtcaacatgggtaacctatggaacttgcacaacaacgggagaacaccgacgagaaaaaagatctgtagcgttagttcctcacgtaggtatgggtcttgagacgagaacagaaacctggatgtcctcagaaggcgcgtggaaacatgcccaaagaattgagacatggatactgagacaccccggattcacaataatggcagcgatcttagcctatactataggaactacacattttcagagagtactaattttcatactcttaacagcagttgccccgagcatgactatgagatgtattggaatatcaaatagggacttcgttgaaggtgtcagtggtggatcatgggttgacatagtattagagcatggaagctgcgtcacaactatggcaaaaaataagccaacattagatttcgaactgataaaaacagaagcaaagcaaccggctacccttcgcaaatactgcattgaagcaaaattaacaaatacaacaacggaaagtaggtgccctacacagggggagccatccttaaaggaggaacaggataagagatttgtttgcaaacattcaatggtagatagaggatggggcaacggatgtggattattcgggaaaggcggtatcgtgacttgtgcaatgtttacttgcaagaaaaatatggaaggaaagatagtacaacctgaaaaccttgaatacactatagttgttacaccccactcaggggaggaacatgctgttggcaatgacacaggcaaacatggccaagagattaaggtcacgccacaatctagcatcacagaagccgaactgaccgggtatgggccagtaacaatggaatgcagtccacgtaccggactggacttcaacgagatggtattgttacaaatggaaaataaagcttggcttgtccacaggcaatggtttctagatttaccattaccgtggcttcccggcgcagataagcaggaatctaactggatccaaaaggaaaccctagtaacttttaaaaacccccacgctaaaaaacaagacgtagtagttttaggatcacaagaaggggcgatgcatacggctctcacaggcgccacggaaatacaaatgtcctcggggaatttgttatttactgggcatttaaagtgcagacttcggatggataaactccaattgaaaggaatgtcatattctatgtgtactgggaaatttaaggtagtaaaggagattgcagaaactcagcacggaactattgtcatacgggtacaatatgaaggcgacggcagcccgtgtaagattccatttgaaataatggacttagaaaaacgatacgtgctcgggagactaataactgtaaacccgatcgtaactgaaaaagattcaccagtaaacatcgaagcagagccaccgtttggtgatagctacataatcataggagtcgaaccgggacaactgaaacttaactggtttaaaaaaggcagctccataggccagatgttcgaaacaacaatgagaggagcaaaacgtatggccatattgggtgatactgcttgggatttcggttctcttggaggtgtctttacctcaataggaaaagcacttcatcaggtatttggggcaatttatggggcagcattttcaggagtcagctggactatgaaaatcttgataggagtcattataacgtggatagggatgaactcacgttctactagtctatcagtatccctagtgttagtaggaattgtaacattatatttaggagtcatggtacaagcagacagtggatgtgtagtttcttggaaaaataaagaattaaaatgtggcagcggcatattcataacagacaatgtacatacgtggactgaacaatacaaattccaaccagagtcgccttcaaaattagcttccgccatacagaaagctcaagaggagggtatatgcggcattaggtcagtcaccagactggagaacttaatgtggaaacaaattacacccgagctgaaccatatcctagctgaaaacgaagttaaactgacaattatgaccggcgatattaaaggtatcatgcaggcgggtaagcgttctctgcgtccccaaccgactgagctaaaatattcttggaaaacttggggaaaggcaaagatgttaagcacggaatcatacaaccagacattcttaatagatggacctgaaacagctgaatgtcctaatactaatcgcgcttggaattccttagaggttgaagattacggatttggtgtctttaccaccaatatctggcttaagttgaaagaaaaacaagacgctttctgtgactcgaagttaatgtcagctgcaattaaagataatcgcgcagtccacgcagacatgggatattggatagaaagtgctttaaatgacacatggaaaatcgaaaaggcaagcttcatagaagttaaaaattgtcattggccaaaatcccacactctctggtctaatggtgtgctggagtccgaaatgattatcccaaaaaacctggccggacctgtatcacagcataattacaggccaggctaccatactcaaatagcaggcccttggcaccttggaaaacttgaaatggattttgacttttgtgacggaacaacagtaattgtgacagaagactgcggaaacagaggaccatcactacgaacaacaaccgcttcaggtaaactcataacagagtggtgctgtagatcttgtacgttacctcccctacgatatcgaggagaagatggctgctggtacggtatggagattcgtccattaaaagagaaggaagagaatctggttaactccttagtgacagctggacacggacaagtagacaacttcagcttgggagtacttggaatggctctctttcttgaggagatgttacgtacacgcgttggcacaaagcatgccattttgctagtggccgtaagttttgtgactctaattacaggtaacatgagcttcaaagatcttgggcgagtagttgtgatggttggtgccacaatggccgacgatattgggatgggagtaacttatttagcattactcgccgcattcaaagtaagaccaacatttgctgccggtttattactccgaaaattgacatcaaaagagcttatgatgacaaccataggcatagtattactgagtcagtcaacaattcctgaaaccgtgctagaactaacagatgcattagcactcgggatgatggtgcttaaaattgtaagaaacatggaaaagtaccaacttgcagtcactatcatggcaattttatgtgtcccaaatgctgtcatcttacagaatgcgtggaaagtctcgtgcacaatattagctgtcgtatccgtgtcgcccttattacttacgagttcccagcaaaagaccgactggataccgctcgctcttactattaagggactaaatccgacggccatttttttgactacgttatcaagaactaataaaaaaagatcctggccactaaacgaagccattatggcagtgggtatggtgtccatcctagcttcaagcctgcttaaaaacgatattccaatgacaggaccgcttgtcgctggcggcctattaaccgtttgctatgttctcactggaaggtctgccgatctggaacttgaacgtgcaactgatgttaagtgggaagatcaggccgaaatctccggatcctccccgatattgtctattacaatatcagaggacggtagcatgagtatcaaaaacgaagaagaggaacaaacactaaccattttaattagaaccggtttactagtcatttctggactatttcctataagtatcccgattacagctgctgcatggtacttatgggaagtaaaaaagcaaagagcaggtgtattatgggatgtaccttcgccgccccccatgggtaaagcagaactagaagatggcgcataccgaataaagcaaaaaggtatattaggctattctcaaattggagcaggcgtatacaaagaaggaacctttcacacaatgtggcatgtaacaaggggtgctgtactaatgcacaaaggtaagaggattgaaccatcctgggcagatgtgaaaaaagacctaatatcgtacggagggggatggaaactagaaggtgaatggaaagagggggaagaggtacaagtattagctctggaacctggaaaaaaccctcgtgcagtccagacaaaaccaggactgttcaaaacaaacaccgggactatcggagcggtaagcctcgatttttctcccggaacgtcaggatcacccataatagataaaaagggcaaagttgtgggactctacggcaatggagtcgtaactcgctctggagcatacgtatcagcaattgcacaaacggaaaaatcaatagagaacaatcctgaaattgaagatgacatattcaggaaaaggcgattaaccatcatggaccttcacccaggagctgggaaaaccaagcgatacttacctgctattgtacgtgaagctataaaacggggcttaagaacgctcatcttagccccaacaagagtcgttgcagctgaaatggaagaagctctacgaggtctaccaatccggtatcaaacccccgcaataagggcagaacacactggaagagagattgttgatttaatgtgtcacgctacattcacaatgagactactttcacccgtacgtgtaccaaattacaacctgataatcatggatgaagcccactttacagatccagcttctatcgcggcccgagggtatatatccacaagagtggaaatgggagaagccgccggcatctttatgacagcaacacctccgggatcacgagacccgtttccgcaaagcaatgcaccaattattgatgaagaaagagagatacctgagaggtcatggaatagcggccatgaatgggtgacagattttaaaggtaaaactgtctggtttgtcccaagtataaaagctggaaatgatatcgctgcatgtctcaggaaaaatggcaaaaaagtaattcagttgagccgaaaaacttttgactctgagtatgtaaagactagaactaatgattgggattttgtagtaacgacggacatctctgagatgggagccaatttcaaagctgaaagggtcatcgacccaagacgctgtatgaaacccgtcatcctaacagatggagaagaacgtgtgatattagcaggacctatgcctgtgacgcatagcagtgcagcgcaacgacgaggaaggattggccgaaacccaaaaaacgaaaacgatcaatatatctatatgggagaaccactggaaaatgatgaagattgtgcccattggaaagaagcaaaaatgctgttggataacattaatacgccggaaggcataataccttccatgttcgaacctgagagagaaaaagtggacgcaatagatggagagtatcgattacgaggcgaggctagaaaaacatttgtagatttaatgaggagaggcgaccttcccgtttggctcgcttacaaagtagcagccgaaggtataaattacgccgacaggcgatggtgttttgacggaattaaaaataaccaaatacttgaggaaaatgtagaagtcgaaatatggccaaaggaaggggaacggaagaagctcaagccaagatggctagacgcaagaatttattctgacccattggctttaaaagaattcaaagaatttgctgcgggtaggaaaagtttaacattaaatctcattaccgaaatgggaagattaccgacctttatgactcagaaaactagagacgctttagataaccttgctgtcctgcatacagccgaggccgggggacgagcttataatcatgcactgagtgaattaccagaaaccttagaaactctactattacttaccctactcgctacagtgaccggaggaatctttctgtttctaatgtctggacgtggaatagggaagatgaccctaggtatgtgttgcattataactgcaagtatcttgctttggtatgcacaaatccaaccccactggattgctgcaagtatcattctggaattctttctaattgttttattaatacctgaaccagaaaaacaacgcacaccccaagacaaccaattaacttatgttgtcatagccatattgaccgttgtagctgccacaatggctaacgaaatgggttttttagaaaaaacaaaaaaagacctaggtttaggtagcatagcgacccaacaacccgagagtaatatacttgacatcgacctacgaccggcttcagcgtggacactctacgcagtcgctactaccttcgtaactccgatgctacgacattcgattgagaactctagcgttaatgtctcattaacagcaatagcgaaccaagcaaccgtactcatgggcttggggaaaggatggccactctctaaaatggacataggtgtaccgctattagccatcggatgttattctcaagtaaatccaataacactgacggctgcactattactgttagttgcacactatgctataataggacccggactgcaggcaaaagctacacgtgaggcacaaaagcgtgctgcagctggtataatgaaaaatcctacagtagatggaattacagtaatagatctagacccaattccctatgacccaaaattcgaaaaacagttaggacaagttatgttactaatattatgcgttacgcaagtacttatgatgaggaccacgtgggcactatgcgaagctttaacactagcgacaggtcccattagcacattgtgggaaggtaacccaggtcgattttggaatacgactattgcagtttcgatggcaaatatattccgagggagttacctagcaggtgcaggattgttgttcagtataatgaaaaatactactaacacgaggagaggtactggaaacatgggagagacactgggtgagaagtggaaatccaggcttaacgcattagggaaaagtgaattccaaatttacaaaaaaagcggtattcaggaagtagatagaactctcgcaaaagaaggtataaaaaggggagaaacagaccaccatgcagtaagtcgaggaagtgcgaagcttagatggtttgtagaaagaaatatggtgacacccgagggaaaggtagtcgatcttggatgtggacgaggaggttggtcgtattactgtggtgggttaaaaaacgtaagagaagtgaagggacttaccaagggaggtcccggacacgaggaacctataccaatgtcaacgtacggatggaacttagtaagattacaatccggtgtggatgtattttttatcccaccagaaaaatgtgacacgctattatgtgatattggtgaaagttcaccaaacccaactgtggaagccggacgtactttgcgggtccttaatttagttgaaaattggcttaataacaacacacagttttgtataaaggtactaaatccatatatgccatcagtaatcgaaaaaatggaggccctacaacggaaatacggaggagctcttgtaagaaaccctctgtctagaaactctactcacgaaatgtactgggttagtaatgcaagcggtaatatagttagtagtgtgaatatgatctcacgtatgctaatcaatagatttactatgagacacaagaaagcaacgtatgaacctgatgtcgatctgggaagtggaacccgtaatatcggaattgaatctgaaacacccaacttggatataataggcaaacgtatcgagaaaataaaacaggaacatgaaacatcgtggcattatgatcaggaccatccatacaagacctgggcttaccacggttcgtacgaaacgaagcaaacgggtagcgcatctagtatggttacaggcgtagtgagactgttgacgaagccgtgggacgtactacctacagtaacacagatggcaatgactgacaccacacctttcggtcaacaaagagtcttcaaagagaaagtagatacccgtacacaagaccctaaagaagcaacaaaaaaacttatgaaaattacagcagagtggctctggaaggaactgggcaaaaaaaaaaccccaagaatgtgtacacgtgaagagtttactcgcaaagtaagaagtaacgccgccttaggcgccatatttaccgatgaaaacaagtggaaaagtgctagagaagcggtggaagactcaagattctgggaactagttgataaagaacgtaatcttcacttggaagggaaatgtgaaacttgtgtctataacatgatgggaaagagggaaaaaaaactcggagaatttggaaaagcaaagggctcacgggcaatatggtacatgtggctcggcgcacgtttcttagaatttgaagcactaggattcctgaatgaagatcattggtttagccgtgaaaatagtctgtcgggagttgagggggaaggattacataaattaggttacatacttagggacgtatcgaaaaaggaaggcggagcaatgtacgcggacgatactgcaggctgggacactcgtatcaccctagaagatttaaaaaatgaagaaatggtcaccaatcatatggaaggagagcataaaaaattagctgaagcaatatttaaactcacatatcaaaacaaggtagtaagagtgcaaagacccacaccgcgcggcaccgttatggacataattagcaggcgagatcagaggggatctggacaagtaggtacttatgggttgaatacttttaccaatatggaggcccaactaataagacaaatggaaggagaaggtgtatttaaaaacatacaacatctaccagtgacagaagaagtagccgtccagaactggttggcacgtgtcggaagggaaagactatcgagaatgccaatatccggcgacgattgtgtggttaaaccgctggatgccagatttcctacggctctaacaccattaaacgacatgggaaaaataagaaaagacattcaccagtgggatccaagtaaagggtggaatgattggacccaagtgcctttctgttctcaccatttccacgaattaataatgaaagacggcagagtgttagttgtcccatgtagaaaccaagatgacttaatcgcgcgtgcccgaatatcccaaggaccagggtggtccttaagagaaacagcttgtttgggcaaatcgtacgctcaaatgtggtcactaatgtatttccatcgtagagatttaagattggcagcaaatgctatatgtagcgccgttccaagccattgggttcccacgtcgcgaacaacatggtccatccatgctaaacatgaatggatgacgactgaagatatgttaacagtatggaaccgggtttggatacgagaaaacccttggatggaagataagacaccggtggagagttgggaggaaatcccgtatctggggaaaagggaagaccagtggtgtggtagtcttataggacttaccagcagagctacctgggctaagaatatacaggtggcaataaatcaagttaggtctcttataggaaacgaagaatatacagattatatgccatctatgaagcgtttccgaagagaagaagaagaggcaggagttttgtggtag

SEQ ID NO: 22687 - RNA, 9876 nt, synthetic construct
  misc_feature 1..9876: note = derived and/or modified CDS sequence (opt6) from DENV-2__FJ205878__SS-prME
  source 1..9876: mol_type = other RNA
agtgcaggcatgatcataatgcttattcctaccgtaactgcatttcacttgacaactagaaatggcgaaccccatatgattgttggaatacaagaaaaagggaaatctctactatttaagacagaagatggcgtaaatatgtgtacgctaatggcaatggacctaggagaattgtgcgaagacaccataacatataaatgtccactattaaggcagaacgagccagaagacatcgattgttggtgcaattcaacctcaacatgggtaacttatggcacttgcactacaactggagagcataggagagagaagagatccgtagcgttggtacctcatgtaggaatgggtttagaaactagaacagaaacttggatgtccagtgaaggcgcttggaaacacgcacaaagaatcgaaacttggatcctaagacatcctggatttacgatcatggcagcaattctggcgtacacaatcggcactacacattttcaaagagtccttatatttattcttttaactgctgttgccccatcaatgactatgagatgcattggaatttccaacagggacttcgttgagggcgtttctggaggttcatgggtcgatattgtgctagaacatggttcatgcgtaactacgatggctaaaaacaaacctacactagattttgagctcattaaaacagaagcgaagcaaccggctacactgaggaaatattgtattgaggcgaaattgacaaacacaaccaccgagtctagatgtccaactcaaggagaaccttctttaaaggaagagcaagataagaggttcgtctgcaaacattcaatggtagatagaggatggggaaacggttgtggcctttttggaaaagggggaattgtaacttgtgcaatgtttacatgtaaaaaaaatatggaaggtaagatagtgcaacccgaaaatttagagtacaccatcgtagtgacccctcattccggagaggaacatgcagtcggaaacgacacagggaagcacggacaagaaatcaaggtaacgccgcagagctcaatcacagaggcagaacttactgggtacgggacggtaacaatggagtgttcaccgagaacaggactcgatttcaatgaaatggtattgctgcagatggagaataaagcatggttagtacatagacagtggttccttgatctcccacttccatggctgcctggtgcagataaacaagaatccaattggatacagaaagaaacccttgtaactttcaaaaacccgcatgcaaaaaaacaggatgtggtagtattaggaagccaagagggagccatgcacacagcgttaacaggagcaacagaaatacaaatgtcatcaggaaatctattatttacgggccatctgaaatgcagattgagaatggataaactccaacttaaaggtatgtcgtattcgatgtgtactggcaaatttaaggtagttaaagaaattgcagagacccaacatggtacaatagtcatacgggtccaatacgaaggagatggatcaccatgcaaaatcccttttgagattatggacctagaaaaacggtacgtactgggtcgtttaataactgtcaatccaatagtcacggagaaagattcaccggttaatatagaagcggagcctcctttcggagactcctatatcattatcggagtagaacctggacaactcaaattgaattggttcaaaaagggatcgagtattggacaaatgtttgaaacaacgatgcggggggcaaaaagaatggcaattctaggtgatacggcatgggatttcggaagcctaggaggagtttttacgagtataggcaaggctctacatcaggtctttggtgcaatatatggagcagctttctcaggagtctcatggacaatgaaaatattaattggcgtaataattacgtggattggtatgaattccagatccacaagcctttctgtttcattagttttagtgggtattgtaacgctttatttaggtgttatggtacaagcagactcaggttgtgtcgtgagctggaaaaataaagagctaaaatgtggcagcgggatcttcattacggacaatgtacatacatggacagaacaatacaaatttcaacccgaatcaccttctaaactagcctccgcaatacaaaaagcacaagaagaagggatatgtggcatacgaagcgttactagactcgaaaacttgatgtggaaacaaattacaccagaacttaatcacatactagccgaaaatgaagtcaaattaactataatgactggtgatataaaaggcatcatgcaagcagggaaaagatcattaagaccgcagccaactgaattaaagtactcatggaagacatggggaaaagcaaaaatgctaagcactgaaagttacaatcaaacctttctcatagatggccctgaaacagccgaatgccctaacaccaatagggcatggaactcattagaagttgaggattacggattcggggtatttacaacaaatatctggttaaaactaaaagaaaaacaagatgcattttgcgactcaaagttaatgtcggctgcaataaaagataaccgcgctgtacatgcggacatgggatattggatagaatcagcattaaatgatacttggaaaatagagaaggcttcatttatagaagtcaaaaattgtcactggcctaaatctcacacgctttggagtaacggtgttcttgagtccgaaatgataatacccaaaaatctagctggtccggtaagtcaacacaattacagacctggctatcatacacagatagcgggaccttggcatctaggcaaacttgagatggatttcgatttctgtgacgggacaactgttattgttacagaggactgcggcaataggggtccctcgctacgaacaactactgcctctggcaagctaataacagagtggtgctgtagaagttgcacactgccgcccctaagatataggggtgaagacggatgctggtacggcatggaaattaggcccctaaaggaaaaggaagaaaacctagtaaactccttggtcacagcagggcatgggcaagtggataattttagtctgggagtattaggaatggctttatttctagaagaaatgcttcgtacaagagtcggcacaaaacacgccatactcctcgtagctgtctcatttgtaacacttattaccggaaacatgagttttaaagatctggggagagttgtagtaatggtaggtgctaccatgacagacgatattggaatgggggtaacttatctggcattactagccgctttcaaggtgagacctaccttcgcagcaggtctactattaaggaagctaacgtctaaggaactaatgatgaccactatagggatagtattactatctcaaagtacaataccagaaaccgtactcgaattgactgacgcgctagcactcggcatgatggtactaaaaatagttagaaatatggagaaatatcaattagctgtaacaattatggctattttgtgtgtacctaatgcagtcatactccagaatgcttggaaggtatcatgtacaattctcgccgttgtgtctgtatcgcctcttctactgacgtcgtcccaacaaaaaaccgattggattcctctagccttaactataaaaggtttaaacccaactgctatatttttaacaaccttgtctagaacgaataaaaaacgctcctggccactcaatgaagcaataatggcagtaggaatggtaagcatactagccagctcattattaaaaaatgatatacctatgaccgggccactagtagccggaggtctattaaccgtttgttatgtgttgactggaaggtcagcagatttagagcttgagagggcgacagacgtaaaatgggaagaccaagctgaaattagtggctctagccccattctgtcaattacaattagcgaggacggttcgatgagtattaaaaacgaagaggaagaacaaacattaacgatactcatccgtaccggtctacttgtgatttcaggcttattcccaatcagtatccctataacggctgccgcatggtacttatgggaagtaaaaaaacaaagagcaggagttttatgggacgtaccaagtcccccaccaatgggaaaagcagaattggaagatggggcctatagaataaagcagaaaggaattctaggatacagccaaataggtgccggcgtctatagagaaggtacgtttcacacaatgtggcatgttacaagaggagctgtactgatgcacaaaggaaaacgtatagaaccttcgtgggccgacgtaaagaaggatctaataagttatggagggggttggaaactggaaggcgaatggaaagaaggagaggaagttcaggtgttagccctagaacctggaaagaacccacgagcagtccaaactaaacctggcttatttaagactaacacagggacgattggagcagtatcacttgacttcagtccaggcacatctgggagtcctataatcgataaaaagggcaaagttgttggattgtatggaaacggtgttgtaacacggagtggtgcctatgtaagcgcaatagcacaaacagaaaaaagcatagaagataatcccgaaattgaagatgacatatttcggaaacgacgtctaaccatcatggatttgcatcctggagcagggaaaacgaaaagatacttaccagcaatagtacgcgaagcaataaagagaggtcttcgtaccttaattctagcaccaacaagagtcgtcgcggccgaaatggaggaagccttaagaggattaccgatcagataccaaacacctgcaatacgagcagaacatactggtagagaaatagtagatttaatgtgtcacgcaacttttactatgcgactgctttcaccggtgcgcgtcccaaattataatctaataataatggatgaagctcattttacggacccagcatcaatcgcggcaaggggatatatctctaccagagtagaaatgggcgaagcagctggaatatttatgacggccacaccacccggatccagggatccatttccgcaatcaaacgcaccgataatagacgaagaacgagaaatacccgaaagatcatggaactccggtcatgaatgggtcacagattttaagggtaaaactgtgtggttcgttcccagtataaaagctggaaacgacatagctgcctgcttaagaaaaaacgggaaaaaggtgattcaactgagccgtaaaacttttgattcagagtacgtaaaaacaaggactaatgattgggacttcgtcgtcaccactgacatcagcgaaatgggggcaaattttaaagcggaaagagttattgatccacgtcgatgtatgaagccagtaatattaacagatggagaggagagagtgatactcgctggcccgatgccagttacacacagttctgcggcccaaaggagaggacggattgggcggaatccaaaaaatgaaaacgaccaatacatatatatgggtgaaccgttggaaaatgatgaagattgtgcacattggaaagaggcgaaaatgctccttgataatattaatactcctgagggcattatcccttcaatgtttgaacccgaacgagagaaagtcgatgctatagacggagaatatagactcagaggtgaagcgcgcaagacattcgtcgatctaatgagacgaggggatttacccgtatggttggcatacaaagttgctgcagaaggcataaactacgcagatagacgctggtgctttgatgggatcaaaaacaatcaaatactagaagaaaatgtcgaagtggagatatggacaaaagagggtgaacgtaaaaaactaaaaccgagatggttagatgcacggatttactcagatccactggcactcaaagaatttaaagaattcgccgcgggtagaaagtcattaactttaaacctaattacagaaatgggaaggctaccaactttcatgacacaaaaaaccagagacgctctagacaatctcgcagtactacacacagcggaggcaggaggcagggcatataaccatgcacttagtgaactaccagagacgctagaaacacttctacttttaacactactagcgacggtgaccggagggattttcctctttctaatgagtggccgcgggattggaaaaatgacattgggtatgtgttgcataatcactgcatcaattttactatggtatgcccagatacaacctcactggatcgcggccagcatcattctagaattctttcttatagttctgttgatacccgaaccagagaagcagcggactccccaggataatcaacttacttatgtagtaatcgcaattttaactgttgtagcagccactatggctaatgaaatgggttttctcgaaaagacaaaaaaagatcttggtttgggttcaatagcaacacaacaaccagaaagcaacatactggacatagaccttcgacctgcaagcgcatggactttatatgcagttgcaacaacattcgttacacctatgttacgccacagtatagaaaactcttcagtgaatgtatcattaaccgcaatagccaatcaggctactgtactcatggggctagggaaaggctggccgctatcaaaaatggacatcggagtgcctcttctagccataggctgttactcccaagtaaaccctataacattaacggcagctctactacttttggtcgcacactacgccataatcgggccaggattgcaagctaaagcaacaagagaagctcaaaaacgagcggcggcaggaattatgaagaaccctacggttgacggcataacagtaattgatctagatccaataccgtatgacccgaaattcgaaaaacaactcggccaagtcatgttgttaatactctgtgtcacacaggtgctcatgatgcggacaacatgggctctgtgcgaggcgttaaccttggccacaggaccgatttctacattgtgggaaggaaatccgggcaggttctggaatacaactatagcagtctcaatggcaaatatatttagagggtcctatctagctggcgctgggttattatttagtattatgaaaaacactacaaatacgcgacgaggaacaggaaacatgggagagactttgggagaaaagtggaaaagtaggcttaatgctctcggcaagagcgagtttcaaatttataaaaaatccggaatccaagaggttgaccgaacattagctaaagaaggaataaaaaggggagaaacagatcaccatgcggttagcagaggtagtgcaaaactgcgttggttcgtcgaaagaaacatggtaacgcctgaggggaaagtagtagacttaggttgtgggagaggagggtggtcatattactgtggaggccttaaaaacgttcgggaggttaaaggattaacaaagggtggaccaggacacgaagaacctatccccatgtcaacatacgggtggaatctcgtccgactgcaatcgggagtggacgtgtttttcatacctcctgagaaatgtgatacactactctgtgatataggtgaaagttctccgaaccctacagtggaagcaggccgaacattacgtgtattgaaccttgtagagaattggctcaacaacaatacgcaattctgtataaaagttctgaacccatatatgccaagtgtcatagagaagatggaagccttacaaaggaaatacggcggtgcacttgtgcggaatcctctctcacgtaactctacacatgaaatgtattgggtgagtaatgcgtcaggaaatatcgtttcatcagtcaatatgataagtagaatgctgattaatcgctttaccatgcgtcataaaaaagctacttatgaaccagatgtggatttaggtagtggaacgagaaatataggtactgagagtgaaatccctaacttagatataatcggtaaaagaatagaaaagatcaagcaagagcacgaaacatcctggcattacgatcaagaccatccctacaaaacctgggcataccatggatcctatgaaacaaaacaaactggatctgcttcaagtatggtaaatggcgtagtacgactattaacgaaaccgtgggacgttctcccaatggtaacccaaatggcgatgacggacacgacaccattcgggcaacaaagagtatttaaagagaaagtggacacaagaacacaagagccgaaagaaggcacaaaaaaattaatgaaaataacggcagaatggctatggaaagagttaggaaaaaagaaaacccctcgaatgtgcactcgggaagaatttacgagaaaagtcaggagtaatgcggcactaggtgcgatcttcactgacgaaaataaatggaaaagtgcacgagaagcagttgaggattcccgattttgggagttagttgataaagaaaggaatttacacctggaagggaaatgtgaaacttgcgtatacaacatgatgggaaagagagagaaaaaattaggagaatttggtaaggcgaaaggttcacgagcaatatggtatatgtggttaggagctaggtttctagaattcgaagctctgggttttctaaatgaagaccattggttctcgcgtgagaattccttatccggggttgagggcgaaggcttacacaagctaggttatatcctcagggatgtaagcaagaaagaaggcggtgcaatgtatgcagatgatactgcagggtgggacacacgcataacattagaagacctcaagaatgaagaaatggtgacgaatcatatggaaggggaacataagaagctggcagaagcaatattcaagttaacttaccaaaataaagtagttagagtacagagaccaactccaagaggaacagtaatggatataattagtcgacgggatcagcgcggttcaggtcaagtcggcacatatggcttaaatacatttacgaatatggaggcacaattaatcagacaaatggaaggagaaggggtatttaagaacattcagcatcttacggttacagaagaagtagccgtaaaaaattggctagcaagagtagggagggagaggttatctagaatggccatttcaggagacgattgcgtagtaaagccactcgacgatcgcttcgcaaatgcattgacagcgcttaatgatatggggaaaatcaggaaggacattcaacagtgggaacctagtaaaggctggaacgactggacgcaagttccgttttgcagtcaccatttccacgagctaatcatgaaagacggtcgagtcttggttgtaccgtgcaggaaccaagacgagcttataggtagggcaaggatatctcaaggggccggctggtctttaagagaaactgcatgtttaggtaagtcatatgcgcaaatgtggagtctcatgtattttcaccgccgagatctcagattggcggccaatgcgatctgctcggccgtaccttcacattgggtaccgacaagcagaactacatggagcattcatgcaaagcacgaatggatgactacagaagatatgcttacagtctggaacagggtatggatacgagaaaatccctggatggaagataagacgcctgttgagagctgggaggagataccttatttggggaaaagagaggatcaatggtgtggctctttaatcggtctcacatcacgtgcaacatgggcaaaaaacatacaagccgcgattaatcaagttaggtccctgattggtaatgaagaatataccgattatatgccaagtatgaaacgatttcgtagagaggaagaagaggccggtgtactttggtag

SEQ ID NO: 22688 - RNA, 9876 nt, synthetic construct
  misc_feature 1..9876: note = derived and/or modified CDS sequence (opt6) from DENV-2__FJ205879__SS-prME
  source 1..9876: mol_type = other RNA
agcgctggtatgataatcatgttaatccctacggtcatggcattccatttaactacgcggaatggagaaccccacatgatcgttggaatacaagaaaaagggaaatcattgctattcaaaacagaagatggggtaaacatgtgtacgttaatggccatggacttaggggaactttgtgaagatacaattacatacaaatgccctctcttgaggcaaaatgaacccgaagatatagattgctggtgcaactcaacaagtacatgggttacatacgggacctgcacaacaactggggaacaccgtagggaaaaacgatcagttgctttagtaccacatgtggggatgggcttagaaacccgaaccgaaacttggatgtcaagtgaaggtgcgtggaaacacgcccaaagaatcgaaacttggattttgagacatcccggtttcacaattatggcagcgatccttgcttatactattggtacaacacacttccagcgagttcttatatttatattgctcaccgctgtagcaccaagtatgacaatgcgatgcattgggatatcaaaccgtgactttgttgaaggcgtcagcggtggatcctgggtcgatatagttcttgagcacggaagctgtgtcacgactatggccaaaaacaaacctacattagattttgaattaataaaaaccgaagcgaaacaaccggcgactttacgaaaatactgtatagaagcgaaacttacaaacaccaccacagaatccaggtgtccaacacaaggagaaccctctctaaaagaagaacaagataaaaggttcatatgtaaacattcaatggtagataggggatggggtaatggatgtggcttgttcggcaaaggaggaattgtcacatgtgcaatgtttacctgtaagaaaaatatggaaggaaaaatagtacaaccagaaaatttggaatataccattgtagtaacccctcatagtggtgaagaacatgcagtaggtaatgatactggaaaacatggaaaagaaataaaagttactccacagtcgagcatcactgaagctgaattaacgggatacggcactgtaaccatggaatgtagtccaaggacaggccttgacttcaacgagatggtcctgttacaaatggaaaataaagcatggctggtccataggcagtggtttctagatcttccattgccatggttgccaggggcagataaacaagagtccaattggatacagaaagaaacgctagttactttcaaaaatccccacgccaagaaacaagatgttgttgtgttaggatctcaagaaggagccatgcatactgctttgacaggggctactgaaatccaaatgagttcaggaaatttgctttttactggccatctaaaatgtaggttgaggatggataaactacaactaaaggggatgagctactcgatgtgcactggaaaattcaaagtagtaaaagagatcgcagaaactcagcatggaactattgttatacgtgtgcaatacgaaggagatggttcaccgtgtaaaattccttttgaaataatggacttagagaaaaggtatgtactaggaagactgattactgtcaaccctattgttaccgagaaagattcacccgtaaacatcgaggcagagccaccattcggtgattcttacataattataggggtagagcctggccaattaaaattaaattggtttaagaaagggagtagtatcgggcagatgtttgaaacaacaatgaggggagcaaaacgaatggcaattttaggtgatacggcttgggattttggaagtcttggaggagtgttcacaagcatcggaaaagcgttacaccaggtctttggggccatatacggtgccgcattctctggcgtaagttggacgatgaaaatccttattggtgtcattattacttggattggcatgaactcaaggagtacatcattgtcagtatcattagtacttgtaggaatagttaccctctatttaggagtgatggtgcaggcagactcaggatgcgtggtgagttggaaaaataaggaactcaagtgtggctcaggaatatttattactgataatgttcacacgtggacagaacaatataagtttcaacccgaaagccctagcaaattagcatctgctatacaaaaagcccaagaagaaggcatatgtggaataagaagcgtaacgagactcgagaacctgatgtggaagcaaataaccccagaactgaaccacatattggctgaaaacgaagtaaagctgactatcatgaccggagacattaaaggaatcatgcaagcaggaaaaagatccttaaggcctcagcctactgagctaaagtattcctggaaaacttggggtaaggcgaaaatgttgtcaactgagagctacaaccagacatttctaatcgacggacctgaaaccgctgaatgtccaaatacaaatagagcatggaacagtctggaagtcgaagactacggtttcggagtttttactacgaatatctggttaaaactaaaagaaaaacaagacgcgttttgtgattcaaaattaatgtcggctgcaataaaggataaccgggccgtacacgcagatatgggatattggatagaaagtgcattaaacgacacttggaaaatagaaaaggcatcatttatcgaagtgaaaaattgtcactggccaaaatcacacacattgtggagtaatggagtacttgaaagcgaaatgattataccgaaaaatttagctggtcccgtttcacaacataattataggccaggttatcatacacaaattgcgggaccatggcacctagggaaattagagatggattttgatttctgtgatggtacgactgtggtcgttaccgaagactgcggtaatcgcggaccgtctttgagaacaacaacggcgtctggcaaattgataactgaatggtgttgtcgaagttgtacgctaccacccctaagatataggggcgaagacgggtgttggtatggaatggagatccgacctttaaaagaaaaagaagaaaatttagtgaatagcctagttactgcgggccatggccaagtggacaatttcagtcttggtgtgctgggcatggcgttatttttggaagaaatgcttaggactagagtcgggacgaaacatgcgatcctattagtggctgtaagttttgtcactttgattacagggaacatgagctttaaagatttaggccgggtggtggtgatggttggtgcaacaatggccgacgatataggaatgggagtaacatatttagcactattagcagcttttaaagtgagaccaacattcgcggcagggttgctcctacggaaactaacgagcaaggaattaatgatgacaacaataggtatagtattgctgtcacagtcgactatcccagaaaccgttctagaacttactgatgcgttggctttaggaatgatggttttgaaaattgttcgtaatatggaaaaataccagttggctgtaacgataatggctatactgtgtgtacctaacgcggtgattctacaaaatgcatggaaagtctcatgcactatactagctgttgtaagcgtttcaccattactactcacaagcagtcagcagaaaacggattggattcctctcgcgcttacaataaaaggcttaaatccaacagcgatcttcctaacgacactctcgcgtacaaataagaagagatcatggccactaaacgaagccatcatggcagttggtatggtgtcaatactggccagtagccttttaaagaatgacatcccaatgacaggcccgctggtagccggagggttgttaacagtatgctatgtattaaccggaagatcagctgatttagaactagagagagccacagacgttaaatgggaagaccaggcagaaatatcaggatcgtcgccgattttgtcaattactatatcggaggatgggagcatgagcataaagaacgaagaagaagaacaaacattaacgatacttataagaacaggattgttagtcatatcagggctgtttccaatatcaatacctataaccgctgcagcctggtatctatgggaagtgaagaaacagagagcaggagtgctttgggatgtgcccagtccacctccgatgggtaaagctgaactcgaagacggagcttatcgaatcaagcaaaaagggattctagggtattcacaaataggagcaggagtatacaaagaaggaacatttcacaccatgtggcatgtaacacgaggagcagttttaatgcacaaaggcaaacgtattgagccctcctgggctgatgtgaagaaagatctaatatcctacggaggcggctggaaattagagggggaatggaaggaaggagaagaagtacaggttctcgcactggaacccggcaaaaatccccgtgccgtacaaactaagcctggtttattcaaaacgaacactggaaccattggagcagtgagcttggacttttcacccggaacatccggttcaccaataatcgataaaaagggaaaggtcgttggattatacggcaacggtgtggtgacgagatcgggagcgtatgtatcagctatagcacaaacagagaaatctatcgaggacaatcccgaaatcgaggacgatatattccggaaacgaaggttaaccattatggatttacatcctggcgcgggcaaaactaaaagatacttaccagcaattgtaagagaagcaataaaacgaggtcttaggacgctcatactcgcccccactcgtgtcgtagcggcggaaatggaagaggccctacgaggtttaccaattcgataccaaacaccagcaataagagccgagcatacaggtcgagagatagtagacctaatgtgtcatgcaacttttactatgagactgctaagtccggtaagagtgccaaactataatttaatcataatggacgaagcccactttacagatccagccagcatcgcagcaagaggttatatatcaacacgagttgaaatgggtgaagcagcagggatattcatgacagcaacgccacccggctcacgagatccatttcctcagtccaatgctcccataatagatgaggaaagggaaattccagaaagaagttggaatagcggccatgaatgggtaactgactttaagggtaaaaccgtatggtttgtaccaagtataaaggccggtaatgatatcgctgcgtgtttacggaaaaatgggaagaaagtaattcaactgtccaggaaaacatttgactctgagtatgtaaaaacccgtaccaatgattgggactttgtagtaactacggacatcagtgagatgggagcaaactttaaagccgagagggtcatagatccacgcagatgcatgaaacctgtaatactcactgatggagaagaaagagtaatattagctggaccaatgcctgtaacccatagttcagcggctcaaagaaggggtaggattggacgaaatccaaagaacgaaaatgaccagtacatatatatgggagaacctctagagaacgacgaggactgcgctcactggaaagaggccaaaatgttgttagacaacataaacacccctgagggaataataccaagtatgttcgagcccgaacgcgaaaaagtagatgctattgatggagagtaccgccttcggggagaagctagaaaaacgtttgttgacttgatgcgacgaggagacttaccagtctggttagcatataaagttgcagcagaaggaataaactatgctgatcgaaggtggtgttttgacggcataaagaacaatcaaatcctggaagaaaacgtagaggtagaaatctggactaaggaaggtgagaggaagaaactcaaaccaaggtggctagatgctagaatatatagcgacccgcttgcgttgaaagaatttaaggaatttgccgcgggaagaaaaagcctaacattaaatttaattactgaaatgggtcgactgcccacattcatgacacagaaaacgagggacgctctagacaatttagctgttttacatacagccgaagctggcggacgcgcctacaatcatgcactcagtgagcttccagaaacactcgaaacattattacttttgactcttcttgcgacggttaccggaggcatattcttattccttatgagcggaagagggataggcaagatgaccctaggaatgtgttgtatcacaacggcatcaatattattatggtacgcgcaaatacagcctcactggatagccgcctcaataattttggagttctttttaatagtcctcctaataccggaaccagaaaaacaaagaacgccacaagataatcagctaacttacgtagtaattgcaatactaacagtagtcgcagccacaatggccaatgaaatgggatttcttgagaaaactaagaaagatctgggcctaggatcaatcgcaactcagcaaccagaaagtaacattctagatatagacctacgaccagccagtgcgtggactctatatgcagttgccacaacgttcgttacacccatgttgcgccattcaattgaaaatagctcggtaaatgtctctctgacagcaattgcgaatcaagcgacagtcttaatgggactaggaaaagggtggccactatcgaaaatggacataggggtcccactattagcaatagggtgctactcacaagttaatccgataaccttaacagcagcacttctactgctagtagcacattatgctattataggcccaggcctccaagcgaaagcaacacgcgaagcacagaagcgagccgcagctggcataatgaaaaatccaactgttgatggaatcacggtaatagacctagatcccatcccctatgacccaaaatttgaaaaacagttaggtcaagttatgctgttgatactttgtgttactcaagtgctcatgatgcgtacgacctgggcgctttgcgaggcgttaaccttagcaactggcccaatatctacactttgggaaggaaatcccggccgattttggaatacgaccattgcagtttcgatggcaaacatcttcagaggttcctatttagcaggggctggtctcctattttcgataatgaaaaatacgacaaatccgagaaggggaacaggaaatatgggggaaacattgggagaaaaatggaaatcccggttaaatgctttggggaagagtgaatttcaaatttataaacgatctggcattcaagaggtagatagaactttagctaaagaaggtataaaaaggggcgaaacggaccaccatgcggtaagccgcggatccgctaaattgaggtggttcgtagaaagaaatatggtaacaccagaaggcaaggtcgtcgatctaggatgtggaagaggaggctggagttattattgtggaggtctcaaaaatgtcagggaagtaaaagggctaacgaaaggcggtcctggtcatgaggaaccaattccaatgtctacctacggatggaatttagttaggctgcaaagtggcgttgatgtatttttcataccacctgagaaatgtgatacacttctctgtgacataggcgaatcctcgccaaacccaaccgtagaagccggacgaacccttagagttctaaacttggtagaaaactggctgaacaataatactcaattctgtattaaagttttaaacccgtatatgccgtcagttatagagaaaatggaagctctacaaaggaaatatggtggtgctttagtcagaaatcccttgtccagaaattccactcatgagatgtattgggtttcgaacgcgagtggcaatattgtctcaagtgtcaacatgatatcccgcatgttaataaatagatttactatgagacataagaaagcaacgtatgaaccagacgtagacctaggctctggaacaaggaacattggcatagaaagcgaaatacctaatttagatataattggcaagagaatcgaaaagataaagcaagagcacgaaacatcttggcattacgatcaagaccatccctacaaaacttgggcatatcatggcagttacgagacaaagcagactggctccgcgtcaagtatggtgaatggtgtggtaagactccttacaaaaccatgggatgtactcccaacggttactcaaatggcaatgacagacacgacaccgtttggtcaacaacgggttttcaaagaaaaagtggatacaagaacacaggaacccaaagaaggaactaaaaagttaatgaaaattacagctgaatggttatggaaagaattggggaagaagaaaactccccgaatgtgtacgcgagaagagttcacacgaaaagttaggagtaacgctgccttaggtgccattttcacggatgaaaacaaatggaagtcggcgcgagaggcagtcgaggattctcgcttctgggagctagtcgataaggaaagaaatttgcatctcgaaggtaaatgcgaaacatgcgtttacaatatgatggggaagcgggagaagaaacttggagagttcggaaaagctaaagggtcaagagccatttggtatatgtggttaggggccagattcttagagttcgaagctcttggatttctgaatgaagatcactggtttagtcgagaaaattccctatcaggagtagaaggagaaggattacataagttgggatatatacttagagatgttagcaagaaagaaggaggagccatgtacgcggacgataccgctggatgggacacacggataactttagaagacttgaagaatgaggaaatggtcacaaatcatatggaaggagaacataagaaattggctgaagcgatttttaaactaacatatcaaaacaaagtcgttagagtacaaaggccgacaccccgaggtacggtaatggatataataagcagacgcgaccaacggggttcgggacaagtcgggacttacggactaaatacctttacaaatatggaagcccagcttatacggcaaatggaaggtgaaggcgtctttaaaaatattcaacacctgactgtaacagaggaagtagccgtgcaaaactggcttgcaagagtaggaagagagcgtctttctagaatggctatttctggagacgattgtgttgtaaagccccttgatgaccgttttgcaaatgccttaacagcattaaacgatatgggaaaaattaggaaggatatccaacaatgggaacctagtaaggggtggaatgattggactcaagtaccattttgtagtcatcattttcatgaactgatcatgaaggatggaagagtacttgttgtaccctgccggaatcaagatgagctgataggccgagcgagaatcagtcaaggagctggatggtcgctgagagagacagcctgcctagggaaatcgtacgcccaaatgtggagtttaatgtactttcatagacgcgacttaaggttggcggccaacgctatttgctcggctgtgcctagtcattgggtaccaacaagtagaacaacttggtcgatacacgcaaaacacgaatggatgactacggaggatatgttaactgtatggaatagagtatggatcagggagaatccgtggatggaagataaaactccggtagaatcatgggaagaaataccatatctaggcaaacgagaggaccagtggtgtggtagtctcatcgggcttacaagtagggcgacatgggccaagaacatacaagcagcgattaatcaagtaagatcattaataggaaacgaggagtatacagactatatgccctctatgaaacgatttagacgagaagaagaagaagcaggagtgctctggtag

SEQ ID NO: 22689 - RNA, 9876 nt, synthetic construct
  misc_feature 1..9876: note = derived and/or modified CDS sequence (opt6) from DENV-2__FJ390385__SS-prME
  source 1..9876: mol_type = other RNA
agtgcgggaatgattataatgctcattccaaccgtgatggcattccacctcacgactagaaatggagaaccacatatgatagtagggattcaagagaaaggaaaaagtttactcttcaaaactgaggatggtgtaaatatgtgtacattaatggcaatggacctgggcgaactttgtgaagatacaattacttacaaatgccccttactacgccaaaatgagccggaagatatagactgttggtgtaattctacgagtacttgggtaacttatgggacttgtacaacaactggggagcatagaagagaaaaacgttcagtcgcattagtgccacacgtgggaatgggattagaaacacgtacagagacatggatgtcttctgaaggcgcgtggaaacatgcacaaagaatagaaacttggatacttcgccatccgggattcaccattatggctgcaatattagcttacacgataggtacaactcacttccagagagtcttaattttcattctcctgactgcagttgcaccgtccatgactatgcgatgtataggcatatcaaacagggattttgtagagggcgtatctggaggttcatgggtcgatatcgtgctcgaacacggaagttgtgtaacaactatggcgaaaaacaaacctactcttgattttgaactaattaaaactgaagcaaaacaaccggcaacccttcggaaatattgcatagaagctaaacttacaaacacgacgacagaatcacgatgccccacccaaggtgaaccatcacttaaagaggagcaagataaacggttcgtatgcaaacatagtatggtagatagaggatggggaaacggttgcggtttatttggaaaagggggtattgtgacatgtgcaatgtttacatgcaagaaaaacatggaaggcaaaatagtacaacccgaaaacctcgagtacactatcgtagttactcctcattcgggtgaggagcatgctgttggaaatgataccggaaaacacgggaaagagattaaagtcacaccacaatcgtcaataaccgaggcggaattgacaggatatggaacagtaacaatggaatgtagcccccgaacaggtttagatttcaacgagatggtgttattacaaatggagaacaaagcgtggcttgtccacagacagtggtttcttgatttaccgttaccatggttaccaggtgcagataaacaggaatccaactggatacagaaagaaactcttgttacttttaaaaatccgcacgctaaaaagcaagacgtagtcgtcttaggatcgcaagaaggagcgatgcacactgcacttacgggtgcaactgagattcagatgtcctctggaaaccttctgtttacaggtcaccttaaatgtcgtcttagaatggacaagctccagttgaagggaatgtcatattcaatgtgcacaggaaaatttaaagtagtgaaagaaattgcggagacacaacatggaactatagtgatccgagttcaatatgaaggagacggatctccatgtaagataccgttcgaaattatggatttggagaagcgatatgttcttggcaggttaataacagtgaacccgatagcgacagagaaagactctccagtcaacattgaagccgagccacctttcggggattcatatataattataggcgtagaacccgggcaactaaaattaaactggtttaagaaaggaagttcaattggtcaaatgttcgaaacgacaatgcgaggcgcaaaacgcatggccatcttaggtgatactgcatgggatttcggtagtttgggcggcgtgtttacgtctattggaaaagcgcttcatcaggtttttggtgcgatttatggagccgcgttttcgggagttagttggacaatgaaaatcctcattggtgtaataattacatggatcggaatgaactccagatcgacatcgctctcagtaagtctagttttagtaggcatagtaaccttatacttaggcgtaatggtacaggccgatagcggatgtgtcgtatcctggaaaaacaaagaactaaaatgtgggtctggcatttttataactgataatgtgcatacttggacagaacagtataagtttcagccagagagtccctccaaattagccagcgcgattcaaaaagcacaagaagaaggtatttgcggtattcgttcagtgacacgtctagaaaacttaatgtggaagcaaatcactccagaactaaatcatatattagcagaaaatgaggtgaaactaacaatcatgaccggggacataaagggtattatgcaagcgggtaaacgatcattacgtccacaaccgactgaattaaagtacagttggaaaacatggggtaaagcaaaaatgctctcaacagagtcatataatcaaacatttttaattgacggacccgaaacagcggaatgtcctaataccaacagagcttggaactcattagaagttgaagattacggttttggggtattcactaccaatatttggttaaaattgaaagaaaaacaagatgctttttgtgatagtaagctgatgagtgcagccattaaagacaaccgagcggtccacgcagatatgggctactggatagaaagtgctttaaatgatacgtggaaaattgagaaggcttcatttatagaggtcaaaaattgccattggccaaaatctcatacattatggtctaatggagtcttagaatcggaaatgattattccgaaaaacctcgctggacctgtgtcccaacacaattatcgccctggatatcacacacaaatagctggaccttggcacctaggtaagttagaaatggatttcgacttctgtgacggaacaacagtaatagtaacagaagactgtggtaataggggacccagcttacgtactaccactgccagtggtaaactaattactgaatggtgttgtcgatcttgtacgctcccacccttacgctataggggagaagacgggtgttggtatggcatggaaattcgacctctcaaagaaaaagaagaaaatttagttaatagcctagtgacggctggacacggacaagtagacaactttagtttgggcgttctagggatggcactatttttagaagaaatgttaaggactagagtaggaaccaaacatgccattctactcgttgcggtatccttcgtaactttaatcacaggtaatatgagtttcaaggacttaggcagagtcgtagtaatggtaggcgccaccatggctgacgacattgggatgggagtgacatatttggcactgcttgctgcatttaaggttcgaccgaccttcgcagcagggcttttactaagaaaattgacaagtaaagaattgatgatgacaacaatagggatagtattattaagtcaatcaacgataccagaaactgttctagaactaacagatgcattagctttaggcatgatggtattaaagatagttcgcaatatggaaaaatatcaactcgcagtaacaataatggccatactgtgtgtaccgaacgcagtaatcctacagaacgcatggaaagtaggatgcacgatacttgccgttgtcagtgtttcccccttgctgttgacaagctctcaacagaaaacagactggataccccttgccttgactatcaaaggactcaacccaacggcgatttttctcacaacattaagcagaacaaacaagaaacgttcatggcctttaaacgaagctatcatggcagtaggcatggttagcatccttgcatcaagtctattgaaaaatgacataccaatgacaggtccgttagtagcaggagggttacttacagtatgttatgtgctgacgggaagaagcgctgatttagagttagaaagagccacagacgtaaaatgggaagatcaagcggaaattagtggtagcagtcccatactatcaataactattagcgaagacggatcaatgagtatcaaaaatgaggaagaagaacaaacactaacgatcttgatacgaactggactactcgtaatatcagggctctttcctattagtattcccataactgcagctgcttggtatctatgggaagttaagaaacaacgtgcgggcgtattatgggatgtcccatcacccccgcctatgggaaaggcagaactcgaagatggtgcatatcgaataaaacaaaaaggaatactcggatatagccaaataggcgcaggagtctacaaagagggtacattccacacaatgtggcacgtaaccagaggggccgtactaatgcacaaaggtaaaagaattgagccgtcatgggccgatgtaaagaaagatttaatttcctatgggggaggctggaagctggaaggcgaatggaaagaaggggaagaagtacaagttctagctttggaaccgggtaaaaaccctagagcggtacagaccaaacccggtctattcaaaacaaataccggaacaatcggagctgtctcacttgatttcagccccggcacatcgggttcgcccatcatagacaagaagggtaaagtagtaggattatatggtaacggagttgtgacccgctcgggagcatacgtcagcgctatagctcaaactgagaaatcgatagaggacaatccagaaattgaggacgatatttttagaaaacgccggcttacaattatggatctacatcccggagccggtaaaacaaaacgatatttaccggcaatagtcagggaagcaatcaaaagaggattacgcaccctcatattagctcccacacgtgtcgtcgcggctgagatggaagaggctctcaggggacttccaataagatatcaaactccagcaatacgaagcgaacatacgggaagagagattgtcgatctcatgtgtcatgctacatttacaatgagattgttatcacctgtaagagtaccgaattacaacctaattattatggatgaagcacactttactgatcctgctagtatagctgccaggggatatatctcaactagagtagagatgggcgaagctgccgggatctttatgacagcaacaccaccaggctcacgtgacccctttccacaaagtaatgcacctataatagatgaggaacgagaaattcccgaaagaagttggaactcagggcatgaatgggttacagactttaaaggaaaaacagtctggtttgttccatcaatcaaagccggcaacgatattgctgcttgcctgaggaaaaatggaaagaaagtaatacaactttcgcgtaaaacattcgacagtgaatatgtcaaaacacgaaccaacgattgggacttcgttgtaacaacagatatatccgaaatgggagccaactttaaggcagagagagtaatagatccaagaagatgtatgaaaccagtaatccttacagatggggaagaacgagtcatattagctggtccaatgccagtaacgcattctagtgctgctcagcgacggggaagaatcggcagaaaccccaaaaatgaaaacgatcaatacatttatatgggcgaacccctagaaaacgacgaagattgtgcacactggaaagaggctaagatgttgctagacaatatcaatactccagagggaataataccctccatgtttgaaccagaacgggagaaagtagacgcaatagatggagagtatcgactgcgtggggaagctcgcaaaacatttgttgacttgatgaggagaggagatcttccggtctggttagcgtataaagtagctgctgagggaataaactatgctgacaggcgatggtgctttgacggtataaagaacaatcaaatattagaagagaacgtagaggtcgaaatttggacaaaagaaggagaaaggaagaaattaaaaccaagatggttggatgcacgaatatacagcgatccgttagctctaaaagagttcaaggaatttgctgcaggacgtaaaagtctcactctaaatctaatcacagaaatgggaaggcttcctactttcatgacgcagaaaaccagggatgctctagataaccttgcggtgctccacacagctgaggcaggaggacgtgcctataaccacgccttaagtgaattgccagagacactggagacactactattactgaccctactagcaacagtcacaggagggatattcttatttctaatgtcgggtcgtggaattggaaagatgacacttggcatgtgttgcataatcaccgccagcattttactctggtacgcgcaaatacaaccgcactggatcgccgctagtataatcttagagttctttttgatagtgttactaattcccgaacctgaaaaacagaggacaccccaagataatcagttaacttacgtcgtaatagcaatcctaactgttgtagcggcaacaatggccaatgagatgggttttctggagaaaaccaagaaagatctaggcctaggaagtatagcaacgcagcaaccagaatcaaatatattagatatagacttacgtccagcttcagcatggactttatatgcggtcgcgacgacctttgtaacgcctatgctgcgacatagtatagaaaactcatcggtcaatgtatcacttacagcaatagcaaaccaagccaccgttctgatgggattaggtaagggatggccactctcaaaaatggacatcggggtaccgctgctggcaataggttgttacagccaggtcaacccaataacgctgacagccgccctcctactactggtagcacattacgccataattggaccgggactacaagccaaagctacgagagaagcccaaaaacgcgcagctgcaggcataatgaaaaatccaactgttgatggtattacagtaatcgatttagatccaataccttacgatcctaagtttgaaaaacagctcggacaagttatgcttctcattttatgcgtaacacaagtattaatgatgcgcaccacctgggcattatgtgaggcattaacactagcgaccggaccaatttctactttatgggaggggaacccggggaggttctggaacacaacaatagctgtaagtatggcaaatattttcaggggctcttatttggccggtgcaggtttactattcagtattatgaaaaatacaacgaacactcgtagaggaaccgggaacatgggagaaaccctcggtgaaaaatggaaatccaggctaaatgcattaggaaaatccgagttccaaatttataagagaagtgggattcaagaagtagatagaacccttgccaaagaaggcataaaacgaggcgaaacagaccaccacgcagtaagcagaggctcggctaaattgagatggtttgtagaaaggaacatggttaccccagaagggaaagtggtggatttgggatgtggaagaggtggatggagttattactgcggtggtcttaaaaatgtacgagaagtaaaaggattgactaaaggcggtccaggtcacgaagaaccgatacctatgagtacttatggatggaacctagttcgactacaaagcggagttgatgtcttctttataccgcccgagaaatgcgatactctattgtgcgatataggggaaagttctccaaaccctacagtagaagccggtcgaacgttgagagtactcaatctagtagaaaattggttaaacaataatacacaattttgcatcaaagtgttaaatccatatatgccaagtgtaattgaaaagatggaagcactgcaacgaaagtatggcggcgcactcgtaagaaatccattgtcccgaaattccacacatgaaatgtactgggtgagtaatgcttcaggcaatatagtgtcaagcgtcaatatgattagcaggatgttaattaatcgtttcacgatgagacacaagaaagcgacctacgaacccgacgttgatttgggttcggggactagaaacataggtacggaatcagaaataccaaacttggacattataggaaagagaatagagaaaataaaacaagaacacgagacatcatggcattatgatcaagaccacccatacaagacatgggcatatcacggaagctatgaaactaaacaaacaggatcggcatcatcaatggtaaacggtgttgttagattactaacgaaaccttgggacgtcctcccgacggtaacccagatggcaatgaccgacactaccccctttggacaacagcgagtcttcaaagaaaaggtagatacgcgcactcaagaacctaaagaaggtacgaagaaattaatgaagatcacagcggaatggctttggaaagaattaggcaagaagaaaaccccacgcatgtgcactcgagaagaatttactcgcaaggttcgttcaaacgcagcgttgggagctatattcactgatgaaaataaatggaaaagcgcacgcgaggccgttgaagattcacgcttctgggaacttgttgataaagaaagaaatctacaccttgagggtaaatgtgaaacttgcgtttacaatatgatggggaaacgagaaaagaaactcggcgagttcggaaaggctaaaggaagcagagcaatttggtacatgtggcttggggcccgatttctagaatttgaagcgctaggtttcttaaatgaagaccactggttttcaagagaaaattcactgagtggagttgaaggagagggactgcataaattaggatacatactgagggacgtcagcaagaaagagggaggtgcaatgtacgcggatgatacagctggctgggatacaagaattactctagaagatctcaagaatgaagagatggttactaatcacatgaaaggtgaacacaagaaattggcagaggcaatatttaaacttacgtaccaaaataaggtcgtacgggtgcagaggccaaccccacgaggaacagttatggatataatctcacgcagagatcagcgaggaagcggacaagtaggaacatatggacttaatacctttactaacatggaggcacaactaatacgacagatggaaggcgaaggagtattcaaaaacatccaacatctaaccgtaacagaagaggtagctgtgcagaactggctagctcgtgtgggtcgtgaacgactatcgaggatggccatttctggtgatgattgtgtggtaaaaccacttgatgatagatttgctaacgcgcttactgcactcaatgacatgggtaaaataagaaaggatatacaacaatgggagccaagtaaaggatggaatgactggactcaagtacccttttgctcacatcatttccatgaactaatcatgaaagacggaagagtcttggttgtcccttgcaggaatcaagacgaactaattggtcgagcccgaattagtcaaggtgcaggttggagtttgagagaaaccgcctgcttagggaagtcctatgcccaaatgtggtctttaatgtactttcatagaagggatctacggctcgctgcgaacgctatttgttcagccgtgccaagccattgggttcctacgtcgagaacaacatggtcaattcatgcaaagcatgaatggatgaccacagaagatatgctaacggtttggaatagagtttggataagagagaacccatggatggaagacaaaaccccagttgagtcgtgggaggaaataccctatctgggaaaacgagaagatcaatggtgtggatctctaataggcttgaccagtagggcaacatgggcaaagaacatccaagcggccattaatcaagtaaggtctctaatagggaatgaagagtatacggactatatgcctagcatgaagagattcagacgagaggaggaagaagcaggagttttatggtag

SEQ ID NO: 22690 - RNA, 9876 nt, synthetic construct
  misc_feature 1..9876: note = derived and/or modified CDS sequence (opt6) from DENV-2__FJ024458__SS-prME
  source 1..9876: mol_type = other RNA
tcagccggaatgataataatgctgatccctacagtaatggcattccatttaacgacccgcaacggtgaaccacacatgattgtggggatccaagaaaaaggtaaatctctacttttcaaaaccgaagatggcgtaaatatgtgcacgctaatggcgatggacctcggtgaactatgtgaagacacaataacatataaatgtccattattaaggcaaaacgaaccagaagatatcgattgttggtgtaatagcacgtcaacttgggttacctatggtacgtgtacaaccacaggagaacacaggagagagaaaagatctgtagctttggtaccacacgttggaatgggcctggaaaccaggaccgaaacttggatgtcctctgaaggcgcatggaaacacgctcaaagaatagaaacgtggatactccgacatcccgggtttactataatggctgctatcttagcttatacaataggtaccacacatttccaacgcgtattaatatttattttactaacggcagtggctccctcaatgacaatgcgctgcataggtatatctaatcgggacttcgttgaaggagtgtccggtggctcttgggtcgacatagtgctagaacatggtagctgcgttacaacaatggcgaaaaacaaacctacgttggatttcgaactaataaagacggaagcaaaacaaccagctacactaagaaaatattgtatagaagctaaactcaccaatactacaacggaaagtcggtgcccaacccaaggggaacctagcctaaaagaagaacaagacaagcgcttcgtatgtaagcacagtatggtagatcgcgggtgggggaatggttgtggattattcggaaaaggcggaatcgttacatgcgcaatgttcacatgtaagaaaaatatggagggaaaaatcgttcaacctgagaatttagaatacacgattgtggtgacaccgcactcaggagaggaacatgcagttggaaatgataccggaaaacacggaaaagagatcaaagttacaccacagtcgtcaattacagaagcagaactgactgggtatggaactgtaacaatggaatgttctccgagaaccggattagatttcaatgaaatggtgcttttgcaaatggaaaataaggcgtggctagtccatcgacaatggttcttagacttaccgctaccatggttaccaggggcagataaacaagaatcaaactggatccaaaaagaaacattagtaacatttaagaatccacacgctaagaaacaagacgtagtcgtacttggatctcaagagggtgcgatgcataccgcacttacaggcgctacagaaatacaaatgagcagtggcaatttattattcacaggacatctcaaatgtcgattgcggatggataaattacaactcaagggaatgtcctattccatgtgtacagggaaattcaaagtagtcaaagaaatcgcagagacccaacatggtacaatagtcatcagagtgcaatatgaaggggatggtagtccttgcaaaatcccctttgaaatcatggatctggagaagcgttatgtcttaggccgattaattacagtaaatcctatagtcacggaaaaagatagcccagtaaacatagaagcagaaccaccctttggagattcatatatcataattggggtcgaaccaggacaacttaagttgaattggtttaagaaaggttcttcaattggacaaatgtttgaaacgacaatgagaggtgcaaaacggatggcgatcctaggtgataccgcttgggacttcggaagtctgggcggtgtatttaccagtattggaaaagcgttacaccaagtatttggcgccatatacggcgctgctttcagcggcgtatcatggacgatgaaaatcctgataggggtcataataacatggataggcatgaacagcagatccacttcactaagcgtttctctagtgctagtcgggatagtcacattatatcttggagttatggtacaagcagactctggatgtgtagtatcatggaagaataaggaattaaaatgtggatcaggcatatttataacggacaatgtacacacttggactgaacaatacaaatttcagccagaatctccctcgaagttggcatcggctatacaaaaggcccaagaggaaggaatctgcggcatacgttcggtcactcgattagagaatcttatgtggaaacaaataacaccagaattaaatcatattctagcggaaaatgaggtaaaactcacaattatgactggagatattaaaggcatcatgcaagcaggccggagatcactcagaccacagccaactgaattaaagtattcatggaagacttggggcaaagctaaaatgttgtcaacagagagctacaaccaaacatttttgatagatggcccggaaacagcagaatgtcctaatacgaacagagcctggaactcattagaagtagaagactatggttttggagtttttacgacgaatatctggcttaagctgaaggaaaagcaagatgcattttgtgacagtaaactaatgagcgcagcaatcaaggataatcgagccgtccacgcagatatggactattggatagaatctgccttaaacgatacatggaagatagagaaggcatccttcattgaagtcaaaaattgtcattgggcaaaaagtcacactttatggagtaatggtgtcttagaatcagaaatgataattccaaagaatttagcaggaccagtctcacagcacaattaccgtttaggataccatacacaaatagcgggaccctggcatttaggaaaattagaaatggactttgatttctgtgatggaaccacagtcatagttacagaagattgcggaaaccgaggaccaagtctcaggaccactacagcatcaggcaaattgataacagagtggtgttgtcgaagttgtactttacccccattaaggtatagaggagaggacggatgttggtatggaatggaaattaggccactaaaggaaaaagaagagaacctcgtaaattccctcgtaaccgcgggacacggtcaggtggacaatttctctttaggagtactaggtatggcgctctttctagaagaaatgctgcgcacgcgtgttggaactaaacacgcaattctattagtagcagtaagttttgtgaccctgataaccggaaacatgagctttaaagatctgggacgtgtcgttgtaatggtcggggcaaccatggcggatgatatcggaatgggtgtcacatacttagcacttttagcggcattcaaggttcgtcctacattcgctgctggtctactacttcgcaaactaacttccaaagaactcatgatgacaacaattggcatcgtattattgtcccaaagcacgattccggaaacggtgctagaactaactgatgcacttgctctcgggatgatggttttaaaaatagtcaggaatatggaaaaatatcaattagcagttacgataatggcaatattatgcgtacctaatgcagtcatcttacaaaatgcgtggaaggtttcttgtactattttagctgtagtgtcagtcagcccattgttacttacatcctcacagcagaaaaccgattggattccattggcactaacgatcaagggtctaaatcccaccgccatatttctcactacccttagcagaacgaataagaaaagatcgtggccacttaacgaagctataatggctgtcggaatggtttcaattttggcctcgtcactattgaaaaatgacatcccgatgacaggcccacttgtagccggaggcttgcttaccgtatgttacgttttaacggggagatcggccgaccttgaactagaacgggcgacagacgtaaaatgggaagaccaagcagagatctccggtagttctccgatcttatctataactatcagcgaagacggctctatgagtattaaaaatgaagaggaagaacaaactctaactattttgattagaacgggcttactcgtaatctcaggattattccctataagtataccaataacagcagctgcatggtacctatgggaggttaagaagcaaagagcaggagtattatgggatgttccatcgccgccaccaatgggcaaagccgaactagaagatggtgcttacaggataaagcaaaagggcatcctcggatacagtcaaatcggggccggtgtttacaaggaaggaacttttcatacgatgtggcatgtaacacgcggggcggtgctaatgcataaaggaaaacgtatcgaaccttcatgggccgacgttaagaaagacctaatatcatatggaggtggatggaagttagaaggtgaatggaaagaaggcgaagaagtacaagttttagcattagaacccggcaaaaatccgcgagcagtacaaacaaaacccgggttatttaaaactaatacaggcacgattggagcggttagtttagatttctctccaggaacaagcggtagtcccatcattgataagaagggaaaagtagtcgggctttatggtaatggcgtcgtgacaagatctggtgcttatgttagtgctatagcccaaacggagaaatctattgaagacaatccagaaatagaagatgacatattcaggaaaagacgactcaccatcatggatctccacccaggtgccggaaaaacaaaacgctatttgcctgcaattgtcagagaagcgattaaaagaggcttacgaacattgattcttgctcctacgagggtagtagcggccgaaatggaagaagcactacgaggcttgcccattcgctaccaaactcccgcaatcagggcagaacataccggtcgtgaaatcgtggatctgatgtgccatgctacatttacgatgagactactgtcgcctgttagagtacccaattacaatttaataattatggatgaagctcatttcacagacccagcatcaattgcggcccgaggttacatatccacgcgcgttgaaatgggagaggcagccggaatatttatgaccgcaactccgcccggaagccgagaccctttccctcagagtaacgctccgataatagacgaagagagggaaataccggagagatcatggaacagcggacatgaatgggttactgactttaagggaaaaacagtgtggtttgtcccatccataaaagcaggcaatgatatcgctgcatgcctaagaaagaacggtaagaaagtaatacagctgtctcgaaaaaccttcgactcagaatatgttaagacacgcacaaacgattgggattttgttgtaacaaccgatataagcgaaatgggggctaacttcaaagcggaaagagtcattgatcccagacgttgcatgaaaccagtaatattaacagacggtgaggagagggttattttagcaggtccaatgcctgtcactcacagctcagcggcccaacgacgaggtaggataggaagaaaccccaaaaatgaaaatgatcagtatatatatatgggcgagccgttagaaaatgatgaagactgtgctcattggaaagaagcgaaaatgctactcgacaatataaatacccccgagggaatcataccgtcaatgttcgaacctgagagagaaaaggtagatgcaatagacggcgaatataggttgcgaggggaagcccgaaaaacattcgtagatcttatgagaagaggagacctacctgtatggctggcatacaaagttgccgctgagggaattaattacgcggatcgaagatggtgctttgatggaattaagaacaatcaaattttagaagaaaatgttgaagtggagatttggactaaggagggcgaacgcaagaagttaaagcctcgttggcttgatgcacgtatatattccgacccattagctctcaaagaatttaaagaatttgcagctggacgtaaatcgctcacgctaaatttaataacagaaatgggacgattaccgacgtttatgacccagaaaacaagggacgcgcttgataaccttgcagtactacacacagccgaagcaggaggccgagcatacaatcatgcgctcagtgagctaccagagacgttagaaactcttttgctgttaacgttgttggccaccgtcaccggagggatattccttttcttaatgtcagggaggggaataggcaaaatgaccctcggtatgtgttgcataataacagcatcgattttattatggtacgcccaaatacaaccacactggatagctgcgtcaataatattagagttctttctgatagtattattaatccctgaaccagaaaagcaacggacaccacaagacaatcagttgacatatgtggttatagcgatattaacagtagtagcagcaacaatggctaatgaaatgggatttttagaaaagacgaagaaagatttcggacttggctcaattgctacccagcaacccgagtcgaatatcttagacatagatctaagacctgcatctgcatggacactctacgctgtagccacaacctttgtaactcccatgctaagacactccatagagaactctagtgtaaatgtctcgctaacagccatagctaatcaggctactgttttaatggggttaggcaagggatggccgttaagcaaaatggatattggcgtaccattgctagcaattggttgttattcacaagttaatcctattactttgaccgctgctttactccttttggtagcgcattatgctataattggaccaggtcttcaagccaaagccactagagaagcgcaaaagagggcggctgctggaatcatgaaaaatcctacagtcgacggaattacggtaatcgacctagatcctataccatacgatcctaaattcgaaaagcaattaggacaagtaatgttgctaatactttgtgtaacacaagtcttaatgatgcgaacaacatgggctttatgtgaagccctgactctagcaacaggccccatatcaactctctgggaaggtaatcccggtcgcttttggaataccacaatagccgtaagtatggcaaacatattccgggggagttacttagcaggcgctggattgttgttctcaattatgaagaatactaccaatacaagaagaggaacaggaaatatcggagagacactaggagaaaaatggaaatcacgattaaatgcgttgggaaaaagtgaatttcaaatatacaagaaaagcggtatacaagaagttgacagaacattagcaaaagaagggattaaaaggggcgaaacagaccaccatgcagtttcaaggggttcagctaaacttaggtggttcgtagaacgaaacatggtaacaccagaaggcaaggtagtagaccttgggtgtggacgaggtggatggtcatactattgtggcgggctcaaaaatgtcagggaagtaaaaggactaacgaaaggagggcctggacacgaagaacccatacctatgagtacctatggatggaacctagtccgcttgcagtctggcgttgacgtattctttattccaccggaaaagtgtgacacactcctctgcgatatcggagaatcgtctccgaatcctactgtagaagcagggaggacactacgggtcttaaacctagtagaaaattggcttaataacaatacgcaattctgtataaaggttctcaacccgtatatgccatcagttatagagaaaatggaagccttacagcgaaaatatggaggtgcattagtaagaaatcccttgtctcggaacagtacgcacgagatgtactgggtttcaaacgcttcaggtaatatcgtttcaagcgtcaatatgatttcaagaatgctaataaaccgttttaccatgcggcataagaaagcgacatatgagcctgatgtagacctaggcagtgggactagaaacataggaatagaaagtgaaataccaaaccttgatatcattggtaaaaggatagagaaaataaaacaagagcacgaaacttcatggcattacgatcaagatcatccctataaaacttgggcttatcacggatcctatgagacaaaacaaactggttcggcatcaagcatggtaaatggggtagtcagactgctaacaaaaccgtgggatgtactaccaactgtcactcaaatggccatgacggatactacacctttcggtcaacagcgtgtattcaaagaaaaagtagatacgcgaacacaagagcccaaagaaggaactaaaaagctaatgaaaataaccgctgagtggctatggaaagaattggggaagaagaaaacaccgagaatgtgtactagagaagaatttacgcgaaaagtacgttctaatgctgcactaggagcaatattcaccgatgagaataaatggaaaagtgcaagggaagcagtagaagacagccgattctgggagttagtcgataaagaaagaaatttacacttggagggtaaatgcgagacatgtgtatataacatgatggggaaaagagagaagaaactaggggagttcggaaaagccaaagggtcaagagctatatggtatatgtggcttggcgctcgctttttagaatttgaagcacttggattcctgaatgaagaccactggttttccagggaaaactctttatcgggagtcgaaggagaaggcttacataaattggggtatatacttcgcgatgttagtaagaaagaaggtggtgcaatgtatgcggatgatactgcaggatgggacaccagaataacattagaagatctcaaaaatgaagaaatggtcactaatcacatggaaggggaacataagaaactagcagaagctatattcaaactaacataccagaataaagtagtcagagttcagaggcccactcctcggggaacagttatggatattatttcgagacgcgatcaaagaggcagtggtcaagtcggaacgtatggtcttaacacatttactaacatggaggctcaactaattaggcaaatggaaggagaaggcgtgtttaaaaacattcaacatttaacagttacagaagaggtagcagtacaaaactggctggctagggttggtagagaaagattatctagaatggctataagcggggatgattgcgtcgtaaagccgttggatgacaggtttgcaaacgctttaactgcgttgaatgatatgggaaaaattaggaaagacatacaacaatgggaaccgagtaaaggatggaatgattggacacaggtacctttttgcagtcatcacttccatgaattgataatgaaagatggacgagtgttggtcgtaccctgcagaaatcaagacgaactaattggacgggcccggatttcccaaggagcgggttggagtttgagagaaacggcttgtttagggaaaagttatgcccaaatgtggtcactgatgtattttcaccgaagggatctgagattagcagcaaatgcaatatgctccgccgttccgagccattgggttcctacttcaagaacaacatggagtattcatgccaagcatgaatggatgactaccgaggatatgctgactgtatggaatagagtatggatacgcgaaaacccttggatggaagataaaacaccggtagagagttgggaagaaataccctatctagggaagcgcgaagaccaatggtgtggctccttgatcggacttacaagccgcgctacatgggcgaaaaatattcaagcagcaattaaccaagttaggagcttaattggcaatgaagaatacacagattatatgccgtccatgaaaagattcaggcgagaagaagaggaggctggggtgctctggtaa

SEQ ID NO: 22691 - RNA, 9876 nt, synthetic construct
  misc_feature 1..9876: note = derived and/or modified CDS sequence (opt6) from DENV-2__FJ205880__SS-prME
  source 1..9876: mol_type = other RNA
agcgcaggcatgattataatgttaataccaaccgttatggcttttcatctaactacgagaaacggtgaaccacatatgattgtaggaatacaagaaaaaggcaaatctctactattcaaaacagaagacggggttaacatgtgcacactcatggctatggacttaggggaactttgcgaagatacgataacgtacaaatgccctctcttacgtcaaaatgaaccggaagacatagattgttggtgtaattccacttccacttgggtaacctatggaacctgcacgactacgggggaacatcggcgagagaaaagaagtgttgcattagtaccacatgtaggtatgggtctagaaactcgtacagaaacttggatgtcaagcgaaggagcttggaaacatgctcaaaggattgaaacatggatcctaagacatccaggttttaccataatggccgcaattctagcctatacgataggcacgactcactttcaaagggtactgatctttattttattaaccgcagtagctccgtcgatgacgatgcgatgtatagggatatcaaacagagactttgtagaaggcgtgtccggaggatcatgggtggatattgtcttagaacatggttcttgtgttactacgatggccaaaaataaacctactttagactttgaattgattaaaaccgaagctaaacaaccagctacacttagaaaatattgtatagaggctaaattaactaatactacaacggaaagccgctgtccaactcaaggagaacctagtcttaaagaagaacaagataaaagatttgtctgcaaacattcaatggtagacagaggatgggggaacggttgtggcttattcggaaaaggtggaatcgtcacctgtgcaatgtttacatgtaagaaaaatatggaaggaaaaattgttcaacccgagaatttggaatatactatagtcgtaactccacattcaggtgaggaacatgcagttggaaatgatacaggaaaacatggccaggagataaaagtaactccacaatctagtatcacagaagcagaattaacaggatatgggaccgtaacaatggaatgctcacctcgtacagggctagactttaatgagatggtactattacagatggaaaataaagcatggcttgtccacagacagtggtttcttgatttacctctgccctggttaccgggtgctgataaacaagagagtaactggatccaaaaagaaacattagtgacattcaaaaacccccacgccaagaaacaagatgtagtggtattaggatcgcaagaaggggcaatgcacacagcactcactggtgctacggaaatacagatgagttcaggaaatttattattcaccggacatcttaaatgccgtctacgtatggataaactacagttgaaaggaatgagctatagtatgtgcacggggaaatttaaagtcgtcaaagaaatagctgaaactcaacatggcacaatcgtaatcagagtacagtacgaaggagacggttcaccctgcaaaataccgtttgagataatggacctagagaaacgatatgtactaggtcgattaataaccgtaaatccgatagtcacggaaaaagattcaccagtaaacattgaagccgaaccgccattcggagacagttatattataataggagtggaaccgggacaactaaaattgaactggttcaagaaaggttcctctataggacaaatgttcgagactaccatgagaggggccaaacgaatggctatactaggcgacacagcatgggactttggaagccttggaggcgtttttacatctatcgggaaggcacttcaccaagtttttggagcaatatatggcgcagcatttagcggggtgagttggacgatgaaaatactgattggagttatcatcacgtggataggaatgaactctcgaagtacctcattgagtgttagtttagttctagtaggaatagtaactctatacctcggcgtaatggtgcaagctgattcaggttgcgtagtgtcatggaaaaataaagaattaaaatgcggttccggaatatttataacagataatgtacatacgtggacagaacaatataagttccaaccagagtcacctagcaaacttgccagcgccatacaaaaggctcaagaagaaggaatttgtggtataaggagtgtgaccagacttgagaacttaatgtggaagcaaataacacccgaactaaatcacatactcgcagagaacgaagtcaaattaacgataatgaccggagatattaagggcatcatgcaagcaggtaaaaggtcattgaggccacaaccaacagaacttaaatatagttggaaaacctggggaaaagcaaagatgctctccacggaaagctataaccagacatttttgattgacggtccggagacagcggaatgtcccaacaccaatagagcttggaactctcttgaagttgaggactatggcttcggagtattcaccactaatatatggttaaaattaaaagaaaaacaagatgcgtcatgtgatagtaaactgatgtctgccgcaattaaggacaatcgagcagttcacgcggatatggggtattggatagagtccgcattaaatgatacatggaaaattgagaaggcttcatttatagaggtgaaaaattgccactggccaaaatctcataccctatggagtaatggtgtgcttgaatctgagatgataatcccgaaaaacctagctggaccagttagtcaacataactacagacctggatatcatactcaaattgcaggtccctggcatctaggaaaactagagatggatttcgatttctgtgacggcacgacagtaattgtgactgaggactgtggtaatagggggccctcattaagaacaacaactgcatctggtaaactaattacagaatggtgttgtagatcttgcactctgccacctcttagatatcgaggtgaggatggatgctggtatggaatggagatacgcccattaaaggaaaaagaagaaaatcttgtaaactcactcgtaactgctggacatggccaagttgacaacttttctctaggcgttttgggaatggcgctattcctggaggaaatgctgaaaacaagagtaggcacaaaacatgcaatcttattagtcgcagtcagctttgtaacactaataacaggaaatatgagttttaaagatcttggacgcgtagtagttatggtaggtgccacaatggcagatgatatcggtatgggagtaacttacctggcactacttgctgcgtttaaagttagaccaacattcgccgccggtttattgctgagaaaactgacctcaaaggaactaatgatgacaactattggaatagtgctgttaagtcaaagcactattcccgaaacagtcttagagttaactgacgctctggcactagggatgatggtattgaaaatagtacggaatatggaaaaataccagctggccgtgacaataatggcaatactctgcgttcctaacgccgtaatattacagaatgcgtggaaagtctcatgcacaatcttagcagttgttagtgtgtcgccgttattattgacaagtagtcagcagaaaaccgactggatacccttagccctaacaatcaaaggattaaacccaaccgctatatttctaaccactctttcaagaacaaataagaaaagaagctggccattaaatgaagccataatggcggtcggaatggtatcaatactagcgtcttccttacttaaaaatgatattccgatgactggccccctagtagctgggggtttgctaaccgtctgttacgtactaactggtaggagcgctgatctggaactcgagcgagcgacagatgttaagtgggaagatcaagcagaaatatctggatcatctccaatactgagtatcaccatttcagaggacggcagcatgtcgatcaaaaacgaagaggaagaacaaaccttgactattttgattagaacaggcttattagtaatatctggactattccctattagtataccgattacagccgcagcatggtatctatgggaggtcaagaaacagcgtgctggggttttatgggatgtgccgagtccacctccaatggggaaagccgaattagaggatggcgcttatcgcatcaaacagaagggcatactcggctattcccaaattggagcgggggtgtacaaggaaggtacattccataccatgtggcatgtaacccggggagcagtattaatgcacaagggcaagcgcatagaaccatcctgggcagatgtcaagaaagacctgataagttacggtggaggatggaagctagaaggcgagtggaaagagggggaagaagtacaagtattggctcttgaaccaggcaaaaatccgcgtgcggtgcagactaagccaggcttattcaaaaccaatactggaaccataggcgcagtatcactagacttttcacccggaacatctggaagtcctattatcgataagaagggaaaagtagtaggactatacggaaatggtgtggttacacgcagtggtgcatatgtttccgcaatagcacagactgagaaaagtatagaagataatccagaaatagaagacgacatatttcgaaagagacgattaacaataatggatttacatccaggggcaggaaaaacaaaacgatatttaccggctatagttcgtgaagcaatcaaacgaggtttaagaaccctgatacttgccccaactagagttgtagcagccgaaatggaagaagcattacgtggattgcctattagatatcaaacaccagcaattcgagccgagcatactggtagggaaatcgtcgacctaatgtgccatgctacatttacgatgaggttactctcacctgtccgcgttccaaactataacctaatcataatggatgaagcacactttacggatccagcatcgattgcagctaggggttacatatcaaccagggtcgagatgggcgaagctgcagggattttcatgacagcgacgccgcctggatcccgtgacccctttccacaaagtaacgctcctatcatagacgaagaaagggaaatacctgaaagaagttggaactcaggtcatgaatgggttacggattttaaagggaaaacagtatggttcgtgccatctattaaagctggaaatgacattgctgcgtgcctacgcaagaatggaaagaaagtgatacaactttcaagaaagactttcgattcagaatatgtaaaaacacgtaccaatgattgggattttgttgtaaccacagatataagtgagatgggagccaatttcaaagcagaacgagtgattgatccacgaaggtgtatgaagccagtaatcttaacagacggcgaagaacgggtaatcctagcagggccaatgcctgtgacacactcctcagcagctcaaagacgaggacgaataggtcggaaccctaaaaatgaaaacgatcaatatatatatatgggagaaccattagagaatgatgaagattgcgcacattggaaggaagccaagatgctattagacaacattaacacacccgagggcattataccaagtatgttcgaaccagaacgcgagaaagtggatgcaattgatggagaatataggctacgcggagaagcccgaaaaacattcgttgatctgatgcggaggggcgatctaccagtatggttagcttataaagttgccgccgaaggcataaactacgcagatagacgttggtgttttgacggaattaaaaataatcaaattttagaagaaaatgtagaagttgaaatttggactaaagagggggaaaggaagaaattaaaaccgcgatggttagacgcaaggatctattcggacccactcgctctgaaagaatttaaagaatttgctgcaggcagaaaaagtttaactctcaacttaataacggagatgggacgcttacccactttcatgacccagaaaaccagagatgctctggataacttggcggtactacatacagctgaagccgggggtcgcgcatacaatcatgcactatctgaattaccagaaacgctggagactctattattattaacattattagctacagttacagggggtatatttttgttccttatgagtggaagggggataggcaaaatgactctaggtatgtgttgcattataacagcttctatattgttatggtatgctcaaattcaaccacattggatagccgccagcataatactggagttctttttgatagttctcttaatcccagagccagagaagcaaagaacgccacaagataatcaattgacttatgtcgtcatagcaatattgacggttgtcgctgccacaatggcgaatgaaatgggattcttagagaaaactaagaaagatctaggtctagggagcattgctactcagcaaccagaaagtaatattctggacatagaccttagacccgcgtctgcatggactctttacgctgtcgcgacaacatttgtaacaccgatgttacgacacagtattgaaaattcgagtgtcaatgtgagcctaaccgcaatcgctaatcaagcaactgttttaatgggtctcgggaaaggatggcccttatcaaaaatggatatcggggtgcctttactagctattgggtgttattctcaggttaatccgataacccttaccgcagctttgctgcttttagtagcacactacgcaattatcggacctgggctacaggcgaaagcaactcgagaagcgcaaaaacgcgctgcagctggcattatgaaaaaccctacagtagatggaatcacagttatagacttagatccaattccgtacgacccaaaattcgagaaacaacttgggcaagttatgctattaatcctgtgtgtaacacaagtcttaatgatgagaacaacatgggccctatgcgaggcactgacattagctacaggtccaatcagtacactttgggaagggaatcctggccgattttggaatacaacaatcgcagtttcaatggccaatatttttagaggaagctatctggccggagccggattactatttagtatcatgaagaacactaccaacacgagaagagggactggcaatatgggcgaaacactaggtgaaaaatggaaatctcggctgaatgcgctaggaaaatctgaatttcaaatatataagaaatcggggatccaagaggtagatagaactttagcaaaagagggaataaaaaggggagagacagatcatcacgcggtgtctagaggatcagccaagttaagatggttcgttgaacgcaatatggtaacaccagaaggtaaagtagtggatctaggatgcggccgagggggttggtcatattattgcggcgggttgaaaaatgtccgtgaagtaaaaggattaactaaaggaggaccaggccatgaagaacccatcccgatgtctacgtacggttggaatctagtacgactccaatcaggagttgatgtattcttcatcccaccggaaaaatgtgatacattactctgtgatattggagagtcctcgcctaatcccactgttgaagctggacgaacccttagagtactcaatcttgttgaaaactggttgaataataacacacaattctgtattaaggtattgaatccttacatgcccagtgtaatagagaagatggaagcgttgcagcgcaaatatgggggagcgctcgtgaggaatcctcttagtaggaacagtacgcacgaaatgtactgggtgagcaatgcaagtggcaatatcgtatctagtgtaaacatgatatcacgaatgttaattaatcggtttacgatgcgacataagaaagcaacttatgaaccagatgtagaccttgggagtggaacccgaaatatcggaatagaatcagaaattccaaatctggatataataggaaaacggattgaaaagataaagcaggaacacgagacctcttggcactatgatcaagatcacccatataaaacatgggcgtatcatggttcgtatgaaacaaaacaaactggaagcgcttcatctatggttaatggggtagtaagattgttgacaaaaccatgggatgtgctacctactgtcacacaaatggctatgacagatactaccccttttggacagcagcgagtgttcaaggaaaaagtagacacacgtacacaagagccaaaagaagggactaagaaattaatgaaaattacggcagaatggttgtggaaagaactgggtaagaagaaaacaccgagaatgtgcactagggaagaatttaccagaaaagtcagatcaaatgcagcattaggtgctatcttcactgatgaaaacaaatggaaatcagctcgcgaagctgtagaagatagcagattttgggaactggtcgacaaagaaagaaatctacacttagagggcaaatgtgaaacatgtgtatacaatatgatgggaaaaagggaaaagaaattaggtgagttcggaaaagcaaaaggaagtagagcgatttggtacatgtggctaggtgctaggtttttggagttcgaagccttagggttcctaaacgaagaccattggttctcaagagaaaatagcttatctggcgtggaaggagaaggtttacacaagttgggatatattttaagagacgttagcaagaaagaaggtggggcaatgtatgcggatgatacagctggttgggacactcgtattacactagaagatcttaaaaacgaagaaatggtcacaaaccacatggaaggagaacacaagaaacttgcagaagcgatatttaagttaacctatcaaaataaagtcgtacgagtacaaagaccaacgccacgagggacagtgatggacataatttccagaagggaccagagaggaagtgggcaagtaggcacatatggattaaatacctttactaatatggaagcacaattgatacgccaaatggaaggggaaggagtttttaagaatattcaacaccttactgtcacagaagaagttgccgtacagaactggttagcgcgagttggaagggaacgtcttagtaggatggcaatttctggcgatgactgcgtggttaagccactggacgatcgctttgctaatgcgctaacggctctaaatgacatgggtaaaatcagaaaagacatccaacaatgggagcctagtaaagggtggaacgactggacccaagttccattttgcagtcatcatttccacgaattaattatgaaagacgggagagtcttagtcgtaccatgcagaaaccaagatgagttgattggcagggcaagaataagccaaggtgcaggatggtctttgagggaaaccgcctgcctggggaaatcatatgctcaaatgtggagtttgatgtacttccatagaagagatctaaggctcgcagctaatgccatatgcagcgccgttccttcccactgggtgccaacatcacggaccacatggtctatacatgcaaagcatgaatggatgaccaccgaagatatgttaacggtatggaaccgcgtctggattcgagaaaatccatggatggaagataaaaccccagtggaatcatgggaggagataccatatctagggaaacgtgaagatcagtggtgtggatctttgatagggttgacgtcgagagcaacatgggcaaagaacatacaggcagcaattaatcaagtacgttctctcatagggaatgaagagtatacagattacatgccttcaatgaaacgatttagaagggaagaagaagaggcaggcgtcctatggtga

SEQ ID NO: 22692 - RNA, 9876 nt, synthetic construct
  misc_feature 1..9876: note = derived and/or modified CDS sequence (opt6) from DENV-2__FJ390387__SS-prME
  source 1..9876: mol_type = other RNA
tcggctggtatgatcataatgctaattcctacagtaatggcttttcatttgactacacggaatggcgaaccccacatgattgtaggtatacaagaaaaaggcaagtcgttattgtttaaaacagaagatggggtgaacatgtgtaccttaatggcaatggatctaggtgaactatgtgaagatactattacatataaatgtcctttattgcgacaaaatgaacccgaagacatagactgttggtgtaatagcaccagcacatgggtcacttatggcacctgcactactaccggtgaacacaggagagaaaagcgatccgtagccttggttccacacgtaggcatgggtctggaaactagaaccgaaacatggatgtcatcagaaggcgcctggaaacacgcacagagaatagaaacatggatccttcgtcatcccggtttcacaataatggctgctatactggcctacacaattggaaccactcatttccaacgggtattaatatttatactcttaaccgcagttgctccgagtatgactatgcgatgcataggtatatcgaatcgcgatttcgtagaaggtgtttctggtggatcatgggtagatatagttctagaacacggatcatgtgtaactactatggctaaaaataaacctaccttagatttcgaacttattaaaactgaagcaaaacaacccgccacattacggaaatattgcatagaagcaaaactaaccaatacaacaacggaaagcaggtgcccgacacaaggagaaccgtcgctaaaagaagaacaagataaacggtttgtctgtaaacacagcatggtagatcgagggtggggtaatggatgcggtttatttgggaaaggaggcattgtgacatgtgccatgtttacatgtaaaaaaaatatggaaggaaaaatagtccagccggagaacttggaatatacaatagtagtcacaccacattcaggagaagaacacgctgtcggaaatgacacgggaaagcatggacaagaaataaaagttacaccacagagctctattacagaagcagagttaaccggatacggaacagttacgatggagtgcagtccaagaaccggacttgatttcaatgaaatggtattattacagatggagaataaagcctggctagtccaccgacaatggtttctagatttacctctgccatggctacccggcgctgataaacaggaatcaaactggatacagaaagaaacgctcgtaacttttaaaaacccacacgccaaaaaacaagacgtagtggtgttaggctcgcaggagggggcaatgcatacagcgctaaccggagccactgaaatccagatgtcatcaggaaacttattatttacgggacatctcaagtgtagactgagaatggacaaattgcaacttaaggggatgtcgtacagcatgtgtacaggtaaatttaaagtagttaaagaaattgcagagacgcaacatgggactatagtgatacgggtccaatacgaaggcgacgggtcaccctgcaaagtcccgtttgaaataatggacttagaaaaaaggtacgtactaggtaggttaatcacagtaaacccaattgtaacagaaaaagattcccccgtcaacatagaagcggaaccgccgtttggcgacagttacatcataataggagtcgaaccagggcagctcaaactaaattggtttaaaaagggaagctcgattggacaaatgttcgaaacaacaatgcgaggtgcaaaaagaatggcgattttaggagatacagcatgggattttggtagcttaggaggcgtttttactagtataggcaaagccttacaccaggtatttggagcaatatatggagcagctttctcaggcgtcagttggacaatgaaaattctaataggagttataataacatggataggaatgaacagtagaagtacatccttatccgtttctctagtgttagtcggaattgtaactctatatttaggggtcatggtccaagccgacagcgggtgcgttgtatcatggaaaaacaaggaactaaagtgtggctcaggcatctttataacagataacgttcatacctggactgaacaatataaattccagcctgaatctccatcgaagctagccagcgccatacaaaaggcacaagaggaaggaatctgtgggatacggtctgtgacaagacttgaaaacttaatgtggaaacagatcacaccagagctaaaccatatactcgccgagaatgaagtcaaactaaccataatgactggagatataaaaggcataatgcaagcaggaaaaagatcattaagaccccaaccaactgagctgaaatatagctggaaaacatggggaaaagccaagatgttaagtacggaatcttataatcaaacctttctaatagatggaccagaaacggcagaatgccccaatacaaatagagcatggaattccttagaagtcgaggactacggattcggagtattcaccactaacatctggctgaaactaaaagaaaaacaagacgctttctgcgacagcaaacttatgtcagctgcgatcaaagacaatagggctgtacatgctgacatgggttattggatcgaatcagcattgaacgacacgtggaaaatagaaaaagcgagttttatagaagttaagaattgtcactggcccaaaagtcacacactgtggtccaatggagtcctggaatctgagatgataatacccaaaaacttagcgggtccagtgagccagcataattacagacccggctatcatacacaaattgcaggaccatggcatttaggaaaattagaaatggatttcgacttctgcgacggaactacagttatagtgacggaagattgcgggaacagggggcccagcctgagaacaactacagccagtggaaaactgatcacagagtggtgttgtagatcttgcactcttcctcctctaagataccgaggagaagatggatgctggtatggcatggagatacgaccactcaaagagaaagaagaaaacctagtaaacagtctggttacagctggacacggccaagttgacaattttagcctaggggtcctcggaatggcactcttcctagaagaaatgctccgcacaagggtgggcactaagcatgccattttattggtggctgtatctttcgtaacattaataacagggaacatgtcattcaaagacctaggccgtgtagtcgtaatggttggagcgacaatgaccgatgacattgggatgggagtaacttatttagcgcttttagcagcttttaaagtgagacctacattcgcagccgggctgctattgagaaaattaacaagtaaggaacttatgatgactaccattgggattgtcttactctctcagtcgactattcctgaaacagtgttagaattgactgatgcactagcactagggatgatggtgctaaaaatagtaaggaatatggaaaaatatcaactggctgtgactataatggcaatattgtgcgtacccaatgccgtaattttacagaatgcatggaaagtcagctgcacgatcttagcggttgtaagcgtgtcgcctctgttactaacctcaagccagcaaaaaacagattggattccgcttgccctaacaataaaagggctaaaccccacggccatttttctaactaccctatcacgaacaaataaaaaaagaagctggcctcttaacgaggcaataatggcggtgggaatggtaagtatattagcttccagcttactaaaaaatgacattcctatgaccggaccgcttgtggctggaggtctattaacagtgtgctacgttcttacaggacggtcagcagacctcgagttagaacgagctaccgatgtaaaatgggaagatcaagcagaaatatcgggtagcagtcccatattaagcattactatttctgaagatgggagcatgagtataaaaaacgaagaagaggaacagacgctcaccatactaattaggacagggcttctcgtcataagcgggctatttccaatatctatacctataacagcagctgcttggtatctgtgggaagttaaaaagcaacgagcaggagtcttatgggatgtaccgtcgccgccgcctatgggaaaggcggaacttgaagatggagcttatcggatcaagcagaaaggtatattaggttactcacagattggtgcgggggtctacaaagaaggaacgttccacactatgtggcacgtcacacggggagcagtattaatgcacaagggtaaaagaatagagcctagttgggcagatgtaaaaaaagaccttatatcatatggaggaggttggaagctcgaaggggaatggaaagaaggagaagaagtgcaagtcctcgcattagaacccggaaagaatccacgagcagtgcagactaaaccaggcctatttaagaccaacacgggtacgataggcgcagtatcattggattttagtccaggcacttccggctctccgatcatcgacaagaaaggaaaagtagtaggtctctacgggaacggagtcgtaacgagatcaggagcttatgtatccgcaatagcccaaacagagaagtcaatagaagataatccagaaatcgaggatgatatatttaggaaacgacgcttaacaatcatggatttacatccgggtgcaggcaaaacaaaaagatatttacctgctatagtacgagaagctatcaaaagagggcttcggactttgatactagcacccacgagggtggtagccgccgaaatggaagaagctttaagaggactacctattcgatatcaaacacccgcaataagagctgaacatactggcagagaaatagtagacctgatgtgtcatgcaacatttacaatgagacttttaagccccgttcgtgtgccaaattacaacctcattatcatggatgaggcccactttacagaccccgcttctatcgcagctagaggatacattagtactcgggtggaaatgggagaggcagccggaattttcatgacagcaactccacccggttcccgggacccttttccccaaagcaatgcaccgatcatagacgaggaacgagagattccagaaagatcctggaactcaggtcatgagtgggtgacagatttcaagggtaaaaccgtatggtttgtacctagtataaaggcgggcaacgatatagcagcttgcttacgaaaaaatggcaaaaaagtgatacaactctctcgaaagacgtttgattctgaatatgtgaaaacgagaacaaatgattgggattttgtagtcacaacagatatatctgaaatgggagctaactttaaagcggaaagggtaattgacccgagaagatgcatgaaaccagtaatactcactgatggagaagagagggtaatactggctgggcctatgccggtaacgcactcctctgcggcccaacggcgagggcgaataggtagaaatcccaagaacgaaaacgaccaatatatatatatgggagaaccgctagaaaacgacgaagactgtgcgcactggaaagaagcaaaaatgctcttagataatatcaacacgccggaaggaataattccgtccatgttcgaaccagagcgagaaaaagtagacgctatagacggagagtacagattacggggcgaggcgaggaaaactttcgtcgatctgatgcgcaggggggatttacctgtatggctagcgtacaaagtcgcggctgaaggcataaactatgcagatcgaagatggtgtttcgacgggataaaaaacaaccaaattctagaagaaaatgtagaagtagaaatatggaccaaggaaggagaaagaaagaagctcaaaccccgctggcttgacgcgcgaatatatagcgacccattagctttaaaagagtttaaagaatttgcagcaggaagaaaaagtcttactcttaatcttataacggaaatgggaagactaccgacttttatgacacagaaaacgagagatgcgcttgacaaccttgcagtattacatacagctgaagcaggagggagagcctataaccatgcactttcagaattaccagagacactagaaactcttttacttttaacgctgctagcaacggtgactggtgggatcttcctcttcctaatgtcgggtaggggtataggaaaaatgactctaggaatgtgttgtattatcacagccagcatactactatggtatgcccaaatccaaccccattggatagcggcaagtataatattagaattttttctcattgtacttttgataccagaacctgaaaagcaaaggactcctcaagataatcaattgacttatgtagtaattgcaatacttactgtagtagcagcaacgatggcaaatgagatggggtttctcgaaaaaacgaagaaagacttgggtctcggtagtatagcaacacaacaacctgaaagtaatatcctagatattgacctaaggccagcatcggcatggacgttatatgccgtagccacaacttttgtcacacccatgctaaggcactctattgagaactcctcagtaaacgtatctctcacagcaatagcaaaccaagcgacggtcttaatgggtttaggaaaaggttggcccctctcaaaaatggatataggcgttccactcctggcgataggttgctacagtcaagttaatccaatcacgctaacagcggcattactcttactagtggcacattacgccattataggtccgggtcttcaagctaaagcgacacgcgaggctcagaaacgagctgcggccggaattatgaaaaacccaacggtagatggaatcacagtaatagatttggatccgataccatatgacccgaagtttgaaaagcagcttggacaagtaatgctattaattttatgcgttacgcaggtactcatgatgagaactacctgggcgctatgtgaggctctaacactggcaaccggaccaatttcaaccttatgggaaggaaatcctggtcgtttctggaatactactattgcagtatcaatggcaaacatatttcgaggatcctatctggcaggagctggattattattttcgataatgaaaaacacgactaacacccgacgaggaacaggcaatatgggagaaacattgggagaaaagtggaagagtcggttaaatgccttaggcaagagtgagttccagatttacaaaaaaagtggaatccaagaagtagaccgtactctggcaaaagaaggcatcaagagaggagagactgaccaccatgcagtaagccggggttcagcaaagttgcgttggtttgtcgaacgaaatatggtaacgcccgaaggaaaggttgtagatcttggttgtggtcgaggcggatggagttactattgtggagggctcaaaaacgttagagaggtgaaaggtttaacaaaaggtggcccaggtcacgaagagcctatacctatgtcgacgtacggatggaatctggtacgtttgcaaagcggggttgatgttttctttatacctccagagaagtgtgatacactgttatgtgatattggtgaaagttcacctaatccaacagtcgaagcaggaaggacactacgggtactaaacctagtagaaaattggttaaataataacacgcaattctgcataaaggtcctaaatccgtacatgcccagcgttatagaaaaaatggaagctttgcaaagaaaatacggcggtgctctagtaagaaacccgctatctagaaacagtacacacgaaatgtattgggtatccaatgcttcgggaaacatagtatcgagcgtaaacatgatatcccgaatgttaatcaacaggtttacgatgagacacaagaaagccacttacgaacctgatgttgacctgggatcaggaactaggaacataggcattgagtcagaaataccgaacttagatatcatagggaaaagaatagaaaagataaaacaagaacacgaaacgagctggcactacgaccaggaccacccatataaaacgtgggcgtaccatggttcctacgagactaaacaaaccggatcagcgtcatctatggtgaatggtgtagtcagacttttaactaaaccttgggatgttttacccactgtaacgcaaatggctatgacggacaccacaccctttggtcagcaaagagtgttcaaggagaaagtagacacaagaactcaagaacccaaagaagggacgaaaaaactaatgaaaattaccgcggaatggttatggaaagaactaggaaaaaaaaaaacacctaggatgtgtactagagaagagtttactcgtaaagtcagatctaatgcagcgttaggagcgatttttacagatgagaataaatggaaaagtgcccgtgaggcggtcgaagacagcagattttgggagctagttgataaagagagaaatcttcatctggaaggaaaatgcgaaacgtgcgtttacaacatgatgggaaaacgcgaaaaaaaacttggcgagttcggaaaagcgaaaggatcacgcgccatatggtacatgtggctaggcgctcgatttttagaatttgaagctttgggattcctgaacgaagaccactggttcagccgagagaattcgctaagcggagttgaaggcgagggtttacacaaattaggatacatactaagagatgttagtaaaaaagagggaggggccatgtatgcggacgacacagctggatgggacactaggataactcttgaggatctaaaaaatgaagaaatggtcactaaccacatggagggtgaacataaaaaattagccgaagcgatatttaagttaacttatcaaaataaagtagtacgtgtccaaagaccaactccgcggggtacagttatggatatcataagtagaagggatcaaaggggctctggtcaggtagggacctatggattgaatacttttacaaatatggaggctcaattgattagacagatggagggtgaaggagtatttaagaatatacaacatctaacagtaactgaagaagtagcagtgaaaaattggttagcacgtgtcggccgcgaaaggttatcaagaatggctatatcgggcgacgactgcgtagtaaagccattagatgatagatttgcaaacgcgttaactgccttaaacgacatgggaaaaattagaaaggacatacaacaatgggaaccgagcaaaggctggaatgattggactcaagtaccattttgcagtcatcactttcatgaattaataatgaaagacggacgcgtactagtcgtaccctgcagaaaccaagacgaactcgttggcagagctcgaattagtcaaggagcaggctggtcgttaagagagacagcgtgccttggaaaaagttacgcccagatgtggtccctaatgtattttcaccggcgagatctcagactcgccgcaaacgcaatatgctcggcagtaccctcacattgggtaccaacatcccgcaccacttggtctattcacgctaaacatgaatggatgacaacagaagacatgttaactgtgtggaatagagtatggataagagaaaatccgtggatggaagacaaaaccccagtagaatcttgggaagagataccctacctgggaaagcgagaggaccaatggtgtggttctttaattggcctgacaagtcgcgcgacctgggccaaaaatatacaagcagcaattaatcaagtccgaagcttgataggtaacgaagaatatacggattatatgcccagtatgaaacgcttcaggcgggaagaagaagaggccggggttctctggtaa

SEQ ID NO: 22693 - RNA, 9876 nt, synthetic construct
  misc_feature 1..9876: note = derived and/or modified CDS sequence (opt6) from DENV-2__FJ024461__SS-prME
  source 1..9876: mol_type = other RNA
agcgctggtatgataataatgttaataccgacagtaatggcatttcacctaacaacgcgcaatggagaaccacatatgattgtgggtatacaagaaaaaggtaaaagcctcctctttaaaacagaagacggagttaacatgtgtacgctaatggctatggatttaggcgaactttgtgaagacaccataacttataaatgccccttactgagacaaaacgaaccggaagatattgattgttggtgcaacagcacaagcacgtgggttacttacggcacttgcaccacaaccggtgaacatcgtcgtgaaaaacgatccgtagccttagtgcctcacgtgggtatgggactcgaaacgagaactgaaacctggatgtcttcagaaggggcatggaaacatgcacaaagaattgaaacttggatactacgacacccaggctttacgatcatggcagcaatcttagcatatacaataggaactacgcatttccaaagagtattaatatttattctactaacagcagtagcgcccagtatgactatgcgatgtatcgggatctcaaatagagactttgtagaaggcgtaagcggaggaagttgggtagatatagtattagaacatggatcctgcgtgacaacaatggctaaaaataaaccaactctggactttgaattaataaaaacagaagcaaaacaacctgcaaccctaagaaaatattgcattgaagcaaaattaacgaatacaacaaccgaatctagatgcccgacacaaggagaacctagtctaaaagaagaacaagacaaaagatttgtatgcaaacatagtatggtggacagagggtggggtaacgggtgtggactattcggcaaaggagggattgtaacctgtgcaatgttcacctgtaagaaaaatatggagggaaaaattgtgcaacctgaaaatttagagtatactattgtggttacgcctcattccggcgaagaacatgctgttggaaatgataccggaaaacatggtaaagagataaaagtgacgccccaaagcagtataaccgaagcggaactaacaggatacggtacggttacgatggagtgttcgccaagaaccggactcgatttcaacgagatggtattattacaaatggaaaataaggcttggctcgttcatagacaatggtttctagatctccctctaccatggctgcctggcgcagataagcaagaaagtaactggatacaaaaagagaccctggtaacctttaaaaatccacacgctaagaaacaagacgtagtggtcttaggttctcaagagggagcaatgcatactgccttgactggtgcaacagaaatccaaatgtcatcaggcaacctgctatttactgggcatctgaaatgtagactaagaatggataaacttcaattaaaaggtatgtcatattctatgtgcactggaaaattcaaagtagttaaagaaatcgccgaaactcaacacggcacaatagtaattagagtacaatatgaaggggatggttcaccatgcaagattccattcgaaataatggacctggagaaaaggtatgtcctaggtcgtctaataacagttaatccgatcgtcacagaaaaagactcaccagttaatatagaagcagaacccccatttggagacagctacataataataggtgtagaaccagggcaactaaaattaaactggtttaagaaaggatcctcaatcggacaaatgtttgagactacgatgagaggagctaaacggatggcaattctgggtgacacagcatgggattttggatctttgggtggggtttttacatcaataggtaaagcactgcatcaagtgtttggagccatatacggtgcagctttcagtggtgtttcttggacgatgaagatattaatcggcgtaattataacctggataggaatgaatagccgaagcacctcattatctgtaagcctggtcctagttggaatagtaactttatatcttggggtaatggtacaagcagactcaggatgtgttgtatcgtggaaaaataaagaattaaaatgcggatcaggtattttcataactgataatgtgcatacatggacagagcagtacaaatttcaacctgagagcccttcaaaactggcaagtgccatacaaaaagctcaagaagaagggatatgcggaatcagaagtgtaacacgtttagagaatctcatgtggaagcagattactcctgaactcaaccacatacttgctgaaaatgaagttaaactaacaataatgacaggagacattaaaggaataatgcaagctgggaaacgatcacttagacctcaacctactgagctaaaatactcgtggaaaacttggggtaaagcgaaaatgctgagtacagaaagttacaatcaaacatttttaatcgatggacctgagacggcagaatgtccgaacactaacagagcatggaacagtcttgaggttgaagattatggattcggcgtattcacaacaaatatatggcttaaattaaaagaaaaacaggatgcattctgcgattcaaaattaatgtctgcggcgatcaaagataatcgggcagtacatgcagatatgggatactggatagagtccgcactaaacgatacatggaaaatagaaaaggccagctttatagaagtcaaaaattgccattggcccaaatctcacacattatggagtaacggagttctagaatccgaaatgataattcctaagaacttagcggggcctgtctcgcaacataactatcggttaggatatcacacccaaatcgctggtccgtggcatttgggtaaacttgaaatggatttcgatttttgtgacggtacaacagtgatagttaccgaagattgtggaaatagagggccatcgctgaggacaactactgcaagtggtaagctaattactgaatggtgctgcagaagctgtacattaccgccattacgatatagaggagaagacggctgctggtacggtatggagataaggcccttaaaggaaaaggaagaaaaccttgtaaattcattagtgactgccggacatggtcaagtggataacttttcgttaggtgttcttggaatggcattattcctagaggaaatgctacggactagagtaggaactaaacacgccatccttctcgttgctgtcagtttcgtaacacttatcactggaaatatgtcgttcaaagatctagggagagtagtcgtaatggtaggggcaacaatggcagacgacatcggaatgggggtaacatacctcgcattgttagcagcattcaaagtgaggccaacctttgcggctggactattgttaagaaaattaacgagcaaagagctgatgatgactacaattggtatcgtactattatcgcagtcaacaataccggaaactgtactagaactgacagacgcactagcattgggaatgatggtacttaaaatcgtgcgcaacatggaaaagtaccaactcgcagtaactattatggcgatcttgtgtgtccccaacgccgtaatcttacaaaacgcatggaaagtatcctgcacaattctcgccgtagtttccgtgagtccacttttactcacatccagtcagcagaaaacagactggatccccttggcattaacgattaaaggattaaaccctactgcaatcttccttacaacactgagcaggactaataagaaaagatcctggcccctgaacgaagcaattatggctgtggggatggtctctattctagcaagctcactcctcaaaaacgacatacccatgacaggtcccctagtcgcgggagggcttctcacagtctgttatgtattaaccggtcgatctgcggacctcgaattagagagagcaactgatgtaaaatgggaagatcaggcagagatatcaggttcgagtccaatcttaagtatcacaatttcggaggacggctccatgagtatcaaaaatgaagaggaagaacaaacattaacaatactgatccgtacaggattgttggttatatcaggactcttcccaataagcattccaataacagccgcagcatggtatctatgggaagtaaagaagcagagggccggggtcttatgggatgtaccaagtccacctccaatggggaaggccgaactcgaagatggcgcctatagaattaaacaaaaaggaatcttaggttattctcagataggggcaggagtttacaaagaaggcacatttcacactatgtggcatgtaacaaggggagccgttttgatgcataaaggaaaacggatcgaaccctcttgggccgatgtcaagaaagacctaataagttacggaggaggatggaaactagaaggcgaatggaaggaaggggaggaagtccaagtactagcattggaacctggcaaaaatccaagagccgttcagaccaagcctggactgtttaaaacgaacactggaacaataggggctgtatccttggacttttcaccaggtacctcgggaagcccaatcattgacaagaaaggcaaggtcgttggcctatatggaaatggagttgtaaccagaagtggcgcttatgtctcagcgatagctcaaacagagaaagggattgaagacaatccagagattgaggatgacatattcagaaagcgaaggttgaccataatggatctccacccaggtgcagggaagactaaacgatacctcccggcaatagtcagagaggcaataaaacgtggtcttcgaactttaattctagcaccaactagagtagtagcggcagaaatggaagaggctctcaggggattgccaattagataccaaacaccagcaattcgtgctgagcatacaggacgagaaatcgtggacctcatgtgccacgcgacttttaccatgagactactatcaccagtacgagttccaaactataatctaataatcatggacgaagctcactttacagatcctgcgtctatagcggcgagggggtatatatcgacccgcgttgagatgggtgaagcagcaggcatattcatgacggcgactccaccagggtcacgggatccattcccccaaagcaacgcacccataatagatgaggaacgcgagattccggaacgaagttggaactcaggacacgaatgggtaactgactttaaaggcaaaactgtatggtttgtaccgagtatcaaggcaggcaacgatattgccgcttgtttaaggaaaaacggcaagaaagtaattcagcttagcaggaaaacctttgactcagaatatgttaaaacacgtacaaacgattgggactttgtcgtaacaacggatatatctgaaatgggcgccaattttaaagcggaaagggtgattgatcctagaaggtgtatgaaaccagtaatcctcactgacggagaagagagagttatattggcggggccaatgccagtaacacatagctcagcagcccagcgcaggggtcgaattgggcgtaatcccaaaaacgaaaacgatcaatatatatacatgggcgagccattggagaatgacgaagattgcgcacactggaaagaagccaagatgttacttgacaatataaacacacccgaaggcattatacctagtatgtttgagccagagcgagagaaagttgacgcaattgatggagaatacaggttaagaggagaagcccgaaaaactttcgtagacctaatgagacggggagatttacctgtatggttggcttataaagttgctgccgagggaataaattacgcagatcgtagatggtgtttcgacggtatcaaaaataaccaaatcttagaggaaaacgtcgaggtagaaatctggacaaaagaaggagaaaggaagaaattaaaaccgcgatggttggacgcccgcatatactctgacccattagctttaaaggagttcaaagaatttgcagcaggaagaaaatccctaacattaaatttgataacagaaatgggacgcttacctactttcatgactcagaaaacacgtgatgctctagacaatctagcggtattacatacagctgaagcagggggacgtgcttataaccacgctctgtccgaactcccagaaacgcttgagacactcctactcctgactcttttagcaacagtaaccggcgggatttttctctttttaatgtcaggcagaggaatcgggaagatgacccttggtatgtgttgcataattactgcatctattttactgtggtacgcacaaatccaaccccattggattgcagcctcaataatactagagttcttcctgatagttctattgataccagagcctgaaaagcagagaaccccacaagacaaccaattaacttatgttgtaatagcaattcttacagtggtagctgcaactatggctaatgaaatgggctttcttgagaaaacaaagaaggatttcggattaggctctatcgcaactcagcaaccggaaagtaacattttagatatagatttgcgaccggctagcgcttggaccttatatgcagtggcaacgacatttgtaacgccaatgttgagacacagtatagagaatagtagcgtaaatgtttccttaactgcaatagcaaatcaggcgaccgtattgatgggtttaggtaaaggttggcctctgtcgaagatggacataggagtaccattattagctataggctgctattcacaggtaaatccgattacactgacagcagcattattgctacttgtagcacattatgctataattggtccagggctacaagcaaaagctacgagagaggcccaaaaacgtgctgcagcaggtataatgaaaaatccgactgtagatggaataaccgtaatagatttggacccgattccatatgatcctaaatttgaaaaacaattgggccaagtgatgttattaattctatgtgttactcaagtactaatgatgagaactacgtgggctttatgcgaggcgcttacactagcaacaggaccgatttcaactctttgggaaggtaacccaggacgattttggaatacgacaatagcagtatcaatggcaaatatcttccgaggatcgtatcttgcaggcgcggggctgcttttcagcataatgaagaataccaccaataccagacgtggaacaggaaacataggtgaaactttaggcgaaaaatggaaatcacgcttaaatgccctgggaaaatctgaatttcagatatataagaaatcgggaatccaagaggttgatcgaactctggccaaagaaggcattaaaagaggcgagactgaccatcacgcggtatcaaggggatccgcaaaactacgttggttcgtggaaaggaacatggtaaccccggaaggtaaggtcgtagatttgggatgtgggcgaggaggatggagctattattgcggtggactcaaaaacgtacgtgaggttaaaggactaacaaagggaggtcccggacatgaggaacctattcccatgtcaacgtatggatggaaccttgttcgattacaatctggagtggatgtctttttcatcccaccagaaaaatgtgatacgttactatgtgatattggagaaagcagcccaaaccccactgtagaagccggcagaacgttgagggtgctaaaccttgtagaaaattggctaaacaataacactcaattttgtataaaggtcttaaatccatatatgccatcggtcatcgagaaaatggaggcactgcaacgtaaatacggtggagccttggtccgcaatccattaagccgcaatagcacacacgagatgtactgggtgtctaatgcatccggaaatatagtatcatcagtcaatatgatatctagaatgctgatcaaccgcttcacaatgcggcacaagaaagcaacatacgaaccagatgttgaccttggtagtggaactcgtaatataggaattgaaagcgaaatccccaatctagatataatagggaaacgtatcgagaaaatcaagcaggaacacgagaccagttggcactatgaccaagatcatccttacaagacatgggcttatcacggttcctacgagacaaaacaaacagggtcagcttcgtcaatggtaaatggtgttgtcagattacttacaaagccgtgggacgtattaccaacagtaactcaaatggcaatgacagacacgactccctttggccaacaacgggtttttaaagaaaaagtggacacaagaactcaagaaccaaaggaaggtactaagaaactaatgaagataacagcagagtggttgtggaaagaactagggaaaaagaaaactccaagaatgtgcacacgtgaagaatttacgagaaaagtacgcagtaatgctgcgttaggcgcaatctttaccgatgaaaacaaatggaagtcggcccgagaagccgttgaagacagccgattctgggaacttgttgataaagaaagaaacctccacttagaaggtaaatgcgagacctgcgtctacaacatgatgggaaagagggagaagaaactaggagagttcggaaaagcaaagggatcaagagccatttggtacatgtggctgggagctagattcctagagtttgaggctttaggctttcttaatgaagaccattggtttagtagagaaaattcgctatcaggagtagagggagaagggctccataaactaggatacattcttcgagatgtaagtaagaaagagggaggagccatgtacgcagacgacacggcaggatgggatactcgaataacgttagaggatctcaaaaatgaggagatggtaaccaaccacatggaaggtgaacacaagaaactggcagaagcaatattcaaactaacatatcaaaataaagtggtacgagtacaacgacctacaccaagaggtactgttatggacataatatcgagacgagatcaaagaggttctggacaggtgggaacctatggcttaaatacttttacaaatatggaagcacagcttatacgacaaatggagggagaaggggtatttaagaatatacaacatttaactgtcacagaagaagtggcggtccaaaattggctagcaagagtcggccgtgaacgattatccagaatggcaatatcaggagatgactgtgtagtcaaacctttagacgatcgctttgcaaatgcacttacggcattaaatgacatgggaaagatcaggaaagacatacaacaatgggaacctagtaaggggtggaatgactggacacaggtccctttttgctcacaccacttccacgaattaataatgaaagatgggcgagttctagtggttccttgtagaaatcaagatgaacttatcggtagagcaaggatatcgcagggagcgggatggtcactacgtgaaacggcatgtctaggaaagagttatgctcaaatgtggagcttgatgtatttccataggcgtgatctacgtttagcggccaatgcgatatgcagtgcagtaccatctcattgggttccaacaagcagaacgacatggtcaattcacgcaaagcacgaatggatgacaacggaagatatgcttacggtctggaaccgtgtgtggattagagagaatccatggatggaggacaaaactcctgtggagagttgggaagaaataccctatcttggaaaaagagaagaccaatggtgcggctccctaataggcctcacaagtagagccacatgggcgaagaatatacaagccgcaatcaaccaggttagatcgttaattggcaatgaagagtacacagattatatgcccagtatgaaacgctttagacgtgaggaagaagaagctggtgtactatggtaa

SEQ ID NO: 22694 - RNA, 9876 nt, synthetic construct
  misc_feature 1..9876: note = derived and/or modified CDS sequence (opt6) from DENV-2__FJ373299__SS-prME
  source 1..9876: mol_type = other RNA
tcagcggggatgatcataatgttaatccccacggttatggcgtttcatctgacgactcgaaacggtgaaccccacatgattgtaggtatacaagaaaaaggaaaatcacttctttttaaaactgaagatggcgtaaatatgtgcactttaatggcgatggacctaggtgaattatgcgaagatacaataacatataaatgtccgcttttacgccagaatgaacccgaagacattgattgttggtgcaacagcacttccacctgggttacttatgggacatgcactacaactggtgaacaccgccgggagaaaagatcagtggcgctagttcctcacgttggtatgggtctagaaacacgaacagaaacctggatgtcatctgaaggtgcatggaaacatgcacagagaatagaaacatggatacttcgacatcccggattcactattatggcagcaatcttggcctatacaattggtacgacgcactttcaacgagtattaatatttatattattaactgcagttgccccgtcaatgacgatgagatgcataggtatttcaaatcgagattttgtagaaggcgttagtggtggcagttgggtagatatcgtgctagaacatggtagctgtgtaacaacaatggccaaaaataaaccgactctagattttgaactaataaaaacagaagcaaaacaacccgcaactttacgcaaatactgcatagaagcgaaactgacaaacacaactaccgaatctagatgccctactcaaggagaaccatcattaaaagaagaacaagataaaagattcgtttgtaaacatagtatggtagatcgaggatggggaaacggatgtggcttatttggcaaaggtggtattgtaacctgcgctatgtttacatgcaagaaaaacatggagggtaaaatagttcagccagaaaatttagaatatacgattgtagttacaccgcactcgggcgaagaacatgcagtaggtaatgataccggtaaacatggtcaagaaataaaagtaactcctcaatcatctataactgaagcagaactaacgggatacggtactgtaacgatggaatgttctccacgtacgggcttagactttaatgaaatggttttgcttcagatggagaataaagcatggttagtacacagacagtggttcctggatttacctctcccctggcttccgggggcagataaacaggaaagcaattggattcaaaaagaaaccctagtaacatttaaaaatccacatgccaagaaacaagatgttgtagtacttggaagccaagaaggggcaatgcacaccgcgctgacaggcgcgacagaaatacaaatgtcttctggtaatttactgttcacaggacatctaaaatgtcgtcttcgtatggacaaactacaattaaaaggtatgtcgtacagtatgtgcaccggtaaattcaaagttgtcaaagagatcgcagaaacacaacatggaacaatcgtaataagagttcaatatgaaggggacggcagcccatgtaaaataccgttcgagattatggaccttgaaaagcgctatgtattagggagactaataacggtaaaccccatagttactgaaaaagatagcccagtaaacatcgaagctgagccaccatttggagattcgtacattatcatcggagtcgagccggggcaattaaagttaaactggttcaagaaaggctcatctatcggacaaatgtttgagactactatgagaggagcgaaacgaatggcaatattaggagacacagcatgggactttggtagtttaggaggagttttcacttcaataggaaaagcactgcatcaggttttcggtgcaatttacggtgcggctttttccggcgtgagctggacaatgaagatattaattggtgtaatcatcacatggattggaatgaactcccgaagtacgtcactaagtgtatctttagtcctagtaggtatcgtaactctgtatttaggggtcatggtccaagcggattctgggtgcgtagtctcgtggaagaataaagaattgaaatgcggatcaggcatttttataacagacaatgtccatacttggacggaacagtacaaattccagcctgagtccccttcgaaacttgcgtccgcaatacagaaagcccaagaagagggaatctgcgggattagaagtgtgacaagacttgaaaatttaatgtggaaacagataaccccagagttaaatcacatattagcagaaaacgaagtaaagctaactattatgactggtgatataaagggtataatgcaagccggaaagagaagtctgcgaccccaaccgaccgaactcaaatattcatggaaaacgtggggcaaagcgaagatgttatcaactgaatcttacaatcaaacattcttaattgacggaccagaaactgcagagtgtccaaatacaaatagagcatggaactccttagaagtagaagattacggttttggtgtttttaccacaaatatttggttaaagctaaaagaaaagcaagatgcgttttgtgatagcagactaatgtccgcagcaatcaaagacaatagagcagtgcacgccgatatgggttattggatcgaaagcgctttaaatgacacatggaagatagaaaaagcgagttttatagaagttaaaaattgtcactggcctaaatctcacactttatggagtaatggagttttggagtcagaaatgataatcccgaaaaatctagctggaccagtatctcagcataattatcgaccgggttatcatacacagattgctggaccttggcatttaggaaaactcgaaatggatttcgatttttgtgatggaaccacagtgatagtcacggaagattgtggaaacagaggtccctctttgaggactactacagcctcgggaaaattaattaccgagtggtgttgccggagctgtacgctaccgcccctgagataccggggtgaagacggatgttggtatggtatggaaatcagacccctcaaagaaaaagaagaaaatttagttaactcattagttacagccggacatggccaagtagataatttttcgcttggtgtactaggtatggcattattcctagaagaaatgttgcgcaccagagttggcactaaacacgcgatactgctagtagccgtgtctttcgtaactttaataacgggtaatatgtcgtttaaagatcttggacgcgtagtggtaatggtaggggctacaatggccgacgacattggtatgggagtaacttaccttgcactactagcggcttttaaggtacgaccaactttcgcggcaggactgttactaagaaaacttactagcaaagaattaatgatgaccacaattggtatcgtattattgtctcaaagcaccataccagaaacagtacttgagttaacagatgctttggcattaggtatgatggttcttaagattgttcggaacatggaaaaataccaactcgctgtaaccattatggcaattctttgcgtgccaaatgcagtaatactacaaaacgcatggaaagttagttgcactatcctagccgtggtctccgtcagcccattattattaacatcatctcaacagaaaacagactggatacctttagcactaactatcaaaggcctgaatcccacagccatatttttaacgaccctgtccaggactaataagaaacgtagttggcctttaaatgaagccataatggcagtgggaatggtatccatactcgcttcaagtctactgaaaaacgatatcccaatgactggcccacttgtggcaggaggcttactcacagtatgctacgttctgactggcagatcggcggacttggaattagaaagggcaacagacgtaaaatgggaagatcaagcagagataagtggaagctcccccatactgtcaatcaccatctcagaagacggatcaatgagcattaagaatgaggaagaagaacaaaccttgacaattttaataagaactgggcttttagtcatcagcgggcttttcccgattagcatacctattacagctgcggcatggtatctatgggaagtcaagaaacaacgtgccggtgtactttgggatgttcctagcccacccccgatgggcaaagcagaattagaagacggggcctatcgaataaaacaaaagggaatacttggctatagtcagataggagctggtgtatataaagaaggtactttccatacaatgtggcatgtaacacgcggcgcagtactgatgcataagggtaaaaggatagaaccttcatgggccgatgtcaagaaagatctcatatcatacggaggaggatggaaacttgaaggagaatggaaagaaggcgaagaagttcaagtattagcactcgagccaggaaagaatccgagagctgtccaaactaagcccggtctctttaaaaccaacactggtacgataggagcagtgtccttggactttagtccaggcacatctgggtcaccaatcatagataagaaaggaaaggtagttggattatatggtaatggagtagtaacccgttctggagcttatgtctcagccatcgcacagacagaaaaatctatagaagacaatcctgagatagaggatgacatatttcgtaaaaggagactaacgatcatggatctccatccaggcgctggtaagaccaaaaggtatctcccggcgatagtgcgcgaagctataaaaagaggactaaggacactaatactcgctccaacgagagtagtagctgcagaaatggaagaggcattaagagggctaccaatccgatatcaaactccagcgattagagcagaacacacaggccgagaaatcgtggatctgatgtgccatgcaacatttacaatgagactattgagccctgttagagtcccaaattataacttaattatcatggatgaagctcattttacggatccggcgagtatagcagcaaggggttacatttcaaccagagtagagatgggtgaagctgccggtatttttatgaccgctactcccccaggctcaagggacccttttccccaatcaaatgcgccaattatagatgaggaacgtgaaatacccgaaagaagctggaatagtggtcatgagtgggtcactgactttaaaggaaaaaccgtttggttcgtaccctcaataaaagctggaaatgacatagcagcgtgcctaaggaaaaatggtaagaaagtaattcaattaagtaggaaaactttcgatagtgaatatgtaaaaacaagaactaatgactgggatttcgtagttacaactgacatatctgaaatgggagccaacttcaaagcagaacgagttatcgaccctcggagatgcatgaaaccagtcatattaactgatggtgaggaaagagtaatacttgcgggcccgatgccagtcacgcattcgtcagccgcgcaaagaagaggacgaatagggcgaaatcccaaaaacgaaaacgaccaatatatatacatgggtgaaccgttagagaacgacgaggattgcgcacactggaaagaagcaaagatgttgcttgataacatcaatactccggagggaattatcccctcaatgtttgaacctgagcgtgaaaaagtagacgcaatagacggggagtatcggcttagaggagaagccagaaagacatttgtcgacctcatgagaagaggtgatttaccagtgtggttagcctacaaagtagcggctggtggaatcaactatgcagaccgccgatggtgctttgacgggattaaaaataatcaaatattggaagaaaatgttgaagttgaaatttggaccaaagaaggggagaggaagaaattaaagccgagatggttggatgcgcgaatatactctgatccactcgccttaaaagagtttaaggagtttgcagccggcagaaagagcttaaccctgaatctaatcacagaaatgggacgattgccgacattcatgactcagaaaacacgagacgcactagataacttggcggttctccatacagcggaagctggaggacgagcatataaccacgctcttagtgaactacccgaaacattagaaacacttctacttctcactttgttggctacggtaactgggggaatatttttattccttatgagcgggagaggaattggaaaaatgacattaggtatgtgttgcattataacagcaagtattttgttatggtatgctcaaatccaaccgcattggattgcggcatcgataatccttgaatttttcttaattgttctactcataccagagccagaaaaacagcgcacaccgcaagataatcaattaacatacgtagtaatagctatattaacggtcgtggcagcaaccatggcaaacgagatgggatttctagagaaaaccaaaaaggacttaggattaggctcaattgcgacccagcaaccagaatctaatatcttggatatagatttacgtcctgcttctgcttggaccctatatgcagttgccactacattcgtcacgccaatgctacgacacagtatcgaaaatagctcagtgaacgtttctttaacagccatagcaaatcaagccaccgtcctaatgggcctagggaaggggtggcctctgagtaaaatggacattggagttcctttactagccattggatgctactctcaagtcaatccgattaccttaactgcagcgcttctattattagtcgcacattatgcgataatcggacctggactacaggcaaaagcaactcgagaagcgcagaaaagagccgccgcaggaattatgaaaaatcctacagttgacggaattactgtcatagatctagatccaattccttacgatcctaagttcgagaaacaattagggcaggtaatgttactcatcctatgcgtaacacaggtactaatgatgcggaccacatgggccctgtgcgaggcactgacgttagcgacaggccctataagcactttatgggaaggtaatcccggcagattttggaacacaactattgcagtaagcatggcaaatatatttcggggttcctatttggcaggagcgggtctactattctctataatgaaaaacactaccaatacacgcagaggaacgggtaacatgggagaaaccttaggagaaaaatggaaaagtagattgaacgctttaggaaaaagtgaatttcaaatttataagaaatcaggtattcaagaggtcgacaggactctagcaaaagaaggaattaagcgcggcgaaaccgatcatcatgcagtaagtcgcggatcggccaagctccgatggttcgttgaacgtaatatggttacaccagaaggaaaggtagtcgatttgggatgtggcagagggggctggtcatactactgcggaggattaaagaacgttcgagaagttaaaggtctaacaaaaggtggacccggacacgaggaacccataccgatgtcaacatacggttggaatttagttcgtctacagtcaggcgtagacgtattctttataccaccagaaaaatgcgacactctattatgcgacataggcgaaagttcacccaaccccacagtggaggctggacgtacattgagagtactaaatcttgttgaaaattggttaaataataatacccaattttgtataaaggttttgaatccatacatgccgtccgtaatcgagaaaatggaagcactacagagaaaatacggcggggccctagtgagaaatccattgtcaagaaactcaacccacgaaatgtattgggttagcaatgctagtggaaacatcgtttcttctgtaaacatgatatccaggatgttaatcaatagatttactatgaggcacaagaaagcgacatacgaaccagacgtagatttaggatcgggtactaggaacatcggcatagagagtgaaactcctaatttagacataatcggaaaaagaattgagaaaattaagcaagaacacgaaactagctggcattacgatcaggatcatccatacaaaacttgggcctatcatgggtcatatgaaacaaaacaaacggggagcgcatcatcaatggtaaatggtgtggtacgtttgctaactaagccatgggatgtgttgccaactgtaactcaaatggctatgacggacacaactccatttggtcaacaacgggtcttcaaggaaaaagtagatacgcgaacacaagaaccaaaagaaggcactaagaaattaatgaaaataaccgcggagtggctgtggaaagaactaggtaaaaagaaaactccacgtatgtgcacacgcgaagagttcacacgtaaagtacggtccaatgcagcattaggcgcaatttttactgatgaaaataaatggaaaagtgcaagagaagcggtagaagattcgcgattttgggagcttgtagataaagaacgaaatctgcatcttgaagggaaatgtgaaacatgcgtttacaatatgatgggcaaacgagagaagaaattaggcgagttcggcaaagcaaaaggctcacgagcaatttggtacatgtggcttggagctcggttcctagaatttgaggctttaggatttctgaatgaagaccattggttctcgcgcgaaaatagcctatcgggggttgaaggtgaggggctacacaaactaggttacattctacgggatgttagtaaaaaggaagggggagccatgtacgctgatgatacagcaggatgggatacaaggattacattagaggatttaaagaacgaggagatggtaacaaaccatatggaaggagagcataagaaattagctgaagcaatcttcaaactaacttaccaaaataaagtagtaagagtacagagaccaactccacgtggaacggtcatggatataataagccgaagggaccagagaggatcggggcaagtaggaacatatggactaaatacatttacaaacatggaagcccaattaattcgacagatggaaggagagggagtgtttaaaaatattcaacatctcacagtaacggaggaggtagctgttcaaaactggcttgctcgagtaggacgagagagactttcacgcatggctatatcgggtgatgattgtgtggtaaaaccattggatgaccgattcgcaaatgccctgacggcactgaacgatatgggaaaaattcgaaaagatattcaacaatgggagccatctaaggggtggaatgattggacccaggtgccgttctgctcacatcactttcatgaattaataatgaaggatggaagggtactcgtggtaccatgcagaaaccaggatgaactaattggcagagcgcgtatatcacaaggcgcgggatggtcgttgcgcgaaacagcatgtttgggtaaatcttatgcgcagatgtggagtctaatgtacttccacaggcgtgatttgaggctcgcggcaaatgcaatttgttcagcagttcccagtcactgggtaccaacatcgagaacgacatggagtatacatgctaaacacgaatggatgacaacagaagacatgctaactgtatggaacagagtctggatacgagaaaatccctggatggaggacaaaactcctgtagaatcatgggaagaaataccatacttgggaaagagagaggaccaatggtgcggaagtcttataggattaacaagtcgagctacatgggctaaaaatatacaagttgcaatcaatcaagttcgaagcctgattggcaacgaagaatacacagattatatgccttcaatgaaaaggtttagacgagaagaagaggaagcaggagtattatggtaa

SEQ ID NO: 22695 - RNA, 9876 nt, synthetic construct
  misc_feature 1..9876: note = derived and/or modified CDS sequence (opt6) from DENV-2__FJ410193__SS-prME
  source 1..9876: mol_type = other RNA
tccgcaggaatgataataatgctgataccaactgtaatggcttttcacctgacaacaagaaatggggaaccccacatgatagttgggatacaagaaaaaggaaagagcttattatttaaaactgaggacggggtaaatatgtgcactttaatggcgatggatttgggtgaactatgcgaggatacgataacatacaaatgccccctgcttagacaaaatgaaccagaagacatagactgttggtgcaacagcacatctacatgggtgacatatggcacctgtaccacaacgggggagcaccgtcgcgaaaaacgatctgtggcattagttccacatgtgggaatgggactagagacaagaacagaaacatggatgtcttctgagggagcatggaaacatgcacaaagaatagaaacttggattttgcgacaccccggttttacaataatggctgctatactggcttacaccatagggacaacacactttcaaagggtactgatatttattttattaacggcagttgccccgtctatgacaatgagatgtataggtatatcaaacagagattttgtggaaggtgtatcgggaggaagttgggtagatatcgtactagaacatgggagttgtgtgacaacaatggctaaaaataaaccaaccctagattttgaactaattaaaacggaggcaaaacaaccagctacattaagaaaatactgtatagaggctaaacttaccaacacaacaacagaaagcagatgccccacacaaggagaacccagtttaaaagaggaacaagataaaaggtttatttgtaaacacagcatggtggatcgtggttggggtaatgggtgcgggttatttgggaaaggcggcatagtaacatgtgctatgttcacgtgcaagaaaaatatggaggggaaaatagttcaacctgaaaacttagaatacacaattgttgtgacaccccactcgggagaggaacatgcagtaggtaacgacaccggcaaacatggtaaagagattaaagtcacacctcaatcaagtataaccgaagcagaactgacaggatatggaacggttactatggagtgcagtccaagaacagggctcgattttaacgaaatggtgctgttacaaatggagaataaagcgtggctcgtccatcgacaatggtttcttgaccttccacttccctggttaccgggagcagataaacaagaaagtaattggattcaaaaagagacgctcgtgacatttaaaaatccccatgcgaagaaacaagacgtagtagtactaggttcccaagaaggcgcaatgcacaccgctttaacgggcgccactgaaatacaaatgagctcaggaaatttactattcacagggcatttaaaatgtcggttgaggatggataaattgcagctgaaaggaatgtcatacagcatgtgcacgggcaaatttaaagtcgtaaaagaaatagcagaaacacaacatgggacaatagtcattagggtacaatatgagggagacgggtctccgtgtaaaattccatttgaaataatggacctagagaaacgatacgttttaggccgtctaattacggtaaatccaatagtaactgaaaaagactcaccagtaaacatcgaggctgagccgcccttcggtgatagttatattatcataggagtcgaaccagggcaattaaaattgaattggtttaagaaaggatcttcaataggacaaatgttcgaaactacaatgagaggtgctaaacgaatggcaatactcggagacactgcatgggattttggctcattgggaggagtattcaccagtataggaaaggctttacatcaggtatttggagcaatttacggagccgcattttctggagtaagttggactatgaaaatcttaatcggtgttatcataacctggatcggtatgaactctaggtcaacaagcctatcagtatctttggtattggtagggatagtaacgctatacttaggtgtcatggtacaggctgacagcgggtgcgtagtgtcctggaaaaacaaagaactcaaatgcggtagtgggatatttataaccgacaatgtacatacatggacagaacaatacaaatttcaacccgaatcccccagtaaactcgcgagtgctatacaaaaggcacaggaagaaggtatatgcggaatccgcagtgtaacaagactagaaaatctgatgtggaagcaaataacacctgaattaaatcatatattagctgagaatgaggtcaaacttacaataatgaccggtgatattaagggaataatgcaagcaggaaagaggtctcttagaccgcaaccaactgaattaaagtatagttggaaaacgtgggggaaagcaaaaatgttgtccacagaaagttataatcaaacttttctaattgatggcccggaaacagccgagtgtcccaatacgaatcgggcgtggaacagcttggaggttgaagattacggcttcggcgtattcaccacgaacatttggttaaaattgaaagaaaaacaagacgccttttgtgatagtaaacttatgtctgctgcaataaaagataaccgtgcggtacatgctgacatgggctactggatagaaagtgcattgaatgatacctggaaaatagaaaaagcatcttttattgaagtcaagaattgtcactggccaaaatcacatactctgtggtcaaatggtgtgctagaatcagaaatgataatacccaaaaatcttgcggggccagtatcccaacataattatcgtcctggctatcatacccagatcgctggtccatggcatttaggtaaattggaaatggactttgacttttgtgatggaaccactgtgattgttacggaggactgtgggaataggggaccatctctacggacgactacggcatccgggaaactaataactgaatggtgctgtagaagttgcactcttccacctttacgatataggggcgaagacggatgttggtatggaatggaaattagaccattaaaagaaaaagaggagaatctagtaaactctctggtaacagccgggcacggacaagtggataatttcagcctaggagtcttaggaatggcgcttttcctagaagaaatgctaagaacccgagtaggaacaaaacatgcaattttgttggtcgctgtttcctttgtgaccttaatcacaggcaatatgagtttcaaggatctaggaagagtggtagtgatggttggagcgactatggcagatgatattggaatgggtgtgacgtatctagcactactcgcggcctttaaagtacgaccaaccttcgctgctggacttctattaaggaaacttacttcaaaagaactgatgatgacaaccatcgggattgttctactaagccaatccacgattcccgaaacggtattagagcttactgatgcattagcactcggtatgatggtgctcaaaatagtaaggaatatggaaaaatatcaattagcagtgacaataatggccatactttgcgtcccgaacgctgtaattttgcaaaacgcgtggaaggtaagttgtacaatactggctgtagtaagcgtctcaccactattactaacaagctcacaacagaaaaccgattggattccgttagcattaacaataaaaggattaaacccaacggctatcttcctcacaactctatcgagaaccaacaagaaacgaagttggccattgaatgaagctattatggcggtaggaatggtaagcatcttggcaagtagcttactaaagaatgacatcccaatgacaggaccgttagtagcaggaggattacttactgtttgttacgtacttacaggtcgatcagccgacctagaattggagcgggcgaccgatgttaaatgggaagaccaagcagagatatccggaagcagtccaatactaagcattacaatatccgaggatggtagtatgtcaatcaaaaacgaagaagaagaacaaaccttaacaatattaatccggaccggactattagtaatttctggcttatttccaatctctattccaataactgccgctgcttggtatctctgggaagtcaagaaacaacgcgcgggagtactgtgggacgtaccatcaccaccgccaatgggtaaagcggaactagaggacggcgcatatcgaattaaacagaagggaatactagggtatagtcaaataggtgctggagtatacaaggaagggacgtttcacacaatgtggcatgttacacgtggtgctgtcttaatgcacaaaggaaaaagaattgagccatcatgggccgatgtcaaaaaggacctaataagttacggtggagggtggaaattagagggtgaatggaaagagggagaagaagtccaggtcctcgctttagagcctggcaaaaatcctagagcggttcaaacaaagccaggcctgtttaaaacaaatacgggcactataggcgccgtgtctcttgatttttcgccagggacatcgggtagtccaattatagataagaaaggaaaagtagtgggattatatggtaacggggtagtaacaagatcaggagcatatgtaagcgcaattgcacaaactgaaaaatccatagaggacaacccagaaattgaggatgacatattccgaaagcgaagactaacaatcatggacttacatcccggcgctggaaagacaaagcgatacctaccagctattgtgagggaagctataaaacgaggacttcggacgttaatattagcacctactcgtgttgtcgccgccgaaatggaagaggctttacgcgggctacccataagataccaaacgccagcaatcagggccgaacatacagggcgcgaaattgtagatctaatgtgccatgccacgtttactatgagactattatcccctgttagggtaccaaactacaatttgataattatggacgaagcacattttactgatcccgcctctatagcagcacgaggctatattagtacgagagtagaaatgggcgaggcagcgggaatatttatgacagccacaccacccggttcaagagacccatttcctcaaagtaatgcccctattatcgacgaagaacgagaaatacctgaaagaagctggaactcagggcacgagtgggtaactgattttaagggaaaaacggtctggtttgttccttctatcaaggcgggcaatgacattgcagcttgtttgcgtaaaaatggtaaaaaggtcatccaactcagcagaaaaacattcgatagtgagtatgttaaaactaggacgaacgattgggatttcgtagttactacagatatatccgaaatgggggcaaacttcaaagccgagagagtcatagacccacgaagatgcatgaaacccgttattttaactgatggagaagaacgagtaatactcgccggtcccatgcctgtaacacattcatctgcggcacagcgtcgaggtcgcattggacgaaatccaaagaatgaaaacgatcaatacatttatatgggtgaaccgttagaaaatgatgaagactgtgcacattggaaagaagcgaaaatgctgctcgataatattaacacaccagaaggtataattccgtccatgttcgaaccagaaagagaaaaagtcgacgcaatagacggcgaatataggttaagaggagaagctagaaagacatttgtcgatctaatgagaaggggcgatctcccggtatggctagcatacaaggtagcagcagaaggtattaattatgctgatcgtaggtggtgttttgatggcataaagaataatcagattctagaagaaaatgtagaagtagaaatatggactaaagagggtgaacgaaagaaactaaaaccaaggtggctggacgccagaatttacagtgacccactcgcactaaaagagttcaaagaatttgcagcgggaagaaagagtcttacgttaaatctgattaccgaaatgggaagactccctacattcatgactcagaaaactagagatgccctagacaatctagccgtcttacatacagccgaggctggtggacgcgcatataatcacgcattatcagagttgccagaaactctagaaactttgttgttactcactttattagcaacggtgacaggtggcatatttctattcttaatgagcggtagaggtatcgggaagatgacactaggaatgtgttgcatcacaactgcaagtatactactatggtatgctcaaattcagccccactggatagcagcaagtattatattagagttctttttaatagttttacttatacctgagcctgaaaagcaacgaacaccccaagacaaccaattaacatatgtagtaatagcaattctcacagtggttgccgcgacgatggcaaacgaaatgggatttttggagaaaactaagaaagatttaggattaggttccattgccacccaacaacctgaatctaacattctagatatcgatttaaggccagcatccgcgtggacactttatgcagtagcgaccacgttcgtgacgcccatgcttagacattccatagaaaattcatctgtaaacgtcagcttaacggcaatcgccaaccaagccaccgtcctcatgggactaggaaaagggtggccgttgagtaaaatggatattggtgttccactgctagctataggatgttattctcaagtgaacccaattaccttaacagctgctttgttactgctagtagcacattacgccattatcggaccgggtctacaagcaaaagctacaagagaagcacagaaaagagctgctgccgggattatgaaaaaccctacggtagacggaataactgttatagacctagatcctataccatatgacccaaaatttgaaaaacaattgggacaggttatgttacttatactttgcgtaacacaagtacttatgatgaggaccacatgggccctatgcgaagccctaactttggctactggcccaatctctaccttgtgggagggaaaccctggtagattctggaacacgacaattgcagtgtctatggcaaatatttttagaggctcctatctagctggcgcaggattgctattttccataatgaaaaacacaacaaatacccgtagaggcaccggcaacatgggagaaaccctcggtgaaaagtggaaaagccgcctaaatgccttgggtaaaagtgagttccaaatttacaaacgtagcgggatacaggaggtcgatcgaactctggcaaaagaagggataaaaagaggcgagacagatcatcatgcagtaagcagaggatccgctaagttaaggtggttcgtggaaagaaatatggtaacgcctgagggtaaagtagtggaccttggttgtggcagaggaggctggtcgtattactgtggtggacttaaaaatgttagggaggtaaagggtttaactaaaggtggcccaggacacgaggagccaataccaatgagtacttatggttggaatctagtgcgacttcagtctggcgttgacgttttctttattccaccagaaaaatgtgatacgctactttgcgatataggagaaagctctccaaacccaactgttgaggccggtagaacactacgtgttttaaatttggtagaaaactggctcaataataatacacaattctgcataaaggttcttaacccttacatgccgtcagtcattgagaaaatggaagcactacaacgaaaatatggaggagcgttagtaaggaacccactcagcagaaattcgacccatgagatgtactgggtgagtaatgcctctggtaatatagtttcatcagtcaacatgataagccgcatgttaataaatagatttacgatgagacataagaaagcaacttacgaacccgatgtagacttaggatcaggaacaagaaacatcggcattgagtctgaaatcccaaatttagatattatcggaaaacggatcgagaaaattaagcaagaacatgaaacaagttggcactacgatcaggatcatccctataagacatgggcttaccatggatcgtatgagacaaaacagacaggttcagcctcatcaatggtaaatggtgtagtcagattgttaactaagccctgggatgtactgcccaccgtaactcaaatggctatgaccgacactacgccttttggacagcaaagggtattcaaggagaaagtagatactcgcacgcaagaaccaaaggagggaactaagaaactaatgaaaatcacagcagaatggctatggaaagaactagggaagaagaaaacgcctcggatgtgcactagagaagagtttactagaaaggtacgaagtaatgcagctctgggagcaatatttacggacgagaataaatggaaatcagcaagagaagctgttgaagacagtagattttgggaactggtagataaagaaagaaacttacatctagaaggcaaatgtgaaacttgcgtttataatatgatgggtaaaagggaaaagaaactcggagagttcggaaaagcaaaaggcagcagggccatatggtatatgtggctgggagcgcggttcttagaatttgaggccctaggatttcttaatgaggatcactggttttctagagaaaattctttaagtggcgtggagggagaaggtctacacaaattaggatacatactgagagacgtctcaaagaaagaaggtggtgcaatgtacgcagatgacacagcagggtgggacacgcgtattactttggaagatctaaagaacgaagagatggttacaaaccatatggaaggggagcacaagaaattagcagaagccatatttaaattaacatatcaaaataaagttgtgagggtacagagaccagcgccaagaggcacagtgatggacattatatcaaggagagatcaaagaggatcaggacaagtgggtacatacgggttgaacactttcacaaatatggaagcgcagttaataagacagatggaaggagagggagtattcaaaaatatacaacatctaaccgtaacggaagaggtcgcagtccagaactggctagctagggttggtagggaaaggctgtccagaatggctatctccggagatgactgcgtagtaaaacctttggatgatagattcgctaacgcgcttacagctctaaatgatatgggcaaaattagaaaagatatacaacaatgggaaccatcaaaaggctggaacgattggacacaagtaccattttgttcacatcatttccacgaacttataatgaaagacgggagagtactggtcgtcccatgccgtaatcaagatgaactaataggtagggctcgaatcagtcaaggagcgggatggagtctacgagaaacagcttgtcttggaaagagttatgcacaaatgtggagtcttatgtactttcatcgtagggatttaagactcgcggctaacgccatctgctcagccgttccttctcactgggtcccgacctcacgcacgacatggagcatacacgcaaaacatgaatggatgacaactgaggatatgctaacagtatggaatagagtatggattcgagaaaacccatggatggaagacaaaactccagttgagtcgtgggaagaaatcccctacttagggaaaagggaagaccaatggtgcggctcattaataggacttacgagccgtgcgacgtgggccaaaaacatccaggctgcaattaatcaagttagatctttaataggaaacgaagagtacacagattacatgccttctatgaagagattccgcagggaagaagaggaggcgggggttctttggtga

SEQ ID NO: 22696 - RNA, 9876 nt, synthetic construct
  misc_feature 1..9876: note = derived and/or modified CDS sequence (opt6) from DENV-2__FJ410195__SS-prME
  source 1..9876: mol_type = other RNA
agtgctggaatgataataatgctaataccgactgtaatggcatttcacctaacgacgaggaacggagaacctcatatgattgttggcatacaagaaaaaggcaaaagcctactgtttaaaacagaagacggagttaacatgtgtacattgatggctatggacctaggcgaattatgtgaggatacaattacctacaaatgcccgttactgagacaaaacgaaccagaagatattgattgttggtgcaattccacgtcgacttgggtaacttatggcacatgcacaacgacaggtgagcatcggcgtgagaaaagatcagttgcattagtcccacatgtaggaatgggtttagagactaggaccgagacatggatgtcttcagaaggagcttggaaacatgcacaacgaattgagacatggatactcagacatcccggatttacgataatggcagctatattggcttatactataggcacaacacatttccagcgagtattaatattcatattattgacagcagtggcaccaagtatgacaatgagatgcataggcatcagcaatagagactttgtagaaggggttagcggaggatcctgggtagatattgtattagaacacggctcctgtgtcactactatggccaaaaacaaaccgaccctggacttcgagttaataaaaactgaagcgaaacagccagcaacactacgaaaatattgcatagaagcaaaattaacaaacacaacgaccgaatcccgttgccctacacaaggagaaccatcactaaaagaagaacaagataaaagatttgtttgtaaacattctatggtagataggggatggggtaatgggtgcggtctgtttggaaaaggaggaatagtaacgtgtgctatgtttacatgcaagaagaacatggaggggaaaattgtacagccggaaaacttagaatacacgatcgtggtaactccccatagtggtgaggaacatgcggttggaaatgatacgggaaaacacggaaaagaaataaaagtcacaccccaatcaagcatcactgaagcagaactaacaggatatgggaccgttaccatggaatgtagcccaagaactggactagatttcaatgagatggtattactccaaatggaaaacaaagcatggctagtacacagacaatggtttttggatttgcccctaccctggctcccaggggcagataaacaggagagtaattggatacaaaaagagacattagtaacctttaaaaacccacatgctaagaaacaagacgtagtggttttaggtagccaggaaggcgctatgcacactgcacttaccggtgctacagaaatccaaatgtcatcagggaacttgctgtttactggacatttgaaatgtagattgagaatggacaaattgcagctaaaaggaatgagctattcgatgtgcacaggaaaattcaaagttgtaaaagaaatagctgagactcaacacggaacaatagtcattagggtacaatacgaaggagacggatcaccgtgtaaaataccattcgaaattatggatctcgagaaaagatatgtccttggaagattaataacggtcaatccaatcgtgacagaaaaagattctccggtaaatatcgaagcagaaccaccatttggcgattcgtacataatcataggcgtagaaccagggcaattgaaattgaattggttcaagaaaggaagttccattggacaaatgtttgagacaacaatgcgaggagctaaaaggatggctatacttggtgacaccgcatgggatttcggtagtttgggaggcgtgtttaccagtattggtaaagctctacaccaggtttttggtgcaatatatggcgctgcatttagtggcgtctcatggactatgaaaatattaatcggagtgataataacttggattggaatgaactccagaagcacttcattatcggtttcgctagtactggtaggaatagtaacactctatctgggtgttatggtacaagcagacagcggctgtgtagtttcatggaagaataaagaactaaaatgtggatctggaatattcataacagacaacgtgcacacatggactgagcaatacaaatttcagcctgaatcgccatccaaattagcatccgcaatacaaaaagcccaagaagagggtatatgtggtatccgttcggtaacgcgactagaaaacttaatgtggaagcaaattacacccgagttaaaccacattttagccgaaaatgaggttaaattgactataatgactggggacatcaagggaataatgcaggcaggaaaacgttctcttcgaccacaaccaactgagctcaaatactcatggaaaacgtggggaaaagcaaaaatgttaagtacagagtcttataatcagacatttttgatagacggtccggagacagcggaatgtcctaatacaaacagagcctggaacagcttagaagtagaggactatgggtttggtgtatttacgactaatatctggcttaaattaaaggaaaaacaggacgcattctgtgattcgaaacttatgtcggcggctataaaagataaccgtgccgtccacgcggacatggggtactggatagaatcagctcttaacgatacttggaaaatagagaaagcgagttttatagaagtcaaaaattgtcattggcccaaatcacacacactgtggtcgaatggagtactagaaagcgaaatgattataccgaaaaacttagccggaccagtcagtcagcataattatagacctggttatcacacccaaatagcaggcccatggcacctcggaaagttggaaatggatttcgatttttgcgacggcactactgttattgtaaccgaagactgtgggaatcgcggccccagcttacgaacgacgactgcttccggaaaattgatcacggagtggtgttgccgatcatgtactctaccaccgctaagatatcgaggagaagatggttgctggtacggtatggaaatacgacctcttaaagaaaaagaagagaatttggttaactcattggttaccgcagggcatggtcaagttgataactttagcttaggagtcctaggtatggctttattcctcgaggagatgctccggactagagttggcactaaacacgccatactattggtggcagtttcttttgtaactctcataactggcaacatgtccttcaaggacttaggtcgggtagtagtaatagtgggagcaactatggctgacgatataggaatgggcgtaacatacctcgcgcttttggcagcttttaaagtacgcccaacgtttgctgcaggattgctgctacgaaaactcacctctaaagagttaatgatgacgaccatagggatagtattgttatctcagtccactatcccagaaactgttttagaactgacagatgcattggctctaggcatgatggttctgaaaatcgtgcggaatatggaaaagtatcagttagcagtaacaataatgactatactatgcgtcccaaacgcagttattctacaaaatgcatggaaagtaagctgtacaattttagcagtcgtatcagtgagtccactactactaacttcatctaggcaaaagacagattggataccgttagcattgacaataaaaggattgaaccccactgcaatattcttaacgactctaagccggactaataagaaaaggtcctggccgttaaacgaagcaataatggccgtaggtatggtgtcaatactagcaagttcattacttaaaaacgatatccccatgactggccctcttgtagccggtggtttattaacagtctgctatgtactaactggtcgcagcgcggatttagaactggaacgcgcaacagatgttaaatgggaagatcaggcagagattagtggttcaagcccaatccttagtattactatatccgaagatggaagcatgtctatcaaaaatgaagaggaagaacaaacattgacaatcctcattagaacagggctgctagttatctccggtttattaccaataagcatcccaatcacggcagccgcatggtatctgtgggaagtaaagaagcaacgcgccggtgtactttgggatgttccttctccaccacctatgggtaaagcagaattagaggatggagcgtatagaatcaaacagaaagggatactggggtactcgcaaataggagcgggtgtatataaagaaggaactttccacacaatgtggcatgtcacaagaggagccgtgttaatgcacaaaggaaaaagaatagaaccgtcgtgggccgacgtcaagaaagatttaatatcgtatgggggaggctggaaactggaaggagaatggaaagaaggtgaggaagtacaagtactcgcactagaacctggcaaaaatccacgagctgtccaaaccaaacctggattattcaaaaccaacacagggacaataggtgctgtatcattagatttctcaccaggtacaagtggtagtcccatcattgacaagaaaggtaaagtagtcgggctatatggaaacggggttgtaacacgttcaggggcttacgtttcagcaatagctcaaacagaaaaatctatagaggataatccagagatcgaagatgatattttcagaaagcgtagactgacgattatggaccttcacccaggggctggtaaaacaaaaagatatctgcccgcaatcgtaagggaagcaataaaaagaggtctacgtacattaatacttgctcctacgagagttgtagcagcagagatggaagaagcattgcggggacttcctatcagatatcaaacaccagcaattagggctgaacatacaggaagggaaatcgtggatctaatgtgtcacgctacattcacgatgagattactctctccagtcagagttccgaattacaatttaatcatcatggatgaagcacactttacggacccggcaagtattgctgcgaggggatatatatcaacgagagtagaaatgggcgaagctgcgggaatattcatgaccgcaactcctcccgggagtagagacccctttccacagtctaatgccccaattattgatgaagaaagagagatacctgaaagatcttggaactcggggcacgaatgggtgaccgatttcaaaggaaagactgtttggttcgtaccaagtatcaaagctggtaatgacatagcagcatgcctgaggaaaaatggcaagaaagtaatacaattaagtaggaagaccttcgacagcgaatacgttaagacccgaacaaatgattgggattttgtagttactacagatatatcagaaatgggggcaaattttaaggcagaacgggtgattgatccaagacgttgtatgaaacctgttatccttactgacggggaagaaagagttatacttgcaggaccaatgcccgtgactcactcaagtgcggcacaacggcgaggtcgaatcgggcgaaatccgaaaaatgaaaatgatcagtatatttacatgggggagcctctcgagaatgacgaagactgcgcgcattggaaagaggccaaaatgttacttgataatattaatacacccgagggaataatccctagtatgttcgaaccagaaagagaaaaagtagatgctatcgatggagaatatcgcctgcgtggagaggcacgtaaaactttcgtcgacctcatgagacgtggagatctaccggtctggctcgcttataaagtcgctgccgaaggtattaattatgctgatagaagatggtgttttgacggcatcaaaaacaatcaaatacttgaagaaaatgtagaggtagaaatatggacaaaagaaggggaaagaaagaaactcaaaccgagatggctggacgcaagaatatattcagatccactagcattgaaagaatttaaagagtttgccgcaggacgcaaatcactcacacttaacttgattaccgagatgggcagactcccaacatttatgactcagaaaacacgtgacgcattggataacctagctgtcctccacacagcggaagccggtggacgtgcgtacaatcacgcactgtctgaacttcctgaaacacttgaaactttgttattattaacattattggccaccgttacaggcggaatatttttattcttaatgtctgggcgaggaataggcaaaatgacgttaggaatgtgttgcattataacagcttctatcctcttatggtatgcgcaaatccagcctcactggatagcggcatctattatccttgagttctttttaatcgttctccttattccggaaccggaaaagcaaaggacacctcaagacaaccagttaacttatgtagtaatagctattttaacagtagtggcagctactatggcaaatgaaatgggatttctcgagaaaaccaagaaagacttgggtctagggagcattgcaacgcaacaaccagagtcaaacatattagacattgaccttcgaccagctagtgcctggactctttatgctgttgccacgacattcgtaactccgatgctcaggcatagtatagaaaacagtagcgtgaacgtttcgttgactgccatagctaatcaagcaacggtgttgatgggtttggggaaagggtggccgctctctaaaatggacataggagtccccttgttggcaataggatgttattcccaagtgaatcctataactcttactgccgcactattattgttagtagctcactacgcgattataggacctggactccaagcaaaagccaccagagaagcgcagaaaagagctgctgctggaataatgaaaaatccaaccgtggatggtatcacagtaatagaccttgaccctataccttatgacccaaaatttgaaaaacaactgggccaagtcatgttattaatactatgcgtaacccaggtcctgatgatgagaactacatgggctctatgtgaagcgcttacattggctacaggtcccataagtacgctgtgggaaggcaaccccggaagattctggaacacgaccatcgcggtgagtatggctaatattttccgcggatcttatttggctggtgcgggattattattttctataatgaagaacacaacaaacactcgaagaggaaccggtaatatgggagaaaccttaggggaaaaatggaaatctagattgaatgctttgggaaagaatgagttccaaatctacaagaaatctggcattcaagaagttgataggacgttagcaaaagaaggtataaagagaggggaaaccgatcaccacgcagtatcacgaggtagcgcgaagttgcgttggtttgtagaaagaaacatggtaactcccgaaggtaaggttgtagatcttggatgcggtagagggggatggtcctactactgcggagggttaaagaacgtacgagaagtgaaaggactgacgaaaggcggcccagggcatgaagaaccaatacctatgagtacttatggatggaacttagtacgtctgcaaagtggtgtagatgtattctttataccgccagaaaaatgtgacacactattatgcgatattggagaatcttcgcctaatccgaccgtagaggctggaagaacactacgagtcttaaacctagtggagaattggttaaataataacactcagttttgcataaaagtgctaaatccgtatatgccttccgttatagagaaaatggaagcccttcaacggaaatacggaggtgcactggtacgtaatcctctttcaagaaacagtacacacgaaatgtattgggtttcaaatgcatcaggtaatatagtgagttcagtaaacatgatatcacgaatgctaataaatagattcacaatgcggcataagaaggcaacgtatgaacctgatgtagaccttggtagtggtacacggaatatcggcattgaatccgaaatcccgaaccttgatattattggcaaacgtatagagaaaattaaacaagagcatgaaacctcctggcactatgaccaagatcacccctataaaacgtgggcttaccacgggtcatacgaaaccaaacagacgggaagcgcgagttcgatggtaaatggagtagtacgtttgctcaccaaaccatgggatgtactacccacggtgacgcaaatggctatgacagatacaacaccatttggacaacaaagggtatttaaagaaaaggtagataccagaacgcaagagccaaaagaaggaaccaagaaattgatgaagatcacagctgaatggttgtggaaggaattaggtaagaagaaaactcctagaatgtgcacacgcgaggaatttaccagaaaagttcgatcaaatgcagctttgggcgcaatattcaccgatgagaataaatggaaaagtgcaagagaagccgtagaagattcaagattctgggaattagtagacaaagaacgaaatctacatttggaaggaaagtgcgaaacctgtgtttacaacatgatgggcaaacgagagaagaaattgggcgaatttggaaaagcaaaagggagccgagcaatatggtatatgtggttaggtgcgcgtttcctcgaatttgaagcgttaggtttcttaaatgaggaccactggttttcaagagaaaacagcctaagcggagtagaaggcgaaggacttcataaattagggtatatattaagagacgtcagtaagaaagaaggaggagctatgtatgcagatgacacggctggatgggacacaagaataacattagaagatctcaagaatgaggaaatggtaacaaaccacatggagggcgaacataagaaactggcggaagctatattcaaacttacatatcagaacaaggttgtaagggtgcaaagacctaccccgagaggaactgtgatggacataatttcaagaagagaccaacgtggatcaggtcaggtcggaacttacgggttaaacacattcactaatatggaagcgcagttaatacgacaaatggaaggtgaaggagtctttaaaaacatccagcacttgactgttaccgaggaagttgcggtacaaaactggctggcgagagttggaagagaacggttatctagaatggcaatcagtggagatgattgcgtcgtaaagccattagatgataggttcgctaatgccttaacagctctgaacgatatgggaaaaatcagaaaggatatccaacaatgggaaccctcaaaggggtggaatgactggacacaagtacccttttgttcccaccatttccacgagcttatcatgaaggatggtcgtgttctagtagtgccatgcaggaatcaagatgaactcatcggacgtgcgagaataagtcaaggtgcggggtggagtttaagagaaaccgcatgcctaggaaagtcgtatgcacaaatgtggtctttaatgtatttccacagaagagacttgcgcttagcagcaaatgctatttgcagtgccgtaccgagtcattgggtcccaacatcacgcactacttggagcattcacgcaaaacatgagtggatgacaactgaggacatgttaacggtttggaaccgggtgtggatccgtgaaaatccatggatggaggataagacccccgttgaatcatgggaggagatcccttatctgggaaaaagagaagatcaatggtgtggatcattgataggattaacatcaagagcaacctgggccaaaaatattcaagctgcaattaatcaagtgagaagcctgataggtaacgaagaatataccgattacatgccatctatgaaacgattccgaagagaagaagaggaagccggtgtgctctggtag

SEQ ID NO: 22697 - RNA, 9876 nt, synthetic construct
  misc_feature 1..9876: note = derived and/or modified CDS sequence (opt6) from DENV-2__FJ432726__SS-prME
  source 1..9876: mol_type = other RNA
tctgcaggtatgattataatgcttataccaaccgtgatggctttccatctaacgaccagaaatggcgaaccacacatgatagtaggaatacaagaaaaaggaaaatctttattgtttaaaaccgaagatggagtaaacatgtgcacgctgatggcaatggacctaggagaactatgcgaagacacgataacatataaatgcccactactacgacaaaacgaaccagaagatatagactgttggtgtaatagcactagcacatgggtaacatatggaacctgtacaactactggagaacaccgaagagagaaaagatctgtagcattagtgccgcacgtggggatgggactcgaaacaagaaccgaaacatggatgagctccgaaggagcatggaaacatgctcaaagaatagaaacctggatattaagacatccaggctttacaataatggcagcaattctagcgtacacaataggtacaacacattttcagagagttcttatattcatattactaactgcagtagctcccagtatgaccatgcgctgcattggaattagcaatagagacttcgtagaaggtgtcagcgggggatcttgggtagatattgtactagaacatggttcatgcgttactaccatggccaaaaataaacctacattggattttgaactcataaaaacagaagccaaacaacccgcaacattaagaaaatactgtattgaagcaaaacttacgaatacaacaaccgaaagccgctgccctactcagggggaaccttcattaaaagaagaacaagataaacgcttcgtatgcaaacattcgatggtcgaccgtggctgggggaacggatgtgggctttttggcaaaggaggaatagtaacttgcgctatgtttacttgcaagaaaaatatggaaggtaaaatcgtgcaaccagaaaatcttgaatatacgattgtcgtaactccgcactctggagaagaacacgctgtaggtaacgatacgggtaaacacggtatggagataaaagtaacccctcaaagctctataaccgaagctgagttgactggatacgggaccgtaaccatggaatgttcaccacgcactggactggacttcaacgagatggtcctcctacagatggaaaacaaagcatggctcgtgcatcgacaatggtttttagatctcccactcccatggttgccaggagcggataaacaggaatctaactggattcaaaaagaaacccttgtaacattcaaaaatccacatgccaagaaacaagacgtagtagttctgggaagccaggaaggcgctatgcacacagccctaacaggtgcaactgaaatacagatgtcctcaggcaaccttttgtttaccgggcatctaaaatgcaggttacgcatggacaaattacaattaaaaggtatgtcctatagcatgtgcacgggcaaatttaaagttgtaaaagagatagcagagacccaacacgggactatagtaatccgtgtgcaatacgagggagatggctcaccctgcaaaataccctttgaaattatggacttagaaaaacgttatgtgcttggtagactaattacagtcaacccgattgttaccgaaaaggatagtcctgtaaatattgaagcagagcctccattcggcgatagttatatcattatcggtgtcgaaccaggccaattgaaactaaattggttcaagaaagggtcgtcaatcggtcagatgtttgaaacaacaatgcgtggcgccaaacgcatggcgattttaggggacacggcatgggacttcggatcgctaggaggtgttttcacttcaatagggaaggctttacaccaagtttttggtgcaatatatggagccgcattcagtggagtatcatggacgatgaaaatcctcattggagttattatcacttggataggtatgaactcaagaagtacctctttatcagtaagtcttgtcttagtaggaattgtcaccttatatctaggagtgatggtgcaagcagactcaggctgtgtggtatcctggaaaaataaagaactaaaatgtggatcaggtatatttataaccgataatgttcatacctggacagaacaatacaaattccaacccgaatcaccttcaaaacttgcctcggccatccagaaagcccaggaagagggcatatgtggtataagatcagtaacccgactcgagaacttgatgtggaagcaaatcaccccagaactgaaccatatacttgcggaaaacgaggtgaaactgacaattatgacaggtgatataaggggaatcatgcaagctggaaagcgttcccttcggccacaaccaacggagcttaaatatagctggaagacttgggggaaagctaaaatgttatcaaccgaatcatataaccaaactttccttatagatggaccagaaactgccgaatgccccaatactaatagagcatggaactcattagaagtagaagattatggttttggcgtatttaccacaaacatctggttgaaactaaaagagaaacaagacgcattttgtgattcaaaattaatgagcgctgccattaaagataacagagctgtacacgccgatatgggatactggatagaaagtgccctaaatgatacatggaaaatcgagaaagcatcattcattgaggtcaaaaactgccactggcctaaatcacatacactatggtccaatggcgtattagaaagtgaaatgatcattccgaaaaatttagcaggtccggcatcgcaacacaattatagaccagggtatcatacacagattgccggcccctggcacctaggtaagctagaaatggacttcgatttttgtgatggaacaaccgtaatagtgaccgaggattgtggtaacaggggtccatctttaaggactacaacggccagtggaaaactcattacagaatggtgttgtagaagctgcaccttaccaccactacgttacagaggagaagacggttgctggtatgggatggagatcagaccacttaaagaaaaagaagagaatcttgtaaacagtttagttacagcaggacacggacaagtagacaatttctccctaggtgtattaggaatggcactgttcttagaggagatgttgcgaacaagagtcggaactaaacatgcaattttattggtagctgtaagttttgtaacacttatcactggcaatatgagctttaaggaccttggacgagtagtcgttatggtcggagcgaccatggcagacgacatcgggatgggagttacctacttagcattattggcagcctttaaagtccgacccacatttgcagcaggcctattactccgtaaattgacgtcaaaagaattgatgatgacaactattggcattgttctattaagccagtcaactataccagaaaccgttttggaattgactgacgctctagcactagggatgatggtattaaagatagtgaggaatatggagaaatatcaattggctgttacaataatggctatactttgtgtaccaaacgctgtcatcctgcagaacgcttggaaagtatcgtgtactattttagcggtagttagtgtgagtccattactcctaacatcatcccaacagaaaacggattggataccactagccttaaccataaaaggtttaaatcctacagccatattcttgacgaccttatcaagaacaaacaagaaacgctcctggcctttaaacgaagccatcatggctgtgggtatggtttccatactggcttcttcgttactgaaaaacgacattccaatgacagggcctctagtagcagggggattattaacggtctgctatgtgctcacgggcaggtcagctgacttagagctggagagagcgactgatgttaaatgggaagatcaggcagaaataagtggttcttctccaatactttcaatcacaatctcagaagatggtagcatgtccatcaaaaacgaagaagaggaacaaaccctaacgattttaatccgaaccggacttttagtaatatcaggcctgttcccaatctcaattccaataactgcggccgcatggtatttatgggaagtaaagaagcaacgagcaggagtactgtgggatgtaccatcaccccctcctatgggaaaggctgaattggaggacggggcataccgaattaaacaaaaaggtatattgggatattctcagattggagccggtgtttataaagaaggaacatttcatacaatgtggcatgtaacgagaggtgcagtgctaatgcataaaggaaagagaatcgaacccagttgggctgatgtcaagaaagacttaatttcatatgggggtggatggaaactagaaggtgagtggaaggagggcgaagaagtacaagtactagccttagaacctggtaaaaaccccagggcagtacagacaaaacccggcttattcaaaaccaacacaggtacaataggagccgtgtcgttagacttttcaccggggacaagcgggtccccgatcatagataaaaagggaaaggtcgttggcttatacggtaatggtgttgtgacacgaagcggagcatacgtctccgctattgcgcaaacggaaaaatcgatagaagataacccagaaatagaagatgacatatttcgtaaacgccgacttactataatggatttgcaccccggcgctggaaaaacgaagaggtacctaccagccatagtgagagaagccattaaaagaggactaaggacattaatattagcacctacgcgcgtcgtggcggcagaaatggaagaagcgttgagaggattacccataagatatcagacaccagctataagggcagaacacacaggcagggaaatagtggacctgatgtgccatgcgactttcacgatgcgattattatcgccagtaagagtacccaattataatcttatcatcatggacgaagctcacttcactgaccctgctagtatcgcagcaagaggttatatttctacacgagtagaaatgggagaagcagccggtatattcatgaccgcaaccccacctggtagtagagatccatttccgcagtcgaatgcgccaataatagatgaggagcgtgaaattcctgaaagaagttggaactcgggacatgagtgggtaacagattttaaaggtaaaaccgtttggtttgtcccatcaattaaggccggcaatgacattgcggcatgtctcaggaaaaatgggaagaaagtaatacaactaagccgcaaaacttttgatagcgaatacgtcaaaacgagaacaaatgattgggacttcgtagtaactactgatatctccgaaatgggcgcgaactttaaggcggaacgagttatcgacccaagaagatgcatgaaacctgtaatcttaacggacggtgaagaaagagtgattttggctggacctatgcccgttacacactcctctgcggctcaaagaaggggaagaattggtcggaaccccaaaaacgagaatgaccagtacatatatatgggagagccactggaaaatgatgaggactgtgcgcattggaaggaagcaaaaatgctattagataatattaacacaccagaaggtataatcccaagcatgttcgaacccgagcgagaaaaagttgatgctattgacggagaataccgcctaagaggcgaggcgaggaaaacattcgtcgatcttatgagacgaggagacttgcccgtttggttagcatataaggtagcagccgaaggtattaactatgcagatagacgatggtgttttgatggcatcaaaaataaccaaatactggaggaaaacgtagaggtggaaatctggactaaagaaggagaaaggaagaaacttaaaccaaggtggctagatgcgcgaatctatagtgacccactagctctcaaagaatttaaggaatttgcagcaggacgaaaaagtctgactctaaatcttattaccgaaatggggcgtctaccgacgtttatgactcaaaagacacgtgacgctctagacaatttggctgtcttacatacggctgaggcgggtggtcgagcatacaatcacgcactctcagaacttccagaaaccctggagactctattattattaactctactcgccaccgttactggaggaattttcttatttctcatgagtggtagaggcataggcaaaatgacattaggaatgtgttgcataatcacagcgtctatactattgtggtatgcacaaatacagccacattggattgcagcctctattattttagagttctttctaatcgttctactaatacctgaacctgaaaaacaaagaacgccacaagacaaccaactcacttacgtagttatagctatattaacggttgtagcagcaacaatggctaacgaaatggggtttttggagaagacaaagaaagatttaggtctgggaagcatcgcaactcaacagccagaaagtaatatactagacatagatctacgacctgccagcgcttggacactctacgcagtagcaacaacttttgttacacccatgttgaggcattctattgaaaacagtagcgttaacgttagcctaacagcgattgcaaatcaagcaaccgtacttatgggattaggtaaaggatggcctttatcaaagatggatataggagtacctttattagcaataggctgctatagccaagtcaaccccataactttaactgcagcattgttactgctagtggcgcattatgcaataattggacctggcctacaagcaaaagccacgcgtgaagcacaaaagcgagctgcagctggaattatgaagaaccctacagtcgatggaattacagttatcgatctagatcctatcccttacgaccctaaattcgagaaacaactaggtcaagtgatgttgcttattctgtgtgttacacaagtattaatgatgcgaacgacatgggcactatgtgaggcactcacacttgcgacaggtccaataagtactttatgggaaggcaatcctggtaggttttggaacacaacaatcgctgtttccatggctaatatattcagaggatcatacttggccggtgctggcctactcttctcaataatgaaaaatacaacaaacacaaggagaggtacgggaaacataggggaaacactaggcgagaaatggaagtctagattgaacgcattaggaaaaagtgagttccaaatctacaagaaatcaggcatacaagaggttgaccgcaccctggcaaaggaaggaattaagagaggggaaactgatcatcatgcggttagcagagggtctgccaaattaagatggttcgtagagagaaacatggttactcccgaaggtaaagtagtagacttgggctgtggcagaggaggttggtcatactactgtggagggcttaaaaatgtccgcgaagtaaaaggactcaccaagggaggacccggtcatgaggaaccgatcccaatgtcaacttacgggtggaacttggtcaggctgcaatccggagtcgacgtattctttattccgcctgagaagtgtgacaccttgctgtgtgacattggcgaatcgagcccgaacccaacagtagaggcgggaagaactctccgtgtcctcaatttagttgaaaattggttgaataataacacccagttctgtataaaggtattaaacccatatatgccaagcgtaatcgaaaagatggaggctttgcaacgtaaatacgggggcgcactcgtccgaaacccactcagccgaaactcaacacatgaaatgtactgggttagcaacgcatcggggaacatagtgtcctcagtcaatatgattagccgtatgctaataaacagatttactatgcgtcacaagaaagctacttatgagcctgacgtagacctaggatccggaacaagaaacatcggtatagaatcagagattcctaatttggatatcattggaaaacgtattgagaaaataaagcaagaacatgaaacctcatggcactacgaccaggatcacccatacaaaacgtgggcctatcatggtagctatgaaaccaaacaaactggatctgcatcctctatggttaatggcgtcgttcgattattgaccaaaccatgggacgtccttcccaccgtaacccaaatggcgatgaccgacacaacccccttcggacaacagagggtattcaaagaaaaagtagatacaagaacacaagaaccaaaggagggtacgaagaaacttatgaaaataacagctgagtggctatggaaagagttaggcaaaaagaaaactcctcgtatgtgcacaagagaagagttcacaagaaaagtgagatcaaatgctgcattgggggcaattttcactgacgaaaacaaatggaagtcggcccgtgaagccgtagaggactcgaggttctgggagctagttgataaggaaagaaatctgcacttagaggggaagtgtgaaacatgtgtctacaatatgatgggcaaaagagagaagaaattaggagagtttggtaaagctaaaggaagtcgagcaatatggtacatgtggctaggagctcggtttctcgagtttgaagcactaggattcctgaacgaagatcattggttcagtagggaaaattctctatcaggagtagagggcgaaggtctccataaattaggatatatattacgtgatgtaagcaagaaagaaggtggagccatgtatgctgatgataccgctgggtgggatacacgtataacactagaagaccttaagaacgaagaaatggtaaccaaccacatggaaggcgagcacaagaaacttgcggaagcgatttttaaattgacataccaaaataaagtcgtgcgcgttcagaggccgactccgagaggcacagtaatggacataatatcacgtcgggatcaaagaggtagtggtcaagtgggtacctatggcttaaatacttttactaatatggaagcacaactgatacgacaaatggaaggcgagggagtcttcaaaaacatacagcaccttacggttacagaggaagtagcagtccacaattggctagctcgagtcggacgagaaagactaagcagaatggctatatcgggagatgactgtgtcgtaaaacctcttgatgatcggttcgccaatgccctaacagctctgaatgacatgggaaaaattcgaaaagacatacagcaatgggaaccttcaaaagggtggaatgactggactcaagtaccattctgttcccaccatttccatgaattgataatgaaggatggtagaatcttagtagtcccatgtcggaaccaagatgaattgatagggagagcaagaataagccaaggagcaggttggtcactacgagaaactgcttgcctaggaaaaagctacgcacaaatgtggtccctgatgtactttcatcgtcgtgatttgagactagcagctaacgcaatttgttcagcagtcccaagtcactgggtacccacatcaaggactacgtggagtatacacgcaaaacacgaatggatgacaactgaagacatgctaaccgtttggaatcgggtgtggataagagagaatccctggatggaagacaaaacccctgtggaatcttgggaagagatcccctacttaggtaaaagagaggaccagtggtgtggctctctcataggattaacgagtcgggcaacatgggcgaagaacattcaagcggcaattaatcaagtcaggagtcttatcggtaacgaagaatataccgattatatgccaagtatgaaaagattcagacgagaagaagaagaagccggtgtattatggtaa

SEQ ID NO: 22698 - RNA, 9876 nt, synthetic construct
  misc_feature 1..9876: note = derived and/or modified CDS sequence (opt6) from DENV-2__JF730049__SS-prME
  source 1..9876: mol_type = other RNA
tctgcgggaatgattatcatgctaattccaactgtaatggcattccatttaacaacaaggaatggagaaccacacatgatcgtaggtattcaggaaaaaggaaaatcattactttttaaaacagaagacggagtgaatatgtgtacgttaatggcgatggacttgggtgaactttgcgaagacacgattacgtataaatgtccattactacgtcaaaatgaacctgaagacattgattgttggtgtaattctactagcacttgggtaacttatggaacatgtacaactacaggagaacacagaagagagaaaaggtcagtagccttagtaccacacgtagggatgggacttgaaacacgaactgaaacatggatgtcttccgaaggagcatggaaacatgcacaacgaatagaaacatggatactaaggcatcccggctttacaataatggcagcaattttagcttacacaatcggcacgactcatttccaacgtgtgttaatcttcatactattaacggcagttgcaccaagtatgaccatgcggtgcatcggaatatcaaatcgcgactttgtggaaggtgtttcgggcggatcgtgggtagatatagtattagaacatggatcatgtgttacaactatggctaaaaacaaaccgacgctagacttcgaactaattaaaacagaagcaaaacaacccgcaactttacgaaaatattgtatagaagcaaaattaactaatactactactgaaagtaggtgcccaacccaaggagaaccgtctctaaaagaagaacaggacaaaagattcgtttgtaaacactcgatggtggatagaggttggggaaacggatgcggcctttttggaaaaggcggaattgtgacgtgcgcaatgttcacatgtaagaaaaatatggaaggtaaaattgtacagccagaaaacttagaatacacgatagtagtgacacctcatagtggagaagaacatgttgtcggtaacgacacaggcaaacatgggcaagaaattaaagttacgccacaaagtagtatcactgaagcagaacttacgggatatggcacagtaactatggaatgttcaccgagaacaggtctcgattttaatgaaatggtattgttacaaatggaaaataaagcatggttagtacaccgccaatggttcttagatttaccgctaccatggctacccggagcagataaacaagaatcaaactggatacagaaagaaacgctagtaacgttcaaaaacccacatgctaagaaacaagacgttgttgtgctaggttctcaggaaggagcgatgcacactgcccttaccggggcaactgagatccaaatgtcttctgggaatttactattcactggtcatttaaaatgtagattacgaatggacaaattgcagctgaaaggaatgagctactcaatgtgtacgggaaaattcaaagtagttaaagaaatcgccgagactcaacatggaaccatagtcatacgagttcaatatgagggtgatggatctccttgtaaaattcccttcgaaataatggatttagaaaagcgatatgtacttggacggctgataacagtaaatcccatcgtgactgaaaaggattctcccgttaatatcgaagcggaacctcccttcggtgatagctacataataattggtgtggagccgggacagctaaagctaaattggtttaagaaaggttcgtcaatcggacaaatgtttgaaacaacaatgcggggcgctaaacggatggcaattctaggagatacagcatgggacttcggttctttaggcggagtatttacgtcaattggcaaagcattacatcaagtttttggtgcgatctatggggcagcgtttagcggcgtatcctggactatgaaaatattgattggcgtcataattacgtggatcggaatgaacagtagatctacgagtctcagtgtgtcattggttttagttggtatagtgacattgtatctcggcgtaatggtccaagcagacagcgggtgtgtagtttcctggaaaaacaaggaattgaagtgcggatcaggaatattcatcacagacaacgttcacacatggactgaacaatacaaattccagcctgagtctccatcaaaacttgcatccgctattcagaaagcccaagaagaaggtatatgcggtatacgttctgtgactcgattggaaaatttaatgtggaaacagataaccccggaactaaaccatattctgaccgaaaacgaagtcaaacttacgatcatgactggtgatatcaaaggaataatgcaagcgggaaaaaggagtctaaggccgcagccgactgaattaaaatactcgtggaagacatgggggaaagcaaaaatgtttagtaccgaatcgtacaatcaaacattcttaatagatggaccagagactgctgaatgtccaaatacgaacagagcatggaactctttagaggtagaagattatggctttggtgtatttacgacaaacatttggcttaaacttaaagaaaaacaagacgctttctgtgattccaaacttatgtcggcagcaataaaagataacagagcagttcacgctgatatgggttattggattgaatctgctctaaatgatacatggaaaatagagaaagcgagtttcatagaagtaaagaactgtcactggcctaaatcacacaccctctggtcgaatggagtattagaatccgagatgataatccccaaaaatctagctggtccggtgagccagcacaactatagacctggttatcatacacaaatagctgggccttggcacctaggtaaattagaaatggattttgatttttgtgacggaaccaccgtcatagttaccgaagattgcggaaataggggcccttcgttacgaacaaccacggccagcgggaaactcataacagaatggtgttgtaggagctgcacgctacccccactacgctaccgcggagaagatggctgctggtacgggatggaaatacggccactgaaggagaaagaggaaaacttagtcaatagcttagtaacagcagggcatggtcaagtggacaatttttcactgggggtattaggcatggctctatttttagaagaaatgcttaaaacacgtgtaggaacgaagcacgcaattctcttagtagccgtcagctttgtaactcttattacgggtaacatgagtttcaaagatctaggaagagtagttgtaatggtaggagcgacaatggctgacgacataggcatgggtgtaacgtacctagcattattagcagcattcaaagtaagaccaacatttgccgcaggtcttctactaagaaagttaacatcgaaagaattaatgatgaccacaattggtatagtattgcttagtcaatcaacaataccagaaacagtattggaattgacagatgccttagctctcggcatgatggtactgagaattgttcgtaacatggagaagtatcaattagcagttactataatggcaattctatgtgttcccaatgcggttatcctacaaaatgcctggaaggtttcgtgcactatcttggctgtcgtaagtgtatcgccgttattgctaacgtcttctcaacaaaagacggattggatacctttagccttaacaataaaaggattaaaccctacggctatatttttaactacactctcccggacgaacaagaaaagaagctggccattaaatgaggcaatcatggcagttgggatggttagcatactcgcatcatcacttcttaaaaatgatataccaatgaccggtcctctagtcgcaggaggattactcactgtatgctatgtattaactggtcgcagtgccgatctagaactagagagagcaactgacgtaaaatgggaggatcaggctgaaattagcggcagttcacccattttatccataacgatatcagaagatggcagtatgtcaattaaaaatgaagaagaagaacaaacgctgactatactgataagaacgggtttgcttgtgatctctggattatttccaatctcaattcctattaccgcagcagcgtggtatttatgggaagtgaagaaacagcgtgctggggtgttatgggatgtcccttcaccaccgccaatgggcaaggccgaactagaagacggagcttatagaataaagcaaaaaggaattttagggtactctcagatcggcgcaggcgtatacaaggagggaacttttcatactatgtggcatgttacaagaggcgctgttttgatgcacaaagggaaaagaatagaaccctcctgggccgacgtcaagaaagacctaatatcctatggagggggatggaaactagaaggcgaatggaaagaaggggaagaagtgcaagttctagcgctcgaacctggcaaaaatccaagagcggtgcaaacaaaacccggattgtttaaaaccagtacaggaacaataggggcagtgtcgctagacttttcgcccggtacctcgggttcacctataattgataaaaagggaaaagtagtagggctttacgggaacggagtcgtgactcgttctggtgcatacgtgagcgcaatagcacaaacagagaaaagcatagaagataacccggagattgaagatgatatctttcgcaaacgtaggttaactataatggatcttcatcccggcgcaggtaagacaaaacgatacctgcctgctatcgttcgagaggctataaagcgaggcctacggaccctaattttagcaccgactcgagtcgtggccgcggaaatggaagaggctttaagaggtctacccatccgatatcaaacgcctgccataagagccgaacacactggaagagaaatcgtagatttaatgtgtcatgccacgtttacaatgagactgctttctcctgttcgtgtaccgaactataatttaatcatcatggacgaagcccactttacagatcccgcttctatagctgcgcgcggatacattagtacccgagttgaaatgggagaagcagccggaattttcatgaccgcgacacccccaggatcacgtgacccgtttccccaaagcaatgcgccaataatagacgaagaacgtgaaattccagaaaggtcatggaactcaggacacgagtgggtaacagactttaaagggaaaaccgtttggtttgtacccagcattaaagcagggaatgatatagcggcatgcttgaggaaaaatggcaagaaagtaattcaattaagcagaaagacttttgactccgaatacgtcaagactcgcacaaatgactgggacttcgtagtgactacagatatttcggaaatgggcgctaactttaaggcagaaagggtaatagatccacgccgatgtatgaaaccagtgatactaacagacggtgaagaacgggttatactggcaggtcctatgcctgtgacacactcaagcgctgctcaaagaagggggcgaataggacgaaaccctaaaaatgaaaacgaccaatacatctatatgggagaaccgttagaaaacgatgaggactgtgcacattggaaagaggctaagatgctcttagacaatataaacactccggaagggataatacccagcatgtttgaaccggaaagagaaaaggtagacgcaattgatggagaataccgactgaggggtgaagcaagaaaaacctttgtagatttaatgcgaagaggtgacctccctgtatggctagcatacaaggtagcggcagagggaataaattatgctgatcggcgatggtgtttcgatgggatcaagaacaaccaaatactagaggaaaatgtagaagtcgaaatctggaccaaagaaggagagcgaaagaaactgaaaccgcggtggctggatgcgcgcatttattctgatccactagccctaaaagaatttaaagaatttgccgctggacgaaagagtttaactttaaatttaataaccgaaatggggaggcttccgacatttatgacacaaaagacacgagatgcgctagataatctcgccgtactacatactgcagaagctgggggccgggcttacaaccatgctcttagtgagttaccagaaaccctggaaacgctactactcttgacgctattagctacagttacaggtggtatatttttatttttgatgtcaggacgcggtataggcaaaatgaccttgggaatgtgttgcataataacagcttcaattcttctttggtatgcacaaattcaaccacattggatagcagcatctattatattagagttctttttaattgtattgctcatccccgaaccagaaaaacaaagaacaccacaggacaatcaattgacctatgtagttattgcaatattgacggtagtagctgctaccatggcaaacgaaatgggctttttagagaaaactaagaaagatttaggtctaggatcaattgctacacaacaacccgaatcgaacatacttgatatagacttaagaccagcaagtgcctggacactgtatgcagttgctacgactttcgttactccaatgttacgtcattccatagaaaactcatcggttaatgtgagtttaaccgcaattgctaatcaggcaaccgttttaatgggacttggaaaaggatggcctctcagcaaaatggacataggggtaccgttactagcgataggatgttattcacaagtgaatccgattactctcaccgcggcactgcttctcctggtggcacactatgctattataggaccgggattacaagcaaaagctacacgagaagctcaaaagcgagccgctgcaggcatcatgaagaatccgacagtagacggtattactgtaatagacctggatcctatcccttacgacccgaaatttgaaaagcaactaggtcaggtcatgttactcatactatgtgtaacacaagtgctgatgatgagaaccacttgggctctatgtgaagccctcacacttgctactggaccaatttcaactctatgggaaggaaacccaggaagattttggaacaccactatagcagtaagcatggctaatatattcaggggttcgtatcttgcaggagccggactgttattttcaataatgaagaacacaactaatacacggcggggaacaggaaacatgggcgaaactctaggtgaaaaatggaaaagtcgtttaaatgccttgggcaaaagtgagttccagatttacaaaaagagtggcattcaagaagttgaccggaccttagctaaggaaggcataaaaagaggtgaaactgaccatcatgctgtgtcacgaggttcagcaaaattacgatggttcgtggaaaggaacatggtaacaccagaaggaaaagttgtagatctaggatgcggacggggtggctggtcctattactgtggaggactaaagaatgtacgggaagtaaaagggttaactaaaggaggaccaggtcacgaagaacctattcccatgagtacatacggctggaatctcgtacgcttacaatctggtgttgatgtattctttatacccccagaaaaatgtgatacattattatgcgatataggcgaaagctctcctaaccctacagtcgaagcaggccgaacattaagagtcttaaatttagttgaaaactggctaaacaacaacacccaattctgcattaaagtcctaaatccctatatgcccagtgtaattgaaaagatggaggcattacaaagaaagtatggaggtgcattggtaagaaacccattgagtcgaaattcgacgcatgaaatgtattgggtaagtaacgcatccggaaacatcgtatcatcagtaaatatgataagtcgcatgctcattaatagattcacaatgagacataagaaagctacttatgaaccagatgtagatctaggtagtggcactaggaacataggtattgagtcagaaattccaaacctagatataataggaaagagaatagagaaaataaaacaagaacatgagacttcctggcattacgaccaagaccatccttataaaacatgggcataccacggctcttacgaaactaaacaaaccggaagtgccagctctatggtaaacggggttgtacgccttctaaccaagccgtgggacgtgttgccaactgttactcaaatggctatgacagacacaacaccttttggacagcagcgagtctttaaagagaaagtcgacactaggacacaagaaccgaaggagggtaccaagaagctcatgaaaataaccgcagaatggctctggaaggagctaggtaagaagaaaacacctagaatgtgtacacgagaggaatttacaagaaaggttcgaagcaacgccgcattaggagcgatattcactgatgaaaataagtggaaatcagctcgcgaggctgttgaagacagccgtttctgggaattggtcgacaaagaaaggaacttacatttagaaggaaaatgtgaaacatgtgtatataatatgatggggaagagggagaagaaactaggagagttcggaaaggcaaaaggttcccgggcaatttggtacatgtggttgggtgctagattcttagagttcgaagcacttgggtttcttaacgaggaccactggttttcacgtgagaatagcttatcgggcgtcgaaggcgaaggattacataagttaggctatatattacgtgatgtctctaagaaagaaggtggggcgatgtatgcggatgacacagcaggttgggatacacggataacgttagaggacctcaaaaatgaagaaatggtaacaaatcatatggaaggagagcacaaaaagctcgcagaagcaatattcaaactaacatatcaaaataaagtagtgcgagtgcagcgaccaacaccgcgcggaactgtcatggatataattagtcgtagggaccaaagaggaagtggacaagtgggaacttatggtcttaatacgtttacaaacatggaagcacaacttatacgacaaatggaaggtgagggtgtgttcaagaatatacaacacttaacagtcactgaagaggtagctgtacaaaactggttggctagggtaggtagagagaggttaagtcgaatggcaatctcaggcgacgactgtgtagtaaaacctctggatgatagatttgctaatgcacttacggccttaaacgacatgggaaagatcagaaaggacatccaacagtgggagcctagtaaaggatggaatgattggacacaagtcccattctgttcccatcattttcatgagctaatcatgaaagacggtagagtactcgtagtaccctgtcgcaaccaagatgaattaataggtagagccaggatctcccaaggcgcgggctggtccttgcgagagacagcatgtttaggaaaatcttacgcacaaatgtggtctcttatgtacttccacagaagagacctacgtcttgcagcgaacgctatttgctcagctgtcccgagtcactgggtaccgacatctagaactacatggtcgatacacgctaaacacgagtggatgacaacagaagatatgcttacggtatggaacagagtttggataagagaaaatccatggatggaagataaaacgccggtcgaatcgtgggaagagattccttacctaggaaagagagaggatcaatggtgcggctcattaataggacttacaagtcgtgccacatgggccaaaaatattcaagctgcgatcaaccaagtccgatcgctaattgggatagaagaatacacggactacatgccaagtatgaaaagatttcgaagagaagaagaggaggcgggagtactgtggtag

SEQ ID NO: 22699 - RNA, 9876 nt, synthetic construct
  misc_feature 1..9876: note = derived and/or modified CDS sequence (opt6) from DENV-2__FJ562098__SS-prME
  source 1..9876: mol_type = other RNA
tcagcagggatgattataatgttaatacctaccgtcatggcattccacttaactaccagaaatggagagccacatatgatagttggaatccaggagaaagggaaatcattacttttcaaaactgaggacggagttaatatgtgtacgctcatggctatggatcttggcgaactatgtgaagatacaattacatataaatgtccactgttaaggcaaaacgaaccagaagatattgattgctggtgcaatagcacaagtacatgggtaacatatggcacatgtactacaaccggagagcaccggagggaaaaaagaagcgttgcactcgttccacacgtgggtatgggtctcgaaacgaggacagagacttggatgtccagcgagggcgcttggaaacacgcccaaaggattgagacttggatacttcgacatccagggttcacaatcatggcggcgatattagcgtatactattggtaccacccactttcaaagggttctaatatttatactacttacggccgtagcccctagcatgaccatgcggtgtatcggtattagcaatagagacttcgttgagggtgttagtggtgggagctgggttgatatagtgctcgaacacggatcatgtgttacgacaatggcgaaaaataaaccgactctagactttgaactgattaagaccgaagctaagcagcccgcaactctacgtaaatattgcatagaagcgaaactcacgaatacaacaactgaaagcagatgtccgactcaaggagaaccctccctaaaagaagaacaagacaaacgctttgtatgcaagcattccatggtggacagaggatgggggaatgggtgtggtctatttggaaagggaggtatcgtaacatgtgccatgtttacttgtaaaaaaaatatggaaggaaaaatagtgcaaccggaaaacttagaatatactattgtagtaactccacactcaggagaagagcacgcagtaggaaacgatacgggaaaacacggaaaggagatcaaagttacaccccaaagctcaatcactgaagccgaattaactggatatggaacagtaacgatggaatgtagccctagaacgggccttgacttcaatgagatggtgttattacaaatggaaaataaagcttggttggtacatcggcaatggttcttagatctacccctcccgtggcttccaggagctgataaacaagaatccaattggattcaaaaagaaactttagtaacattcaaaaacccccacgccaagaaacaggatgttgtagttctagggtcacaagagggtgcaatgcataccgcactaacgggagctacagaaatacaaatgtcatctggtaacttactattcactggacatctgaaatgtcggctaagaatggataaactacaactgaaggggatgtcgtactcgatgtgtacgggtaaattcaaggttgttaaagaaattgctgaaacacaacatggtactattgtcattagagtgcagtatgaaggagacggatcgccttgtaaaattccttttgaaattatggatttagaaaagcggtacgtgttgggccgtttgatcacagttaaccccatcgctacagaaaaggacagtccggtaaacattgaagcggaacctccctttggtgactcgtatataataataggtgttgaaccgggtcaactcaaattaaattggttcaaaaaaggctcttcgataggacagatgttcgaaaccacaatgcgaggagccaaaaggatggcaattttgggagacactgcatgggacttcggctctctagggggtgtctttacatctatcggcaaagcactacaccaagtatttggcgcgatttacggagcggcttttagtggagtttcgtggactatgaaaatactaataggagtaataatcacttggattggaatgaacagtcgaagcacatccttaagcgttagtttagtgcttgtggggatagtcactctatatttaggcgtaatggtacaagcggacagtggctgcgtagtatcctggaaaaataaagaactgaagtgtggatcaggaatctttattacagataacgttcatacatggacagaacaatacaaatttcaacctgagtcaccaagcaaattggcatctgcaatccaaaaagcacaggaagagggaatttgtgggatacgtagtgtcacgcggctagaaaatctaatgtggaaacagataactccagaattaaatcatatacttgctgaaaatgaagtaaaattgactataatgacaggtgatatcaagggaattatgcaggcaggaaagagatctctacgaccacagccaatagagcttaaatatagctggaagacgtggggaaaggcgaaaatgctcagtacagaatcacataatcaaacttttctgatagacgggcccgaaaccgcagagtgtccaaacacaaaccgtgcatggaactcacttgaggtagaagactacggtttcggtgtattcactaccaatatctggctccgattaaaggaaaaacaagatgctttttgtgactcgaagttgatgagcgccgcaatcaaggacaacagggcggtacatgctgatatgggatattggatcgaaagcgcactcaatgacacctggaaaattgaaaaagctagttttatagaagtaaagaattgtcactggcccaaatcccatactctctggagcaatggtgttttagaaagtgaaatggtgatacccaaaaatttagcaggcccagttagtcaacacaactataggccaggataccatactcaaatagctggtccttggcatcttggaaaactagagatggattttgacttctgcgacggtactacagtaattgtaacagaagattgcggaaatcgaggaccctcccttagaacaacaacagctagcggtaaactaattactgaatggtgctgcagaagttgcacattacctccattaagatacaggggcgaggatggttgctggtatggaatggaaattaggccgctcaaagagaaggaagaaaacttagtaaactctctagtaacggccggtcatggccaagttgacaattttagtctaggcgttttagggatggcgctatttcttgaggagatgctcagaactcgcgttggtactaagcatgcaattttgctagtcgctgtaagttttgttaccctcataaccggcaatatgtcgtttaaagatcttgggagagtagtagtaatggtgggtgccaccatggcggacgatattggcatgggagtaacatatttggccttactagcagcattcaaggtaagacccacttttgccgcaggcttgttattacgtaaattaacaagtaaggaattaatgatgacgacgataggaatcgtactcctatctcaatcgaccattcccgaaacagttttagagctcactgatgcattggcattaggaatgatggtgctgaaaatagtgagaaatatggaaaaatatcaattagcagtcacaataatggcaatattatgtgttcctaacgctgtaatcctccaaaatgcatggaaggtatcatgcacaattttagcagtagttagtgtctcacctttattactgacctcatcacaacaaaaaactgactggataccacttgcattaacaattaaaggattaaatcccacagctatctttctaaccacactctccagaactaataagaaaagatcttggccactgaacgaggcaatcatggctgtcggtatggtaagtattttagcttctagtttgctaaaaaatgatatacctatgactggaccattagtagcaggaggcctgcttactgtatgttacgttcttactggtcggtcagctgatctagaattagaacgcgctaccgatgttaaatgggaagaccaagccgaaattagtggttcaagtccaatcctatcgattactatatctgaagatggtagtatgtcaataaagaatgaagaagaagaacaaacactaacaatactcatcaggactggactgctagttataagtggcctatttccaatctctatacctataacagcggctgcatggtacttatgggaagtaaaaaaacaaagagccggagtcctctgggacgtacccagtcctccacctatggggaaagccgaattagaagatggtgcctatagaataaaacaaaaaggcatcttaggatactcccaaattggagcaggagtttataaggaaggaacattccacacaatgtggcacgtaacgcgtggagcagtgctaatgcacaaaggtaaaagaatagagccatcttgggctgatgtaaaaaaagacctaattagttatggtggagggtggaaattagaaggagaatggaaagagggtgaagaagttcaggtacttgctttagaacctggaaagaatcctcgtgcagtacagaccaaaccaggacttttcaaaacgaataccggtacaatcggtgcggtatcattagacttttcccccggcacatcaggatccccaataatagataagaaaggaaaagtagtaggattatacgggaatggggttgtgacgcgatccggagcatacgtttctgcgatcgcacaaactgaaaagagcatagaagacaatcctgaaatagaagatgatattttcagaaagaggcgtttgacaataatggacttacaccccggagccggaaaaacaaaaaggtacctcccagcgattgtacgtgaggctattaaaagaggactaaggacgttaatcttagcaccaactagggttgtggcagctgaaatggaggaagcacttagagggttacctatcagataccaaactccagcaatcagagctgaacacacgggaagagaaattgtagatttaatgtgccatgctacttttacaatgcgacttttgtccccggtaagggttcctaattataatcttattatcatggacgaagctcactttaccgatcctgcatcgatagcagctagagggtacatctcgacaagggttgaaatgggagaagcagcggggatattcatgaccgcaacaccacctgggtcacgagatcctttcccacaaagtaatgccccaataattgacgaggaaagagaaattccagaaagatcatggaactctggccatgaatgggtgactgatttcaaaggaaagactgtttggttcgttccttcaataaaagcaggaaatgatatagcagcttgccttcgaaaaaatggtaaaaaagtcatacaactatcccgaaagaccttcgactccgagtatgtaaagacacgaacaaatgattgggattttgtcgttacaacggatatatcagaaatgggggcgaactttaaagctgaacgcgtcatagaccctcgtcgttgcatgaagccagtaatacttactgatggagaagaaagggttatattagcaggaccaatgcctgttactcattcgtcagcagcacaaaggcgaggcaggataggacgcaaccctaagaatgaaaacgatcaatatatttatatgggagaacctctggaaaatgacgaagattgtgcacactggaaggaggcaaaaatgctcttagataacattaatacaccagagggaatcattccaagtatgtttgaaccagaaagagagaaggtagacgccatagacggggaatatagacttaggggggaagcaagaaagacattcgtagacttaatgagaagaggtgatctcccagtatggctggcatataaagtagccgctgagggtataaattacgcggaccggagatggtgtttcgacgggatcaaaaataaccaaatactggaagaaaatgttgaagtggaaatatggaccaaagagggagaaagaaaaaaattaaaaccgcgatggttagatgcgcgcatatattcagaccctttagcgttaaaggaattcaaagaatttgccgcggggcgaaaatcattaacactaaatctcatcaccgagatggggaggttacccactttcatgacacaaaaaacccgtgatgccctagataatttggcggttctgcatactgcagaagcaggaggaagagcttacaatcatgcattatcagagttacccgaaacactagaaactttacttttgctgacgttattagcaacagtgacgggtggaatctttttgtttctaatgtcaggtagagggataggaaaaatgactttggggatgtgctgcataattactgcctccatactgctctggtatgctcagattcaaccgcattggattgcggccagcattatactagagttctttctaatagttttactaatccctgagcccgaaaagcaaagaacaccccaagataaccaattaacatatgtagtgatagccatattgaccgtagttgcggcgactatggccaatgagatgggcttcttagaaaagacaaaaaaagatctaggactgggaagtatagcaacacaacaaccagaatccaatatactcgatatcgatctccgcccggcctcagcatggacgctgtatgcagtagcaactacattcgtaacaccgatgcttagacacagtatagaaaattcatcagtcaacgtatcgttgacagccatcgcgaatcaggcgacagttctaatgggcttaggcaaaggatggcccctctctaaaatggacatcggcgtgcccttgctagccataggctgttattcacaagtaaatcccatcacactaaccgcagctttgcttttacttgttgcccattacgcgataataggtcctggactacaggcgaaggcaacccgggaagcccagaaacgcgctgccgcgggtataatgaagaatccaacggtagatggaatcactgtaattgacttagatcctataccatacgatcccaagttcgagaaacaactcggacaagtaatgttactaatattatgtgtcactcaggtactaatgatgaggacaacatgggctctgtgtgaagcactcactttagccacaggaccgataagcacactgtgggaagggaatccaggacgtttttggaatacaacaatcgccgtatcaatggccaacatatttagaggaagttatctagcgggagcagggctactattctcaataatgaaaaacaccacgaatacacgtagaggaacaggcaatatgggtgagacactgggagaaaaatggaaatcacgattaaacgcgttaggaaaaagtgaatttcagatttacaaaaaatcaggcatacaagaagtcgaccggacgttagcgaaagaggggatcaagagaggggagacagaccaccatgcagttagtaggggaagcgcgaaactaaggtggttcgttgagagaaacatggtcaccccggaaggaaaggttgtagacctgggttgtgggagaggaggttggtcgtactattgcggaggactgaaaaacgtcagagaagtcaaaggcctaactaaaggcggtcctggtcatgaagaacccatacccatgagcacttatggatggaacttagtaagactacaaagcggcgttgacgtcttctttattccacctgaaaaatgcgatactttattgtgcgacataggagaatcctctccaaatcctaccgttgaggcaggacgcacgcttagagtattaaatctcgtggaaaattggttaaacaacaatacacaattttgcatcaaagtcttaaatccatatatgccgagtgtaattgaaaaaatggaagcacttcaaagaaaatatggaggcgcgcttgtccgtaatcccctatcaagaaacagtacacatgaaatgtattgggtatcgaacgctagcggaaatatagtatcttccgtcaacatgatcagtcgcatgttaattaataggtttaccatgaggcataagaaagcgacctatgaacctgatgtagatctaggatcaggaacaagaaacataggtatagaatcagagattccgaacctcgacatcatcggcaaacgaattgaaaagataaaacaagaacacgagaccagctggcattacgatcaagatcacccatacaagacctgggcatatcacggtagttatgaaacaaagcagactggatcagcctcaagcatggtgaacggagtggtaagactgctaaccaaaccttgggatgtactaccaacagttacacaaatggctatgactgacacaactccctttgggcaacagcgcgtctttaaagaaaaagtcgatacaaggacccaggaacctaaagaaggaacaaaaaagctgatgaaaattacggcggagtggctatggaaagaattaggcaaaaaaaaaacccctcgtatgtgcacaagggaagaattcacccgaaaggttagatctaatgcggctttaggtgctatatttacagacgaaaataaatggaagtcggcacgggaagcagtagaagacagtcgcttttgggaactcgtcgataaagaaagaaaccttcatcttgaaggcaagtgtgaaacatgtgtctataacatgatgggaaaacgcgaaaaaaaactgggcgaatttggtaaagcaaaggggtccagagccatctggtatatgtggctaggcgcaagatttttagaatttgaagctttaggatttttaaacgaggatcactggttttcaagggagaacagcctatcaggagtggagggggagggattacacaaactcggctacatcttaagagatgttagcaaaaaagaaggtggcgcaatgtatgcggacgatacagcgggatgggacactaggatcacactagaggatctaaaaaatgaggaaatggtaactaatcatatggaaggagaacataaaaagcttgcagaggcaatcttcaaattaacttaccaaaataaagtggtaagagtacagcgacctactccccgcggtactgtaatggatattatatcgaggagggatcaacgtggttcaggacaagtcggaacgtatgggctaaatacatttactaatatggaggctcaacttattaggcaaatggaaggggagggagtattcaaaaatatacaacatcttacggttacggaggaagtagcagttcagaactggctcgcgagagtcggaagagagagattgagtaggatggctattagcggtgacgattgcgttgtaaaacctttagacgatcgtttcgcgaatgcgttaacagcattaaatgatatgggaaaaatacgaaaagatatacaacagtgggagccttcaaagggttggaacgattggacacaagtcccgttttgctcccatcattttcatgaattaatcatgaaagacggcagagtgctagttgtaccatgtcgaaaccaagatgaactaatcggtagagcaaggattagccaaggtgcggggtggagcttaagagaaacggcatgtcttgggaagagttatgctcaaatgtggagtctaatgtatttccaccgcagggatctccgcttagcagccaacgcgatctgctcagcagttccgtcgcattgggttccgacttccagaactacttggtctatacacgcaaaacatgagtggatgacaacagaagacatgttgacagtctggaaccgagtatggatcagagaaaatccatggatggaggacaaaactcctgtagagagttgggaagaaatcccatacttgggcaaaagagaggaccaatggtgcgggagcctaattggattgactagtcgagccacatgggcaaaaaatatacaggcagcaattaatcaagtcaggtctttgataggtaatgaagagtatactgattacatgcctagcatgaagcgttttagacgagaagaagaagaagccggagttttatggtag

SEQ ID NO: 22700 - RNA, 9876 nt, synthetic construct
  misc_feature 1..9876: note = derived and/or modified CDS sequence (opt6) from DENV-2__FJ859028__SS-prME
  source 1..9876: mol_type = other RNA
agcgcgggtatgattattatgttaatcccaactgtaatggcttttcatttgacaacaagaaatggtgaaccacatatgatagttggtattcaagaaaaaggaaaaagtttgcttttcaaaacggaagacggcgtaaacatgtgtacattgatggcaatggaccttggtgaattgtgtgaagatactataacgtataaatgccctctactacgtcaaaacgaaccagaagacatagactgttggtgtaattcaacatctacctgggtaacatacggtacatgtactactaccggagaacacagaagggaaaaacgaagcgtagctttagttcctcatgtggggatgggtttagaaacccgcacagagacttggatgagctctgaaggtgcatggaaacacgctcaacgcatagaaacctggatacttaggcatccagggttcacgattatggcagcaattttggcgtacacgataggtacgacacacttccaacgtgtgctcatatttatcctactgactgcagtagccccgtcgatgactatgagatgtataggtatctccaatcgcgattttgtagagggtgttagtggaggatcatgggtagacattgtactagaacacgggtcttgtgtaacaacaatggcgaaaaataaacccaccctagactttgaattaataaaaacagaagctaaacaacccgcaaccttacgtaaatattgcatcgaggcaaaattaacaaatactacaacagaatctagatgccccactcaaggagaaccgtcattaaaagaggagcaagataaaaggtttgtatgcaaacattcaatggttgatcgaggttgggggaatggctgtggtctttttggtaaagggggaattgtaacctgcgcaatgttcacttgcaagaaaaatatggaaggaaaaattgttcaaccagagaatctagagtacacgatagtagtcactcctcactcgggagaggagcacgcagttggaaatgatacaggtaaacatggacaagaaattaaagtaacgcctcaatcctctatcactgaagctgaactgacaggatatggtacagtcacaatggaatgctccccacgaacaggcttggatttcaacgagatggtcttactacaaatggaaaacaaagcctggttagtacatagacaatggtttctagacttacctttaccctggctacccggagctgacaaacaagaatcgaattggattcaaaaagagacattggtaacctttaaaaatccacatgccaaaaagcaagatgttgttgtactcggctcacaagaaggagcaatgcacactgcactcacaggcgctaccgaaatccaaatgtcgagcggtaaccttctcttcaccggacatttgaagtgtagactacgaatggacaagttgcaattaaaaggtatgagttatagcatgtgcacgggaaaatttaaggtggtgaaagaaatcgcagaaacgcaacatggcacaattgttattagggtacaatatgagggagatggctcaccatgtaaaataccatttgagataatggatttggagaaaaggtacgtgctcggacgattaattaccgtaaatcccattgttacggagaaagactcgcctgtaaacatagaggccgaacccccattcggagatagctatataattataggcgtagaacccggacaactaaagctgaattggtttaagaaaggtagttcaattggacagatgttcgaaacaacaatgagaggagctaaacggatggcaatattaggagacactgcatgggactttggttcattgggaggagttttcacctcaatcgggaaagcgttacatcaagtctttggggcaatctatggtgctgcattttcgggtgtcagctggactatgaaaatattgattggagtgataattacttggataggaatgaactcccgttctacaagtctatcggtaagtctagtcttggtcggaatagtcacactatatttaggagtcatggtacaggcagatagcgggtgtgttgtatcttggaagaacaaagaattgaaatgcggcagcgggatttttattacagacaacgtacacacatggaccgagcagtacaaattccaacccgagagtcccagtaaattagcgagtgctatccagaaggctcaagaggaaggtatttgcggtatcagaagtgtaacccgactagaaaacctcatgtggaagcaaatcacaccagaactaaaccatatacttgcagagaatgaagtaaaactcacgatcatgactggagatataaaaggtataatgcaagcgggaaaaaggtcacttcgaccacaacccaccgagttaaaatatagctggaagacatggggaaaagcaaagatgttaagtacagagtcatacaatcaaacattcttaatcgacggtcccgagactgcagaatgtccaaacacaaacagagcatggaactctctggaagtggaagattatggatttggggtatttacaacaaacatctggctcaaactgaaggagaaacaagatgctttctgtgattcaaaactaatgtcagcggcaattaaaaataatagagcagtacacgcagatatggggtattggatagagagtgcactaaatgacacatggaaaatagagaaggcttcatttatagaagtgaaaaattgtcactggcctaaatcacacacgctatggtcaaacggagtcctagagtcagaaatgataatacccaaaaatttagcaggcccggtttcgcaacacaattaccggccgggataccatactcaaatagctggaccctggcaccttggaaaattggagatggatttcgatttttgcgacgggaccactgtggttgtaacggaagattgcggtaatcgtggcccatcattgcgaacaaccacagcttcgggaaaattgatcactgaatggtgctgtaggtcatgcaccctaccgccacttaggtaccgtggagaagacggatgttggtatggaatggaaatccgccctttaaaagaaaaggaagagaatttagtaaattcattggtaacagcaggccacggacaagtggataacttttcattgggagtcttaggaatggctttatttctagaagagatgttacgcacgagggtggggaccaagcacgctattctattagtcgccgtatcattcgtaacccttattacaggtaacatgtcgtttaaagaccttggcagggtagttgtcatggttggcgctacaatggccgacgacattggtatgggtgtaacctatctggccctgttagcggcttttaaagtgcgaccaacatttgcagccggtctattacttcgtaaattaacctcaaaagaattaatgatgactactattggtatagtactcctatcccaaagtactatacctgaaacagtattagaactgactgacgctttagccttgggaatgatggtcttaaaaattgttcgaaatatggaaaagtaccaattagctgttacaattatggcaatcctctgcgtgccaaacgcagtaatactgcaaaatgcatggaaagtctcttgcacaatcttagcagttgtgagcgtaagcccacttctattgacatcatcgcaacagaaaacagattggatcccactggcattgacaattaaaggcctaaacccaacggcaatatttttaactacactttccaggaccaataagaaaaggtcgtggcctttgaacgaagctattatggcagtaggaatggtgtccatactagcgagctcgctactaaagaatgacataccaatgaccggtccgctagtggccggcggattacttacggtctgctatgtactaactggaaggtccgcagatctagaacttgaaagagcaaccgacgtaaaatgggaagaccaggcagaaattagtggaagtagccctatattatcaattacaatctcagaagatgggtcaatgagcatcaagaacgaggaagaggagcaaacattaacgatattaataaggaccggacttctagtcatatcaggactattccccataagcatcccaataacggctgcggcttggtatttatgggaagtgaaaaagcagagagctggggtcttatgggatgtcccaagcccaccacctatgggaaaagccgaactagaggacggagcgtatagaataaaacaaaaaggtatattaggatattcacaaataggggccggggtatataaggaagggacgttccatacgatgtggcatgtaactaggggtgccgtgctaatgcacaaaggaaaaaggattgaaccaagctgggccgatgttaagaaagacctaatttcttatggcggagggtggaagctagaaggagagtggaaagaaggtgaagaggttcaggtattagctctagaaccaggtaaaaacccacgagcagtgcaaacgaaaccaggattatttaaaacaaacactgggacgatcggcgctgtttcattagacttttcacccggaacaagtggaagcccaatcattgataagaaaggaaaagttgtcggtctctatggaaatggagtcgtaacaagatcaggagcctacgtctcagcgatagctcaaactgagaaaagtatagaggacaacccagagatagaagatgatatatttaggaaaaggcgtttgactataatggacttacatccgggtgcagggaaaacaaaaagatacctacctgctatagtgagagaagctattaaacgaggtttacgaaccttaatcctggcccctacaagagttgtggcagcagaaatggaagaggcattaagagggctgcctattcgttatcaaacacccgcaataagagctgagcacactggacgggaaattgtagatttgatgtgtcatgccacatttacaatgagacttctatcacctgtaagggtgcccaactacaatctaattattatggatgaagcacacttcacggatcccgcctccattgccgctcgtggctacattagtactcgagtagagatgggtgaagccgcaggcatttttatgaccgctacgccaccaggatcacgtgaccctttccctcaatctaacgcgcctataatcgacgaagaaagagaaataccggaaagaagttggaactcaggacacgaatgggtaacagatttcaagggaaagactgtatggtttgtaccttccataaaagccgggaacgatattgctgcttgcctaaggaaaaatggaaagaaagttatacagttatcaagaaaaacattcgacagcgaatacgtaaaaacaagaactaatgactgggatttcgtagtaactacagatatatcagaaatgggcgcaaattttaaagccgaaagagtaattgatcctcgcagatgtatgaaaccagttattttgactgatggagaagaacgagtgatcctagcaggcccaatgcctgtaactcactctagtgcggcccaaaggcgtggacgtataggaagaaatcctaaaaatgaaaacgatcagtatatatacatgggcgaaccattggaaaatgacgaagactgtgcacattggaaggaagcaaagatgctcttagacaatataaatacacctgaaggaataataccgagtatgttcgagccggaaagggaaaaagtggatgcgatcgatggggaataccgattaaggggagaagctcgaaaaacatttgttgacctaatgcgccgaggagatctgccagtttggttagcttacaaagtcgcagcagaaggaataaactatgcagacagaaggtggtgctttgatggaatcaagaacaaccaaatactggaagaaaacgtggaggtagaaatatggactaaagaaggagaacgaaagaaacttaaacctagatggctagacgcaagaatatactctgatccattggcactaaaggaatttaaagagtttgcagcaggcaggaaatcattaacactgaacttaataaccgagatgggtcgattacctacctttatgacacagaaaacgcgagacgcactagacaacctggcagtattacatacagcggaggcagggggacgggcctataaccatgcgttatcagagttacctgaaaccctcgagacactacttttactcacattacttgccacagtgactggcggtatattcttattcttaatgtcaggaagaggtattggaaaaatgactcttgggatgtgttgtataatcacagcatcaatattattatggtatgcacaaatccaaccgcattggattgcagcatctataattttagagttctttttaatagtactacttataccagaacccgagaaacagcggactccccaagataatcaattaacttacgttgtaattgcaatattgactgtagtagcggctacgatggccaatgaaatgggatttttagaaaagactaagaaagatctgggactcggatctatagctacacaacaacctgaaagtaatatattagatatcgacttaagaccagcaagcgcttggacactttatgctgtagctacaacatttgtaacacctatgctgcggcactcaatagaaaattcaagtgttaatgttagtttaaccgcaatagccaatcaagcgaccgtactaatgggactgggtaaaggatggcccctatccaaaatggacattggcgtcccacttctggctattggatgctattcacaagttaatccgataactttaacagcagcattgttattgctagtggctcattacgcgattattggcccaggcttgcaggctaaggctactagagaggcccagaaaagggctgcggcgggtataatgaaaaatccaaccgtagacggaatcacagtaatagacctcgatccgataccctatgaccccaaatttgagaaacagttaggacaagtgatgctcttaatcctgtgcgtcacacaagttctaatgatgaggaccacatgggcgttatgcgaagcactcacacttgcaactgggccaataagcacattatgggaaggaaaccctggacgcttttggaatacaacaattgcagtatcaatggcaaacatctttcgtggttcatacctcgctggtgcagggcttttattttctataatgaaaaacacaacaaacactcgaaggggaactgggaatatgggagaaacactcggggaaaaatggaagtctcggctcaatgctctcggaaaaagcgaatttcaaatatataagaaaagtggaatacaagaagtagaccgcacattggccaaagaaggaattaagagaggcgaaactgaccaccatgctgtatcaaggggatctgccaaattgcgatggtttgttgaaagaaacatggttactccggaaggcaaagtagtggatctaggttgtggtagaggtggctggtcctattattgcggcgggctcaaaaatgttcgtgaggttaaaggactcacaaaaggaggtcccggccatgaagaacccattccaatgtcaacgtatggatggaatttagtccgcctccaaagcggtgtggatgtatttttcattccgccagaaaagtgtgacacacttttatgcgatataggagaatcatcaccgaacccaaccgtagaagcaggaagaacccttagagtcttgaatcttgttgagaattggctgaacaacaacactcaattctgcataaaagtacttaatccatacatgccctccgtaatagagaaaatggaagcattacagcggaaatacggaggggcactggtacgtaatcctctatcgcgaaactcaacgcatgaaatgtattgggtgtcaaatgcttccggcaatatagtaagctctgttaatatgatatctcgaatgttgataaacagattcaccatgagacataagaaagctacctacgaaccagatgttgacctcggctcagggactagaaacattggaatagagagtgaaattcctaacttggacataattggaaaaagaatagagaaaataaaacaggaacacgaaacgtcatggcattacgatcaggaccacccttataagacgtgggcataccatggatcgtatgagacaaaacaaacaggatcagcatcctcaatggtaaatggagttgtccgactacttacaaaaccttgggatgtcttacctacggttacacaaatggctatgacggacacaacccctttcggacaacagcgtgtttttaaggagaaagtagacacaagaactcaggaaccaaaagaaggcaccaagaaattgatgaaaataacagcagaatggttgtggaaagagctaggaaagaagaaaacgccacgtatgtgtacacgggaagaatttacaaggaaagtccgatctaatgcagcgttaggcgcaatttttaccgatgagaataagtggaaaagtgcacgggaagctgttgaagattcacggttctgggagctcgtcgataaagaaagaaacttgcatctcgaagggaaatgtgaaacatgtgtgtataacatgatgggtaagcgagagaagaaactaggtgagttcggaaaagccaaaggttctcgtgccatatggtatatgtggctcggtgcacgatttcttgagtttgaggcattgggattcctaaacgaggaccattggttcagtagagaaaatagtctttcaggcgttgaaggtgagggtctacacaaactcggttacattctccgagacgtaagcaagaaggaaggtggtgctatgtacgcagatgacacagccgggtgggacacacgtattacattggaagaccttaagaatgaggaaatggtcaccaaccacatggaaggcgaacataagaaactagccgaggcaatattcaaattaacgtatcagaataaagttgttagagtacagcgccctacaccgaggggaactgtaatggacataatcagtcgccgcgaccaacgtggatcagggcaggtaggaacttatgggctgaacacatttacgaacatggaggcacaactcataagacaaatggagggagagggagtgtttaaaaatatacaacacctaaccgtcactgaagaggtggccgttcaaaattggcttgcacgtgttggaagagaaaggttatcccgcatggcaatctcgggagatgattgtgtagtcaaaccacttgatgacagatttgccaatgccctcacagctcttaatgacatggggaaaatccgtaaagacatccaacagtgggaaccgtcaaaaggttggaacgactggactcaggtgcccttctgctctcaccattttcatgaattaattatgaaagatggacgagtacttgttgtcccatgtcgtaatcaagacgagctaattggccgcgctcgcatcagtcagggtgcaggatggtcacttagagaaactgcgtgcttaggcaaatcgtacgcgcaaatgtggtctctgatgtactttcaccgacgagacttgcgtttggccgccaacgcaatttgctctgcagtacccagtcactgggttcccacgtctagaacaacctggtcgatccatgctaaacatgaatggatgacaacggaagacatgttaaccgtatggaatcgagtatggattagagaaaatccctggatggaagacaaaacgcccgttgaatcttgggaagaaatcccataccttggaaaaagagaggaccaatggtgtggtagtctaattggacttacttcaagggcaacatgggccaaaaatatacaagttgcgataaaccaagtaagaagtttaataggaaacgaggagtacactgattacatgccatcaatgaaaaggttcagacgagaagaagaagaagccggtgttctatggtaa

SEQ ID NO: 22701 - RNA, 9876 nt, synthetic construct
  misc_feature 1..9876: note = derived and/or modified CDS sequence (opt6) from DENV-2__FJ410200__SS-prME
  source 1..9876: mol_type = other RNA
tcagccggcatgattattatgctcatccctacggtaatggcctttcacttaacgacaagaaatggagaaccgcatatgatagtaggtatccaagagaagggtaaaagtctattatttaagacagaggatggagtcaatatgtgtacgcttatggctatggatctaggagagctttgtgaagatacgattacttataaatgcccattactgagacaaaacgagccagaggacatagattgctggtgtaattctaccagtacatgggtaacctatggtacatgtacaactactggtgaacacagaagggaaaagagatcagtggcgctggtgccacatgtcggaatggggttggaaacaagaacggaaacatggatgtcatcagaaggtgcttggaaacatgcacaacgcatcgaaacctggattctccgacatcctggatttaccataatggcagctatattagcatatacaataggaacaacacacttccagagggtactcatcttcatcttactaacagcagtagctccatcgatgacaatgagatgtataggtatcagtaatagggatttcgtcgaaggggtttcagggggctcatgggtagacattgttttagagcatggaagttgcgtaacaacaatggcaaaaaataaaccgacgttagacttcgaactaataaaaaccgaagcgaagcaaccagctactctgcggaaatattgtatagaagcaaaactcaccaatacaacaacagagagtcgttgccccacacaaggagaaccttcgttgaaagaagaacaagataaacggtttgtctgtaaacattcaatggttgatcgaggctggggtaacggatgcggattattcggcaaaggtgggatcgtaacatgcgccatgtttacttgcaaaaaaaatatggaagggaaaatagtgcaacctgaaaacttggagtatacaatcgtagttacgcctcactctggtgaggaacacgcggttggtaacgataccgggaaacatgggcaagaaataaaagtaacacctcaaagtagtattacggaagcagaattaacgggttatggaacagtaacaatggagtgctcaccaagaactggcttggatttcaacgaaatggtattactacagatggaaaataaggcatggcttgtacatcgacaatggttcttagacctccccctaccttggttgccgggagcagataaacaggagagtaattggattcaaaaagagacattggttacattcaaaaatcctcatgctaagaaacaggatgtagtggtattaggtagtcaagaaggagcaatgcacactgctcttactggagcaactgagatacaaatgtcgtcgggtaacctattattcactggacatctcaaatgtagattaagaatggacaaattacaactgaaaggtatgtcatactcaatgtgtacgggaaagtttaaggttgttaaggaaatagcggagacgcaacacggtaccatagtgataagagtccaatatgagggagatggttcaccatgtaagataccatttgagattatggaccttgaaaaaagatatgtactcggaagactcattacagtaaaccctattgtgactgaaaaagactcacctgtaaatatagaagcagagccgccatttggagatagttatatcataataggagttgagcccggtcagctaaaattaaactggtttaaaaaaggcagttctatcggacaaatgttcgaaacaacaatgagaggtgcaaaacgaatggccatacttggtgacacggcatgggatttcggaagccttggtggagtatttacgtcaatcgggaaggcattacatcaagtctttggtgcaatttacggggcagcgttctcaggagttagttggacaatgaaaatattgataggagtaattataacatggataggtatgaactcgagaagtacttctctttccgttagcctcgtacttgttgggattgtgaccttatacttgggagtcatggtacaagccgactcaggatgtgtagtgagttggaaaaacaaagaactaaaatgtggatcgggaatattcataactgacaatgttcacacatggaccgaacagtacaaattccaaccagagtcaccctcaaaactggcgtcagcaatccagaaagctcaagaagagggtatatgtggtattcggtcagtaactagactagaaaacttaatgtggaaacaaataacgcccgaacttaaccacatacttgcagagaacgaagtcaaattaacaataatgaccggcgacatcaagggtatcatgcaagcgggtaaaagatccctacgaccgcagcctactgagcttaaatattcatggaaaacatggggtaaggcgaaaatgctcagcacagaaagttataaccaaacatttttgattgatgggcctgaaacagccgagtgtcctaacactaatagggcctggaactcgctcgaagttgaagactatggatttggagtctttactacgaatatatggctaaaattaaaagagaagcaagacgcgttttgtgatagtaaattaatgagtgctgcaatcaaggataacagagccgtccatgcggacatggggtactggattgaatcggcattaaatgatacatggaaaatagagaaagcgagttttatcgaagttaaaaactgtcactggcccaaatcccacactctttggtctaatggagtattggaatcagagatgataattcccaaaaatttggcaggtcctgtctcccagcacaactatagacctggatatcatactcaaatagctgggccctggcatctaggaaagctagaaatggacttcaacttttgtgacggtaccaccgtaatagtaacagaagattgcgggaatcgcggcccgtcattgaggactacaaccgcatctggtaaacttataacggaatggtgttgtagaagttgcacacttccgcctctacgatacagaggagaggacggttgttggtacggaatggaaatacgacctctaaaggaaaaggaagaaaatctcgtgaattccctagttactgccggacatgggcaggtcgataacttttcacttggtgttctaggaatggcccttttccttgaagagatgttacgaacacgagtcggaaccaaacatgcaatactattagttgctgtttcatttgtcactttaataaccggaaatatgtcatttaaggatctaggaagagtagttgtaatggttggtgccacgatgactgacgacattggtatgggtgtgacatatttagcattactagcagcgttcaaggttcgtccgaccttcgcggcgggtttgttactgagaaaattaacatctaaagagttgatgatgacaactataggaatagtactcttaagtcaatcaacaatacctgaaacagtcttggagcttacggatgcattggcattaggaatgatggtcttgaagatagtccgtaatatggaaaagtatcagttagccgttacaatcatggctatcttatgtgtgcccaacgcagtaatattacagaatgcgtggaaagttagttgcacaatcttagctgtcgtctcagtttcgccattattacttacatcatctcagcagaaaacagattggatccccctagctctaacaataaaaggattaaatcctactgcaatttttctcacaaccctgtcaagaactaacaagaagagatcatggcccctaaatgaggccatcatggctgtagggatggttagtatcctcgcatcttcattacttaagaatgatatacccatgaccggcccgttagttgcaggaggcttattaacagtctgttacgtattaaccggaagatctgctgatcttgaattagagagggcgactgatgttaaatgggaggaccaagcagaaatatcgggctctagtcctatcctcagtattacgatttcggaggatggaagtatgtcaattaaaaatgaagaagaagaacaaactcttaccattctaataaggacggggctcctagtaatatcaggcctgtttccgattagtatccctattacggctgctgcttggtacctatgggaagtaaaaaaacagagagcaggtgtcttatgggatgttcccagtccacctcctatgggtaaagctgaactagaagatggggcatatcgcattaaacagaaaggaatcctaggatattcacaaatcggggcaggcgtatataaagaaggtactttccacactatgtggcacgttacaagaggggccgtacttatgcacaaaggaaagagaatcgaaccaagttgggcggatgtgaagaaagaccttatttcatacggcggaggatggaaactagaaggcgagtggaaagaaggggaagaagttcaagtcctagcgctagagccaggcaaaaacccacgagcagttcaaaccaagcccggtctattcaaaacaaataccggtactataggagcggtatctttagacttttcaccaggtacgtctggttcacccattattgataaaaagggcaaagtagtgggtctgtatggtaatggagtggtcacacggtctggagcatacgtgtcggctatagcgcagactgaaaagtctatcgaaaataacccggaaatagaagatgatatattccggaaaagaagattaaccattatggatctgcatccgggagctggcaaaacgaaaagatatctcccggcaattgtaagagaagcgattaaacgaggattaagaacactaatcctagcacctacaagagttgtagccgctgaaatggaagaagcattacgaggactaccgatacgatatcaaacccccgcgatcagggcagaacacacaggtagggaaatcgtagatctcatgtgtcatgcaacatttacaatgcgactactatcgccagtaagagtaccaaactataatcttatcatcatggatgaagctcactttactgacccggcatcgattgctgctagaggatacatatctactcgagtagaaatgggcgaagcagcaggcattttcatgacagctacaccaccggggagtagagatccatttccacaatcgaatgctccaattatagacgaagaacgagaaatacccgaacgtagctggaattcaggacatgaatgggtaactgactttaaaggtaaaacggtgtggtttgtgccatctataaaggctggaaatgatattgccgcatgtctaagaaaaaacgggaaaaaagtgatccagctctcccgaaaaacatttgactcggaatatgttaagacaaggaccaacgattgggattttgtagtcaccacagacataagcgaaatgggagcaaacttcaaagcggaaagagttatagatccgagacgttgtatgaaaccggtcattttaacggatggagaagaaagagtaattttagcaggtcccatgcccgttacgcattcatcagcagcccaacgcaggggtagaattggacgaaacccaaaaaatgaaaacgaccaatacatatatatgggagaacctctagaaaatgacgaggactgcgctcactggaaagaggcgaaaatgctacttgacaacataaatacacctgagggcataatccccagcatgttcgaaccagaaagggagaaagttgacgcaattgatggtgaataccgacttaggggtgaggctagaaaaacgtttgtcgacttaatgcgacggggtgatctcccagtttggctagcttataaagtagcagcagaaggaatcaactatgccgatcggcgttggtgttttgatggcataaaaaataaccaaattcttgaggaaaacatggaagtagaaatctggacaaaagaaggggaacggaaaaaactaaagcccagatggcttgatgcacggatatactccgatccattggcattaaaagaattcaaagaatttgcagcaggtcgaaagtccttaacattgaatctaattacagagatgggtagattaccaacgttcatgacacaaaaaacaagagatgcccttgacaacttagcagtactccacaccgcagaagcaggagggagggcatacaaccacgcactaagcgaattaccagaaactcttgaaactttacttttactgacattattagccacagtcactggaggcatattcttattccttatgtctggcaggggaattggaaagatgaccctagggatgtgttgcatcattacagcttctattctcttgtggtatgcgcaaatacagccacactggatagcggcatctataatactagaattctttcttatagtcttgctaataccagaaccagagaagcagcgcacgccacaagacaatcaactgacgtatgtagtgattgcgatactaacggtggtagcagcaacaatggctaacgaaatgggttttttagaaaaaacgaaaaaagacctgggcttgggcagtattgcaacaagacaaccggaatcgaatatcttagatatagacttacggccggcgagtgcatggacactttacgcagtagccacaacgtttgtaacaccaatgttacgacattccatagaaaactcaagtgtaaatgttagtctaacagcaatagcaaatcaggctactgtgctgatgggactgggaaaaggttggcctttatcaaaaatggacatcggtgtacctctactggcaataggatgttatagccaagttaatcctatcacgttaactgccgccttattgcttctggtagcccattacgctatcatcggacccgggttacaagccaaagctaccagagaagctcaaaagagggcagccgcgggaataatgaagaacccgacagttgacggaataaccgttatcgacctagatcccataccttacgatccaaaattcgaaaagcaactaggtcaagttatgttactagtgctatgtgtaacacaggtacttatgatgcgcacgacatgggctctttgtgaagctctaacattagccaccggtccgatatcgacattatgggaaggaaatcctggtagattttggaacacaaccatagccgtaagtatggcaaatattttccgcggttcatatttagccggtgcaggactactatttagtatcatgaaaaatacgacgaataccagaaggggcacaggaaacatgggagaaacgcttggcgaaaaatggaagtcaagattaaacgccctcggcaaatctgagtttcagatctacaaaaaatcaggtattcaagaagtagacagaaccctagcgaaagaaggaatcaaaagaggagaaacagaccaccacgccgtttcccgaggatcggctaaacttcgatggtttgttgaacgaaacatggttacgcccgaaggcaaagtggtcgatctaggatgtggccgtggaggttggagttactattgtggaggtctgaaaaacgtgcgagaagtaaagggactaaccaaaggcggtcccggccatgaagagcctattccaatgtccacgtacggctggaatctcgtaagactacaaagcggggtcgatgtctttttcatccctccagagaaatgtgacacgctgttatgtgacataggggaaagcagccctaatccgactgttgaagctggaaggaccctgagggtactgaatctagtcgaaaattggttaaataacaacacacagttttgtattaaagttctaaacccttatatgccaagcgtaattgaaaaaatggaggccttacaaagaaagtacggcggcgcgcttgtaagaaacccattatcaagaaactcaacccatgaaatgtattgggtaagcaacgcctccggtaacatcgtttcgtcggtgaacatgatctctaggatgttaattaatagatttactatgaggcacaaaaaagctacatatgagccggatgtagatctaggaagcggaactcggaacataggaatagagtcagagataccaaacttagacattattggtaaaaggatagaaaaaattaaacaggaacatgagacttcatggcattatgaccaggatcacccctacaaaacatgggcatatcacggtagctacgaaactaaacaaactggctcagcttcatcaatggtaaatggtgtcgtgcgactattaactaaaccatgggacgttctaccaactgttacacaaatggcaatgaccgatacgaccccattcgggcaacaaagagtgtttaaggaaaaagtagatacccgaacccaagaacccaaagaagggacgaaaaaattaatgaaaatcactgcagaatggctatggaaggaactagggaaaaaaaaaactcctagaagatgtacaagagaagagtttacaagaaaagtacgtagtaacgccgctttgggagcaatatttacagatgaaaataaatggaaaagtgctagagaagcagtagaggacagccgcttttgggaattagtggataaagaaagaaatttgcatttagaaggtaaatgtgaaacatgcgtctataatatgatgggcaaacgggaaaaaaaattaggggaatttggcaaagcaaaaggtagcagagcaatatggtatatgtggttaggtgcgcgctttctagaatttgaagcgttgggatttctcaatgaggaccactggttctcgagagaaaattctctatcaggagtagaaggggagggtttacacaagttaggatatattttgcgtgatgtttcaaaaaaagaaggaggagcaatgtatgctgatgacacagccggatgggatacccgtataacacttgaagatttaaaaaacgaagaaatggtaacaaatcatatggaaggcgaacacaaaaagttagcggaagcaatattcaaattaacatatcaaaacaaagttgttagggtacagagacctaccccaaggggaacagtcatggatattatatcccgaagggatcaacgtggctctggacaagttggaacatacggattgaacacgtttactaacatggaagcacagctcattcggcaaatggaaggtgagggagttttcaaaaacattcaacatctgactgtaaccgaagaggtagccgttaaaaattggctcgctagagtggggagagaacgtttaagtagaatggccatttccggggatgattgtgttgtaaaacctttggacgaccgattcgctaatgctttaactgctttaaacgacatggggaaaatacgcaaagatatacaacaatgggagccaagcaaaggttggaatgattggacgcaggtccctttctgtagccaccattttcatgaattgatcatgaaagacggtcgagtacttgtcgtgccgtgcagaaatcaagatgaattaataggcagagcccgcatctcacaaggagctggatggagtctccgagaaactgcctgtctaggcaaaagctatgcacagatgtggagcctcatgtattttcatagacgtgatcttaggctagcagcaaacgccatttgcagcgcagtgcctagccattgggtacccacatccagaactacttggagtatacacgccaagcacgaatggatgacaactgaagacatgttgactgtttggaatagagtttggataagagagaacccatggatggaagacaagacccccgtcgaatcatgggaggaaataccctacctaggtaaacgagaagatcagtggtgtgggtcattaatcgggttaacttcgagagccacatgggccaaaaacatacaagccgcgattaaccaagtccgctcactgataggaaatgaagaatataccgactacatgccaagcatgaaaaggttcagacgagaagaggaagaggcaggcgtgttgtggtaa

SEQ ID NO: 22702 - RNA, 9876 nt, synthetic construct
  misc_feature 1..9876: note = derived and/or modified CDS sequence (opt6) from DENV-2__FJ410202__SS-prME
  source 1..9876: mol_type = other RNA
agcgcaggcatgataattatgttaattcccaccgtaatggcattccacctcactacgagaaatggtgaaccacatatgatagtaggaatacaagaaaaaggaaagagcttacttttcaaaaccgaagatggcgtcaatatgtgtacattaatggcaatggatttaggagaattatgtgaagacacaataacgtataaatgtcccttacttcgccaaaatgaaccagaagatatcgactgttggtgtaactcaacgagcacgtgggttacctacggaacatgtacaacgacaggtgaacaccgccgggaaaaacgctcagtagcgttagttccacatgtaggcatgggattagaaacacggactgaaacctggatgtcatcagaaggagcttggaaacatgctcaaagaattgaaacctggatcttgagacaccccggattcactatcatggcggcaatactggcttacactattggaacaactcactttcaacgagttctaattttcatacttcttactgcagtcgccccttcaatgacaatgcgctgcatcggaattagtaacagagactttgttgaaggtgtctcaggtgggagttgggtagatatagtactcgaacacggcagttgtgttactacaatggccaaaaataaaccgacattggattttgaactcattaaaacagaggccaaacagccagccacactaagaaaatattgcattgaagcaaaattaactaacacgacaactgaatcacgttgtccaactcagggcgaacccagcttaaaagaagaacaggataaacgctttgtatgtaaacactcaatggttgatcgtggatgggggaacggatgcggattattcgggaaaggaggaattgtaacgtgcgctatgtttacctgtaagaaaaatatggaaggaaaaatagttcagcctgagaatttggaatatactattgtcgtaacaccacattccggtgaagaacatgcggttggtaatgataccgggaaacacggcaaagaaattaaagttaccccgcagagttccattactgaggcagagttgaccggttatggtacagtaacgatggagtgtagtccaagaacgggcctcgattttaatgaaatggtgttattacaaatggaaaacaaagcgtggctagtacatcgtcaatggttcctagatttgccattaccctggctaccaggtgcagataaacaagaaagtaactggatccaaaaagaaaccctagtcaccttcaaaaatccacatgccaagaaacaagacgtcgtagtcctcggctcacaagaaggtgcgatgcatactgcgctaacaggagctactgaaatccaaatgtcatcaggtaacctcctatttacaggacacttgaagtgccgtctgcgtatggataagttacaattaaaaggcatgtcctattctatgtgtacagggaagttcaaggtagtcaaagaaatagcagaaacacaacacggcactatagtaatacgtgttcagtacgaaggagacggatctccatgtaaaattccatttgaaattatggacttagaaaaacgctacgttcttggcagactaataacggtaaacccaatagtcactgaaaaggactccccggttaatatagaagcggagcctccattcggcgacagttacatcataataggtgtcgaacctgggcaactcaaattgaactggtttaagaaaggatcatcgattggacaaatgtttgaaacgacaatgagaggcgccaagagaatggcaatccttggagacacagcatgggactttggaagtttgggaggagtgtttacgagtgtaggaaaggcacttcaccaggttttcggagctatctatggtgctgccttttccggagtcagttggacaatgaagatcctcatcggtgtgattataacatggatcggtatgaacagtaggagtacgtcactgtccgtttccttagttttagtaggcatagtaacgttatatctaggtgtaatggtacaggcagattccggctgtgtcgtctcgtggaaaaacaaagagttaaaatgcggctcaggcatctttatcacggacaacgtccatacttggactgaacaatacaaattccaacctgagagtccttctaagttggcatcagcaatacagaaggcccaagaagaaggaatttgtggaatccgtagtgttacccgcctggaaaatcttatgtggaaacaaattacccccgaactgaatcatattctggccgaaaatgaagtaaaattaaccataatgacaggcgatatcaaaggaattatgcaagcaggcaaacgaagtctaagaccacaacccacagaattaaagtatagctggaaaacgtggggaaaagcgaagatgctttctacagagtcttacaaccagactttcctcatcgacggtcccgagacagctgaatgtccgaacactaatagagcttggaatagcttagaagttgaagattatggatttggggtttttacaacaaacatttggttaaagctcaaagaaaaacaagatgcattttgtgactccaagttgatgtcagcagctattaaggacaaccgggcagtacatgctgatatgggatattggattgaatcagcattgaatgatacttggaagatcgaaaaagctagtttcatagaggtaaagaattgtcattggccaaagtcgcatactctttggtcgaatggagtattagagtcagagatgataattcccaaaaatcttgcaggacccgtttcccaacataattatcgtccgggttaccacactcaaatagccggaccatggcatttgggaaagttagaaatggactttgatttctgcgatggaaccaccgtaatcgtcaccgaagattgcggtaaccgagggcccagcttgaggaccaccaccgcgtcaggtaaattgatcactgagtggtgttgccgtagttgtacgctgccacccctgagatatcgaggtgaagatggatgttggtatggaatggagattagaccactgaaggaaaaagaagaaaatttagtaaactcattagttacagctggacatggacaggtagataatttttcactaggagtcttaggaatggccctctttctagaagaaatgcttcggaccagggtaggcacaaaacacgccatattattagtagcagtgtcatttgttacattaattacaggtaatatgtcatttaaagaccttggaagagtagtagttatggttggtgcgacgatggcagacgacattggtatgggagtaacgtatctagcactattggcagcattcaaagtaagaccgactttcgccgcaggattactcttaagaaaactaacttccaaagaactgatgatgacaacgattggaatcgtcttgctatcacaatcaacaatacctgaaacagtattagaattgactgatgcgctggctctaggaatgatggtgctaaaaatagtaagaaacatggaaaagtatcaacttgccgtaacaattatggccatcttgtgcgttcccaacgccgtcattctgcagaatgcttggaaagtgtcctgtaccattttagctgttgtatcggtttcacctcttttactaacgtcaagccaacagaaaacggactggataccacttgctcttacgattaaagggttaaatcccactgcaatatttcttacaaccctatcacgcacaaacaagaaaagaagttggccgctgaacgaggccataatggctgtcggcatggtgagtatacttgcatctagtttattgaaaaacgatatacccatgacaggtccattagtggcaggagggctacttactgtatgctatgtgctaacaggacgctcagcagatctagaactagaaagggctactgatgttaagtgggaagaccaagcagagatttcaggatcttcaccaattctgtcgataacgatttcagaggacggttcaatgtctatcaaaaatgaagaggaagaacagactttgacaatcttaataagaacaggtcttctcgtaatatcgggtctctttccgatatcaataccaataacggctgcagcctggtatttatgggaggtaaagaaacaacgagccggcgttttatgggatgtgccttcaccaccaccaatggggaaagccgaattggaggacggcgcttataggataaaacagaaaggtatattagggtatagtcaaataggggcaggcgtttataaagaaggcacttttcacaccatgtggcatgtaacaaggggagcagttctaatgcacaagggtaaacgaatagaaccatcatgggccgacgtcaagaaagacctaatctcgtatggcggagggtggaaactagagggtgagtggaaggagggagaagaagttcaggttttggcactagagccgggtaagaatccacgtgcagtacaaacaaaacccggcttatttaaaactaacacaggcacaataggggcagtgagtctcgattttagccccggcacatcaggcagcccaattatcgacaaaaagggaaaagttgtgggcctttatggcaatggtgtagtgacaagatcaggtgcctatgtatcggctatcgcacaaacagagaagtcaattgaagacaatcctgaaattgaagacgatatatttaggaaaagacgattaacgattatggatctgcacccgggagcaggaaaaactaaacgatatcttccggcaatagtccgagaagcaataaaaagaggattaagaactcttatactcgcgccaaccagggtggtcgcagccgaaatggaagaagcattgcgaggacttccaataagatatcaaacacccgcgattcgggccgaacacactggacgagaaatcgtagatcttatgtgtcacgccacatttaccatgcgcttactatcaccggtcagagtccctaattacaaccttataattatggatgaagctcattttacagacccagcttccatcgcagcgcgaggatacatttccactcgagttgaaatgggcgaggcagcaggcatctttatgacagcaacacccccaggtagtcgggaccctttcccacagagtaacgcacctataatagatgaggaacgggaaattccagagagatcatggaatagcggacatgagtgggtcacagattttaaaggtaagacagtatggtttgtccctagcatcaaggctggaaatgacatcgccgcttgcttaaggaaaaacggaaagaaagtaatccagctatctcgtaaaacctttgattcagaatacgttaagaccaggacaaatgactgggattttgttgtaacaactgatatatcagagatgggcgccaatttcaaagctgaacgagttattgacccaaggagatgcatgaaacccgtaatacttacagacggcgaagaaagagtaatcctggcaggacccatgcctgttactcattcaagtgctgcccagagaagaggtagaatagggcggaatcccaaaaacgaaaatgaccaatacatctatatgggcgagccgttggagaatgatgaagattgtgcacattggaaagaagcaaaaatgctattagacaatattaatacacccgaagggattatcccaagcatgtttgaaccggaaagagaaaaagtggatgcaattgacggagaatacagattacgaggtgaggcacgaaaaactttcgtagatttgatgcgacgaggtgatttaccagtttggttagcatataaagtagcagcagaagggataaactatgccgacagaagatggtgttttgatggtatcaaaaataaccaaattctggaggaaaatgttgaggtggaggtatggacaaaagaaggcgaaaggaagaaacttaaaccacgatggctagatgcaaggatctattcggacccgttggcactaaaagaatttaaggaatttgctgctggaagaaagagcttaacattgaatctaataacagaaatgggacgattgcccacattcatgacacagaaaactagagacgcactagacaatttagcagtcttacacactgcagaggtcggaggcagagcatataatcacgcattatcagagttacctgaaacactagagactctccttcttctaacgcttttagctacggtaacaggtgggatatttttattcttaatgtcaggacgaggaataggtaaaatgacactggggatgtgttgtattataacggctagtattcttttatggtatgcacaaatacagccgcactggatagcagcgtcaatcatactagagttctttctaattgttttattgattccagaaccggaaaaacaacgaacgcctcaagataatcagctaacatatgttgtgattgcgatattaaccgtagtagcagcaaccatggcaaatgagatgggatttctagagaaaacaaagaaggatctaggattaggttcgatagcgacacaacaacctgaatctaatatactggatatagatttaagacccgctagcgcttggaccctctatgcagtagcaacgacatttgtcacccctatgcttcgacattccatcgagaactcaagcgttaatgtgtcactaaccgctattgcaaatcaagcgaccgtactaatgggattgggaaaaggttggcctctttcaaaaatggatataggtgtcccattacttgcaataggatgttattcacaagttaacccaattacattaacagctgcattattactattagttgcgcactatgccatcataggaccaggattacaagcaaaagcaacaagagaggcccagaaacgcgccgcagcaggaatcatgaaaaatccaaccgtcgacgggataacagtaatagatctagatccaatcccgtacgaccctaagtttgaaaaacaattaggacaagttatgttactcattttgtgcgtcacccaagttctgatgatgcgaactacctgggctctttgcgaggctttaaccttagcaaccggtccgatcagcaccctctgggaaggaaatccaggacgtttctggaataccaccatagcagtatctatggcaaacatctttagaggtagttatttggctggtgccggattattattttctattatgaaaaacacaacaaatacgagacgaggaactggaaacatgggagaaacccttggagaaaaatggaaaagcaggctaaatgctcttgggaaatctgaatttcagatatacaaacggtcaggaatacaggaagtcgatagaactctcgcgaaagaaggcattaaaaggggagaaacagatcatcatgcggtatcaaggggttcagccaagttaaggtggtttgtagaacggaatatggtaactccggaagggaaggttgttgatttgggatgcggcagaggcggatggagctattattgtggtggccttaaaaacgtacgcgaagtaaagggactaactaaaggaggcccaggacatgaagaaccgatacctatgtctacctacggatggaaccttgttcggttacagagcggtgtagatgttttcttcataccaccagaaaaatgcgatacattactatgcgacataggtgaatctagtccgaacccaacggttgaagctgggagaacactccgagtactcaacctagtagaaaattggcttaacaataacactcagttttgtataaaagttcttaatccttatatgccatcggttatagaaaagatggaggcactacagaggaagtatggtggagcgctggtaaggaaccctctatcccgaaacagtacacatgaaatgtattgggtaagcaatgcctccggtaacattgtaagttcagttaacatgataagtcggatgttaatcaatagatttacgatgagacataagaaagctacttatgaacctgatgtagacttaggttcgggaacaagaaatataggtatcgagtctgaaatccccaatctagacattattggaaaaagaattgagaaaataaaacaagaacatgaaacaagctggcattatgaccaagaccacccttataaaacatgggcataccacgggtcatacgaaacaaagcaaacaggatctgcctcctcaatggtaaacggtgtggtccggctgctaaccaaaccctgggatgtcctaccaacggtaacacagatggcaatgacggatactactcctttcggacaacagagagtattcaaggagaaagtagatactcggacccaagagcctaaggagggcacaaagaaattaatgaaaattactgccgagtggctatggaaagaactaggcaaaaagaaaacaccaagaatgtgtacaagggaagagttcacccgaaaagtgagaagtaatgcagcactcggcgcgatatttactgacgaaaataaatggaaatcagctagagaagccgttgaagattctcgtttctgggaattggtagataaggaaaggaacctgcacctagaaggaaaatgtgagacatgcgtgtataacatgatgggtaaacgggagaagaaactcggtgaatttggcaaagcaaaagggagtagagcgatctggtacatgtggttaggagctcgctttttagaatttgaggctttggggttcttgaatgaagatcactggttcagtcgggagaactctctatctggagtggagggtgaaggactccataaattgggttatattttaagagatgtttcgaagaaagaagggggagccatgtacgctgacgacaccgcaggatgggacacacggataacacttgaagatttgaaaaatgaggaaatggtcaccaaccatatggagggagagcataagaaactggcagaagctatctttaaactaacctaccaaaataaagttgtaagagtacagcgccccacaccgcgaggtactgtaatggacattatatctcgcagagaccaaagaggctcaggacaagttggaacgtatggactaaatacgttcacgaatatggaggcgcaattgatcagacaaatggaaggagaaggagtttttaaaaacattcagcatttaacagtgactgaggaagtagctgttcaaaattggctagcacgcgtaggcagagaacgattatcacgtatggcgataagcggggacgactgcgtggttaaacccctagatgatcgattcgcaaacgccctaacagctctcaacgacatgggaaaaatccgcaaagacattcaacaatgggaacctagcaaaggatggaatgactggacgcaggtaccattttgtagtcatcattttcacgaactaattatgaaagatggaagagtacttgtagttccgtgccgaaatcaggatgagttgataggacgagctagaatcagccaaggggctggttggagcctccgagaaaccgcatgtttaggaaaatcttacgctcaaatgtggagcttaatgtactttcacagaagggatttacggcttgcagctaacgcgatatgtagtgcagtaccttcgcactgggtcccgacgtctcgtacgacttggtcaatccacgcgaaacacgaatggatgacaacagaagatatgttgacagtctggaacagagtttggataagagaaaatccctggatggaagataagacaccagtagaatcctgggaagaaatcccttacttaggtaaaagagaagatcagtggtgtggatcattaataggcttaacatcccgagctacgtgggcaaagaacattcaagcagcaatcaaccaagtaagatccctcattgggaatgaagagtacatcgactatatgccttcaatgaaacgattccgacgagaagaggaagaagcgggtgtcctgtggtaa

SEQ ID NO: 22703 - RNA, 9876 nt, synthetic construct
  misc_feature 1..9876: note = derived and/or modified CDS sequence (opt6) from DENV-2__FJ410208__SS-prME
  source 1..9876: mol_type = other RNA
agcgctgggatgataataatgttaataccaacagtaatggcattccacttaactactcgtaacggtgaaccccacatgattgtaggaatacaagaaaaaggaaaaagtctattattcaaaacagaagatggagttaacatgtgtacacttatggcaatggacctcggagaactctgtgaagacacaattacgtataaatgtcccctactaagacaaaacgaaccagaagacattgattgctggtgtaatagcacatctacatgggtaacatacgggacatgtaccacaaccggagaacacagaagagaaaaacgatcggttgctctagtgccacatgtaggtatgggactagaaacaaggaccgaaacatggatgtcaagcgaaggagcatggaaacacgcacagcgcatcgaaacctggatactaagacaccctgggttcacaataatggcagcaatactggcttatacaatcggaacaactcacttccagagagttcttatatttattttacttaccgcagtagctcccagcatgacaatgagatgtataggaatatctaacagagactttgtagaaggagtatcaggaggcagctgggtagacatagtattggagcatgggagctgtgtaacgacgatggccaaaaataaaccaactctcgactttgaactcatcaaaacagaggccaaacaacccgcgacattacgaaaatactgtatagaagcaaaactgaccaatacaactacagaaagccgatgtccaacgcagggagaacccagtctaaaagaggaacaagataaaaggtttgtgtgcaaacacagcatggtagacagagggtggggcaacggttgtgggttgtttggaaaaggaggaattgttacgtgtgctatgtttacctgcaagaaaaacatggagggaaaaattgtacaaccagaaaacctggagtacacgatagtagtaacaccacatagtggtgaagaacacgcagttggaaatgacacagggaaacatggacaagaaattaaagttaccccacaatcaagtatcacagaagctgaacttacaggatacggtacagtaacaatggagtgctcaccccgaactggattggactttaatgaaatggtattgttgcagatggagaataaagcctggctagttcaccgacaatggttcttagatctacccctgccatggcttccaggtgcagacaaacaagaatcgaattggatacagaaagaaactctagtaacattcaaaaatccccacgcgaagaaacaagatgtagttgtattaggaagtcaagaaggcgcaatgcatacggctttaacaggcgcgacagaaatacaaatgagtagtggaaatttactctttacaggccatctgaaatgccgcctgaggatggacaaattgcaactaaaaggtatgtcatactctatgtgtactggcaaatttaaagtagtaaaagaaatagcggaaacgcaacacggaacaattgttattagagtgcaatacgaaggcgatgggagcccttgtaaaataccctttgagataatggacctagagaaacgttacgtattaggtcgcttaataacggttaatcctatagtaaccgaaaaagattcaccggttaatatagaagcagaaccacctttcggagattcctacataataattggggtagaaccagggcaacttaaactaaattggttcaagaaaggttcatcaataggacaaatgttcgaaacaacaatgagaggtgcgaaaagaatggctatactcggcgatacggcctgggacttcgggagcctagggggagtgtttacatcaattggtaaagcattacaccaagtttttggagctatctatggagcagcatttagtggggtaagttggacaatgaaaatattaataggggtaatcatcacatggatagggatgaactcccgatctacatctctcagcgtttccctagttctagtaggtatcgttactttatatctcggagtaatggtccaggctgacagcggttgcgtcgtatcttggaaaaataaagaactaaaatgcggtagtggaatatttatcaccgacaacgttcatacttggacagaacaatacaaattccaacctgaatcaccaagtaaattggcaagcgccatacaaaaagctcaggaagaaggaatatgcggaataagatctgtaacacgactggagaatttgatgtggaaacaaataacgccggaacttaaccatattctagctgaaaatgaggtcaaattaacaataatgactggagatatcaaaggaatcatgcaggcaggaaaaaggagcttgaggcctcagccgacagaattgaaatatagttggaaaacttggggaaaagctaaaatgttatcaactgaatcatacaaccaaacgttcttaattgatggcccagagacagcagaatgtcctaacacgaatagggcttggaactcgctagaagtagaagattacggattcggggtattcacaaccaatatctggctcaaactaaaagaaaaacaggatgcgttttgtgacagtaaactaatgagcgcagctataaaggacaaccgagccgttcacgcagacatgggctactggatcgagtctgccctaaacgacacctggaagatagaaaaggcttctttcatagaagtcaaaaattgccactggcctaaaagtcatacattatggtcgaatggtgtactggagtcagaaatgattatacctaagaacctcgcaggaccagtaagtcaacataactacagaccgggatatcacactcagattgctggtccatggcatttaggaaaactcgaaatggattttaacttctgcgacggtacgaccgttatagttactgaagactgcggaaatcgaggtccatctttacgaacaactacagcgagtggaaaactaataactgagtggtgttgcagatcttgcacacttccccctctacgctaccgtggagaggatggctgttggtacggaatggaaataaggcctttgaaggaaaaggaagaaaatttggttaactcacttgtcactgcaggtcatggacaagtggacaatttcagtctaggagtcctcgggatggcattattccttgaagaaatgttgaggaccagagtaggaactaaacatgcaatattattagtagccgtatcctttgtaacgctcatcacaggaaatatgagttttaaagacctcggtcgtgtcgtagtaatggtgggcgctaccatgactgatgatattgggatgggtgtcacgtatttagccctcctcgcggctttcaaagtgaggccgacattcgctgctggcctccttctgagaaaacttaccagtaaagaactaatgatgacgacaattggcattgtattactatcccaatcgacaataccggagaccgttttagaactaactgatgcgctcgctctaggtatgatggtcttaaaaatagtgcgaaatatggaaaaataccaacttgcagttacaataatggccatactatgcgtaccgaatgctgtgatattgcaaaacgcatggaaagtttcgtgtactatattagcagttgtcagcgtaagccctctactattgactagctctcaacagaaaacagactggataccgcttgcccttaccataaaaggattaaaccctaccgcgatatttttgaccaccttgagtagaacaaataagaaacggtcctggccactgaatgaggctattatggctgtaggtatggtctccatattggctagttcgctactcaaaaatgacatacccatgactggacccttagtggccggcggtctacttacagtctgttacgttcttaccggacgttcggcggatctagaactcgaacgtgcaacagatgtaaaatgggaggaccaagctgaaataagcggttcatcaccgatactaagtattacgatctcagaagacggtagtatgagtatcaaaaacgaagaggaagaacaaaccttaacaattctcatacggacaggactactcgtaatttcaggattatttccaattagcataccgattacggcagcagcttggtacctttgggaagtcaagaaacaacgagctggcgtactctgggatgttcccagtccacctccaatgggcaaggctgaactcgaagacggagcgtacaggataaaacaaaagggcatcttgggatactcccaaataggagctggagtctataaagaaggaacatttcacacaatgtggcatgtaacacgcggcgcagtcttaatgcataagggaaagcgaatagaaccaagttgggcagatgtcaagaaagatttaatctcatacgggggaggatggaaacttgaaggtgaatggaaggaaggagaagaagtccaagttttggccttagaaccgggaaagaatccccgggccgtgcaaacaaaaccaggactgttcaaaaccaacacgggaactattggagctgttagtctagacttctcaccaggaacatcgggaagccctatcattgataagaaaggaaaagtagtaggtctttacggtaacggagttgtaacacgatctggggcgtacgtatcggcgatagcacaaactgaaaaatctatagaagataacccagaaatagaggatgacatattccgtaaaagaagattgaccattatggatcttcaccctggggcaggtaaaacaaaacgctaccttccggcaatcgtcagagaagccattaaaagaggactcaggaccttaattttagctcctacacgggttgtcgccgccgaaatggaggaagccctgagaggtttgccaattcgctatcagacaccagcgatacgagctgaacatacgggtagggaaattgttgatctcatgtgccacgccactttcactatgagactgctcagtccagtacgtgtaccaaattacaatcttataataatggacgaagctcacttcacagaccctgcgtccatagcggcccgtggatacattagtacccgggttgaaatgggcgaagctgccggcatttttatgacagcaacgccgcctggttccagagatccgttccctcaaagtaatgccccaattattgatgaagaacgagaaatacctgaaagatcgtggaactcaggacacgagtgggtaactgattttaaaggaaaaacagtctggtttgtgccatcgataaaagcgggcaatgatatagccgcttgtttacgaaagaatggaaagaaagtgatacagttatcaagaaagacgttcgattcggaatatgtaaaaacaagaacaaatgactgggacttcgttgttacgactgacatttcagaaatgggggcaaattttaaagcagaacgtgtaattgaccctcgacgatgtatgaagccagttatattaacagacggggaggagcgtgtaatacttgcagggcccatgccagttacgcatagctcggcagctcaaaggcgaggaagaatcggacggaatcccaagaacgaaaacgaccaatacatctatatgggtgaaccactagaaaatgacgaagactgtgcacactggaaagaagcgaaaatgttacttgataatatcaatactcctgagggaataattccatccatgttcgagcctgaacgagaaaaagtagatgccatagacggagagtacaggttacgaggtgaagcacgtaaaacctttgtagacctaatgcgaagaggagacttacctgtctggctagcctacaaggtagccgcagaaggcataaactatgctgacagacgttggtgttttgacggaataaagaacaatcaaatcctcgaagagaatatggaagtcgaaatatggacaaaagaaggagaacggaagaaactgaaaccacgttggttagatgcccgaatatacagtgacccactggctttaaaagaatttaaggaatttgcagccggtcgtaaatcattgacactaaaccttattactgaaatgggcaggctcccaacttttatgacccagaaaacacgcgatgcgttagataacctcgctgtactgcatacagcagaagctggtggccgggcatataatcacgcactgtctgaactaccagaaactttagagacattactactgctcacactccttgccacagtaacaggcggaatattcctttttctaatgtccggaaggggaattggaaagatgaccctcggtatgtgctgtataataactgctagcattctattatggtatgctcaaattcaaccacactggatagcagcatcgatcatactagagttctttcttatagttctcttaattccggaaccggaaaaacaacgtactcctcaagacaatcaactaacttacgtagtgatcgctatactcactgtagtagcagctacaatggctaatgaaatgggattcttggagaagacaaagaaggatctagggcttgggtcaatagcaacaagacaacctgagagtaatatacttgatattgatctcagaccagcgtccgcatggaccctttatgccgttgctacaacattcgttacccctatgttgcggcattcaattgaaaattcatccgtaaacgtttcactcacagcaattgccaaccaggcaacagtgttaatgggcctcggaaaaggttggcccttgagcaaaatggacataggagtcccattgctagccataggatgctacagtcaagtaaatccaataaccctaacggccgcgctattgttgcttgtagctcactatgcaataattgggccggggctccaagcaaaggctactcgtgaagcacagaaaagagcagccgcaggcataatgaagaacccaacggtcgatggtatcactgttattgacctagatccaataccttatgatcccaagtttgaaaagcaactaggtcaagtaatgctactcgtcctatgcgtaacacaagtgctaatgatgcgaacgacatgggcgctttgtgaagcattgacattagcgaccggacccatatctacgctttgggagggcaaccctgggagattctggaacacaacgatagcagtgtcaatggctaatatatttagaggtagttacctagcaggagctggactcttattctccattatgaagaatactactaatactagacgaggtacgggcaacatgatagaaactttgggagagaagtggaaatcaaggctcaatgcacttggtaaatccgaatttcaaatttacaaaaagtctggcatacaagaagtagatagaacactggctaaagaaggcataaaaagaggtgaaacggatcatcacgctgttagtcgcggttctgctaaactgcgatggttcgtcgaaaggaatatggtgactccagaaggaaaagtagtagatcttggctgcggaagaggcggctggagttactactgcggaggtctcaaaaatgtaagagaagtaaaagggctaaccaaaggaggaccaggacatgaggaaccaataccgatgagcacatatggatggaatctagtgcgtttacagtcaggagtggacgttttcttcataccacccgaaaagtgcgatacattgttatgtgacattggagaaagctcaccaaaccctacagttgaagctggtcgaacgttacgcgtcttaaacttagtagaaaactggctgaataacaacacacaattttgtatcaaggtactaaacccatatatgccatcagttatagagaaaatggaggctctacaacgcaaatacggcggtgcactcgtaagaaacccactatctagaaattccacgcacgagatgtattgggtttcaaatgcaagtggaaacatagtaagttcagtaaatatgattagtagaatgctaattaaccgatttactatgcgacataaaaaggcaacatacgaaccagatgtagacctaggatcaggaactcgaaacataggtatcgaaagtgaaatccccaacctggatataataggaaaaaggattgaaaagattaaacaggaacacgagacatcatggcactacgaccaagatcacccatataaaacatgggcataccatggaagttatgagacgaaacaaacaggaagcgcatcatcgatggtcaacggggtagttaggctcctcaccaagccatgggacgtactaccaacagtaacacagatggcaatgaccgatactacgccattcggacagcagcgggtcttcaaagaaaaagtagacacaaggacacaggaacccaaagagggaacgaaaaagctcatgaaaataaccgcagagtggttatggaaagaattaggtaagaagaaaacaccgcggatgtgtactagagaagaatttacccgcaaggtacgaagtaatgcagcattgggcgcaatcttcacagatgagaataaatggaaaagcgctagagaggcagtagaggacagtaggttctgggagctggtcgataaagaacgaaatctacatttagaagggaaatgcgaaacttgcgtatataatatgatgggaaaacgggagaagaaactaggtgaatttggtaaagctaaaggtagccgagcaatatggtacatgtggctaggagcaagatttttggaatttgaagcgttgggtttcctgaatgaagatcattggttttcccgtgagaactccctaagcggcgtagaaggcgaaggtctgcataagttaggatatatattgagagatgtaagcaagaaagaaggaggtgcaatgtacgctgacgatactgctggttgggatacacgaataaccttagaggatctcaaaaacgaagaaatggttaccaatcatatggaaggtgagcataagaaactagctgaagccattttcaagctaacgtaccaaaacaaagtagttcgggtgcagagacctactccgaggggaactgtaatggacatcatcagtcgaagagaccaaagaggatccggccaggtaggaacatatggacttaacacgttcaccaacatggaagcacaactgattcgacaaatggaaggtgaaggggtattcaaaaacatacaacacttaacggttacagaagaagtagctgtcaaaaactggttagcgagggtgggaagagaacgcctatcgaggatggccataagtggggatgattgtgttgtaaaacctttggatgatcgttttgctaacgcattgactgcactaaatgacatgggaaagataagaaaagacatccaacagtgggaaccaagtaaaggatggaatgattggacccaagtacctttctgtagccaccatttccatgaattgataatgaaagatggacgtgtactcgtcgtcccatgtagaaaccaggatgaattgattggtagggcacgaataagtcaaggcgcggggtggtccttaagagagacagcatgtctaggtaaaagctatgcccaaatgtggagtttaatgtattttcataggcgcgacttaaggttagctgcaaacgcaatatgttcagctgttccctcacattgggtaccaacatccaggacaacatggtcgatccacgcgaaacacgaatggatgaccacggaagatatgttaacagtatggaatagggtatggatacgagaaaatccgtggatggaagataaaacacctgttgagtcttgggaagaaatcccatacttaggtaagcgtgaagatcaatggtgcggatctttgattggattaacctctagagctacatgggccaaaaatatacaggcagcaattaaccaagtaagatcattaattggcaacgaagaatatactgactatatgccatcgatgaagcgatttagacgtgaagaggaagaagctggagtattatggtaa

SEQ ID NO: 22704 - RNA, 9876 nt, synthetic construct
  misc_feature 1..9876: note = derived and/or modified CDS sequence (opt6) from DENV-2__FJ461305__SS-prME
  source 1..9876: mol_type = other RNA
tccgctggaatgataattatgctaatcccaaccgtcatggcttttcatttaactacacgcaacggcgaaccacatatgatcgtcggaatccaggagaaaggcaaaagtttgttattcaagacagaagatggcgtcaatatgtgtacattaatggccatggacctaggtgaactttgtgaagatacaataacctacaaatgtccattgctacgtcaaaacgaacccgaggacatagactgttggtgcaactctacaagtacttgggtgacttatggaacatgtacaacgacgggagagcacagacgtgagaaacgaagcgtagctcttgttccacatgtaggtatgggattggaaaccagaacggaaacatggatgtcaagtgaaggcgcgtggaagcatgctcaaagaatagaaacttggatcctacgtcaccctgggtttaccatcatggcagcaattctagcttacacaattggaacaacccactttcaaagagtattgatatttatattactcacggccgtagctccatccatgactatgaggtgtataggaatatccaacagggatttcgtggaaggtgtaagtggcggaagctgggttgacatagttttagagcatggaagctgtgtaacaactatggctaaaaataaaccaacattggactttgagttaattaaaactgaagcaaaacaaccggcaacactacggaaatattgtatcgaagctaaattaactaataccacaacggaatcaagatgtcctactcagggagaaccttctttgaaagaggaacaagataaacggtttgtatgcaagcatagtatggtagatagggggtggggaaacggatgtggattgtttgggaaaggtggtatagtgacttgtgcaatgttcacatgtaagaagaacatggaaggaaagatcgtccaaccggaaaatttggaatacaccatagtagtaacgccccattcgggtgaggagcacgctgtaggcaatgatacgggtaagcatggtcaagagataaaagtaacaccacaaagttcaattacagaagcggaattaactggttacggcactgtaacgatggaatgtagtccacgtacaggattagactttaacgaaatggtactattacagatggaaaataaagcttggctggttcatcggcagtggttcctggacttaccgcttccctggttacccggagccgataaacaagagagcaactggatccaaaaagaaacgttggttacatttaaaaatccacacgccaaaaaacaggacgtagtggtattgggatcccaagagggcgcaatgcatacagcactaacaggagcaactgaaatacaaatgtccagtggcaacttattatttacgggccacttaaagtgtagattacgtatggacaaacttcagttaaagggaatgtcttattcaatgtgtacaggaaaattcaaagttgtcaaagagattgctgagacacaacatggtactattgttatccgggttcaatatgaaggcgatggatcgccctgcaaaatcccatttgaaattatggacctagagaaaaggtatgtactaggaagactgattacggtaaaccccattgtaacagaaaaagactcaccggtaaatatagaagcagagccaccatttggagactcgtatataattataggtgttgagccaggtcaactgaagctcaattggtttaaaaaggggtcatctataggacaaatgttcgagaccactatgagaggggccaaacgtatggcaatattaggagacactgcgtgggatttcggaagtctcggaggagtttttacatcaattggaaaagcactacatcaggtatttggtgccatttatggagctgcattctccggtgtaagttggacaatgaagatattaatcggagtgataatcacctggatcgggatgaatagtcggagcacgtccctgagcgtgtcacttgtcttggtcggtatcgtaacactgtacttaggtgttatggtacaagcagattcgggatgtgtggtgagttggaagaacaaggaactaaaatgcggttccgggatatttataactgataatgtccacacctggactgaacaatataagttccaaccggagtccccatctaaattagcttcagccatacaaaaagcacaagaagaaggtatatgcggaataagaagcgtaacgcggttagagaatttaatgtggaaacaaattacgccggagctcaatcatatattagccgaaaatgaagtcaaactgacaataatgacaggagatatcaagggtataatgcaagcaggaaagagatctttaaggccacaacctacggaattaaagtattcatggaaaacgtggggtaaagctaaaatgctgtcaacagaatcttataaccaaacattcctaatagatggacctgaaacagctgaatgtccaaacactaatagagcatggaattcgctagaagttgaggactatggttttggagtattcaccaccaatatatggttgaaacttaaagaaaaacaagatgcattttgtgactctaaactaatgagcgcagcgattaaggataatcgagctgtacatgcagacatgggatactggatagaatcggcacttaatgatacctggaaaatagaaaaggctagttttatagaagtaaagaactgccactggcccaaatcccatacgttatggtcgaacggggtgctagaaagcgagatgattattcccaaaaatctagcgggccccgtcagtcagcataactatcgtccaggctaccacacacaaatcgccggaccgtggcatttgggaaaattagagatggactttgacttttgcgacggcactacagtcatagttacagaagactgtgggaatagagggccttcattacggactactactgcctcaggcaaactaattacagagtggtgctgtagatcatgtaccttaccgccacttcgatatagaggagaggacggatgttggtatggaatggaaataagaccgcttaaagaaaaagaagagaatttagtcaacagtctggttactgcagggcatggacaaatagacaacttcagtttgggcgtcttaggcatggcactgtttttagaggaaatgttaaaaactagggtaggcaccaaacacgccattctgctggtggccgtatcttttgtaacacttatcacaggcaatatgagttttaaagatctaggtagggtagtggtcatggttggtgcgacaatggcagatgacataggaatgggcgtgacttatctagcgctactagccgcctttaaggtaagaccaacatttgcagctggtcttttactaaggaaattaacatcaaaagaattaatgatgacaactatcggaatagtattactaagtcaaagcacaattccagaaacagtcctggaattaacagatgctttggcattagggatgatggtgctcaagatagtaaggaacatggagaaatatcaactggcagtgacgatcatggcaatactgtgtgttcctaacgccgttatactccaaaacgcatggaaagtgagttgcactatactcgcagttgtaagcgtttccccgttgttgcttacaagttcccaacaaaaaactgattggatacccttagctctgacaataaagggacttaatccaacagcgatattcctaaccactctaagtagaacgaataagaagagatcatggcctcttaatgaagcgataatggctgtaggcatggttagtatactcgcatctagtctattaaaaaatgatatccctatgacgggacctctagttgcgggcggattactcacagtatgttatgtattgacgggaagaagtgccgacttggaactagaacgcgcaactgatgtcaaatgggaagatcaagctgaaatatcgggatcaagtcctatactcagtataactataagtgaagatggttcaatgtcaatcaaaaacgaggaagaagaacaaactttgacaatacttattcgaaccggattacttgtaatcagcggactatttccaataagtatccctatcaccgcggcggcatggtacctctgggaagttaaaaaacaaagagctggggttctctgggatgtacctagcccaccgcccatgggcaaagccgagttagaggatggagcctatcgaattaaacagaaaggtatcctaggttattcacaaataggtgcaggagtctataaagaagggacattccacacgatgtggcatgtaacgagaggagcagttctcatgcataaagggaagcggattgagccctcatgggcggacgtaaaaaaagatcttatttcatacggaggaggatggaagcttgagggggaatggaaggaaggagaagaagttcaagtcctagctctagaaccaggtaaaaatccaagggctgtgcagacaaaacctggtctattcaagactaataccggaacaataggtgccgtgagtctagatttctcaccagggacttcaggatcaccaataatcgacaaaaaggggaaagtcgtaggattgtacgggaatggggtagttacgagatctggagcttatgtaagtgcaatcgctcaaaccgaaaaatcgattgaagacaatccagagatcgaggacgatattttcagaaaaagacgtttaacaattatggacttacaccctggagccggaaaaactaaaagatacttaccagcgatagtaagagaagcgattaagagaggactaagaacgctaattctagctccaacccgtgttgtagccgcagagatggaagaagcgcttagaggattacccatacggtatcaaacaccagctatacgtgctgagcatacagggcgcgagatagtagatctcatgtgccacgcaacattcacaatgcgtttattatcgccagtacgtgttccaaactacaacttgataatcatggacgaagcacactttaccgaccctgcatcaatcgccgcaaggggttatataagtactcgtgtagaaatgggggaagcagctggaatattcatgactgcaactcccccgggctcgagggacccatttcctcaaagtaatgccccgattattgatgaagaaagagagattccagaaagaagctggaactctggacatgaatgggtcactgactttaaggggaagacagtatggtttgtaccaagtataaaggcaggtaacgatattgcggcatgtttaagaaaaaacggcaagaaggttatacaattgagtagaaaaacatttgactcagaatatgtaaaaaccagaaccaacgattgggactttgttgtaactacagacatttctgaaatgggcgcaaatttcaaggcagaacgggttatagacccacgacgttgtatgaaacccgtaattttaactgatggtgaagaaagagtaattctagctggaccaatgccagtcacacattcctcagctgcacaaagaaggggacggattggtagaaatccaaagaatgaaaatgatcaatacatttacatgggtgaacccctggaaaatgacgaagactgcgcccactggaaagaagcaaagatgctccttgacaatataaatacacccgaagggataattccctcaatgtttgaaccagaaagggagaaggtcgacgcgatcgatggagaatatagattgagaggcgaagcacgaaagacatttgtagacttaatgcgacggggtgacctacctgtctggttagcgtataaggttgctgcagaggggataaattacgctgatagaaggtggtgttttgatggaattaagaacaatcaaattcttgaggaaaatgtggaagtagaaatatggacaaaagagggagagaggaagaaactaaaaccaagatggttagatgctcgaatatactcagaccctcttgcattaaaagagttcaaagagtttgcagctggaagaaaaagtctaactcttaatctaataaccgaaatgggaaggctgccaacgtttatgacgcaaaaaacacgggacgccctagataacctagcagtacttcataccgcagaagcgggtggtcgagcatacaatcatgctctctctgaactacctgaaacgctagagacattgttattacttacgctactagcgacggtgacaggaggcatttttttattcttaatgtcggggcgaggaataggcaaaatgacccttggcatgtgctgtataataactgctagcattctgttgtggtatgcacaaattcaacctcattggatcgcagcaagcataatactcgagttttttctaatagtcctgttaataccagagccagaaaagcaaagaactccgcaggataaccaattgacatatgtcgttatagcaatcttaacagttgtagcggccactatggcaaacgagatgggctttctagaaaaaaccaagaaagatttaggtctggggagcatagctacacaacaaccggagtcgaacatcctggatatcgacttaagaccagcctcagcatggacattatatgcagtagcgaccacattcgtgacacccatgttgagacactctattgaaaattcctctgtgaatgtaagcctaacagcgattgccaatcaagccactgtactaatgggcttaggaaaagggtggccactttcaaaaatggatatcggagtacctttattagccataggatgctacagtcaagtaaatccaatcactttaactgcggcactcttgttactagttgcacattatgcaattataggtcctgggctacaggcaaaagcaaccagggaagctcagaaacgtgctgcagcgggaataatgaagaacccgacggtagacggtattacagtcattgacctggatccaataccatacgatcctaagttcgaaaaacaattaggccaagtaatgctattaatactatgtgtgacacaagtgctaatgatgaggactacatgggcactgtgtgaggcactcacattggcaacaggacctataagtacgctttgggagggtaatcctggtagattttggaatacaactatagcagtgagcatggcaaatatctttaggggatcatatttggctggcgctggtctactattttcgattatgaagaacaccacaaatacaagaaggggtactggtaatatgggggagactctaggtgagaaatggaaatctaggcttaacgcactaggcaaatcggaattccagatctataaaaaatcaggtatccaagaagtagaccgcaccttagcaaaagagggaataaagagaggagaaacagatcatcatgcagtgagccgcgggtccgctaaattgaggtggttcgtagaaagaaacatggtaacaccagaaggtaaagtcgttgatttgggatgtggaaggggggggtggagctactactgcggaggattaaaaaatgtacgagaagtaaaaggattaacaaaagggggtccggggcatgaagaacccatcccaatgtccacttatggatggaacttggttcgcctccaaagcggcgtcgacgtcttctttatcccaccagaaaagtgcgacacccttctctgtgacataggagaatcatctcctaacccaactgttgaagcgggtagaacactgagagtgcttaaccttgtagaaaactggctaaacaataatacacagttttgcattaaagttctgaatccctacatgcccagtgtgattgaaaaaatggaggcactacaaaggaaatacggaggagctctcgttagaaatcccctaagcaggaattcaacccatgagatgtactgggtgtctaacgcttcgggaaacatagtatctagtgtaaacatgataagccggatgctaataaatcgttttaccatgagacataagagggctacctacgagccagatgtagacctaggctccggaacaagaaacattgggatagaatctgaaattccaaatttggatattataggaaagcgaatcgagaaaataaaacaagagcacgaaacgtcatggcattatgatcaagaccatccttacaaaacatgggcatatcatggctcctacgaaacaaaacaaacaggctcggcatcttcaatggtaaacggcgtagtacgactgttgacgaagccgtgggatgtgctaccaaccgtgacacaaatggcaatgacagatacgactccttttggtcaacagagagtttttaaagagaaagttgatacgagaacgcaagagccaaaagaaggaacaaagaagctcatgaaaatcacagccgaatggttatggaaagagttaggaaaaaagaaaactccaagaatgtgcacaagggaagaattcaccagaaaagtccggtctaatgctgcacttggagccatattcacagatgaaaacaaatggaaatccgcacgcgaagcagtcgaagactcaaggttctgggagttagtcgataaggaaagaaacttacatttagaagggaaatgtgagacatgcgtatataacatgatgggtaaacgggaaaaaaaattaggggaattcggaaaggcaaaggggagcagagcgatttggtatatgtggctaggtgcaagattccttgagtttgaagcattagggtttctcaatgaagaccactggttttcgcgagaaaacagtttgtcaggagtcgaaggagaaggattgcataaacttggatatatacttcgtgacgttagcaagaaagaaggaggcgctatgtacgcggacgataccgccggatgggacaccaggattaccctcgaagatttaaagaatgaggagatggttacaaaccatatggagggggagcacaaaaaacttgctgaggcaatttttaaattgacctaccagaataaggtggtaagggttcaaaggccaaccccgcgtggcactgtcatggacattatctccagacgagatcaaagaggatctggacaagttgggacatatggattgaacacatttacaaacatggaagcacagctaataagacaaatggaaggtgaaggagtattcaaaaatatccaacatttaacagtaacagaggaagttgcagtccaaaattggttggcccgtgttggtagagaaagactatcgaggatggcaatttcaggtgatgattgtgtagtaaagcccctagatgatagatttgcaaacgcattaacagcactaaacgatatgggaaaaatcaggaaggatattcaacaatgggaaccttcgaaaggttggaatgattggactcaggtaccattttgttctcatcactttcatgaacttatcatgaaagatgggagagtccttgtagttccatgtagaaatcaagatgaacttataggaagggcgcgaatcagccaaggggctggttggtcactgagagaaaccgcatgcctgggtaaaagctacgcacaaatgtggtctttaatgtattttcatagaagggatctacgattggccgccaatgccatttgttcggcggtaccatcccattgggtgccgacaagcaggacgacttggagcatacacgcaaagcatgaatggatgaccacggaagacatgttaaccgtttggaacagagtatggataagagaaaacccgtggatggaagacaaaacgccagtagaatcatgggaagagataccatacttaggtaaaagagaggatcagtggtgcggcagtttgattggattaacatccagggcaacctgggcaaaaaatatccaagcagcaataaaccaagtacgtagtctgattgggaatgaagaatatacagactatatgccaagtatgaaacggttccgacgagaggaggaagaagccggcgtactatggtag

SEQ ID NO: 22705 - RNA, 9876 nt, synthetic construct
  misc_feature 1..9876: note = derived and/or modified CDS sequence (opt6) from DENV-2__FJ410215__SS-prME
  source 1..9876: mol_type = other RNA
tcagcaggtatgataattatgttaattccgacagtaatggcatttcatttaacaaccagaaacggagaacctcacatgatcgttggtatacaagagaaaggaaaatccttactcttcaaaactgaggatggtgttaatatgtgtacgctcatggcaatggacttgggagaactatgtgaagatacgattacatacaaatgcccattacttcgtcaaaacgaaccagaagacatagactgttggtgcaactcaacttcaacatgggtaacctatggaacctgtactacgacaggagaacacagaagagagaaaagatcagtcgcgttggttccacacgtaggcatgggacttgaaactcgtactgaaacttggatgtccagtgaaggtgcttggaaacacgcacaacgaatagaaacttggatcctaagacatcccggttttaccattatggctgcaatactcgcatatactatcggaacaacgcatttccaacgcgtgttaattttcatattgctgacggcagtagcaccgtcaatgacaatgagatgtattggaatttctaatagagatttcgttgaaggggtaagtggagggtcctgggtagacatcgttctagaacatgggtcatgtgtcacaactatggcgaaaaataaacccactttggactttgaacttataaaaacagaggcaaaacaaccagcaactctgcgtaaatattgtatagaggctaaactaacaaatactacaacagaatcacgttgcccaacacaaggtgagccatcattaaaagaagaacaagataaacgttttgtatgtaaacactccatggtggaccgggggtgggggaatggatgcggactctttggaaaaggaggcattgtaacgtgcgccatgttcacttgtaagaaaaatatggagggaaaaatagttcaaccagaaaatttagaatacactatcgtcgtaacaccccatagtggagaagaacacgccgtaggaaatgatactgggaaacatggaaaagaaataaaagtgactccacaatctagtattacagaagcggaactgacaggttacggcacggtaactatggaatgttcacccagaactgggttagacttcaatgaaatggttttactacagatggagaataaagcctggctagttcatcgccaatggtttctggatctacccctaccatggctgccaggagcagacaaacaagagtcaaattggatccagaaagagactctagttacgtttaaaaatccacatgccaagaaacaagatgtcgtcgtacttggaagccaagaaggagcaatgcacactgcactaaccggcgctacggaaattcagatgtcatctgggaacctgttatttacaggacatctaaaatgcagactacgcatggacaaactacagctaaaagggatgagctattcaatgtgtactggaaaatttaaagtcgtcaaagagatcgcggagacgcaacatggaaccatagtcataagagtccaatacgagggtgacggctcaccatgcaaaataccttttgaaattatggatctcgagaaacgctatgtactcggaaggttaattacggtcaatcctatcgtaaccgaaaaagatagtcctgtaaatatcgaagcagaaccaccttttggcgactcatatattattataggagtcgaaccagggcaattaaaattgaattggtttaaaaagggttcgtccatcggacagatgtttgaaacaactatgcgaggcgcaaaacggatggcgattttaggtgataccgcgtgggatttcggttcactaggaggtgtctttacttcaatcggcaaggcattacaccaggtattcggagctatatatggtgcggcattcagcggggtaagttggactatgaaaatactaataggagtaatcattacctggattggaatgaatagcaggtcaacctctctaagtgtatcgcttgttttggtaggtatcgttacgctatatctaggcgtaatggttcaagcagactccggatgtgttgtgtcctggaaaaataaagaactaaaatgcgggtctggaatatttataactgataatgtgcatacctggacggaacaatataaatttcaacctgaatcacctagtaaattggcatcagcgatacaaaaagcacaggaagaagggatttgtggaataaggagcgtgactcgtttggagaaccttatgtggaagcaaataactccagaactcaatcacattttagcggagaacgaagtaaaacttacaatcatgacaggagatataaaaggaataatgcaagctggaaaaagaagcctacgaccgcaaccgaccgaattaaaatacagttggaaaacttggggtaaggctaaaatgttaagcacagaatcatataatcaaacctttctaatagatggtccagagacagccgagtgtccaaatacgaatagagcttggaactctctagaagtagaagattacggttttggtgtatttactaccaacatatggttgaaacttaaagaaaaacaggacgccttctgtgactcaaaattaatgtcagccgcgataaaagacaatagagcagtacacgcagatatgggatattggatagaatcagctctaaatgacacttggaaaatcgaaaaagcatccttcatcgaggtcaaaaactgtcattggccaaaatctcacactctatggagtaacggtgtcctcgaaagtgaaatgataatacccaaaaatcttgccggcccagttagtcaacacaactaccgaccagggtatcatacacagatagctggcccttggcatctaggcaaacttgagatggacttcgatttttgtgacggtactacagtaatagttacggaagattgcggtaaccgtggaccatcactgcgaacaacaacagcatctggcaaattgattaccgaatggtgttgtaggtcgtgtacgttacctccattgagatatcgtggcgaggacggttgctggtatggaatggaaataagaccccttaaggaaaaggaggaaaaccttgtaaattcattagtgacggcaggccacggacaagtcgacaatttctcattaggtgtattaggaatggctctatttttagaagaaatgcttaggactcgagtaggaacaaaacacgctatattactggttgccgtcagcttcgtgacccttataactggaaatatgtcattcaaggatttggggagagtagttgttatggtcggtgcggcaatggcagacgacataggaatgggagtaacatacctagcattacttgcagcatttaaagtgagaccgacattcgcagcaggactcttattgcgaaaactcacatctaaagaactaatgatgactacaataggtatagttttattgtcgcaatcgaccattccggaaactgtgcttgaattaacagatgcattggcactaggcatgatggtcttaaagattgtccgtaatatggaaaaataccaattggctgtaacgataatggctattttatgtgtcccaaatgcggtgatcctgcaaaacgcttggaaagttagctgcactatactagccgtagtgtctgtaagcccattactacttacatcctcacagcagaaaacagattggataccgttagccttgactattaaaggtctaaacccaactgctatatttttaactacattgagtcgtacgaataagaaaagatcatggccattaaatgaagctataatggcagtaggtatggtatccatattagcatcctcgttgcttaaaaatgatattcctatgactggaccattagtggcagggggtttattaacagtttgctatgttttaacaggaaggagcgcggacctagaattagagcgagcaactgacgtaaaatgggaagatcaagcagaaatttctggatcgtcaccaatactatcaattaccatatccgaagacggttctatgtctatcaaaaacgaggaagaagaacaaactttaactatacttataagaactggtctgctagtcataagtggtttatttccgattagtatacctattacggcagcagcttggtacttatgggaggttaagaaacagcgtgccggtgtgctttgggacgtaccctcgccgcctcctatgggaaaggcggaattagaagacggagcttataggataaagcaaaaaggtattttaggttactcgcaaataggagccggtgtctacaaagaaggcacttttcacaccatgtggcacgttactcgtggggcagtcctcatgcataaaggaaaacgtatcgagccgagttgggcggatgttaagaaagatctaattagttatggaggtggctggaaattagagggggaatggaaagaaggggaggaggtccaggtattggcactagaacctggcaaaaaccccagggcagtccaaacgaaaccagggctattcaaaactaataccggaacaattggcgctgtcagtttagattttagccccggtacatctggttcaccaattatcgacaagaaaggaaaggtcgtagggttatatggaaatggagttgtgactcggagcggggcatacgtgagcgcaattgctcaaactgagaaaagtatagaagataatccagagatagaagatgatattttccgaaaacgccgactcactattatggacctacacccaggagcaggcaaaactaagagatatttaccagctattgtacgtgaagcaattaaaaggggtctaagaacgttaatcctagcccccacaagagtcgtagcagcagaaatggaagaggcactccgtggtctcccgataagatatcaaacccctgcaattagggcagagcatacggggagagaaattgtagacctaatgtgtcacgcgacatttacaatgcgcctgttgtcgcctgttcgtgttccaaactacaatttgattataatggacgaagcccactttaccgatcctgccagcatcgcggctagaggctatatatcaacaagagtggaaatgggagaagcagcaggaatatttatgaccgccacaccaccaggctcccgtgatccttttcctcaatctaatgcccccataatagatgaagaacgagagattccggagcgaagctggaacagtggtcacgagtgggtgacagatttcaaaggtaagactgtgtggtttgttccatcaattaaggcgggtaacgatatagctgcatgtttgaggaaaaacggtaagaaagtaatacaactatcgaggaagacatttgatagcgaatatgtcaaaacacgaacaaatgattgggattttgtcgttactacggatatcagtgaaatgggagcgaatttcaaagcggaaagagttattgacccacgtcgatgtatgaagccggtcattttgacagacggggaagaaagagtaatactagcaggcccaatgccagtaacacacagttcagctgcacagcgtagaggtcgtataggaaggaacccgaaaaatgaaaatgatcaatacatttatatgggtgagcctttagaaaatgatgaagactgtgcacactggaaagaagcgaaaatgctattagacaatataaatacgccggaaggtataataccttcaatgtttgaaccagaacgagaaaaagtcgacgcaatagatggagaatacagattaagaggagaagctcgtaagacatttgtagacttaatgcgtagaggagacttaccagtttggcttgcttacaaagtagctgcagaaggaattaattatgctgataggcgttggtgctttgatggtatcaagaataatcaaatcttagaagagaatgttgaagtggagatttggacaaaggaaggagaaaggaagaaattaaaaccgagatggcttgatgctcgaatttattctgatcctttagcacttaaagaatttaaagaatttgctgctggccgaaaatcgttaacattaaatctaataaccgaaatggggagactcccgacttttatgacacaaaagaccagggacgctttggataacctcgcggtactacacacggctgaagcaggcggccgtgcctacaaccatgctttgagcgaactgcctgaaactctggaaacgcttttgctcctaactctattagcaactgtcacgggaggaatctttctattccttatgtccggtagagggattggcaagatgacccttggcatgtgttgcatcatcactgcatcaatactactatggtacgcgcaaattcagccgcattggatcgcagcgtctataatactagagttctttctaatagtgctccttatacctgaacctgagaagcaacgtacacctcaggacaatcaattaacttacgttgtaatagccatattgaccgtagtagcagccaccatggctaacgaaatgggttttctcgagaaaacaaagaaagattttggtctaggttctatcgcaacccagcaacctgagtccaacattttagacattgacctcagacctgcctcggcttggacactttacgcagtagctaccacctttgtaaccccaatgctaagacacagtattgaaaattcttccgtaaacgtgtcattaacggctattgctaatcaggcaacggtcttaatgggtcttggcaaagggtggccgttatcaaagatggacataggagtaccattgctagcaattggatgctattcacaagtgaatcccatcacactcacagccgccctattactattagtcgcacattatgcgatcatcggtcccggactacaggcaaaggctactagagaagcacaaaaacgagccgctgcaggaataatgaaaaatcctacggtagacggcataacagtaatagatttagacccaataccctatgatccgaagtttgaaaagcaattagggcaagtcatgttgttaattctttgcgttactcaagtactcatgatgcgtaccacctgggctctatgtgaggctttgacattagccaccgggccaataagtacattatgggaagggaaccctggaagattttggaacacaacaatagccgtttccatggcaaacatattcagagggagttacctagccggtgcaggccttttgttttccattatgaaaaataccactaacactcggcgagggaccggtaacataggagaaacactaggagagaaatggaaatcgcgtttgaatgcattaggaaagagcgaatttcagacctataagaaatctggcatacaggaggttgatagaactttagcaaaggaagggataaagagaggggaaaccgaccatcatgcagtttctcgtggaagtgcaaaactacgatggtttgtcgaacgtaacatggtaacaccagagggcaaagtggtcgacttaggctgtggaagaggaggttggtcttattattgcggtggtctgaagaatgtaagagaggtgaaaggactaacgaaaggaggaccaggtcatgaagaaccgataccaatgagtacatatggatggaacttagtaaggctacaaagtggcgtagacgtattctttattccacctgaaaagtgtgacacacttttatgtgacataggggaatcgtcaccgaatccgactgtggaagccggacgaaccctaagagtgctaaacttagtggaaaactggcttaataacaatacacagttttgtataaaggttttgaatccttacatgccttccgtaatagagaagatggaggctttacaacgtaagtacggaggagcgttggttagaaatcctttatccaggaatagtacccatgaaatgtattgggtatccaacgcttcaggcaacatcgtttcctcagtcaatatgatctcacgtatgttaataaatcggtttacaatgaggcataagaaagccacatacgaacctgacgtggatttaggtagtggaactagaaatataggaattgaaagtgaaattcctaatctagatataattggaaaaagaatagagaaaattaaacaggaacatgaaacatcttggcactacgaccaagaccacccctataaaacgtgggcatatcatggaagctacgaaacaaaacaaacaggtagcgcctcaagtatggtaaatggcgtggtgcgtttgctaaccaaaccctgggatgtgctccccacggtcacacaaatggctatgacagatacaaccccgtttggtcaacaaagagtctttaaagaaaaagtcgatactcggacacaagaacctaaagaagggaccaaaaagctaatgaagataacagcggaatggttatggaaagagttaggtaagaagaaaacaccacgaatgtgcacacgcgaagagtttactaggaaggtgcgttccaacgctgccttaggagcaatttttacagatgaaaataaatggaagtcagcaagggaagctgtagaagatagccgtttctgggagctagtggataaagaaagaaatttacatttggaaggaaaatgcgagacttgcgtatacaacatgatgggtaaaagagaaaagaaactcggtgaatttggtaaagcaaaaggatcaagagcgatctggtacatgtggttaggtgctcgcttcttggagttcgaagcgcttgggtttttgaatgaagatcattggttctcgagagagaatagtctctcaggtgtagaaggtgagggattacataaattaggatacatactccgggatgtgagtaagaaagaagggggagcaatgtacgcagatgacaccgctgggtgggatacccgtattactttagaagacttaaagaatgaagaaatggttacaaatcatatggagggggaacacaagaaattagccgaagccatctttaaattaacttatcagaataaggtagtacgggtacaacgaccgactccccgtggaacggttatggatattatcagtagacgagaccagagaggttccggccaagtaggaacgtacggactgaatacgtttacaaatatggaagctcaactaataagacaaatggaaggagagggtgttttcaagaacatacaacatctaacggtcacagaagaagttgcagttcaaaattggttggcaagagtaggaagggaaagattaagccgcatggctattagcggcgatgattgcgttgtgaaacctctcgatgacagatttgccaacgcactaactgctctgaacgatatgggaaagatcagaaaagatatccaacagtgggaaccctctaaaggctggaatgattggactcaagtgccattttgttcccatcactttcacgaactaatcatgaaagatggccgagttttagtagtcccctgtaggaaccaagatgaactaattggacgagcacggatttcacagggcgcagggtggtctttaagagaaacggcctgtctagggaaatcttatgctcaaatgtggagtctaatgtattttcacagaagggatttgagactcgctgccaatgcaatatgttcagccgtcccaagtcattgggtcccgacaagtcgaacgacatggtcaatacatgccaagcatgaatggatgactaccgaggacatgttgaccgtttggaaccgcgtatggatacgtgaaaacccatggatggaagataagacacccgtcgaaagttgggaagaaatcccttacttaggaaaacgagaagaccaatggtgtggtagcctaataggtctaacatctcgagcaacatgggctaaaaacattcaagcggcaataaaccaagttcggtctctaataggaaacgaagaatacacagattatatgccctcgatgaaacggtttcggagagaggaggaagaagcaggggttctgtggtga

SEQ ID NO: 22706 - RNA, 9876 nt, synthetic construct
  misc_feature 1..9876: note = derived and/or modified CDS sequence (opt6) from DENV-2__FJ461309__SS-prME
  source 1..9876: mol_type = other RNA
tccgctgggatgattattatgttaattcctactgtaatggcatttcatttgacaacgcgaaacggggaaccacacatgatagtagggatacaagaaaaagggaaatcgttattatttaaaacggaagacggcgtgaatatgtgtacgttaatggccatggatttaggcgaattatgtgaagacacaattacgtacaaatgtcctcttttacgtcaaaacgaacctgaagatattgactgttggtgcaattcaacaagtacatgggtaacatatggaacttgcacaacaaccggggaacaccgccgagagaaacgatctgtagcattagtaccccatgtaggaatgggcttagaaactagaactgaaacatggatgagttccgaaggcgcatggaaacacgcacaaaggattgaaacgtggattctgagacatcccggatttacaataatggcggctatactagcatacacgataggtactactcactttcaacgtgtacttatttttatacttttgactgctgtagcgccatcaatgacaatgcgctgtataggaatttccaatagggattttgtggaaggggtttcaggtggaagttgggtagacatcgtcctagaacatgggagttgtgttaccacaatggctaaaaataaacccactttggatttcgaactgataaaaaccgaagccaaacaaccggcaactctccgcaaatactgcatagaagctaaattaactaatacgactacagagtcacggtgcccaacccagggtgaaccctctttaaaagaggaacaagataaaaggtttgtttgtaaacactcaatggtggataggggctggggcaacgggtgtggtctttttggtaaaggaggaatagttacatgtgcaatgtttacatgtaagaaaaacatggaggggaaaatagtgcaacccgaaaatctagaatacaccatagttgttactcctcatagtggagaagaacacgctgtaggaaacgacactggtaaacatgggcaggaaataaaagtaaccccacagtcaagtataacggaagccgaacttaccggttatggaaccgtaacaatggaatgttcaccaagaacaggtctagactttaatgaaatggttcttttacaaatggaaaataaagcctggttagtccaccggcagtggtttctagatctacctctaccgtggctaccaggcgcggacaaacaggaatcgaactggatacagaaagagactctcgtaacatttaaaaacccacatgctaagaaacaagatgtagtagtgttaggttcgcaagaaggagccatgcataccgcgctcaccggagcgacagagatacaaatgtctagcggaaatctactcttcacggggcaccttaaatgcagacttcgtatggataaactacaattaaaaggaatgagctattctatgtgtaccggtaaatttaaagttgtaaaagaaatagcagagactcaacatgggacaattgtaatcagagtgcaatacgaaggggatggctcaccatgcaaaatcccgtttgaaataatggatttggaaaaacgctatgtacttggacgtcttatcacagtcaatccaatagttacagaaaaagacagtccagttaacatagaagcggaaccacccttcggcgattcttacataattattggagtagaaccaggacaactcaaactaaattggtttaagaaaggcagttcaataggacagatgtttgagacgacaatgagaggggcaaaaagaatggctatcttaggtgacaccgcatgggacttcggatcacttggaggagtatttacaagcattggcaaagcactacaccaagttttcggcgctatatacggagccgcttttagcggggtatcatggacaatgaaaatattaatcggggtaatcattacatggatagggatgaactcgagatcgacttcgttatcagtttcactcgtattagtaggaatagttacattgtatttaggagtcatggtccaagcagattcaggctgtgttgtttcgtggaaaaacaaagaacttaaatgtggtagcggaatattcataactgacaacgtacacacgtggacagagcagtataaattccaaccagagtcaccatcgaagttagcgtcagctatacaaaaagcacaagaagaagggatatgtggtatacgaagtgtaacacgactagagaacttaatgtggaagcaaataactccggaattgaatcacatcctggccgaaaacgaggtcaaactaactatcatgactggtgacataaaaggtattatgcaggcgggtaagagatcccttagaccacaaccgacagaattaaaatatagttggaaaacatgggggaaagcaaaaatgttatcaacggaaagctataaccagacgttcttaatcgatggtcctgaaaccgcagaatgccctaatactaatcgcgcatggaacagtcttgaggtagaagactatgggtttggagtatttacgactaacatttggctcaaactaaaagaaaaacaagatgccttttgcgacagcaaattaatgtccgcagccataaaagacaaccgagctgtacatgcagatatgggttattggatagaatcggcattaaacgatacgtggaaaatagaaaaagcctcttttatcgaagtcaaaaattgtcattggccgaaatcacatacattgtggtcgaatggggtattagaatcagaaatgatcataccaaagaatctcgccgggccagtgtcccagcataactatagacccggatatcatactcaaatagctggcccatggcacctcggaaagctagaaatggatttcgatttttgtgatgggaccacagtcatagtaacagaagactgcgggaatcgtgggcctagcttaaggacaactacagctagcggaaaactgataacagaatggtgttgtaggagttgcaccctaccgccgttacgatacagaggagaagatggctgctggtacgggatggagatacgaccactcaaggaaaaagaagaaaacctcgtcaattctctagtaaccgccggccatggccaagtcgataacttttcactgggtgtattaggcatggcactattcttagaagaaatgcttaaaactcgagttgggactaaacacgcaatacttttggtagccgtaagttttgttacattgatcaccggaaatatgtccttcaaagatctaggacgagtggttgtcatggtaggcgcaactatggcggatgacatcggtatgggggtaacgtacttagcgctgctagcagctttcaaagtacgtcccacctttgctgcaggattacttctaaggaaactaacaagcaaagaattaatgatgacaacaattggaatagttttactatctcaaagtacaatcccagaaactgttctagaattgactgacgccttagctctcggaatgatggtgttaaagatcgtacgaaatatggaaaagtaccaattggcggttactattatggcaatattatgtgttccaaatgctgtaatcttacaaaacgcatggaaggtgtcatgtacgattttagctgttgtatcagtttcacccttattattaacatcaagtcaacagaaaacggactggataccgttagcccttactatcaaaggccttaacccgactgctatattcttaacaaccctatcacgtaccaacaagaaaaggtcatggcccctaaatgaagccattatggctgtaggaatggtcagcatattagcaagctcactactaaagaatgatataccaatgacaggaccgttagtggctggtgggcttctgacagtctgttacgtactgacgggaagatcagcagacctggaactggaaagagcgacagatgttaaatgggaagatcaggccgaaattagcggcagttcaccaatcttgtcaattacaatatctgaggacggtagtatgtcgatcaaaaatgaagaagaagaacaaacactgaccatacttataagaacagggttgttagtaataagtggtctgttccccatttcgatacccattacagcggcagcctggtacttgtgggaagtaaagaagcaacgtgcgggcgtattatgggacgttccaagccctccgccaatgggaaaggcagagctagaggacggtgcctacagaatcaagcaaaaaggtatcctgggatacagccaaatcggtgccggggtgtataaggaaggaaccttccacactatgtggcacgtaacgagaggtgcagtgttaatgcacaaaggcaagaggattgaaccatcatgggccgacgtcaagaaagatctgatatcttatgggggtggttggaaactcgaaggagaatggaaagaaggagaggaagtacaagtactagcacttgaacccggtaagaacccacgagcggtacaaactaagccaggactatttaaaacaaacactggaaccataggagctgtatctttagatttttccccagggacatcaggaagcccaattatagacaagaaaggtaaagtcgtaggattgtatggaaatggtgtcgtcacaagatcaggtgcgtatgtcagtgcaatagcacagaccgagaaaagtattgaggataatccagaaatagaagacgacatatttagaaaaagaaggcttacaatcatggatctgcatcctggtgctggtaaaactaaacgctacttacctgcaatcgtaagggaagcaatcaagagaggtctgaggacattaatactagcaccgacgcgagtggtggcagcagaaatggaagaagctctcagaggattaccaattcggtaccagactcctgctatacgtgcagagcatacaggtcgggaaatcgttgatttgatgtgccatgcaacctttacaatgagattactctcgccagttcgcgttccaaattataatcttataattatggacgaagcacattttacggatccagcgtcaatcgcagcaagaggatatatatcaactcgagttgaaatgggagaggccgcgggaatttttatgactgcaacgccaccagggagccgtgacccttttccacaatcaaacgcaccaattattgatgaggaaagagaaatccctgagagaagttggaacagcggccacgaatgggtaactgattttaaaggaaaaacggtatggttcgtcccatctataaaggccggcaatgatatagcagcttgtctcaggaaaaatggtaaaaaggttatacaattgagccgtaagacatttgatagcgaatatgtcaaaacacgtacaaatgattgggattttgtagtgacaacggatataagcgaaatgggagcaaacttcaaagcagaaagggtcatagatccgagacgttgcatgaagcccgtgattctcacagatggcgaagagagagtcatattggcggggcctatgccggtaacacattcctcagcggcacaaagaagaggcagaatcgggagaaaccccaaaaatgaaaatgatcaatatatctatatgggggaaccattagaaaacgatgaggattgtgcacactggaaagaagcgaagatgctacttgacaatatcaatacacctgaagggattataccaagtatgttcgaacctgaacgagagaaagttgacgcaatagacggagaatataggctgaggggcgaagctagaaaaacgtttgtagatcttatgcgccgtggtgatttaccagtttggctggcatataaagtcgctgctgaaggaataaattacgcagatagacggtggtgttttgacggaatcaaaaataatcagatattggaggagaacgttgaagttgaaatttggacaaaagaaggcgaaagaaagaaactaaagccgaggtggctagatgcccgcatatactctgatccactagcactcaaagagttcaaagaatttgcagctggacggaaaagtctaactctcaacctaataacagagatgggaagattaccaacatttatgacacagaaaactagagacgctcttgataacctagcagtgcttcataccgcagaagctggtggtcgggcttacaatcatgcactaagtgaactcccggaaacgttggaaaccctattgcttttaacattactagcaactgtaacgggtggaatatttttatttcttatgtcaggaagaggaatcggcaaaatgactctgggaatgtgttgtattatcacagcttcgatcctattatggtacgcacaaattcagccacactggatagccgcatcgataattctggaatttttcttgatagtattattaataccagaaccagaaaagcagagaactccgcaggacaaccaattaacttacgtagtaattgctatcctaactgttgtagcagccactatggcaaacgagatgggattcttggagaaaactaagaaagatttgggtcttggctcaatagcaacacagcaacctgaaagcaatatattagatatagaccttcgacctgctagtgcttggacactgtatgcggtggctacaacattcgtcacgccgatgttgcgtcattcaatagaaaattccagtgtgaatgtttccctaacagcaatcgcgaatcaagctacggtacttatgggactagggaaagggtggccattgagtaaaatggacataggtgtcccgctactagctataggatgttacagccaagtcaaccctataactttaaccgcagcacttctgctattagtagcgcactacgcaatcataggtccgggactacaagcgaaagcgacccgagaagcacagaaaagagccgcagcggggattatgaaaaatccgacggtggatggcatcaccgttattgatttagatccgataccttacgacccaaagttcgaaaaacagttaggtcaggtaatgctattgatcttatgtgtaacacaggtactaatgatgagaacaacatgggcattatgtgaggcgttaacgctggcaactggccccatcagtacgctatgggaaggaaatcccggacgcttctggaacactactatcgcggtatcaatggctaatattttccgtggttcttacttagcaggggcaggcttattattcagtataatgaagaacacaactaatacgcgaagaggaacgggcaacatgggcgaaaccttgggtgagaaatggaaatcacgtcttaacgccttaggaaagagtgaatttcaaatctataagaaaagtggaatccaagaagtagacaggacccttgccaaagaaggaataaaacgtggtgagacagaccaccacgctgtcagccgtggaagtgccaaactacgatggttcgtagaaagaaacatggtaacacccgaaggtaaagttgttgatctgggctgtggacgtggaggatggtcgtactattgtggaggtttgaaaaacgtacgcgaagttaaaggcctgactaaaggagggcctggacatgaagaacccattccgatgagcacctatggatggaatttagtcagattgcaaagcggagtagacgtcttctttatcccaccagaaaagtgtgatacactgttatgcgatattggtgaatccagccccaatcctactgttgaagcaggaagaacattaagggtcctaaatttagtagaaaactggttgaataataacactcagttctgtataaaagttttaaatccatatatgccttcagtcatcgagaaaatggaagcactgcaacgtaaatatgggggtgctcttgttcgcaatccattatcacgaaattcaacgcacgagatgtattgggtatcaaacgcaagtggaaatatcgtgagctctgtgaacatgatttcaagaatgctgattaatcgttttactatgagacacaagaaagcaacatacgaacccgatgtggatttaggatctggtacccgaaacattggaatagaatcagaaatcccaaacctagatatcatcggtaagagaatagaaaagataaaacaagaacacgagaccagttggcactacgatcaggatcacccatacaagacctgggcttatcacggatcatatgaaaccaaacaaacgggaagtgctagctcaatggtaaatggtgttgtgcgtttattgaccaaaccatgggatgtcctcccgactgtgactcaaatggccatgacagatacaaccccattcggccaacagagagtgttcaaagaaaaggtagatacaagaacacaagaacctaaagagggaacgaagaaactaatgaaaataacggcagaatggctttggaaagagttgggtaagaagaaaacgccaaggatgtgcacgcgggaggaatttactagaaaagtaagaagtaatgcagcattaggagcaatattcaccgatgaaaacaaatggaagtcagctagagaagcggtcgaggacggaagattttgggaactggtcgataaggaaagaaatctacacctagagggtaaatgcgaaacatgtgtctataatatgatgggtaagcgggaaaagaaattgggagaatttggaaaagcaaaagggagccgagcaatatggtacatgtggttaggcgctagattcctagagtttgaagcactgggctttctaaatgaggatcattggttctccagggaaaactcattgtcgggagtcgaaggagagggtctccacaaattagggtatatcctcagagatgttagcaagaaagaaggaggggctatgtacgcagacgatacagctggatgggatacaagaataactctagaagatttgaaaaacgaagaaatggtaaccaatcatatggaaggtgaacataagaaactagcagaggctatattcaaacttacataccagaataaagttgtgcgagttcagcgtccaacaccaagaggaaccgtaatggatattatctcacgacgagatcaacgtggatcgggccaagtgggtacgtatggtttaaacactttcaccaacatggaggctcagctaatacgacaaatggagggggagggagtttttaagaatatccagcatttaacggtaacggaagaggtggccgtacaaaactggcttgctagggtaggaagagagcgattgagcagaatggcaattagcggggatgactgcgtcgttaaaccactggacgatcgtttcgcaaatgcattgactgcattgaatgatatggggaagataagaaaggacatacaacaatgggaaccgtcaaagggctggaatgattggactcaggtacctttttgcagccatcatttccatgaattaattatgaaagatgggagagtattggtagtgccatgtagaaatcaggacgaattaataggccgagctagaatcagccaaggcgcaggatggtccttaagggaaacagcttgtttaggaaagagttacgctcaaatgtggagcctcatgtatttccatagacgagacctaagactagccgcgaacgcaatttgctctgccgtgccctcacactgggtaccaacctcgagaacaacatggagtattcacgccaaacatgagtggatgactacagaagacatgttaactgtctggaatcgtgtttggatccgagaaaacccgtggatggaggacaaaactcccgtagaatcatgggaagagataccctatttaggaaaaagagaagaccagtggtgcggaagtcttataggtctcacgagcagagcgacctgggcgaagaatattcaagcagcaataaatcaagtacgttctttaattggcaatgaagagtacactgattatatgccgagcatgaaacgctttcggagagaggaagaagaagctggggttttgtggtaa

SEQ ID NO: 22707 - RNA, 9876 nt, synthetic construct
  misc_feature 1..9876: note = derived and/or modified CDS sequence (opt6) from DENV-2__FJ461311__SS-prME
  source 1..9876: mol_type = other RNA
tcggcaggaatgattataatgctaattcctacagttatggcattccatcttacgactcgcaatggagaaccacatatgatcgtggggattcaagaaaaaggaaaaagtcttctattcaaaacggaagatggagttaatatgtgtactctaatggcaatggatctcggagaattatgcgaagatacaataacttataaatgtccattgctaagacaaaatgaaccagaagacatcgactgttggtgtaatagcacttcaacatgggttacctacggaacttgcacaacaactggagaacatcgacgagaaaaacgttccgtagctttagtacctcacgtagggatggggttagaaacacgaacagaaacatggatgtcaagcgaaggtgcatggaaacatgcgcaaaggatagaaacgtggatattgagacatccaggattcacgatcatggctgccattttagcatatacgataggtaccacacattttcaacgagtattaatatttatccttctcactgcagtagcgccatcaatgaccatgcgttgtataggaattagtaatcgagactttgtagaaggcgtttctgggggttcctgggtagacattgttctcgaacatggctcttgcgtaacaacaatggccaaaaacaaaccaacattagattttgaactgataaaaactgaagcaaagcaaccggctactttgagaaaatattgtatcgaagccaagctaaccaatacaacaaccgaatcaagatgcccaactcaaggagaaccgagcttaaaggaggagcaagacaaacgtttcgtgtgcaaacactctatggtagataggggatggggtaatggttgtggactattcggcaaaggcggtatcgtgacctgtgcaatgtttacttgcaaaaagaatatggaaggtaagatcgtacaaccagagaacctagaatatacaatagtcgtaacaccgcattcaggtgaagaacatgctgttggcaatgacaccggtaaacatggccaagaaataaaagtaactccacaatcgagtataactgaagccgaattgactggctatgggacagtcactatggaatgtagtccacgtaccggactcgactttaacgaaatggttttgctacaaatggaaaataaagcatggctggtgcatcgtcagtggtttttggatcttcccctgccttggttaccaggcgccgataaacaggaatcaaattggattcaaaaagaaaccctcgtaacctttaaaaatccacatgccaagaaacaagatgtcgtggtcctcggcagtcaagaaggtgccatgcacacggctcttacaggtgcgactgagatacaaatgtcatccggcaatcttttgtttactggccacctaaagtgtcgtttaagaatggataaactccaacttaaaggtatgagttattccatgtgcacaggcaaattcaaagtcgttaaggaaattgctgaaacacaacatggtactattgtcataagagtccaatacgaaggtgatggaagtccgtgtaaaatcccatttgaaataatggatttagagaaaagatacgttctcggtaggttaatcactgtcaatcccatagtaacagagaaggactcaccagtcaatatagaagcggaacctccttttggggacagttacatcattattggagtcgaaccaggccaacttaaattaaattggtttaagaaaggttcttctattggtcagatgtttgaaacaactatgaggggagcaaagcgtatggcaatactaggggatacagcatgggattttggttcccttggcggagtatttacatccataggaaaagcgttacaccaagtgtttggagcaatatatggtgccgcgttttcaggtgtatcatggactatgaaaattttaattggagtcatcattacttggataggaatgaactcgagaagcacatcattatccgtgagtctagtattagtaggcatagtcactctgtatttaggagtgatggtacaagcagacagcggctgcgtcgtctcatggaaaaacaaagagctaaagtgtggaagcgggatatttatcaccgacaatgtgcacacatggaccgaacaatataaatttcaaccggaatcgcccagtaaattagcgagtgcaatacagaaagctcaagaagaaggtatatgcggcataaggtcagttactagattagaaaatttaatgtggaaacaaatcacccctgaacttaaccatatattagcagaaaatgaagtaaagttgactataatgacgggtgacattaaagggataatgcaagcgggtaaaagaagtctacgaccacaaccaacagagctcaaatacagttggaaaacttggggaaaagcgaaaatgttgtcaacggaatcatacaatcaaacgttcttaattgatggtccagagactgccgaatgcccaaatactaacagagcttggaactcattggaggttgaggactatgggtttggtgttttcactacaaatatatggcttaagttaaaagaaaaacaggacgctttttgcgatagcaagttgatgtctgctgctatcaaggataacagagcggttcacgcagatatgggatattggatagaaagtgcattaaacgacacatggaaaatagaaaaagccagcttcatagaagtaaagaactgccattggccaaaatcgcatacattatggtctaacggcgttttagaatccgaaatgataataccgaaaaatctcgcgggcccagtgtctcaacacaactatcggccagggtaccacacgcagatagcaggaccatggcatttaggcaaacttgaaatggacttcaatttctgtgatgggactactgtgatcgtaacagaggactgcggtaatcggggacctagtttgagaacgacaacagcctcaggtaaactaattacggaatggtgctgtagaagttgcacactaccacccctccgttataggggagaagatggctgttggtacggaatggagatacgtccattgaaggaaaaggaagagaatttagtaaattcattagttactgccggccatggacaagtggataacttttccttaggagtacttggtatggcattatttctagaagaaatgcttagaacaagagttggtacaaagcatgccatactgctagttgctgtatcatttgtaacacttataacgggaaatatgagttttaaggatttaggtagagtcgtagtcatggttggcgccacgatgaccgacgacatagggatgggagtgacttaccttgccttattagccgcgttcaaagtacgtccgactttcgcagcgggattgttgttacgcaaattaacaagtaaggagttgatgatgacaacaatcggcatcgtgttgttatctcagagcacgatacccgaaactgtactcgagttaacggatgcacttgcgctaggcatgatggtactaaaaatagtaagaaacatggagaaataccagttagccgttactattatggcgatactctgcgtaccaaatgctgttatattgcagaatgcgtggaaagtttcttgcacgatactagctgtcgtatccgtatctccattactcttaacatcatcccaacagaaaacagattggatacctttagcattaactattaagggtctcaatcctacagcaatatttctcactacgctttcacgcacaaacaagaaacggagttggccgcttaacgaggcaataatggcagtaggcatggtgagtatactagcgtctagtctactcaaaaatgatataccaatgactgggcctttagttgcaggcggactattgacagtatgttatgtgctaactgggagaagtgcagatcttgagctagagagagctaccgatgtgaaatgggaagaccaagctgagataagcggatcatcccctattctttccataacaataagcgaagatggttccatgagtatcaaaaatgaggaagaagaacaaaccttgacaatattaataaggacgggtttattggtaatcagtggtttatttcctatttcaatacctataacagcagcagcatggtatctttgggaagtgaagaaacaaagagccggcgtcttatgggacgtgccgtcaccaccacctatgggaaaggcagagcttgaagacggtgcctacagaataaaacaaaaaggtatactcgggtacagtcagattggagctggggtatataaagaaggtacctttcatactatgtggcacgttacccgaggagcagttttgatgcataaaggaaaaaggatagaaccgtcctgggccgacgtcaagaaagatttaataagttacggcggaggatggaagttagaaggggaatggaaagaaggagaagaagtacaggtcctagcattagaaccaggtaaaaacccccgagcagtgcaaacaaagccaggcttatttaaaacaaacacagggaccataggagctgtatccctagacttttcaccaggtacatctggctctccaataatagataagaagggtaaggttgtagggttatatggcaatggcgtagtcactagatctggagcatacgtaagtgctatagcccaaaccgagaaaagcatagaagacaatccagaaatagaagatgacatattccgcaaacgacgattaacaataatggacctacatcctggcgctggaaaaactaagcgctacttacctgctattgtaagagaggcaataaaaagaggactaagaactctcatactcgcacctactagagtagtagccgcggaaatggaagaggcattaagaggactccccatacggtaccaaacgccagctattagagcagagcacacaggacgagaaatagtagatctaatgtgtcatgctacctttactatgagattattaagtccagtaagggtaccgaattataaccttataatcatggatgaggcacatttcactgatcccgcaagtattgccgcgcgcggatatatatcgacccgtgtagaaatgggagaagcagcgggtatatttatgactgctaccccgcccggaagtcgggatccgtttccgcaatctaacgcacctataatcgatgaagagagagagatacccgagaggagctggaacagtggccacgaatgggttaccgatttcaaaggtaagacggtttggtttgttccaagtataaaagctgggaacgatatcgccgcctgtttgaggaaaaacggtaaaaaggtaatacagcttagtcgcaaaactttcgatagcgaatatgtaaaaacgagaactaatgactgggactttgttgttacaacggatatatctgaaatgggcgctaattttaaagcggaacgcgtaattgatccaagaagatgtatgaaaccagtaatccttactgatggagaagagagggtgattctagcaggaccaatgcctgtaacccactcctcagcagcgcaaagacgaggtagaataggacgcaaccccaaaaatgagaatgaccaatatatttacatgggggagcccctagagaatgacgaagattgtgcacactggaaagaagcaaagatgctgcttgataacattaacacacctgagggtatcataccaagtatgttcgaacccgagcgagaaaaagttgacgccatcgatggcgaataccgtctaaggggtgaggcacgaaagacatttgtagatctaatgagaagaggcgatttgccggtgtggctggcatacaaagtggcagcagaaggtatcaactatgcagatagacgatggtgtttcgacggaattaaaaacaaccaaatattagaagagaacatggaagtcgaaatatggactaaggaaggagagaggaagaaattaaagccacgttggttggatgccagaatttattcagacccacttgcgctcaaggagtttaaggaatttgcagcgggtcgaaaaagtctaacgttaaacttaatcacggaaatgggacgtctgccaacatttatgactcagaaaactcgggacgccctcgataatttagcagtgttacacacagccgaggctgggggcagagcttataatcatgcattatcagaacttccagagacccttgagaccttgctactgctaactctacttgcaaccgtaaccggcggtatattcctttttcttatgtctggtcgaggtatcggcaagatgactctaggtatgtgttgcatcattacagcctcaatactcttgtggtacgcacaaattcaaccccattggatcgcagcctcaatcatacttgagttcttccttatcgtacttttaataccagaaccggagaaacaacgtaccccacaggacaatcagctaacgtatgtagtcatagctattttaacagttgtggctgcaactatggcaaacgaaatggggttcctagaaaagacaaagaaagatcttggactgggtagcattgctaccagacaaccagaaagcaatatattggatatagatctcagaccagcatcagcgtggaccctctatgcagtagctacaacatttgtgactcccatgctgagacacagtatagaaaattcgtctgtaaatgtatctctaacagccatcgccaatcaagcaacagtactcatgggactaggtaaaggatggccactgtctaaaatggacattggcgtccccttgctagcaattgggtgttacagccaggtaaaccccataacactaaccgccgcactattgctattagtagcacattacgcaatcatcggacccgggctccaggctaaggctacaagggaagcacaaaaacgagcagccgctggcattatgaagaatcctacagtcgatgggattacagtaatagacttagatcccataccatatgaccctaagttcgaaaagcaactgggacaagtaatgttactcgttctatgcgtaactcaagtattaatgatgaggacaacttgggcattgtgtgaagctctaacactagccacgggcccaatatccaccttgtgggaaggcaatccaggcagattttggaataccacaatagctgtgagcatggccaatatatttagaggaagctacctagctggtgctggcctactattttcaataatgaaaaatacaactaacacaagaaggggtactggaaatatgggggaaacattaggagagaaatggaaatcgcagttaaatgcgcttggaaaatcggaatttcagatttataagaaatcaggcatccaggaagttgatagaacacttgcgaaagaaggtataaaaagaggtgaaacagatcaccatgctgtcagtcgtggaagtgcgaaacttcgatggtttgtagaacgcaacatggtaactcctgaaggtaaagttgttgatctaggttgcggtaggggtggttggtcatactactgtggcggactcaaaaatgttcgcgaagtaaagggtctgaccaaaggaggacctggccacgaagaaccaatccctatgtcaacatatggttggaatttagttagacttcaatcaggagtagatgtatttttcatacctcctgaaaagtgtgacacactattatgtgacataggtgaatcgtcaccaaatccgaccgttgaagcaggacgaactttgagggtcttaaacctagtagagaattggctaaacaataatacacaattttgcataaaagtgctgaatccctatatgccatctgtgatcgagaagatggaagccctccaaaggaaatatgggggagctctagtacgtaatccactgtcccgcaatagtactcacgaaatgtattgggtatctaacgcgagtggtaatatagtcagttcagtaaatatgataagtagaatgctaataaaccgttttaccatgcggcataagaaagcaacatacgagcccgacgttgacctcggcagtggcacccgaaatatcggaattgaaagtgaaataccaaacttagacataattggcaaaaggatagagaaaataaaacaggaacacgaaactagctggcactatgaccaagatcatccatacaaaacttgggcctaccatggatcatacgaaaccaaacaaacgggttcggcttcatccatggtcaatggagtagttcgcctattaaccaagccttgggatgtgttgccaacagtcactcagatggcgatgacagacacaactccctttggtcagcaacgggtatttaaagagaaagtagatacgagaacacaggaacctaaagaaggaacgaaaaagttaatgaaaataacagctgaatggctgtggaaagagttaggcaagaagaaaacgccaagaatgtgtactcgagaagagttcacaagaaaagttagaagcaatgccgcactaggagccatttttacagatgaaaacaaatggaaatctgcccgtgaagctgttgaagatagccgtttctgggagttagtagacaaagaaagaaacctccatctagaaggtaaatgcgaaacttgcgtgtataacatgatgggaaaacgtgagaagaagttaggtgagttcggaaaagccaagggcagccgcgctatatggtatatgtggctaggagcgcgttttctagagttcgaagccttaggctttcttaacgaagaccattggtttagcagggagaatagcctaagtggcgtggaaggcgaaggtttgcacaaacttggatacatattgagagatgttagcaagaaagagggaggtgcgatgtacgcagacgacacggcaggatgggacaccagaataacattagaggacctcaaaaatgaagaaatggtaactaatcatatggaaggagagcataagaaactagctgaagcaatatttaagctaacttaccagaataaagtggttagggttcaaagaccaactcctagaggaacagtaatggatataattagtcgccgtgaccagcggggatctggtcaagtaggaacttacggactaaacacctttactaacatggaggcccagttaatcaggcagatggaaggagagggcgtattcaaaaatatacaacatcttacggtaacagaagaggtagcagtcaaaaattggttggcccgggttggacgtgaacgtctgtcgcgcatggcaatttccggtgacgattgtgttgtgaaacccttggatgatcgctttgcaaacgcactaaccgctttaaatgatatgggtaagatacgaaaggatattcaacaatgggagccttccaaggggtggaatgattggacacaagtacctttctgttcacatcacttccatgagctcataatgaaagacggacgcgtgctagtcgtgccatgtagaaaccaagacgaacttattggtagggcaagaatatcacagggtgcggggtggtcacttcgagaaaccgcttgcttggggaaatcctatgcacaaatgtggtcactaatgtattttcacagacgtgatttaagactagctgccaacgccatttgtagcgctgtgccaagtcactgggtacctacatcacgaactacttggtcaatacacgccaagcatgaatggatgacaaccgaagacatgttaacagtatggaatagagtatggataagggaaaatccatggatggaggacaagactcctgtcgaatcgtgggaagagatcccttatctaggaaaacgtgaagatcaatggtgcggctctttaataggacttacgagcagagcgacttgggcaaagaatatacaagcagcaattaaccaggtaaggtcgctaattggaaatgaagaatatacggactacatgccatcaatgaagaggttcagaagggaagaagaggaagcaggggttctttggtag

SEQ ID NO: 22708 - RNA, 9876 nt, synthetic construct
  misc_feature 1..9876: note = derived and/or modified CDS sequence (opt6) from DENV-2__FJ410217__SS-prME
  source 1..9876: mol_type = other RNA
tcagcagggatgataatcatgcttattccaaccgtaatggcgtttcacctgaccactcgtaatggagaacctcacatgatagtaggtattcaagaaaaagggaaatcattattattcaaaacagaagatggtgtaaatatgtgtacccttatggcaatggacctcggagaattgtgtgaagatacaattacttacaaatgtccattattacgccaaaatgaaccagaagatatagattgctggtgcaatagtacgagtacatgggtaacatatggaacatgtactacaactggcgaacatcgtcgagaaaaacgtagcgtagcacttgtgccgcatgttgggatgggactagaaacccgtacagaaacgtggatgtctagtgaaggtgcatggaaacacgcacaaaggatagaaacatggattttaagacatcctgggttcactatcatggcagcaatacttgcttatactataggaaccacacatttccaaagagtattgatattcattttattgacagctgtcgcacccagtatgacgatgagatgtatcggtatcagcaatcgagatttcgttgaaggcgtaagtgggggcagttgggtagacatagtactagagcatggttcgtgtgtaaccactatggctaaaaacaaaccgactttagattttgaattaatcaaaaccgaagctaaacaaccagctaccttaagaaaatactgcatagaggctaaattaaccaacacgacgacggaaagtagatgcccgacccaaggagaaccttcactgaaagaggaacaggataaacgattcgtatgtaaacactccatggttgatagaggatggggtaacgggtgtggtctttttgggaaaggcggcatcgtgacatgtgctatgttcacatgtaagaaaaacatggagggaaaaatagtacaaccagaaaatcttgaatacacaatcgtagtaacaccacacagcggagaggaacatgccgtcgggaatgacaccggcaaacatgggaaagaaatcaaagtaacaccacagtcctccataacagaagccgagcttacaggttatggaactgtcacgatggaatgctcaccacggacgggactcgactttaatgaaatggttttactccaaatggagaataaagcatggttagtccaccgacaatggttcctcgacttacccttaccatggttgcccggagcggataaacaagagtccaactggatacaaaaagaaaccttagtaactttcaaaaatccgcatgccaagaaacaggacgttgttgtactagggtctcaggagggagctatgcatacagcattgacgggcgccactgaaatacaaatgagctcaggtaatcttctttttactggacacttaaaatgtcggttaagaatggataaactgcaactcaaagggatgtcatactctatgtgcacaggaaaatttaaagtagtaaaagaaatagcggaaactcaacacggaacaatagtaattagagtacaatatgagggagacggcagcccatgcaaaataccttttgaaataatggatcttgagaaacgatatgtactagggcgtttaattacagtaaacccgattgtaaccgaaaaagactcgcctgtcaatatagaagcagaaccaccgtttggagactcatatattatcataggcgttgaaccagggcaattaaaactcaattggtttaagaaagggtcctctattggacagatgtttgaaacaaccatgaggggtgctaaacgaatggcaattttaggggatacagcatgggattttggaagtctaggaggggtattcacgagtataggtaaagcactgcatcaagtatttggtgctatatacggtgcagctttttcaggcgtttcatggactatgaaaattctaattggagtgataatcacgtggatagggatgaactctagaagtacatcgttatcagttagtctagtgttagtgggaattgtaactctctatctaggcgtgatggtgcaggcagactcgggatgcatagtgagctggaaaaataaagaactaaaatgtggttcaggcatttttgtaacagacaatgtgcatacatggactgaacaatacaagttccaacccgaatcaccaagtaaactagcatcagcaattcaaaaagcacaagaagagggaatatgtgggatacgatcagtaacacgcttggaaaacctgatgtggaaacaaattaccccggaattgaaccatatattagccgaaaatgaggtaaagctcaccattatgacaggtgatataaaaggtatcatgcaagcaggtaaaaggtcattgcggccccaacctaccgaactaaagtactcctggaaaacctggggtaaggcgaagatgctcagtacagaaagtcataatcaaacttttcttatagacggccccgaaactgctgaatgcccaaatacgaatcgagcatggaactcattggaggtagaagattatggttttggggtatttaccacgaacatatggttacgtttgaaggagaagcaagacgctttctgcgacagtaaattgatgagtgcagcaattaaagacaatcgagccgttcatgcggacatgggttattggattgaaagcgcgttgaatgacacatggaaaatagaaaaagcgagttttattgaagtcaaaaattgtcactggccaaaatcgcacacgctatggtcgaatggagtcctagaatctgaaatgataatacccaaaaacctcgccggtcccgttagtcaacataattacagaccaggctatcatacgcaaatagcaggtccttggcatctcggaaaattagaaatggatttcgacttttgtgacggcacaaccgttatagtcacagaagattgcgggaacagaggtccgagcttacgaacaacaaccgcctcgggaaaattaataactgaatggtgctgccgatcatgtacactacctccattaagatataggggagaggatggctgctggtatggaatggaaattagaccattaaaagaaaaagaagaaaatttagttaattcactcgtaacagccggacatggtcaagttgataatttttctttaggggtcctaggaatggctctatttttagaggaaatgttaaggaccagggtaggaaccaaacacgctattcttctcgtcgcagtcagtttcgtaacattaatcacaggaaatatgagctttaaagacttgggacgtgtcgttgttatggtgggagcgacaatggctgatgatattgggatgggcgtaacttacctagcgttacttgcagctttcaaagtgagacccactttcgcggccggcttattattgaggaagttaacaagtaaagaacttatgatgaccacaatcggtatagtattattaagtcagtcgacaatacctgaaaccgttctggaactgaccgacgcgttagcgctgggaatgatggtcctcaagatcgtaagaaatatggaaaaatatcaactcgcagtgacaattatggcgatactttgtgtaccgaacgcagtaatattgcaaaacgcttggaaagtaagttgtacaattttagcggtagtaagcgtcagtccactacttttaacctcatctcaacagaaaacagattggataccacttgcgcttacaataaaaggtttaaaccccacagcaatatttttaactactttaagtagaacaaataagaaacgatcctggccattaaatgaagccataatggccgttggaatggtctcgattctagcttcatcattactgaagaacgatattccaatgacaggccccctcgtggccggaggattattgacagtctgctacgtcttgacaggcagatctgcagatctcgaattagaacgcgccaccgacgttaaatgggaggatcaagcggagataagcggctcaagtccaatcttatcaattaccatatccgaagacggcagtatgtccatcaaaaatgaagaagaagaacagactttaactatactaataagaacaggattactggttatctcaggtctatttccgataagtattccaataactgccgcagcgtggtacctatgggaagttaagaaacagagggcaggagtattatgggacgttccatctccaccaccaatggggaaagcggaattagaggatggggcctacaggataaaacaaaaaggaatttttggatacagccaaataggcgccggagtttataaagagggaacattccatacaatgtggcatgtaacacggggcgcagtactaatgcataaaggaaaacgaatagaaccatcctgggctgacgttaaaaaggatctcataagctacggagggggatggaaattagagggagaatggaaagaaggggaagaggtacaagtcttagcacttgaaccgggaaagaacccaagagcggttcaaacgaaacctggtctatttaagactaacacaggaactattggtgccgtgtcattggacttttcaccagggacgtccggctctccaattatagataagaaaggaaaagtagtcggattatacggcaacggcgtcgttacaagatctggtgcatatgtaagcgcgattgcacaaacagagaaatcaatagaagataatcctgaaattgaagatgatatattcagaaaacggaggctcacaatcatggatttgcacccaggagcagggaaaacaaaaagatacctccctgctatagtgagagaagcaataaagagaggtctgaggacactaatattggcaccaactcgtgtcgttgctgcagaaatggaagaagcgttgagaggtttacctatcaggtatcaaactcccgcgatacgtgcagaacataccggccgtgaaatcgtagacctgatgtgtcacgcaacgtttacaatgagattgctttcaccagtacgagttccaaattataatttaatcataatggacgaagctcatttcaccgaccccgccagtatagccgctcgaggatacatctcaacaagagttgaaatgggtgaagcagctggaatttttatgacagcaactccaccaggatcacgagatccttttcctcagtccaatgcaccaataatcgatgaggagagagaaatacccgaaagaagctggaactccggacatgaatgggtaacagacttcaagggcaaaacagtatggttcgtaccaagcataaaagcaggaaatgatatagctgcctgcttacgcaaaaatggtaaaaaggtcatacaattaagtcgaaaaacattcgactccgaatatgtaaaaacacgcacaaatgattgggacttcgtcgtaactactgacatcagcgaaatgggtgccaattttaaagctgaacgggttattgacccacgaagatgtatgaaaccggtgatcttggcagacggagaagaacgcgttatcctagcaggtcccatgccagtcacacattcatccgcagcgcagagaagagggaggataggtcggaacccgaaaaacgagaacgatcaatacatatatatgggagaacccctagagaatgacgaggattgtgctcattggaaggaagccaaaatgttattggataatattaatacgccagaaggcataatcccgtcgatgtttgaaccggaaagagagaaagtcgatgccatagatggggaatatcgcttacgaggggaagccaggaaaacatttgttgaccttatgcgaagaggggatctgcccgtatggctagcatacaaagtagcggcggagggtattaactatgccgacagacgttggtgtttcgacggcattaaaaataaccaaatactggaagagaacgtcgaagtagagatatggacgaaagagggcgagagaaagaaacttaagcctagatggcttgatgcacgcatatattcggatccactagcactgaaagaatttaaagaatttgccgcgggaagaaagagcctaacattaaaccttataacggaaatgggcagactaccaacttttatgacgcagaagacgcgagatgcactagataatctagccgttctccatacagcagaagcagggggcagagcatacaatcacgctttatcggaattaccggagacacttgaaacactactacttctgacacttctcgctactgtaacaggaggaatattcttgttcctcatgagtggtagaggaatagggaaaatgacactgggaatgtgctgtattatcaccgcgtcgattttgctttggtatgcacaaatccaacctcactggatagccgcaagtattattttagagttcttcctaatagtgttattaataccagagccagaaaaacaaagaacaccacaagataatcaactaacctatgttgtaatagctatcttaacagtagtagcagccacaatggccaatgaaatgggatttcttgagaaaactaagaaagatctgggattggggtcaattgcaacacaacaacctgaaagcaatatacttgatatagatctaagaccagcgtccgcatggactttatacgcggtagctactacattcgtgacacccatgttacgccattccattgaaaatagtagtgtgaacgtcagtttgacagcgattgctaatcaggctacggttttaatgggtctcggcaaaggctggccattgagcaaaatggatattggagtcccattattggctataggatgctatagtcaagtaaaccccataaccctaacagcagcactcctgctattagttgctcattatgccattattgggcctggattacaagccaaagcgacacgggaagctcagaaaagagcggcagcaggaataatgaaaaatccaacagtggacggaatcacggtaatcgatttggatccaataccttatgacccaaagtttgaaaaacagctaggtcaagtaatgctcttgattttgtgtgttacgcaggtcttgatgatgcgtactacatgggcactatgtgaagcgcttacattagcaacaggtccaatttctacattatgggagggtaatcctggtcgattctggaatacaaccatagcagttagtatggcaaatatttttagaggaagttacttggcaggagcgggacttctcttcagtataatgaagaatacaacaaatgcaagacgaggaactggtaatatgggagaaaccctcggcgaaaagtggaaatcaagattgaacgctttgggtaagagtgaatttcagatatataagaaaagtggtatccaggaagttgatcgtactttagccaaagagggcattaagcgtggagagaccgatcaccatgcagtatcccgtggctcagcaaaattaagatggttcgttgaacggaatatggtcacgccagaaggcaaggtagttgatcttggatgtggtcgaggaggatggagttattactgtggaggactgaagaatgtaagagaagttaaaggacttactaaaggaggaccagggcatgaagaaccaataccaatgtcaacgtacggctggaatctagtaagacttcagtctggggttgatgtcttctttataccacctgaaaaatgtgatacattgttatgcgacataggtgagagttctccaaatccaactgtggaagcaggcagaacccttagagtgttgaatctggtagaaaattggttaaacaacaatactcaattttgtattaaagttctaaatccttatatgcctagcgttatcgagaaaatggaagcactgcaacgaaaatatggcggtgctttggttagaaacccgttgagccgaaatagtacccacgaaatgtattgggtatctaacgcatcaggaaatattgtatcctcagtgaacatgatcagccgaatgttgataaacagattcaccatgagacataagaaagccacatatgagcccgacgtggatctcggcagcggcacgcgtaacattggaatagaatcggaaataccgaacttagatattatcggaaaacggattgaaaagataaaacaagaacatgagacttcctggcattacgaccaagatcatccatataaaacatgggcctaccatggatcttacgagaccaaacagacaggcagtgcaagttctatggtaaacggagtcgtacgattactgacgaaaccctgggacgtcttaccaacagtcacacaaatggccatgacagataccactccattcggtcaacagcgtgtctttaaagaaaaggtagacacgagaacccaagaacccaaagaagggacgaagaaacttatgaaaattacggctgagtggttgtggaaagagctaggcaagaagaaaactccaaggatgtgtactcgcgaagagtttacaagaaaagtacggagtaatgcggccttgggagcaatatttacagatgaaaataaatggaaatctgcacgagaagcagttgaggactcaaggttctgggaattagttgataaagaaagaaatctgcacctagaaggcaaatgtgaaacttgtgtttataacatgatgggtaaacgagagaagaaactcggcgagttcggaaaagctaaagggtctagggcaatttggtatatgtggttaggtgctagatttctagaatttgaggccctcggattcttaaacgaggatcactggttttcaagagaaaatagcctaagcggcgttgagggagaaggtctacacaaacttggatatatattaagagacgtaagtaagaaagaaggcggggcaatgtacgccgacgatacagctggctgggatactcgtataacattagaggaccttaaaaacgaagaaatggtaactaaccatatggaaggagaacataagaaactagcagaagcaatatttaagctcacctaccaaaacaaagtcgtaagagtacaacgacccacacctagaggaaccgtaatggatattatatctcgtagagaccagagagggtcagggcaggttggtacatatgggttaaatacctttacgaatatggaagcccaattaatacgtcaaatggaaggggaaggagtatttaagaatatacaacatttaaccgtaacggaagaagtggcagtccaaaactggttagcccgtgtaggcagggaaagactttctagaatggcaatctctggagatgactgcgtagtaaaaccgctagatgaccgattcgccaatgcactcactgcactaaatgacatgggcaagataagaaaagacattcaacaatgggaaccatctaaaggatggaatgactggacccaagtgcctttttgttcgcaccattttcacgaactaataatgaaagatggacgagtgctggtagtcccatgtcgaaatcaggatgaacttatcggtcgagcaaggatatcacaaggcgcgggctggtctctccgtgagacagcctgcttaggcaaatcatacgctcaaatgtggagtttgatgtattttcatcgcagagatctaaggttagctgcaaatgcaatttgctctgcagtaccatcccactgggtgccaacatctaggacaacgtggagcatacatgccaaacacgagtggatgaccacagaggatatgctcacagtttggaatcgagtatggattcgtgaaaatccatggatggaagacaaaaccccagtcgaatcttgggaagaaataccatacctagggaaacgagaagaccaatggtgcggtagtttaataggtctaacaagtagagccacatgggccaaaaatatacaagcagcgattaatcaggtacgttcattaattggaaacgaagaatatacagattatatgccctcaatgaaaagatttcggagagaagaagaagaagcgggagtgctatggtag

SEQ ID NO: 22709 - RNA, 9876 nt, synthetic construct
  misc_feature 1..9876: note = derived and/or modified CDS sequence (opt6) from DENV-2__FJ410219__SS-prME
  source 1..9876: mol_type = other RNA
tctgcaggtatgattattatgcttatacccacagtaatggcgttccatctaactacacgtaatggagaacctcatatgattgtaggaatacaagaaaaaggaaagagcctactttttaaaacagaagatggtgttaacatgtgtacgcttatggctatggacttgggagaactctgcgaagatactatcacttacaaatgtccgctgttacgccagaatgaacctgaagatatcgattgttggtgcaacagcacaagcacctgggtgacatacggaacgtgtactacaacaggtgaacaccgtcgtgagaaaagaagtgtagccttagttccacatgtaggcatgggcctagaaactcgcacagaaacctggatgagtagtgagggggcatggaagcatgcacagcgtatagagacgtggatattgaggcaccccggctttaccataatggcagcaattttagcatatacaatcggtaccacccactttcaacgagtgcttatttttattttactgacggccgtagcaccatcaatgacaatgcgttgcattgggataagtaacagagacttcgtagaaggtgtttcaggtggatcttgggttgatatcgtattggagcatggctcctgtgtaacaacaatggcgaaaaataaaccaacattagattttgaattgataaagacggaggcaaagcagcctgctactctacgaaagtactgcatagaagcaaagctaacaaatactaccacagagtcgagatgtcccactcaaggagaaccatcgttgaaggaagaacaggataaaagatttgtgtgcaaacattcgatggtcgacagagggtggggcaatggatgtggtctctttgggaaaggcggaatagttacctgcgccatgtttacctgcaaaaagaacatggagggtaaaatagtgcagcccgagaaccttgagtatactatagttgtgacgccacactcaggcgaagaacacgccgtgggaaatgatacgggtaaacatggccaagaaataaaggttacgccgcaaagtagcatcacagaagcagagttaacaggctatggaacagtaacgatggaatgttcccccagaaccgggctagacttcaacgaaatggtcctgttacaaatggaaaataaagcatggcttgtacacaggcaatggtttctcgatcttccattaccctggttgccaggggcggataaacaggaatcaaactggattcaaaaagagactttggtaacatttaaaaatccacacgctaaaaaacaggatgtagtggttttaggaagccaagaaggcgcaatgcacacggctttaactggtgccacggagattctgatgtctagtggtaaccttttattcacaggtcatctgaaatgtcgcttgaggatggataaactccagttaaaaggaatgagttactccatgtgcacggggaaatttaaggtggtgaaagagattgctgaaacacaacacggaactattgtaatacgagtccagtatgaaggtgatggatcaccatgtaaaattccatttgaaataatggatttggaaaaaagatacgtactgggcagattgataaccgtcaatccgatcgttacagagaaggatagtccagttaatatagaagcagaaccaccctttggagactcatacataataataggtgtagaacctggccaattgaaactcaactggtttaaaaaaggatcatcaataggacaaatgtttgagacgactatgcgcggagcaaaaagaatggcaattttaggggatacagcgtgggattttggatcattaggaggcgtttttactagcattggtaaagcattacatcaagtttttggtgccatctatggcgctgcgttttctggcgtcagttggacgatgaaaattctaataggtgtaatcataacatggatagggatgaacagtcggtcaacaagcctgtccgtttcattagtactagtgggaatcgtgacgctctatctgggcgtaatggtgcaggcagactcaggatgtgttgtcagttggaagaacaaagagcttaaatgcggtagcggcatatttattacggataatgttcacacatggacagaacaatacaaattccagcctgagagtccatccaaacttgcatcagcgatacagaaagcccaggaagaagggatatgtgggatcagaagtgttacaagacttgagaatctgatgtggaaacagatcacgccggagttaaatcacattttggcagagaatgaggttaaactaacaattatgacaggagacattaaagggatcatgcaagcgggtaaaaggttcttaagaccacagccaaccgaactgaaatactcatggaaaacgtggggcaaagccaaaatgctctcgacagaatcgtacaatcaaacattcctaatcgatggaccagaaacagcagaatgtcctaatactaaccgtgcatggaatagtcttgaagtggaagattatggttttggtgtttttacaactaatatttggctcaaactgaaagaaaagcaagacgcgttctgtgattctaaactcatgtccgctgccataaaggataatagagctgtgcatgctgatatggggtattggatagagtccgcattaaatgacacgtggaagattgaaaaagcatctttcatcgaggtcaaaaattgccactggccaaagagccacacactttggtcaaatggtgtccttgagtccgagatgattatacctaaaaatctagcgggaccagtgagtcagcacaattaccgtccaggctatcacacccaaattgcagggccgtggcatttaggtaaactagaaatggatttcgatttctgcgacggaacaacagtaattgtgacagaggattgcggaaatcggggaccgtcgcttaggacgacaacggcctcaggtaaattaattacagagtggtgttgtcgaagttgtacactaccgcctttaaggtatcgtggtgaagatggttgttggtatgggatggaaataagacccctaaaagaaaaagaggaaaatttagtcaatagcttagtaacggcaggacatgggcaggtggataacttctcattaggagtactaggaatggctttatttttagaggagatgttaagaaccagggttggaatgaagcatgcaatactgcttgtagcggtaagtttcgttacactcataacgggcaatatgagtttcaaagatcttggccgcgtcgttgtaatggttggcgcgacaatgacggatgatataggtatgggagtaacctatttagccttattggctgctttcaaagtaagaccaacatttgcagcagggctgttacttcgtaaattaactagcaaagaacttatgatgataactataggaattgtcttgttaagtcaatcaacgattcccgagacagtcttagagctgacagatgctttggccctcggaatgatggtattaaaaattgtcagaaatatggaaaaataccagttggcggttacgataatggctattctttgtgttcctaatgctgtcatcctacaaaatgcctggaaagtatcatgtacgatcttggcagtcgtttcagtgtcacccttattgttgacttcttctcagcaaaaaactgattggatacccttagccttaacgattaagggactaaacccaaccgcgatattcttaactactctatcaagaacgaataaaaaaagatcttggcccttgaatgaagctataatggcagtaggcatggtatcaatattggcaagttctctcctaaaaaatgacataccgatgaccggaccattagtagcgggaggattactaacagtttgttacgtattaactgggagatcagctgatttagaattggagagagtaaccgatgtaaaatgggaggatcaagccgaaatcagcggtagctcgcccatcttatctataaccataagcgaagatggcagtatgagtataaaaaatgaagaggaagaacaaacgctcaccatattaataagaacgggactattagttattagcgggcttttcccgatcagtatacccataacagccgctgcctggtatctatgggaagtaaaaaaacaaagagctggcgttctatgggacgtacctagtccccctccgatgggaaaagctgagttagaagatggggcttatagaataaagcaaaaaggtatattaggatattcacagatcggcgctggtgtatataaggaaggcacatttcatacgatgtggcatgttacaagaggagcagtattgatgcataagggaaagagaatagaaccatcatgggcggatgtgaagaaagatctgatcagctacgggggaggctggaagcttgaaggcgagtggaaggaaggcgaggaagtgcaagtcttagctctggaacccggaaaaaatccacgagcggtgcaaactaaacctggccttttcaaaaccaacacaggtacgataggtgctgtaagtctagatttctcgcctggaacatcaggctctcctatcattgataaaaaagggaaagtggttgggttgtatggaaacggtgtggtaacaagatcaggagcctatgtgtcagccatagcacagacagaaaagtcaatcgaagataatcccgaaatagaagatgatatattcaggaaaagacgattaactattatggatctgcaccctggagcaggaaaaacaaaaaggtatctccctgcgatagtccgtgaagcaatcaaacgcggtttaagaacattaatattagccccgacgcgtgtcgtagcagctgaaatggaagaagctctacgaggtctgccgattagatatcaaactcctgcgatacgagcagaacacaccgggagagaaatcgtagatttaatgtgccatgccacgtttacaatgcgattattaagccctgtaagggtacccaattataatttaattatcatggacgaagcgcactttactgatccagcttccatagccgcacgaggatacattagtacccgcgttgaaatgggagaggcggcaggcatttttatgaccgctaccccacccggatctcgagatccatttccacaaagtaatgctcctattatagatgaagagcgtgagataccagagagatcctggaattcaggacatgaatgggtcacagacttcaagggcaagaccgtgtggttcgtgccttctattaaggcaggcaatgatatagctgcgtgtttaaggaaaaacggtaaaaaagttattcagctatcacgcaaaacgtttgatagtgaatatgtgaaaacaaggactaatgactgggatttcgttgttacgactgatatctcagaaatgggcgcaaactttaaagctgaaagagtaatagacccaagacgttgtatgaaaccagtgattctgactgacggagaagagagggttatattggcagggccaatgccagttacacattcatcagctgcccagagaaggggaagaatcggtcgtaacccaaaaaacgagaatgatcaatacatatatatgggcgaaccattagaaaatgatgaggattgcgcgcactggaaagaagcaaaaatgctactggataatataaatacacctgagggcattatcccaagcatgtttgaacccgagagggaaaaagtggatgccatagacggtgagtaccgcttaaggggagaagcaagaaagacatttgtggacttaatgcgtagaggcgacttaccggtgtggttagcatacaaagttgcagccgaagggataaattacgctgacagacgatggtgtttcgatggcataaaaaataatcaaatcctcgaagaaaatgtagaggtagaaatttggactaaagagggtgagagaaaaaagttaaaacctagatggcttgatgcaagaatatattctgacccactagccttaaaagagtttaaggagttcgcagcaggccggaaaagcttaaccctaaatctaatcacggaaatgggaagactgccaacttttatgacccaaaaaactcgagatgcactcgataacttggcagtcttacacaccgcagaggcaggcgggcgtgcttacaaccacgcattgtcagaactcccggaaacgctcgagacactactattactgacactgttagcaaccgtaactggaggaatctttctatttctgatgtcgggacgaggaataggtaaaatgactttaggtatgtgctgtataataactgctagtattttgctatggtatgctcaaatccaaccgcattggatagccgcttcgatcatattagaattctttttaatagtattactcatcccggaacctgaaaaacaaagaacaccgcaagacaatcagctcacctacgtagtgatagcgatactaacggtagtagctgcgacaatggcgaatgaaatgggttttttagaaaagactaaaaaagatctgggtcttggttcaatagcaacgcaacaaccagagagtaacattcttgacatcgaccttaggcccgcaagcgcttggacgttatacgcggtcgcaacgactttcgtaacacccatgttgagacattcaatagagaattcaagtgtaaatgtttcattgacagccattgcaaatcaagcgaccgtactgatgggattaggcaagggatggccgctcagcaaaatggatataggagtacccctgctagccatcggatgttatagtcaagttaacccaattaccttaacagcggctttgctattattagtagcacactacgctattattggacctgggttgcaggcgaaagcaacaagagaagctcaaaaacgagcagccgcaggaattatgaaaaatcctacagtggatggaatcacggtaattgacctagacccaattccatatgatcctaagttcgaaaaacaacttggccaagtaatgttactgatcttatgtgtgactcaggttctaatgatgagaacgacatgggcattgtgtgaggctctaacgctagctacaggccctataagtacgctttgggaaggaaatccaggacgattttggaatactacaatcgcagtatctatggccaatatatttcgaggctcttatttggccggtgctggattgctattctccataatgaaaaatactacaaacactcggagagggacagggaacatgggtgaaactttaggagaaaaatggaagtcacgccttaacgcacttggaaaatctgaattccaaatatacaagaagtcaggtatccaagaagtagaccgcacactagccaaagagggaattaagagaggagaaacggaccaccacgcagtttcacgaggaagtgcaaaactcaggtggttcgttgaaagaaatatggtaactccggaaggaaaagttgttgatctaggttgcggtagaggaggatggtcatattattgcggcgggctaaaaaatgtgcgggaagtaaaaggacttacaaaaggaggaccgggtcacgaagaacctattccaatgtcaacatatgggtggaacttagttcgattacaaagcggagtcgatgtgtttttcatcccgcctgagaaatgtgacacattactatgcgatattggagaatctagcccaaacccaaccgtagaagcgggtcggacattaagagtattaaatttagtagaaaattggctaaataataatacccaattttgtatcaaggtattgaatccatatatgcctagcgttatagaaaaaatggaagcacttcaacggaagtatggtggcgcattggtaaggaatcctctctcgagaaattccacacacgaaatgtattgggtgtcgaatgcgtccggtaatatagtatcaagtgtcaatatgatatctaggatgctgataaatcgttttacaatgagacataagaaagcgacatatgaaccagatgttgatttgggaagcggcacgcgaaacataggaatcgaaagcgagattcccaatttagacatcataggaaaacgtattgaaaaaatcaaacaggaacacgaaacaagctggcattatgaccaggaccatccatacaaaacttgggcctatcatgggagctatgaaactaagcaaactggctctgcctcgtcaatggtgaacggagtagttagattattaacaaaaccttgggatgtcttacccaccgtgactcaaatggcaatgaccgacactactcctttcggacaacagagggtgtttaaagaaaaggtagatacaagaacccaagagccgaaagaaggaacaaagaaactaatgaaaataacagctgaatggctatggaaagaactgggcaaaaaaaaaacacctagaatgtgtactagggaagaatttacacgaaaagtaaggtctaatgctgcattaggtgctattttcacagatgagaataagtggaagtcagcaagagaagccgtagaggattcaagattttgggagttagttgataaggaaagaaatctccacctagaaggaaaatgtgaaacgtgcgtttataacatgatgggcaaaagagaaaaaaaattgggtgagtttgggaaagcaaaaggatcgagggctatttggtacatgtggttgggcgcaagattcttagaattcgaagcactaggattcctaaatgaagaccattggttttcacgcgaaaatagcctttcaggtgtggaaggtgaaggactacataagttgggttatatattgcgcgacgtgtccaagaaggaaggtggtgccatgtacgctgatgatactgcgggctgggatacacgaattacactagaggatttaaaaaatgaagaaatggtaacaaaccatatggagggagaacacaaaaaattagcagaagccatatttaaacttacctatcaaaataaagtcgtcagggttcaacgacctacacctcgtggaacagttatggacataatatcccgacgtgatcaaagaggttcagggcaagtgggcacatatggactaaatacatttacaaacatggaagctcaactgattaggcagatggagggtgaaggagtattcaagaatatacagcacttaactgttacggaagaagtagctgttaaaaattggctagcaagagtaggtcgcgaacgactgtcaagaatggccatatccggcgacgattgcgtcgttaagccacttgatgatagattcgccaatgcattaacggccttaaatgatatggggaagataagaaaagatatacagcaatgggaaccctctaaaggatggaacgattggacacaagtcccgttttgtagtcatcattttcatgagttaataatgaaagatggtcgagtattagtagtcccatgtcgcaaccaagacgaacttattggaagagctcgcataagtcaaggagcaggctggagtttaagagaaaccgcatgtctcggaaaatcgtatgcgcagatgtggagcctaatgtatttccaccgcagagacctaagactcgccgcaaatgctatctgctctgcggtaccatctcactgggtgccaacatcaaggacgacatggtcaattcatgcgaaacatgagtggatgacaactgaagatatgctcactgtatggaatcgggtttggatacgtgaaaacccatggatggaagataagacacctgtagagtcgtgggaagagattccttacctgggtaaacgagaagaccagtggtgtggatctctcatcggactaaccagccgtgctacgtgggcaaagaacattcaagcagcaataaatcaggttcgatcactaattggaaacgaagaatataccgattatatgccgagcatgaaacgattccgacgagaggaagaagaagcgggagtactatggtaa

SEQ ID NO: 22710 - RNA, 9876 nt, synthetic construct
  misc_feature 1..9876: note = derived and/or modified CDS sequence (opt6) from DENV-2__FJ461314__SS-prME
  source 1..9876: mol_type = other RNA
tccgcgggaatgataataatgttaataccaaccgtaatggcttttcatttgacaacgcgaaacggagaaccgcacatgattgtaggaatacaagaaaaaggtaaatccttactttttaaaacagaagacggggttaacatgtgtacactaatggctatggatcttggtgaattatgcgaagatacaataacatacaaatgtcccttattacggcaaaatgaaccagaagatatagactgctggtgtaatagcacaagcacttgggtaacttatgggacgtgtactactaccggagaacatagacgcgagaaaagaagtgtcgcactggttccacatgtcggtatgggtttagaaaccagaactgaaacatggatgtcatcggaaggcgcatggaaacacgcacaacggattgaaacgtggattctaagacacccgggattcactatcatggctgctatattagcatatactataggtacaacacacttccaaagagtcttaatctttattttactaactgctgtagctccgtccatgacaatgcgttgtataggaatttctaatagagacttcgtagaaggagtaagtggtggatcttgggttgacatcgtattagaacatgggtcctgtgtaaccacaatggcgaaaaacaaaccaaccttagatttcgaactaataaaaacagaagcgaaacaacccgctacattacgcaaatactgcatcgaagccaaactaactaacacgacaaccgaaagccggtgtcccacacagggggaacccagcttaaaagaagaacaagacaaacgttttgtatgtaaacactcgatggtggacagaggctggggtaacggatgtggattatttgggaaaggaggcatagttacttgcgctatgttcacatgcaagaaaaatatggaaggaaaaatcgtacaacccgaaaatttagaatacaccatagtcgtcaccccgcatagtggagaggagcatgcggtaggtaatgacacaggaaaacatgggcaagaaatcaaagtgactccacaatcttcaatcacagaagcagaattaacgggctatggcaccgtaacaatggaatgtagccctagaactggactggatttcaacgagatggttctacttcagatggaaaataaagcctggctagtccacagacaatggttcctagatcttcccttaccttggctaccaggagcagacaaacaagagagtaattggatccaaaaagaaacgttagtcacatttaaaaaccctcatgctaagaaacaagatgtagttgtcttaggaagccaagaaggtgccatgcacacagcactgacaggagctactgaaatccaaatgtcatcaggtaatcttttattcactgggcacctcaagtgcagactgagaatggataaactacaacttaaggggatgtcgtattccatgtgcactggaaaatttaaagtggtaaaggaaattgccgaaacgcagcacggaacaatagtgattcgtgtgcaatacgaaggcgatgggtcaccgtgcaaaataccatttgagataatggatttagaaaagcgttatgtgctaggtcgcctcataactgttaatcccatcgtcactgaaaaagattccccggtaaacattgaagccgagccgccatttggagatagctatataattattggcgtggaacccggccaactcaagctaaactggttcaagaaaggatccagcatcggtcaaatgtttgagacaacaatgcgaggagctaaaagaatggcgattctcggtgacacagcttgggacttcggttccctcggcggcgtatttacaagtataggcaaggccctacatcaagttttcggcgcaatatatggggccgcattttcaggcgtgtcttggacactaaaaatattaatcggagtaataatcacttggatagggatgaatagcagatcaaccagtttgtctgtcagtctagtcctagtaggaattgtaacgttgtatttgggcgtaatggttcaagcagattcgggatgcgtcgtgagttggaaaaataaggaactgaagtgtggaagcggaatatttattactgacaatgtacatacgtggacggagcaatataagttccagcccgaatccccatcaaaactcgcatccgcaatacagaaggctcaagaagagggtatatgtggaataagaagcgtcactaggctggaaaaccttatgtggaaacagatcacccccgaactcaaccacatattggcggaaaacgaagtgaaattaactataatgactggagatataaaaggaatcatgcaagcaggcaaacgatccttaagacctcaaccgactgaacttaaatactcttggaaaacatggggaaaagcaaaaatgctgagcacagagtcatataaccaaacttttctgatagacggacctgagacagctgagtgtcctaataccaaccgagcctggaactcattagaagtagaggattatggatttggggtttttaccaccaacatttggcttaaattaaaagaaaaacaagacgcattttgtgactcaaaattaatgagtgccgcaataaaagacaatcgcgcagttcatgccgacatgggttactggatagaaagcgcattgaacgatacttggaaaatcgaaaaagcatcattcatcgaagtcaagaattgtcattggccaaaatcccataccttatggagcaatggtgttctggaatcagagatgatcattcccaaaaaccttgcagggccggttagtcaacacaattatcgcccaggttatcacacccagattgcaggaccatggcacttaggaaaacttgaaatggactttgatttctgtgacggcactactgtaatagtaacagaagactgtggtaacagaggaccttcactacggacaaccacggcctcaggaaagttaataacagagtggtgttgcagatcatgtacccttcctcctctaagatacagaggcgaggatggttgttggtatggtatggaaatacggccactgaaagagaaggaagagaatttagtcaactcattagtgacagctggacatggccaagtagacaatttttcactaggagtcttaggcatggccctatttctagaagaaatgctccgcacacgagtcgggacaaaacatgccattttactcgtagcagttagcttcgtgacgttaataacagggaatatgtccttcaaagatctgggaagggtggttgtcatggtaggagcaacgatggcagacgatataggtatgggggtaacgtatctggcattacttgcggcatttaaagtacggcctacatttgctgcaggtctattactacgaaagttaacatcaaaagaactcatgatgacgaccatcggaattgtcctattatcgcagagtactataccagaaactgtactagaacttactgacgctctcgcgctcggtatgatggttctaaaaatagtcagaaatatggagaaatatcaattagccgttacaattatggcaatattatgcgtacctaatgccgtgatcctgcaaaacgcttggaaggtatcctgtactatattagccgttgttagtgtatcaccacttctattaacgagtagtcaacagaaaaccgactggataccattagcgttaacgatcaaaggattaaatccgacagcgatatttctaacaacgctaagtagaactaacaagaaacgatcctggcctctaaacgaagcaatcatggccgttggaatggtatcaattttagcgagttcactccttaaaaatgatatcccaatgacggggccattagtagcaggagggcttctaaccgtatgttatgttctaactggcagatcagcggatctcgagttagaacgagccacagacgtgaaatgggaagaccaagcagagatttcaggaagcagccccatactgagcataacaatttccgaagatggatctatgtcaatcaaaaatgaagaggaggagcaaacactaaccatactgatcagaactggccttctagtaattagtgggctatttcctataagtataccgattaccgcagccgcatggtacctgtgggaagttaagaaacaacgagcaggcgtgctatgggatgttccatcgccacctccgatggggaaagcggaactcgaagacggagcataccgaataaaacaaaaaggaattttaggttattcacaaataggagccggtgtgtataaagaagggactttccatactatgtggcatgtcacaagaggtgcagtactaatgcataaaggaaaacgtatagaacctagttgggcggatgtgaagaaagacttaatcagttatggtgggggctggaagttagaaggggaatggaaagaaggagaagaggttcaagtcctggcactagagccaggcaaaaatcccagggccgtacaaaccaaaccgggactcttcaaaacaaatacggggactataggtgcagtaagcctggattttagtcctggcacatcaggctcaccgataatcgacaaaaaggggaaagttgtaggactatacggtaacggcgtagtaactcgatcaggcgcatatgtatctgccatagcacagacagaaaagagcatcgaagataatcccgaaatagaagatgatatattccgcaaacgaaggttaactatcatggacctacaccccggggcgggtaaaactaaaaggtatctgccggcaattgttcgagaagctataaaaagaggacttagaacccttatcctggcgcctactcgagtcgttgccgccgaaatggaagaggctttaagaggcctacctataagatatcaaacaccagcaatacgagcagaacatacaggaagggaaattgtagacttgatgtgtcacgcaacgtttacaatgagactgttatcacctgtaagggtgcctaattataacctaattatcatggatgaagcacattttactgacccagcatcaatagctgcacgggggtatatctccactagagtagaaatgggagaagctgcaggtatttttatgaccgctacaccgccagggtcccgggatccatttccacaatcaaacgcgcctattatagatgaggaacgagagatacctgaacgatcgtggaactctggccatgaatgggtaacggatttcaaaggaaagactgtgtggtttgtcccgtctataaaggccggaaatgacattgcagcctgtctaaggaaaaacggcaagaaagttattcaactgtcacgcaaaacatttgactcagaatatgtaaaaacgcgtacaaatgactgggacttcgtcgttactacagacatctccgaaatgggagcaaactttaaggcagaacgagtgatcgaccctcgacgatgcatgaaaccagttatacttactgatggggaagagagagtgatacttgcagggccaatgcccgtaactcactccagcgcagcccaaagaaggggacgaatcggcagaaacccgaaaaacgaaaatgaccagtatatatacatgggcgaacctctcgaaaacgatgaagactgcgcccactggaaagaagctaaaatgctactagataatatcaatacgccagaagggatcatcccatcgatgttcgaaccagaaagggaaaaggtggatgccatagacggcgaataccgcctacggggagaagccagaaaaacatttgttgacctaatgcgtcgtggggatctcccagtatggctagcttataaggtagcggcagaaggcataaactatgcggatagaaggtggtgttttgacggaatcaaaaataaccagatattggaagaaaacgtggaagttgagatatggactaaagaaggagaaagaaagaaactaaagccaagatggttagacgctaggatttattcagatcctctagcattaaaagagttcaaagagttcgccgcaggacgaaaaagtttaactcttaatttgataaccgagatgggaagactcccgactttcatgacacagaaaacacgagatgcacttgacaatctagcagtattacacacagcagaagccggtgggcgagcatacaatcatgcactgagcgaattaccagagacattggaaacattgttgttattaaccttactagcaactgtaactggaggaatctttttatttctcatgtccggcaggggtataggcaaaatgactttagggatgtgctgcataattacagcctctatacttctatggtatgcacaaattcaacctcattggatcgcagccagcattatattagaatttttcttaatagtgctactaataccagaaccagaaaaacaacgcactccacaagacaatcaactgacgtacgtagtgattgcaatcctaactgttgtggcggcgacaatggcaaatgaaatgggttttctagaaaagactaaaaaggacctgggcttgggatccatagctacacagcaacctgaatcaaacattctagatatagatttaaggcctgcctcagcctggacattgtatgcagttgcaacaacctttgtaactcccatgttacgacattctattgaaaacagttcagtcaacgtgagcttgacagcaatagcaaaccaggccacagtactaatgggactaggtaaaggttggccattgagcaagatggatataggagttccgcttctagcaataggttgttattcacaagtaaatcctataacattaactgcagcgttactgctattggtagcccattacgcgattataggacccggactacaagcaaaagcgacgcgtgaagcacaaaagcgcgcagctgcggggatcatgaagaacccaactgtggatggtataacggtaatagacttggatccgatcccttacgatccaaaatttgaaaaacaattaggacaagttatgttacttatattatgcgttacacaagttttgatgatgagaacaacatgggcattgtgtgaagccttgacattagctaccggaccgatctcaacattatgggaaggcaaccctggacggttttggaacaccacaattgcagtaagtatggctaacatttttagaggatcgtatctagcgggggcaggattgctgttttctatcatgaaaaacacaaccaatacccgacgagggacagggaatatgggggagactttaggcgaaaaatggaaatctagattaaacacattaggtaaatcagagttccaaatctataagaaaagcgggattcaagaagtagacagaacattagcaaaggaaggtataaaacgaggagagacagatcaccatgcagtatcaagaggcagcgcaaaactccgatggtttgtagaacgaaatatggtgacaccagaagggaaggttgttgatttaggttgtggacgaggcggatggtcttattattgtggagggctaaagaatgtaagagaggtgaaaggcttaactaaaggaggacctggacatgaagaaccgataccaatgagcacttatggctggaatttagtaagacttcaaagcggcgttgatgtgttctttataccaccggaaaaatgcgacacgctactttgtgacataggagaatcttcgccaaacccaaccgtggaggctggccgaacgctccgagtactgaatttggtagagaactggttaaacaacaatacccagttttgtataaaagtattaaatccttatatgccaagtgtcattgagaaaatggaagccttacaaagaaaatacggaggtgctttagtgcgaaatcctctaagtagaaattcaactcacgaaatgtattgggtttccaacgcatcaggaaatattgtatcatctgtaaatatgataagccgaatgctcataaaccgttttacaatgagacacaagaaagcaacatacgagccggacgttgatttaggttcgggtacccggaatataggcattgagtcagaaatcccaaatctagatataataggaaagaggatagagaaaataaagcaagaacatgagacatcgtggcattatgaccaagaccatccatataaaacctgggcttatcatggaagctacgaaacaaaacaaacagggtcagctagttctatggtaaatggagtagtcagactgttgacgaaaccctgggatgtgctacctaccgttactcaaatggcaatgaccgatacaacgccgttcggtcaacaaagagtattcaaggaaaaggtagataccaggacacaagaaccgaaagaaggaacaaagaaattaatgaaaattactgcagaatggctttggaaagagcttggcaaaaagaaaaccccaagaatgtgtacaagagaagaatttacacgaaaagtgcggtctaacgcagctcttggagcgatatttactgatgagaacaagtggaaatccgctagagaagcagtggaagactcgcgattctgggagcttgtggataaggaacgaaacttgcatttagaaggaaaatgtgaaacttgtgtgtataatatgatgggaaaacgagagaagaaactcggagaatttggaaaagcgaaaggtagtcgggcaatttggtacatgtggctgggagcgcgctttttagaatttgaagcattgggattcctaaacgaagatcattggttctcaagggaaaattctctcagcggtgtcgagggggaagggttacataaattgggctatattttacgagacgtcagtaagaaagagggcggcgctatgtatgcagatgacaccgctggatgggatacacgtataacattggaagatctcaagaatgaggaaatggtaacaaatcatatggaaggcgagcacaaaaagttagccgaagccatatttaagctaacataccaaaacaaagtagtaagggtccaacgtcccacacctcgaggcactgtaatggatataatttcgcgtagagaccaaagaggtagtggacaagttggcacatacggtctaaacacattcactaacatggaagcacaattaattagacagatggaaggagaaggcgtattcaagaatattcaacatttgaccgtaacagaagaagttgcagtgcaaaattggttggctagagtcggtagagagaggttatcaagaatggcaatctctggggatgattgtgtagtaaagccattagacgatagattcgcaaatgcgctcactgcattaaatgatatgggaaaaataagaaaggacattcaacagtgggaaccatctaaaggctggaacgattggacacaggttcccttctgttcacaccatttccatgaattgattatgaaagacggaagggtacttgtagtaccctgccgtaatcaagatgagttaataggcagagcacgaatctcacaaggcgcaggatggtctctgagggaaacagcttgtctcggtaaaagctacgcacaaatgtggtctctaatgtactttcatagacgggatctacgtttggcagcaaacgcaatatgctcggccgtgcctagtcattgggtaccaacgagtagaactacgtggagtattcatgctaaacacgagtggatgacgaccgaagacatgttaacagtttggaatagggtatggatacgagaaaatccgtggatggaagacaaaacacctgtagagagttgggaggaaattccctacctaggcaaacgagaagaccagtggtgcggaagtttaattgggttaacatccagggctacatgggcgaaaaacatacaagctgcaataaatcaggtaagatcacttataggtaacgaggaatacactgattacatgccaagcatgaaaaggtttcgaagagaagaggaggaagctggtgtcctatggtaa

SEQ ID NO: 22711 - RNA, 9876 nt, synthetic construct
  misc_feature 1..9876: note = derived and/or modified CDS sequence (opt6) from DENV-2__FJ410221__SS-prME
  source 1..9876: mol_type = other RNA
tccgcaggtatgattattatgctaataccgacagttatggcgtttcatttaaccaccagaaatggtgaaccacacatgattgtaggtattcaagaaaaaggtaaaagtttgttattcaaaacagaagacggagtcaacatgtgtacactaatggcaatggatctaggggaactatgtgaagatacaataacttataaatgtccgttattaagacaaaatgaaccagaagatatagattgctggtgcaatagcacgagcacgtgggttacttacggaacttgcaccaccactggtgaacacagaagggagaaaagaagtgttgcattagttcctcacgtagggatgggattagaaacacgtacggaaacatggatgagcagtgaaggagcatggaaacacgcacaacggatcgaaacctggatattaagacatcctggattcacgatcatggcagctatcctagcttacactattgggactactcactttcaaagagtcttaatctttatattacttacagctgtagctccaagcatgacgatgaggtgtataggtatttctaaccgtgatttcgtagaaggtgtatctggtggaagttgggtagacattgtactagaacacgggtcatgtgttaccacaatggccaaaaataaaccaaccctagattttgaattgataaaaaccgaagcgaaacaaccagcaacattacgaaaatactgcattgaagctaaattaactaacaccaccactgaatctagatgtccaacgcaaggcgaaccaagtctaaaagaggagcaagataaacgttttgtctgcaaacattcaatggtggaccgtggctggggtaacggatgtggcctatttggaaaaggtggaatcgtaacgtgtgccatgttcacatgcaagaaaaatatggagggaaaaattgttcaaccagagaatctggaatatacaatcgtagttacaccacattcaggcgaagaacatgcagtgggtaacgacaccggtaaacacggcaaagagataaaagttacaccacaatcgagcattactgaagcagaactcacaggttatgggacagttacaatggaatgcagcccaagaacgggccttgactttaacgagatggtcctattacaaatggagaataaagcatggcttgtacaccgacaatggtttctagacttacctttaccatggcttccaggtgcagataaacaagaatcgaactggatacagaaagaaacattagtaacatttaaaaatccgcatgcgaagaaacaagatgtagtagttttaggtagtcaagagggagcgatgcacacagcacttacaggagcaactgaaatacaaatgtcatctggaaatttgctttttactgggcatctaaaatgtcgcttgagaatggacaaactacaacttaaaggcatgagttattctatgtgtacaggtaaattcaaagtggtaaaagaaatcgcagaaacacaacacggtacgatagtgattagagttcaatatgagggagacggaagtccttgcaaaatacctttcgagataatggacctcgagaaaagatacgttttaggtagactgataactgttaaccccatagttactgaaaaagacagtccagtgaacattgaggcagaaccaccatttggcgacagctatattattattggagtcgagccgggccaattgaaactaaattggtttaagaaaggctctagtattggccaaatgttcgaaactactatgagaggcgcaaaaaggatggcaattctaggtgacacggcgtgggactttggatcactagggggtgtattcacaagtatcggaaaagcattgcatcaagttttcggagcaatatatggtgcagcatttagtggcgtatcatggactatgaaaatcctcataggggttataattacttggataggcatgaatagtagaagtacttctttaagcgtaagcctggtgttggtaggcatagtaacactctacctaggagtcatggtacaagccgacagcggttgtgtagtgagttggaaaaataaagaactcaaatgtgggtccggaatcttcataactgataatgtacacacgtggactgaacagtataaattccaacctgaaagtccaagtaaattagcgtcagccatccaaaaagcgcaagaagagggcatttgcggtatcagaagtgttacaagactagaaaatttaatgtggaaacagatcacgcccgaactaaatcatattttggccgagaacgaagtaaaactaactataatgacaggggatattaaaggaattatgcaagctggaaaaagaagtctaagaccgcaaccgacagaattaaaatattcctggaaaacatggggaaaagctaaaatgctatctaccgaatcctataaccaaacattcttaatagacggaccagagacagcggaatgccccaacacgaaccgagcatggaactccttagaggttgaggactacggatttggagtttttactaccaacatttggctaaaattaaaagaaaagcaagatgctttttgtgactcgaagttaatgtcagcggcaataaaagataacagagccgtccatgctgacatgggttattggatagagtcagcattgaatgacacatggaaaatagaaaaggcctcttttatagaagtgaaaaattgtcattggccaaaaagccataccttgtggtccaacggagtattagaatcagaaatgattattcccaaaaatcttgcgggcccagtctcacagcataattataggcccggctatcacacacagatagcgggaccctggcacttaggaaaattagaaatggacttcgacttttgtgacggaacaacggtaatagtaaccgaagattgtggaaatagaggaccttcgctaagaacaacaacagcttcaggaaagttaatcacagagtggtgctgtcggtcatgtacacttccacctcttcgttataggggtgaagatggatgctggtatggaatggaaatacgcccgttgaaagaaaaagaagaaaatctagtcaacagcctcgttacagcaggccatggtcaggtcgataacttttccctgggagtattaggcatggcacttttcctagaagagatgttgcggactcgagtaggaacaaaacatgcaattttgctggtagcagtatccttcgtaacgcttattacaggtaacatgagttttaaagatttaggcagagtagtagttatggtaggcgcgattatggctgatgatatagggataggagtcacatacctggcacttctcgctgcattcaaagtaagaccaacgtttgcggcgggattattgctacgcaaacttacctcaaaagaattgatgatgactactataggaatcgtcctactaagccaatccaccatcccagaaaccgttctagaactaacagatgcgttggcactgggtatgatggtattgaagattgttaggaatatggaaaaataccaactggcagttaccattatggccatactgtgtgtaccaaatgcagtaatacttcaaaacgcttggaaggtatcgtgcacaatactagcggttgtatccgttagcccactcttgctcacatcaagtcaacagaaaactgactggatacctcttgcgctgacgataaagggactaaaccccactgcaatattccttacgacactatcacgtacaaacaagaaaagaagttggccactcaatgaagctatcatggcagtaggaatggtaagcatcttggcttccagcctattgaaaaatgacattcccatgacaggtccattggttgctgggggacttttaacagtttgctacgttctaactggcagatcagcggatttggaactagaaagagctacagatgtgaaatgggaagaccaagcagagatatcgggctcatccccaatactgtccatcactatttctgaagatggtagcatgagtatcaaaaacgaagaagaggaacaaacgttaactatcctgataaggactggattgctagtaatttcaggactctttccaatcagcataccgatcacagcagcagcctggtatctatgggaagtcaagaaacaaagagccggtgtattgtgggatgttcctagtccgcctcctatgggaaaagctgaattagaggatggagcctacagaataaagcaaaaagggatattaggctattcacagataggagcaggcgtctataaggagggaacgtttcacacgatgtggcacgttacccgtggcgccgtcctaatgcataaaggtaaaagaatagaaccatcgtgggctgatgtgaagaaagacctaatttcctacggcggcggatggaaattagaaggtgaatggaaagaaggtgaggaggtccaagtactggcccttgaacctggcaaaaatccacgtgccgttcagacaaaaccgggcctatttaaaacgaataccggaaccataggagcagtatcactagatttctccccaggaacttcggggagccctattattgacaaaaagggcaaagtggtcggattatatggtaatggcgtggtaactagatcaggtgcgtatgtctcggccattgcacaatcggaaaaatctattgaagataaccccgaaatcgaagacgacatctttagaaaacgaagactaaccataatggatttacatccaggagcaggaaaaacaaagcgttatttgcccgcgattgtcagagaagccattaagcggggtttgagaacattaatcctagccccgactagagtcgtagcagctgaaatggaagaagcactacgtggattacccatcagatatcagactccagcaatacgggtggaacacacaggcagagagatcgtagacttaatgtgccatgcaacatttacaatgagacttttatcccccgtaagggttcctaattacaaccttatcataatggacgaagcacacttcacggatccagcgtcgatagctgctagaggttatatatcaacccgtgtcgagatgggagaagcggcgggtatattcatgactgccacgccaccgggcagccgagatccttttccccaatcaaatgcgcctataattgatgaggaaagagagattccagaacggtcatggaacagcggacatgaatgggtcacagattttaaaggtaagactgtctggtttgtgccgagtataaaagccgggaacgacatcgctgcttgtctcagaaagaatgggaaaaaggtaatccagttgtcaaggaaaacattcgatagtgaatatgtaaaaactcgtacaaatgattgggacttcgtggtaacaacagatatatcagagatgggagcgaatttcaaggcagaaagggtgattgaccctcgaagatgcatgaaacccgtaatcttaaccgatggggaagaacgagttatcctggcaggaccaatgccggtcacacatagttctgcagcacagcgccgaggacgaatcggacgtaatcctaaaaacgagaatgaccagtacatatacatgggcgaaccactagaaaatgatgaagattgcgctcactggaaagaagcaaaaatgttgttagataatattaataccccagaagggataatcccctccatgtttgaaccagaaagagaaaaggtagatgcgatcgatggcgaatacaggctaaggggtgaagcacgtaaaaccttcgttgacttaatgaggagaggggatttgccagtttggctcgcctataaggttgccgcggaaggtataaattatgcggacagaagatggtgtttcgacggtataaagaataaccaaatattagaagaaaacgtcgaagtagaaatctggactaaggaaggtgaaaggaagaaattaaaacctcgatggttagatgctcgaatttatagcgatcctctggcgctaaaggaatttaaagagttcgccgctggaagaaaatcattaaccctgaacctaataactgaaatgggaagactcccaacatttatgacacagaaaacgagggacgcactagataacctggcagtattgcatactgcagaagcaggaggtcgcgcttataatcatgcgctgagtgaattaccggaaactttagaaacgcttctactactcacactcttagcaacagttacaggaggaatatttctattcttaatgtccgggagagggatcggaaaaatgactttaggaatgtgctgtatcataacagcaagtatattactttggtatgctcaaatacaaccacactggatcgccgcatctataatactagaatttttcttaatagtgctacttattcccgagccagaaaaacaacgaacaccacaagacaatcaattgacctacgttgttatagccatattaacagtagttgcagcgaccatggctaacgaaatgggattcttagagaagaccaagaaagatctaggactcggctcaatagctacccaacagcctgaatccaatatactcgacattgacctgagaccagcttctgcctggactttatatgcagtggctacgactttcgtcactccaatgctgcgccactctatagaaaactcaagtgttaatgtcagcctgaccgcgatagcgaatcaagccaccgttctaatgggtctaggcaagggctggccattgagcaaaatggacattggagttccactactagccattggatgttactctcaagttaacccaataacattaactgccgcgttattgctcttagtggcacattacgctattataggaccgggactccaagcaaaagcaacccgagaggcccagaaaagagcagctgctggaattatgaagaatccaactgtagacggtattaccgttatagacttagatccgatcccatatgacccaaaatttgaaaaacaattgggtcaagtgatgcttttaattttatgcgttacccaagttctaatgatgcgcactacatgggcactatgtgaagcgctaacactggcaaccggcccaataagcactttatgggaaggaaatccaggacgattttggaatacaacaattgccgtctccatggctaatatatttcgtggatcatatcttgcaggagccggactactgttctctataatgaaaaacacgaccaacactaggcgagggactgggaacattggcgaaacgctaggagaaaaatggaagtcaaggctaaacgctttaggcaagagcgaatttcaaatctataagaaatccggaatccaagaagtagaccgtacccttgctaaagaaggcattaagaggggagaaacagaccatcacgctgtatcaagaggcagtgcaaagttaagatggtttgttgaacgaaatatggtaactccggagggaaaggttgtggacctaggatgtggacgaggtgggtggagttattattgtggcggtctgaaaaatgttcgagaagtcaagggcttaactaaaggaggacctggacatgaagaaccaatcccaatgtcgacttatggttggaatttggtcagactacagtcgggtgtcgacgtgttctttattccaccagaaaaatgtgatacgctcctctgcgatatcggggaatctagtcctaatcccacggttgaagccggtaggactctgagagtattaaacctggtagaaaattggttaaataataatactcagttctgcataaaagtattgaatccatacatgcctagcgtaatcgaaaagatggaggcactacaaagaaaatacggaggagctcttgtccgtaatcccctgtcaagaaacagtacacacgagatgtattgggtgagtaatgcatctggtaacatcgtatcatctgtaaatatgatatcaagaatgttgataaacagattcactatgcgacacaaaaaggcaacgtatgaaccagatgtcgatttaggctctggtactcggaatgtaggaatagaatcagaaatacctaatctggatataataggcaaacgcatcgagaagattaagcaagaacacgaaacttcatggcattatgaccaagatcatccatacaagacatgggcatatcatggaagttatgaaacgaaacaaaccggatcagcgagtagtatggttaacggcgtcgtacgattactcactaaaccgtgggatgtccttcctacagtgacacaaatggccatgacggacacaactccattcggacaacaaagggttttcaaagaaaaagtcgatacaagaacgcaggagccaaaagaagggacgaagaaactaatgaaaattactgctgaatggctatggaaagagctaggtaaaaagaaaactcctcgaatgtgcacgcgcgaagagtttacaagaaaagtaagatcaaatgctgcattaggggcgatatttacggatgagaacaagtggaaaagtgccagagaggcggttgaggattcacggttttgggaattagtcgataaagaacgaaacttgcatttagagggtaaatgcgaaacttgtgtgtacaacatgatgggtaaaagagagaagaaattgggggaatttggaaaagcgaaaggtagtagagctatatggtacatgtggctcggtgcacgtttcctagagttcgaggctttaggatttttaaacgaagaccactggttctcacgagaaaatagtttatcaggggttgaaggagagggactgcacaaacttggttatattctacgagacgtgtcaaagaaagagggtggggctatgtatgctgatgacacagctggctgggatactagaatcacgctcgaagatctcaaaaatgaagaaatggtcaccaatcacatggaaggcgaacataagaaactagccgaagccatcttcaaattgacatatcaaaataaagtagtgagagtacaaagaccaaccccaagaggaaccgttatggacataatctctagaagagatcaacgtggaagtgggcaagtcggaacatacggccttaatacatttacaaacatggaagcacaattaattcgtcagatggaaggggagggagtgtttaagaacatacaacatcttactgtgacagaagaagtggctgtacaaaattggctcgcaagagtaggaagggagcgtctgtcgagaatggcaataagcggagatgattgcgtagtcaaaccattagacgatcgctttgcaaacgctcttacagcactcaacgatatggggaaaataagaaaagacatccaacaatgggaaccgtctaaaggctggaatgattggactcaagtaccattctgttcacaccactttcacgaacttataatgaaagatggacgcgttttagtagtaccctgtcgtaatcaggatgaattaataggccgagctagaatctcgcaaggagctgggtggtcacttcgagaaacggcttgtctaggaaaatcatacgctcagatgtggagtctgatgtattttcaccgaagagatctgagattggctgccaacgctatttgttcagccgtcccatcacactgggtaccaacgtcacgtacgacttggtcaatacatgcaaaacatgaatggatgacaacagaagacatgctgacagtatggaatagagtctggatacgtgagaatccatggatggaagataagacaccagtagaatcttgggaagaaataccatacctaggaaaaagagaggaccaatggtgcggcagtttgataggtctaacgtcacgtgccacatgggccaaaaacatacaggccgctataaatcaagtgagaagcctaataggcaacgaagagtataccgattacatgccatccatgaaaaggttccgacgggaagaagaagaggccggagtactttggtga

SEQ ID NO: 22712 - RNA, 9876 nt, synthetic construct
  misc_feature 1..9876: note = derived and/or modified CDS sequence (opt6) from DENV-2__FJ547064__SS-prME
  source 1..9876: mol_type = other RNA
agtgcaggtatgataattatgttaatcccaacggtaatggcttttcatttgacaactcgtaatggggaaccacacatggttgtaggaatccaagaaaaaggaaagagcttactattcaaaacagaagatggagtaaatatgtgtacgctaatggctatggacttgggagaactatgtgaagataccattacctataaatgcccacttttacgtcaaaatgaacctgaagacattgactgctggtgcaatagtacaagtacatgggtaacatatggcacatgtacgacaacgggagaacatagacgcgagaaaagaagcgtggccctcgtgccacatgtggggatgggtttagagacacggacagaaacgtggatgagttctgaaggggcatggaaacatgctcaacgaatcgaaacatggatacttcggcatccaggttttactataatggcggctatactagcttacacgataggtactacccatttccagcgcgtattaatatttattttactaacggccgttgcaccatcaatgacgatgcgatgcattggaatatcgaatcgtgattttgtagaaggagtttccggaggatcttgggtagacatcgtactagaacatggcagttgcgtgacaaccatggctaaaaacaaaccaacacttgactttgaacttattaaaactgaggcaaaacaaccggcaacattacgtaaatattgtattgaggccaaactaacaaatacaacgactgaatcgcgatgtcccactcaaggagagccgtcattgaaagaggaacaagataaacgatttgtctgtaaacacagtatggtagaccgaggttggggaaatggctgcgggctttttggcaaaggaggcattgtaacatgtgccatgttcacttgcaagaaaaatatggaaggaaaaatagtacagcctgaaaacttagaatacacgattgtagtgacgccccactcgggtgaagaacacgctgttggaaatgataccggaaaacatgggcaagaaataaaagttacacctcaatcttcaataacagaagctgaattaactggatacggaacagtgacaatggaatgtagtcctcgaactggactggacttcaacgaaatggtgttattacagatggagaacaaagcatggttagtgcaccgacaatggtttctagacttaccacttccttggttgccgggtgctgataaacaggaatcgaactggattcaaaaagaaactcttgtgacatttaaaaatccgcatgcgaagaaacaggatgtcgtcgtgttaggctcgcaagagggcgctatgcataccgcactaacaggcgcaacagaaattcagatgtcgagcggtaatctactatttactggacatttaaaatgcagactgagaatggataaactacaactaaaagggatgagttacagcatgtgcactggaaaattcaaagtcgttaaagaaattgcagaaacacagcatggcacaattgtgatcagagtacaatatgaaggagatggatcgccgtgtaaaatacctttcgaaataatggatctagagaagaggtacgtattaggtcggttaataaccgtgaacccaattgttactgaaaaagactcgcctgtaaatatagaagcagagcctccttttggagatagttacatcataataggcgtcgagcctggacaattaaaattaaactggtttaagaaaggatcctccattgggcaaatgttcgaaacaacgatgagaggagcgaaacgaatggcaatccttggtgatacagcatgggactttggatcgttaggaggggtattcacgtcaatcggaaaagcactgcaccaggtctttggagctatctatggagcagcgttttcgggagtgagctggaccatgaagatactaattggcgttataataacctggattggtatgaacagcaggtccacgagcttgtcagtcagtctagtattggttggcatagttacgttatacttgggggtaatggtacaggctgactcgggatgcgttgtaagttggaaaaataaagaactaaaatgtggcagtgggatttttataacagacaatgtgcatacatggacagaacaatataaatttcaaccagaatctcctagtaaattagcttccgctatccaaaaagctcaagaggaaggtatttgcggaattagatcagttacacgacttgagaacctgatgtggaagcaaatcactcccgagttaaaccatattctagcagagaatgaagtcaaacttacaataatgacaggagatataaagggaataatgcaagccggtaagcgatcccttagaccccaaccaacggaattaaaatactcctggaaaacgtgggggaaggcaaaaatgctatcaacagaaagttacaaccaaacattcttaatcgacgggccagagactgcggaatgccctaatacaaacagggcttggaatagtctggaggttgaagactacggattcggagtatttactacgaacatctggctaaagttaaaagaaaaacaagacgctttctgtgactctaaattaatgtctgccgcgataaaagacaaccgagcagttcatgcggatatgggatattggatagagtctgccttaaacgacacctggaaaattgagaaagcatcattcatagaagtgaaaaattgtcattggccaaaatcacacactctctggtccaacggagttttagaaagtgaaatgataatacccaaaaatctcgcagggccagtgtcccagcacaactacaggcctggataccatactcagatcgccggcccatggcatcttgggaaactagaaatggactttgacttttgtgacggcacgactgttatagttaccgaagattgcggaaatagaggcccaagtcttcgtactactacagcctctggtaaattaataacagaatggtgctgtagaagttgtacattacctccactacgatacagaggggaagacgggtgctggtacggtatggaaattagacctttaaaagaaaaagaagaaaatttagtaaacagtttggtgacagctggacacggacaggttgataacttttcattaggtgttctaggaatggctttatttttagaagaaatgctacgaacccgagtcggaaccaaacatgccatactgctagtagccgtgtcattcgtaacattaataacaggaaatatgagttttaaagatctaggtagggtcgttgtgatggtaggcgctacaatgaccgatgatataggcatgggcgttacataccttgccttattagctgcctttaaggtccgccccacattcgctgcaggtctactactacgaaagctgacatctaaagagttaatgatgaccacaataggtatagtgttgctcagtcagtctacaataccggaaacagttttagaactgacagatgcactagccttagggatgatggtactaaaaattgttagaaatatggagaaataccaacttgcagtaactataatggccattctatgtgtccctaatgcagtcattctacaaaatgcctggaaggtatcttgtacgatacttgcagtagtctccgtatctcctctactgcttacaagttcccaacagaaaacagactggatccccttggcgttaacaattaaaggtttgaatcctactgctatctttttgacgacattgagtcgcacgaataagaagaggtcatggccgcttaatgaagctattatggccgttggtatggtatccatattggcttctagtttactcaaaaacgacattcccatgacaggacctttggtagctggtggactattgacggtatgctacgttctaactggaaggagcgcagatttagaattggaaagagcaacggacgtaaaatgggaagatcaagcagaaatctcgggaagcagccccattctcagcataactatatccgaagatggtagcatgtctatcaagaatgaagaagaagaacaaacactgacgatattaatccgaaccgggttgttagtcatttcaggattatttccaatttcaatacctatcaccgctgcagcctggtatttatgggaagttaagaaacagcgagctggagtattatgggacgtacccagtcctccgcccatgggcaaggcggagctggaagacggcgcatatagaatcaaacaaaaaggcattctcggttatagtcaaattggagcgggagtttaccgagagggaacttttcacacgatgtggcacgtaacccggggtgctgtactcatgcataaaggcaaacgcatcgagccctcatgggccgatgtcaaaaaggatttgatatcctatggaggcggatggaaactagaaggcgaatggaaggaaggtgaagaagttcaagtactcgctctcgaacctggtaaaaatccacgcgctgttcaaactaaaccgggactgtttaaaacgaacacaggtacaataggcgccgtatctttagattttagtcctggtacttcaggaagcccaattatagataagaaaggtaaagtagtaggtctctacggcaatggggtagttactagaagcggagcgtacgtcagtgcgatagcacaaaccgaaaagtcaatagaagataatccagagattgaagatgacatattcaggaagcgacgtctgacaataatggatttgcatcctggggcaggaaaaactaaaaggtatcttcccgcaatcgttcgagaagcaataaaaaggggtctaagaacactaatactagcgcccactagagttgtcgcggctgagatggaggaagccttaagagggcttcctattcgctatcaaactcctgccataagagcagaacacactggtagagaaattgtagatctaatgtgtcatgctacgtttacaatgcgcttactatcccctgtacgagtaccgaattacaatcttatcatcatggatgaagcacattttaccgatccagcatctatagcagctcgaggatacatatctaccagggtagaaatgggagaagcggcagggatatttatgactgcgacgccacccggctcgcgcgatcctttcccgcaaagtaacgccccaataatagatgaggaaagggaaataccagagcgcagctggaactcgggtcatgaatgggttaccgatttcaagggtaaaaccgtatggttcgtaccatcaataaaggctggaaatgacatagttgcttgtctaaggaaaaatggcaagaaagtaattcaactgtcaagaaaaacttttgacagtgaatacgtaaaaacgaggacaaacgattgggacttcgttgttacaactgacattagcgaaatgggagcaaactttaaagcagagagggttatagatccaagaagatgcatgaaaccagtcatattaactgatggcgaagaaagagttattttggcaggaccgatgcctgtaacgcattcaagcgcagcacagagacgaggccgcatcggaaggaaccccaaaaacgaaaacgaccaatatatttacatgggggagccactggagaatgacgaagattgtgctcactggaaagaagcaaaaatgttactggataacataaacacccctgaaggaataatcccaagtatgtttgagccagaacgggaaaaggttgatgctatagacggcgagtacagacttaggggagaagcgcgaaagacatttgtggacttaatgcgcagaggagatttaccagtatggctagcatataaagtagcggcagaaggtattaactatgcggatcggagatggtgtttcgacggcattaaaaataatcaaattttagaggaaaacgttgaagtcgaaatttggacaaaagaaggagagagaaagaaacttaaacccagatggctggatgctagaatatactctgatccactcgctttaaaggaatttaaagaatttgctgcaggacgaaaaagcctgaccttgaatcttataacagagatgggacgactccctacatttatgacacagaaaactcgagacgctttagataacttagccgtactgcacacagctgaagctggtggacgagcatacaatcacgcattaagtgaactgccggaaacattagagactctgctcttattaacgttactagctacagttacgggcggaatatttttgtttcttatgtctggaaggggaattggtaagatgactcttggaatgtgctgtattataacagcaagcatcctactgtggtatgcacaaattcaaccacactggatcgccgcaagtatcattctagaatttttcctaattgtgttgttaataccagaaccagaaaagcaaagaacccctcaggataatcaattgacatatgtcgtaattgcaatcctaacggtagtggctgctacgatggcgaatgaaatgggctttctagagaaaacgaagaaagatttagggctaggatcaatagctacacaacaaccagaaagcaatatattagatattgacctccgtccagcctctgcgtggacactttacgctgtagctacaacgtttgtaacgccgatgcttcgtcatagtattgaaaattcatcagttaacgtcagcttgactgctatcgctaatcaggcaacagttctgatgggactgggaaagggttggccactaagcaaaatggacataggagtccccttactggccattggttgttactcacaagtaaatccgattacattaactgcggcactattgctattagtggcgcattatgcaattatcggcccaggactgcaggcaaaggcaacaagagaagctcaaaaacgagccgccgcaggtataatgaaaaaccctacagttgatggaataaccgttatagacctggatcctataccttacgaccctaaattcgaaaaacaattggggcaagtcatgttactcatattgtgcgttacacaagtactgatgatgcggaccacttgggccttatgcgaagcacttacgcttgctacaggacccatatcaacgttatgggaaggaaaccctggaagattctggaataccacaatagcagtatctatggcaaacatcttcagggggtcttacctagccggagcaggattattatttagcataatgaagaatacgacaaacacaagacgaggtacaggcaacatgggagagacactaggtgagaagtggaaatcacggcttaatgcgttgggtaaatctgaatttcaaatttacaaaaagagtgggattcaagaggttgaccgcaccttagcaaaagaagggatcaagcgaggagaaacggatcaccatgccgtatccagaggctcagctaaattaagatggtttgtggaaaggaacatggtaacaccagaagggaaagttgtggatttagggtgtggcaggggcgggtggtcgtattattgcggaggtctcaaaaatgtaagagaagtaaaagggttaactaaaggaggtccaggacatgaggaaccaatccctatgtcaacttacggatggaacctagtaagactacaaagtggtgttgacgtgttctttataccaccagaaaaatgtgatacactgttgtgcgacataggggaaagttctccaaacccaacggtagaagcagggcggactttaagggttttaaatctcgtggaaaactggcttaacaataatatacaattttgtatcaaagtcctaaatccatatatgcctagtgtaatagagaaaatggaagccttacaacggaaatacggaggtgccttggtaagaaatcctctaagtagaaactccacacatgaaatgtactgggtatctaacgcctctggaaatatagtttcctcggtaaatatgatctctcgaatgctcataaacagattcacaatgcgtcataagaaagctacttatgaaccagacgtggaccttggatcagggacaaggaatataggtacggaaagcgaaatcccaaatttagatattataggaaaaagaatagagaaaataaaacaggagcacgaaacatcatggcactacgatcaagatcatccatacaaaacttgggcataccatggatcctacgagacaaaacaaacaggctctgcatcgtctatggtaaacggagtagtacgactactaactaaaccttgggatgtcctccccatggtaactcaaatggcaatgaccgacactacaccttttggacagcaaagagtattcaaagagaaagtagacacaagaactcaagagccaaaagaaggtactaagaaattgatgaaaatcactgctgaatggctatggaaagaattaggcaagaagaaaactcctagaatgtgcactcgggaggaatttacaagaaaagtcagaagcaatgcggcactcggcgcgatttttaccgacgaaaacaagtggaaatcagcgagggaagctgtggaggacagtaggttttgggagttggttgacaaagagagaaacctacacttagagggaaaatgcgaaacgtgcgtatataatatgatgggaaaacgcgagaagaaattaggagaatttggaaaagccaaaggatcgagagcaatatggtacatgtggctcggggcgagatttctggagtttgaagctctaggatttttaaatgaagatcactggttctccagagagaactccctatcgggggtagagggtgagggattacacaaactagggtacatcctacgagacgtttcaaagaaagaaggtggagcaatgtacgcagatgataccgcgggttgggatacccgtattacactagaagatctgaaaaacgaagaaatggttactaatcatatggaaggagaacacaaaaagttggcagaagccattttcaaacttacatatcaaaataaggtagtgcgagttcaaagacccactccccgtggcaccgtaatggacatcatctctagaagagaccaaagaggaagcggtcaggtaggtacatatggcctaaatacattcactaatatggaggcacagctaattagacaaatggaaggtgaaggcgtattcaagaatattcaacatttaacagttacggaagaagttgccgtcaaaaactggcttgcaagagtagggcgtgaaaggttatcacggatggctataagtggcgatgattgtgttgtcaagcctctagacgatcgattcgcaaacgcactaactgcattaaatgacatgggaaaaatccggaaagatattcaacaatgggaaccgtctaaagggtggaacgattggacacaagtaccattttgctcacaccattttcatgaacttataatgaaggacggtcgagtattagttgtaccttgcaggaatcaagatgaattaatagggagagcccgtatttctcaaggagcaggttggtccctacgtgaaacagcctgtcttggcaaatcatacgcccaaatgtggtctttgatgtattttcacagaagagacctaagacttgcagccaatgcaatatgtagcgccgtcccatctcactgggtaccaacaagtagaactacttggtcaatacacgcaaaacatgaatggatgacgacagaggatatgctcactgtttggaacagagtatggatacgagaaaacccgtggatggaagacaagacgccggttgaaagttgggaggaaataccatacctcgggaagcgagaagaccaatggtgcggaagtttaataggattaacaagccgtgcgacgtgggcaaagaatatccaagcagcgataaatcaggttcgaagtttaattggaaacgaagaatacacagattatatgccatctatgaagagatttcgacgagaagaagaagaggctggcgttctgtggtag

SEQ ID NO: 22713 - RNA, 9876 nt, synthetic construct
  misc_feature 1..9876: note = derived and/or modified CDS sequence (opt6) from DENV-2__FJ410223__SS-prME
  source 1..9876: mol_type = other RNA
tctgcaggtatgatcattatgttgatacctacagtcatggcatttcacttaacgacgcgaaacggagaaccccacatgatagtagggatccaagaaaaagggaaatcattattatttaaaaccgaagatggagtaaatatgtgtacattaatggctatggacttaggcgaattgtgtgaagatactataacatataaatgtccactattacggcaaaatgaaccagaagacatagactgctggtgcaattcgacgtcaacttgggttacttatggtacctgcacaaccaccggcgaacatagaagggagaaaagatcagtagcattagtaccacatgtggggatgggattagaaactaggacagaaacttggatgagctcagaaggggcatggaaacatgcgcagaggattgaaacttggatcttgcgtcatccaggattcaccatcatggccgcgatattagcatacactatagggaccacgcactttcaacgcgttctcatatttatacttcttacggctgtagcgcctagcatgacaatgcgttgtatcgggatatccaaccgggatttcgtcgaaggcgtgagcggaggaagttgggtggacatagtactggaacatggatcgtgtgtaactaccatggccaaaaacaaaccgacattagacttcgaattgataaaaactgaggcaaaacagccagctacattgcgtaaatattgcattgaagcaaaacttaccaacacgacaaccgaatcgagatgtcctacacaaggcgaaccttcactcaaagaagaacaggacaaacgcttcgtgtgcaaacattcaatggtagacagaggctggggaaatgggtgcgggttatttggaaaaggaggtatcgttacctgcgctatgttcacttgcaagaaaaacatggaaggtaaaatagtacaacctgaaaatcttgagtataccatagtagttacccctcattcaggagaggaacatgcagtaggtaatgacactggcaaacacggacaggaaattaaagttacaccccaaagctctattaccgaagcagaacttacgggttatggtacagtaacgatggaatgcagcccgcgaacaggtctggattttaatgagatggtattactgcaaatggaaaataaagcctggcttgttcatcgacaatggtttttagatttaccactaccatggttacccggcgctgacaaacaagaatctaattggatacagaaagagacattagtaacattcaaaaatcctcatgctaagaaacaagatgtcgtagttctaggatcacaagagggagcaatgcatacagccttaactggagcaaccgaaatacaaatgtcgagtggtaacctattatttactggtcatcttaaatgcagattacgcatggataaacttcaattaaaaggaatgagttatagcatgtgcacaggtaaattcaaagttgtcaaagaaatcgctgagacacaacatggtacgatagtaattagggtacaatatgagggcgacggaagtccgtgcaaaataccgtttgaaataatggacctcgaaaaacgatatgttctcggtagattaatcaccgtcaatccgatagtaactgaaaaagatagtccagtgaatatagaggcagagccaccattcggggattcttatattataattggcgtcgagcctggccagcttaagctcaactggttcaagaaaggaagctcaatcgggcagatgttcgaaaccactatgcgcggtgcgaaaagaatggccatactaggcgatactgcctgggattttggaagtctaggaggggttttcacctcaatagggaaagcattgcatcaagtattcggagccatatatggagccgccttttcaggggtaagttggacaatgaaaatattaataggtgtaataatcacgtggattggcatgaatagtcgatcaacatcactatcagtatccctggtactcgtaggaatcgttaccttatatctaggtgttatggtacaagcggactccggatgtgtggtaagttggaaaaataaagaattgaaatgtggttcaggtatatttatcacggacaatgttcacacttggacagagcagtataaattccaacccgagagcccttctaaattggcatcagctatacagaaagcgcaagaagaaggaatatgtggaataaggtcagtaacccgcctagaaaacttgatgtggaaacagattactccagaattaaaccatatactagcagagaatgaggtaaaacttacaatcatgactggagacataaagggaattatgcaagcgggcaaaagaagtcttcgaccccaaccaacagaactaaaatattcctggagaacttgggggaaagcaaaaatgttatcgactgaatcttacaaccaaacattcctcatcgatggcccagaaacggcagagtgtccaaatacaaatagggcatggaatagcttagaggtagaagattatggattcggcgtttttactacaaatatatggcttaagttgaaagaaaagcaagatgcattttgtgacagtaaattaatgtccgctgcgatcaaggataaccgagctgtccatgcggatatggggtattggatagagtctgctttaaatgatacttggaaaatcgagaaggcttcatttattgaggttaaaaattgccattggcccaaatctcatactctctggtcaaatggtgttctcgaaagcgaaatgataattcccaaaaatttagccggacccgtaagccaacacaactataggcccggttatcacacacaaattgcaggaccgtggcatcttgggaaactcgaaatggatttcgatttttgcgacgggactacagtaatagttacagaagactgtggaaaccgggggccatctctcagaactactaccgcttcagggaaattgatcactgaatggtgttgtagaagttgcacacttccgccactaaggtaccgcggagaggatggatgctggtatggaatggagatacggcccttgaaagagaaagaagaaaacctagtaaattcgctcgtaactgccggacatggccaagtggacaatttctctctcggagttttaggaatggcattatttctcgaggaaatgctaagaacacgtgttggaactaaacatgccatacttctagtggcagtttcgtttgtaactttaattacgggaaatatgtccttcaaggatctagggcgtgtagtagtaatggtaggtgccacaatggcggacgacataggaatgggcgtaacctatctagcgttacttgctgcctttaaagtacgtcctacgtttgcagctggactgttattacggaaattaacgtcaaaagaattaatgatgaccacgataggaattgtactgttatcacagtcaacaataccagaaacagtattagaactcaccgacgcactagccttaggtatgatggttctgaagatagtaagaaatatggaaaaataccaactagctgtgacaatcatggcaattttatgcgtaccaaatgcagtaatcctccaaaacgcctggaaggtttcttgcacaatactagctgtagtatcagtatcccccttattgttaacttcatcgcaacagaagacggattggattcccttagctctaacaattaaaggtttgaacccaacggcaatattcctaacaacactttcacgcactaacaagaaacggtcttggcccctcaatgaagctataatggcggttgggatggtaagcatactagcttcgtcgctccttaaaaacgatatccccatgaccgggcctctagttgcaggaggactactaacggtatgctatgttctgacaggaaggagtgcagacttagagctggaacgcgccaccgatgtgaagtgggaggatcaagcagagatatcaggatcgtctcccatattaagtataacaataagtgaagatggatcgatgtctattaaaaacgaggaagaggaacaaactttaactatactaattcggacagggttattagtcatctccggactattccctatctcaatacctatcacagctgctgcttggtatctatgggaagtcaaaaagcaacgagcaggagttctgtgggatgtacccagtccaccccctatgggtaaggcagaactcgaagatggagcgtatcgaataaaacagaaaggaatactaggttatagccaaataggtgcaggggtatacaaagaagggacttttcatacaatgtggcatgttacccgaggtgcagtgcttatgcataaaggaaaacgaatagaaccatcctgggcagacgttaagaaagacctaatttcctacggtggcggatggaaattagagggcgagtggaaagaaggagaagaggtacaagttctcgcccttgaaccagggaaaaaccctagagcggtacagaccaagccaggtttgtttaaaacaaacacgggaactataggagccgttagcctggacttttcaccaggtacatccggatcgccaattatagataagaaaggcaaagtggtaggattgtatggaaacggggttgtaacacggagtggcgcatacgtttccgcaattgcgcaaactgagaaaagcatcgaggataatccagaaatagaagatgacattttcagaaagaaaagactcactatcatggaccttcatcctggagcaggcaaaacaaaaagatatctacctgctatagtaagagaagcaattaagcgtggactaagaacgcttatactagcacctacgagagttgtcgctgccgaaatggaagaagcattaaggggtttgccgattagatatcagacccctgcgattagagcggagcacacagggcgtgaaatcgtagatttaatgtgccatgcaacttttaccatgagattactaagcccggtgagggtcccgaattataatctaattatcatggacgaggctcattttaccgacccggcctcaatagcggcaagagggtatatatcaactagggtcgaaatgggtgaagccgccggaatctttatgacagctactccacccggatctcgagacccatttccccaatctaatgcacctatcatagatgaggaaagggagataccggaaagatcgtggaactcagggcacgaatgggtaacggattttaaaggcaagacagtatggtttgtaccttcaatcaaagctgggaatgatattgccgcttgtttacggaaaaatggcaagaaagtaatacaactatcgcggaaaaccttcgatagtgaatatgttaaaacgagaacaaacgactgggactttgttgttacaaccgatattagtgaaatgggcgcgaacttcaaggccgaaagggtaattgatccaaggaggtgtatgaaaccggttattctaaccgacggcgaggaacgggttatactagctgggccaatgcctgtgactcactcatcagcagcccagaggcgaggaagaataggacgcaaccccaaaaatgaaaatgatcaatatatttatatgggagaacccttagaaaatgacgaagattgtgcacactggaaagaggcgaagatgttgttagacaatattaatactcctgaaggaataatccccagcatgttcgaaccagaaagagagaaagtcgacgctatagatggtgagtatagattaaggggtgaagcaagaaagacatttgtagatttgatgaggcgaggagatctgcctgtttggcttgcatataaagtcgcagcagaggggataaattacgctgaccgtagatggtgttttgatggaatcaagaataatcagatactagaagaaaatgttgaggtcgaaatatggaccaaagaaggagaacgtaagaaattgaaacctcgctggttagatgctcgtatatatagcgatcctcttgcattaaaagagtttaaggagttcgcagcaggtcgcaaatccttaactctaaatttaataacagagatgggtagattaccaacattcatgacacaaaagacaagagacgcactagataacttggccgtattacatactgcagaagcgggaggtcgtgcttataatcatgcgttaagtgagctacccgaaaccctagagactttacttttgttagcactcctcgctactgtaaccggtggaatctttctttttctaatgtccgggagaggcattggtaaaatgaccttagggatgtgctgcatcattactgctagtatactactatggtatgcacagatacaacctcactggatagcggcaagtattattctagagttctttctaatcgttctactaataccagaaccagaaaaacaacgaactccgcaagacaaccaactgacttacgttgttatagcaatactcactgtggtagctgcaaccatggcgaatgaaatgggattcttagaaaagactaagaaggatttaggattaggaagtattgcaacccaacaacctgaaagcaatattctagacattgacttaagacctgcatcagcatggactctttatgcagttgctaccacatttgttacaccaatgcttcgtcacagtattgaaaatagcagtgtgaatgtaagcctaacagcaatcgcaaaccaagctacagtactcatggggcttggtaaaggttggccccttagcaaaatggacataggtgtaccattattagctatcgggtgctactctcaggttaatcctataacactcactgcagcattattattactcgtagctcattatgcaataataggtcctggtctccaagctaaggctacacgagaagcacagaaaagagcagcggcaggcataatgaaaaatccaaccgtagatggtataactgttatagatctcgatccaataccatacgatccaaaatttgaaaagcaattgggacaggtgatgctcctaatactttgcgtgacacaagtattaatgatgcggaccacatgggctctgtgtgaggccttgacactggcaacgggaccaatctcaacgttgtgggaagggaacccagggcgattttggaatactactatagcggtctccatggccaatatttttagaggttcctacctagctggtgcaggactattatttagtataatgaagaacacaacaaatacacggaggggcacgggcaacatgggagaaaccttgggcgaaaagtggaaatctaggctaaatgcattaggaaaaagtgaatttcaaatatataaaaagagcggcatccaagaagtagatcgaacgttagcaaaggaaggcatcaaaagaggcgagactgatcaccacgcggttagtagaggaagtgctaagttgaggtggtttgtggaaagaaatatggtaactccagaaggtaaagtagtggatctaggatgtggaaggggaggatggtcttattactgtgggggacttaaaaacgtacgagaggtaaaaggcttgacaaaaggtggaccaggacatgaagaaccgatacccatgtcaacatacggatggaatctggtgagattacagagtggtgtagatgtgttctttataccgcccgagaagtgcgacactttactatgtgatataggggagagctcgccgaatccaacggtcgaagccggtagaaccctccgagttttaaatctggtcgaaaattggttaaacaataatacgcaattctgcataaaagtgttaaacccatatatgccaagcgtaatagagaaaatggaagcacttcaaaggaaatatggtggtgcacttgtccgcaatcctctgagcggaaatctcaaaaacgaaatgtattgggtatcaaatgcaagtggcaacattgtgagcagtgtcaacatgataagtagaatgctaattaatcgctttacaatgagacacaagaaagcaacctatgaacctgatgttgatttggggagtgggacgaggaatataggtatagaatcagagacaccgaacctggatataattggtaaaaggattgagaaaataaaacaggaacacgaaacaagctggcactatgaccaagatcatccgtataaaacgtgggcataccatggaagctacgaaactaaacaaacaggaagtgccagtagtatggtcaacggtgtagttaggttactgactaagccctgggatgtcttaccaacagtaactcagatggcaatgaccgataccacaccttttggacaacagagggtattcaaagagaaagttgatacgcgaactcaggaacccaaagagggtactaagaaactaatgaaaatcaccgcagaatggttatggaaagaattaggtaagaagaaaaccccacgaatgtgtacgagagaggagttcactcgaaaagttagatctaacgctgcacttggagcaatctttacagatgaaaacaagtggaaaagcgccagagaagcagtagaggacagtagattctgggagttagttgacaaggagcgaaatctccatcttgaaggaaagtgcgaaacatgcgtatataatatgatgggaaaacgagagaagaaactgggcgagttcggtaaagccaaaggaagtcgagctatttggtatatgtggttgggcgctcgcttcctagagtttgaagcattaggattcttgaatgaagatcattggtttagcagagaaaattcattgagcggtgtcgaaggcgaaggtctacacaaactaggctacatactaagggatgttagtaagaaagaaggtggagcaatgtacgcagatgatactgctggttgggatactcgtataactttagaagatttgaaaaacgaagaaatggtaaccaatcacatggaaggagaacacaaaaagctagcagaggcgatatttaaactcacctatcaaaacaaggtagtaagagtccaacgacccacgccccgcggaacagtcatggacattatcagcagaagggaccagagaggatcaggacaagtcggcacttatggactcaatacattcacaaacatggaagcgcaactaataagacaaatggagggagaaggtgtttttaaaaatattcagcacttgaccgtaaccgaagaagtggcagtacagaattggttagccagggtaggcagggaaaggttaagtcgtatggcgatatcaggcgatgactgtgtagtaaaaccccttgacgacaggtttgcaaacgcgctgacggctctaaacgacatgggtaagatacgaaaagacatccagcaatgggaaccaagcaaaggatggaacgattggactcaagtaccattctgttcacaccattttcacgaacttattatgaaagatggcagagtgttggtagtaccttgtagaaatcaagacgaactaataggcagagcgcgaattagtcagggagcaggatggagtctaagggagacagcatgtcttggaaaaagctacgctcagatgtggagtttaatgtattttcacagaagagaccttagactggtagccaacgcaatatgtagtgctgttccatcacattgggtaccaacaagcagaaccacgtggtcgatacacgccaaacatgagtggatgacaacagaagacatgctgaccgtatggaatcgtgtgtggatacgggaaaacccatggatggaggataaaactccagttgagagctgggaagaaataccctatttaggcaaaagagaggatcagtggtgcggatctttgataggcttaacttccagagcgacatgggctaaaaacatacaagcggcgatcaaccaggtacgaagtctgatagggaatgaagaatacactgattacatgccgagtatgaagagatttcggcgcgaagaagaggaagccggggttctatggtga

SEQ ID NO: 22714 - RNA, 9876 nt, synthetic construct
  misc_feature 1..9876: note = derived and/or modified CDS sequence (opt6) from DENV-2__FJ410224__SS-prME
  source 1..9876: mol_type = other RNA
tcagcgggaatgataatcatgttaattccaacggttatggctttccatcttactactagaaatggtgaaccacatatgattgtaggcattcaagaaaaagggaaatcgttgctattcaaaactgaagatggcgttaatatgtgtacattaatggcgatggatctaggtgaactatgcgaagataccgtaacttataaatgccctttactacgtcaaaatgaacctgaggatattgattgctggtgcaatagtacgtctacgtgggttacatatggaacatgcacaacaacgggagaacatagacgtgaaaaacggtcagtagctctagtccctcatgttggaatgggtttggagactagaacagagacctggatgagcagcgagggtgcttggaaacatgcacaaagaatcgaaacttggattttgagacacccgggattcaccatcatggcagctatattggcatacacaattgggactacacatttccaaagagtattaatctttatattgttaaccgcggttgcaccttcaatgacaatgagatgtattggcatatcaaatagggatttcgtagagggtgttagtggagggtcatgggtagacatagttttagaacatggtagttgtgtcacgaccatggcgaaaaacaaaccaactttagactttgaattgataaaaactgaagcgaaacagccagcaacactacgtaaatactgtatcgaggctaaactcacaaataccactaccgaaagccgatgcccaacacagggtgaaccttcactaaaagaagaacaagataaaagattcgtatgtaaacactcgatggtagaccggggatggggcaacggttgtggattgtttggtaaaggaggaatagtaacctgcgcgatgtttacctgcaagaaaaatatggagggtaaaatcgtacaaccagagaatttagaatacactatagttgttacgccacactctggggaggaacatgcagtagggaatgatactggcaaacatggaaaagaaattaaggtaacacctcagagctctataaccgaagctgaactcactggttatggaacagtgaccatggagtgttcaccaaggacaggtttggatttcaatgaaatggttctactacagatggaaaacaaagcgtggttagtacaccgacaatggttcttagacctcccactaccctggctgccaggcgcagacaagcaagagtctaactggatacaaaaggagacactcgtgactttcaaaaatcctcatgccaaaaagcaagacgtagtagtgctaggaagtcaagaaggagcaatgcatacagcattaactggggctacagagatccaaatgagttctggaaacttattattcacgggccacctaaaatgcagattaagaatggacaaactacaacttaagggaatgtcctactcaatgtgcacaggtaagtttaaggttgttaaggaaattgcagaaacacaacacggcactatagttattagggttcaatatgaaggtgatggtagtccatgtaaaattccttttgagattatggatcttgagaaaagatatgtcctgggtcggctgataactgtgaacccaatagtaactgaaaaggattcccccgtgaatatagaagcagaacctccgttcggcgacagctatatcataattggagtggaaccagggcagttgaaattaaattggtttaagaaaggaagtagtataggtcaaatgtttgagacgacaatgagaggagcgaagcgaatggcgatactaggcgatacagcatgggactttggaagtctaggaggcgtattcacttcaataggaaaagccctgcatcaagtgttcggtgcaatttatggagcagctttctccggcgtatcatggacgatgaaaattttgatcggggtgatcatcacttggattggaatgaactctaggtctactagcttaagcgtcagcttagtattagttggaacagtcacactatacttaggggtgatggtccaagcagactcgggatgcgtggttagttggaaatcaaaagaactgaaatgtggtagcggcatatttatcacagataatgtccatacatggacagaacaatataaattccagcccgaatcacctagtaaattggcatccgccatccaaaaagcacaagaagaaggaatctgcgggatacggagtgttaccagactagaaaacttaatgtggaagcaaataactcccgagttaaatcacatcttagctgagaacgaagttaagctgacaattatgacaggagacataaaaggtattatgcaagcaggaaaacgatccttaagacctcagccaaccgaattaaaatatagttggaagacctgggggaaagcgaaaatgctctcaacggaatcatataaccaaacattcttaatagacggccccgaaactgcagaatgtcctaataccaatagagcctggaatagcctagaagttgaagattatggattcggggtgttcacaacaaacatatggttaaaactaaaagagaaacaagatgcattttgcgatagtaaactaatgtcagcggctataaaagacaatagggctgttcatgcagatatggggtattggattgaaagcgcactgaatgacacttggaagatagaaaaggcaagtttcattgaagtcaaaaactgtcattggcccaaaagccatacactttggagtaacggtgtcctagaatctgaaatgataatacccaaaaatttagcgggaccagtatctcagcataattatagacctgggtaccacacacagatcgctggaccatggcatctaggcaaacttgaaatggactttgacttctgcgacggtacaactgtaattgtaacggaagattgtggaaatcgtggaccatctctaagaactactacagcgagcggaaaacttataaccgaatggtgttgcagatcatgcacactcccaccgttaagatacaggggcgaagatggttgttggtatgggatggaaatacggccgttaaaggagaaagaagaaaatcttgtcaattctctagtcacagcagggcacggacaagttgacaactttagcttaggtgtactaggaatggccctttttctagaggaaatgctaagaactcgagtcggcacaaaacatgctatcctactcgtggctgtaagtttcgtaaccttgatcacaggtaacatgtcttttaaagatctagggagggtcgtagtcatggtaggggctacaatggctgatgacatagggatgggggtaacatatttagctctgttagcagcattcaaggttagacctacctttgcggctggcttgttattgagaaaactaaccagtaaggagttaatgatgacaaccatcggcatagtactactttcgcaatcaacaattccggagacggtattggaattgacagatgcccttgcactaggaatgatggtactaaaaatcgtcagaaatatggaaaaatatcaacttgccgttactataatggcgattctatgtgtccctaatgctgtcattcttcagaacgcgtggaaggtgtcatgcacaattttagcagtagtttcagtcagtcctctattacttacaagtagtcaacaaaagacggattggatccccctggcactaacaatcaagggcttaaacccgacagctatatttttaacaacactaagtagaacaaacaaaaagagatcttggccgctaaacgaagctataatggctgttggaatggtttcaattttagcatcaagcctattgaaaaatgatatacctatgacaggtcccctagtcgcaggcggattactaaccgtatgttatgtgttgacaggacgatcagctgatctggaactcgagagagctaccgacgtgaaatgggaagaccaggctgagatcagtggtagttcaccaatactgtctattacgatatcagaagatggaagtatgtcaattaaaaatgaagaagaagaacaaaccctgaccattttgataaggacagggctattagttataagcgggctattcccaattagcatccccataacagcggcagcatggtacctatgggaagtcaagaaacaaagagccggtgtattatgggatgttccgtcaccgcccccgatgggcaaagcagaacttgaagacggggcatataggataaaacaaaaaggaatacttggatactcccaaataggtgcaggagtatacaaagaaggcacgtttcacacaatgtggcatgttacgaggggcgcagtgctaatgcataaaggaaaacgaattgaaccgagctgggcggacgttaagaaagatctgatttcatacggcggaggttggaaacttgaaggagaatggaaagaaggagaagaggtgcaagtcctagctttagaacctggcaaaaaccctagagctgtacaaacaaagcccggtcttttcaaaaccaatacaggcactataggtgctgtatcattggacttctcgccaggcacgtcaggctcccctataatagataaaaagggcaaagtagttggattatatggtaacggcgtagtaacaagaagcggagcatacgtatcagcaattgcccaaacagaaaaatcgatcgaagacaaccctgagatagaggatgatatatttcgaaagcggagattgacaataatggatttgcatcctggggcgggaaaaacaaagcgatatctcccggccatagtccgagaagcgataaaaagaggacttagaactttaattcttgctccgacccgcgtggtagcagcggaaatggaagaggcgcttcgcggattaccgattagatatcaaacacccgcgataagggccgagcacacaggtcgtgagatcgtagatctaatgtgtcatgctactttcacaatgaggctactttcgccagtacgagtaccgaactacaacctaattatcatggacgaggcccattttacagaccctgcctcgatagcagctcgaggttatatatcaacacgcgttgaaatgggcgaggcagctggaatatttatgacagctacaccccctggctctcgtgacccttttccccagagtaatgcaccaataattgatgaggaaagggagatccctgaacgttcctggaactcaggccatgaatgggtgacagatttcaaaggaaaaactgtgtggtttgtgccgtcgataaaagcaggcaacgatatcgccgcttgtctaaggaaaaatggtaagaaagtcatacaattaagtagaaagacattcgactcagaatacgtaaaaacaaggaccaacgactgggattttgtcgtgactactgacatttctgagatgggagcgaactttaaagcagaacgggtcatcgaccctaggcgttgtatgaaaccagtaattcttacagacggtgaagaaagggtcatccttgcaggtcctatgccagttacgcattcctcggctgcacaaagaagaggaaggataggtagaaacccaaagaacgagaatgaccaatatatctatatgggagagcctttggaaaatgacgaagattgtgcacattggaaggaagctaaaatgttattagacaatataaacacaccagaagggataataccctccatgttcgagcctgagcgtgagaaagtagatgccatagacggagaatatcgcttaagaggtgaggcaaggaaaacgtttgtagatttaatgcgtaggggtgatttaccagtatggctagcatataaggtagcggcggaaggaatcaactatgctgatcgtagatggtgtttcgatggcattaaaaacaaccaaatattggaagagaatgtggaagtagagatatggacgaaagaaggggaaaggaagaaattaaaaccaagatggctagacgctagaatctacagcgatccacttgcattaaaagaatttaaagaatttgcggcaggcagaaaatcactcacattaaacctgataacagaaatgggaagattgcctacatttatgacccagaaaactagggacgctttagacaacctcgcagttctgcatacggcagaagcagggggccgtgcttataatcatgcactaagcgaactaccggaaacattagaaacacttttactattaacattattggcaactgttacgggaggcatatttctatttttaatgtctggacgggggataggaaagatgacgttaggcatgtgctgtattataacggcatccatactcttatggtatgcacaaatccaaccacattggatagcggcatcaatcattctagaatttttcctaatcgttttactaataccagaacctgaaaaacaaaggaccccgcaagataatcaattaacttatgtagtgatagcaatattgacagtggtagctgccacgatggccaatgaaatgggctttcttgagaaaactaagaaagatttgggcctaggaagtatcgctactcaacaaccagaatcgaacatactggacatagatctgcgtccagcttccgcttggaccctctacgcggttgccactaccttcgtaacccctatgctgcgacactcaattgaaaactcatcggtcaatgtcagtttaactgcaatcgcaaatcaggcaacagtgttaatggggttaggaaaaggatggccactgtcgaaaatggatataggagtaccacttctagcgataggatgctactcccaagtcaaccctataactcttacggctgctctattattattagtcgctcattatgccataataggaccggggctgcaggcaaaggctacgcgagaagcacaaaagcgcgcagcagcaggaattatgaaaaatccaacagtcgatggaattacggtaattgatctagatcccataccttatgatccaaaattcgaaaaacaattgggacaagttatgctattaatcctctgtgtcacccaagtcttaatgatgagaacaacatgggccctttgtgaagccctcacactggctaccggaccaataagtaccctttgggaaggaaatccgggacgattctggaatacaacgattgcggtatcaatggctaacatattcagaggaagttacctagcgggggcaggtctactattttctatcatgaaaaatacaacaaatacccggcgcggtacaggtaatataggagaaacattgggtgaaaagtggaaaagcaggttaaacgcactggggaaaagtgaatttcaaacttataagaaatcaggaatacaagaagtagatagaaccttagcaaaggaaggcatcaagcggggtgagacagatcatcatgccgtgtctcggggaagcgcaaaacttcgatggtttgttgaacgtaatatggtaactcccgaagggaaagtagttgatttaggatgtggtagaggtggttggtcttactattgcgggggcctgaaaaatgttcgagaggtgaaagggctaactaaaggaggcccggggcatgaagaaccgattccgatgtcgacgtatggatggaatttagtcagacttcagagtggagtagatgtgtttttcattccaccagaaaaatgtgatacattgctatgcgatataggtgaatcatctcccaatccaaccgtggaggccggacgaacactgagagtgctaaatctagtagaaaattggctaaataataatactcagttctgcatcaaagtattgaatccctacatgccatcggtaattgagaaaatggaagcacttcaaagaaagtacggtggagccctcgtcaggaatcctttatcacgaaactcgacccatgaaatgtattgggtaagcaacgccagcggaaatattgtatcctcagtcaatatgatcagcagaatgctaattaatagatttacaatgagacacaagaaggctacttatgaaccggatgttgatctgggcagtggaacacgtaacatcggaatcgagtcagaaattcctaacctagatataattggaaagagaatcgaaaagattaaacaagaacatgagacaagttggcattatgaccaagatcatccatacaaaacgtgggcatatcatggtagctatgaaactaaacagacaggatcggcctcaagcatggttaacggcgtagtaagactacttactaaaccatgggatgtcctaccgacagtaacacaaatggcaatgacagacacgacaccctttggtcaacaaagggtattcaaggaaaaggtagatacaagaacacaagaaccgaaagaaggaacgaagaaattaatgaaaatcacagcagagtggctgtggaaagaactaggtaaaaagaaaactccgcgcatgtgtacaagagaagagttcacacgtaaagtcagatccaatgctgctcttggagcaatatttacggatgaaaataagtggaagtctgcaagagaagcggtagaagacagtcgattctgggagttagtcgataaagagaggaatttgcatttagaaggaaaatgcgaaacgtgcgtctacaacatgatgggaaaacgagagaagaaacttggagaatttggaaaggccaagggaagtagagcaatatggtacatgtggctaggagcgaggtttctagaatttgaagctctaggatttctcaacgaggaccattggtttagtcgtgaaaattctttatccggggtagaaggcgaagggcttcataaacttgggtacattttaagggatgtcagtaagaaagagggtggagcaatgtacgccgacgatactgcgggctgggacacacgaataactttggaggatctcaaaaatgaagagatggtaacaaaccatatggaaggcgaacataagaaactggcagaagccatattcaaattaacatatcaaaataaagttgttcgagtacaaaggcccacccccaggggaacggtaatggacatcataagcagaagagaccaacgtggatcaggacaagtgggtacatatggattgaatacgttcactaacatggaagcacagctaattagacaaatggaaggcgaaggtgtgtttaagaacattcaacatctaaccgttacagaggaagtagctgtacagaattggctcgccagagtaggaagggagcggctgagcagaatggcaataagtggcgatgattgtgtagtaaagcctttagatgaccgatttgccaatgcactaactgccctaaatgatatgggcaagatcagaaaagatatccagcaatgggaaccttctaagggatggaacgattggacacaggtaccgttttgttctcaccacttccatgaactaataatgaaggatggtagggttctggtagttccctgcagaaaccaagacgaattaattggacgcgctagaatcagtcaaggagcaggctggagtctgcgagagacggcatgtttaggcaagagttatgctcaaatgtggagtttgatgtactttcaccgaagagacctacgtttagcagcaaatgcgatttgctccgcggttccaagtcactgggtgccaacatcccgtacgacctggagcatacacgctaaacatgaatggatgactaccgaagacatgttaaccgtatggaacagagtgtggattagggaaaatccatggatggaggataaaacgcccgtcgagagttgggaagaaataccctatctaggtaagcgtgaagatcaatggtgtggatcacttatagggttgacctctagagctacatgggccaaaaatatacaggccgctataaatcaagtacgaagtctgataggaaacgaagagtacaccgattacatgccgtccatgaaacgttttcgacgagaggaagaggaagccggagtactgtggtaa

SEQ ID NO: 22715 - RNA, 9876 nt, synthetic construct
  misc_feature 1..9876: note = derived and/or modified CDS sequence (opt6) from DENV-2__FJ461321__SS-prME
  source 1..9876: mol_type = other RNA
tccgctggtatgataataatgctaattcctacagttatggcatttcatctgacgactagaaatggggaacctcatatgatagtaggcatacaagagaaaggcaagagtctgctgtttaagacggaagatggagtaaatatgtgtacactcatggcaatggatctcggagaattatgtgaggatacaataacatataagtgcccacttttaagacaaaatgaacccgaagatatagattgttggtgcaactcgacatcaacgtgggttacgtatggcacttgcacgacaactggcgagcaccgcagggaaaaacgatcggttgcgttggtcccacatgttgggatgggattagaaacaagaacggaaacttggatgagttctgaaggagcatggaaacatgcacaaagaattgagacatggatcctaagacacccagggttcacaataatggcagcgattctcgcctacacgataggtactacacatttccaaagagtgctaatattcatcctgttaactgcggttgccccaagtatgaccatgcggtgtataggcatttctaatagagatttcgtcgaaggagtatcaggtggttcgtgggtagatatagttcttgaacatggaagttgtgttacaacaatggccaaaaacaaaccgaccttagactttgagttaattaaaacggaagctaaacaacctgccacgttacgtaaatactgcatagaagccaagcttaccaataccacaacagaaagtaggtgtccaacgcagggcgagccctcgttaaaagaggaacaagataagcgatttgtctgtaaacatagtatggtggatcgcggatggggcaatggctgtggattgtttggtaaaggtggaatagtaacatgtgccatgtttacctgtaaaaaaaatatggaaggtaaaatcgtacaaccggaaaatttagaatacacgattgtagtgactccacatagcggggaagaacacagtgtcggcaacgataccgggaaacacggtatggaaataaaagtaacacctcaaagttctataactgaagcagaactcactggctatggcacagttaccatggaatgttctccccgaacaggacttgactttaatgagatggtacttcttcaaatggaaaacaaggcatggttagtacacaggcagtggtttctagaccttccactaccatggcttcctggcgcagataagcaagaaagtaattggatacaaaaggagacattagtaactttcaagaatcctcacgcgaaaaaacaagatgttgtggtgctaggatctcaggaaggagccatgcacacggcactgaccggcgctacagagatccaaatgtcttcaggaaatctattatttaccggccatttgaaatgtaggttaaggatggacaaactgcaattaaaagggatgagttacagcatgtgtactggaaagtttaaagtagttaaagaaatagcagaaacgcaacatggcaccatagtcatcagagtacaatacgaaggagatggaagcccttgtaaaataccatttgaaattatggacctagagaaacgatatgtattgggtagactcattactgtaaatcctatagtcaccgagaaggactcaccggttaacatagaggcggagccaccgttcggggacagttacattattataggagttgaaccaggacaactcaaattaaactggtttaagaaaggatccagtataggacaaatgttcgagacgacaatgagaggcgctaaaaggatggcaatacttggcgatactgcatgggatttcggaagtttgggaggggtatttacttcaatcggtaaagccttgcatcaagtattcggagcaatatacggagcggcttttagtggagtaagttggacaatgaaaatactgatcggtgtgataatcacgtggataggaatgaacagccggagtacctcactaagtgtaagcctcgtactagttggtatagttacactatatctgggagtgatggtacaagcagattcgggttgtgtagtaagttggaagaataaagagcttaagtgcgggagcggaatttttataacagataatgtacacacatggacggaacagtacaagttccaaccagaatcaccgtcaaaactcgcgtcagctatacaaaaggcgcaagaagagggtatatgtggaataagaagtgtcactcgcctagaaaacctgatgtggaaacagataaccccagaacttaaccatattctcgcggaaaatgaggtcaaacttacgatcatgactggagatatccgtggtattatgcaggcaggtaagagaagtcttcgaccacagcctacggaattaaaatactcatggaagacctggggtaaagccaaaatgctcagcacagagtcatacaatcaaacatttctaattgacggacctgaaacagctgaatgtccaaatacgaatagggcttggaattcactagaagtggaggactatggattcggcgttttcactacaaacatttggcttaaacttaaagaaaagcaggatgcattttgtgatagcaagctaatgagtgcggcaattaaggacaaccgtgcagtacacgcagatatgggttattggatagaaagcgcactcaacgacacttggaaaatagaaaaagcaagttttattgaagtcaagaattgtcactggccaaaatcgcatacattgtggagcaacggagtcctagagagtgagatgattataccaaagaacttggctggtcccgtgtcccaacataactaccggccaggttaccacacgcaaattgcgggaccttggcatttagggaaacttgagatggacttcgatttctgtgacggaactactgtaattgtgacagaagattgtggtaacaggggtccgagtttaagaacaacaacagcatccggaaagcttattacagaatggtgttgcaggagctgcactttgcctcccctaaggtatagaggagaagatggatgctggtatggaatggagatccgacccttaaaagaaaaggaagaaaatttagtaaacagtttggtcacagcgggccacggccaggtagataattttagtttaggagtattagggatggcactctttttagaagaaatgcttcgcacaagagtagggacaaagcatgcaatcttattagtagctgtaagtttcgtcaccttaataacaggaaatatgtcctttaaagacttagggcgtgtagttgtcatggtaggagctactatggcggatgacatcgggatgggagttacatatttagcactattggcggcattcaaagttcgaccaacatttgctgctggattgttattaaggaagcttacgtccaaagaattgatgatgaccactattggaattgtattgttaagtcaatccactattcctgaaacagtcctagaactcacagatgcactcgctttaggcatgatggtgctgaagattgtacgtaacatggaaaaatatcaacttgcagtaaccattatggcaatactatgtgttcctaacgcggtaattcttcaaaatgcgtggaaagtttcatgtacaattttagccgtagtgagtgtgtctccactgcttttaacctcgtcacagcaaaaaaccgactggatacctttggcactcacgattaaaggtttaaatccaaccgcgatatttttaacgactctaagccgtacgaataagaaaagaagctggccgctaaacgaagcgattatggcagttggaatggtatccattctggcaagctcattgttaaaaaacgatataccaatgacgggacctttagtagcggggggtcttttgactgtatgttatgttcttacgggaagaagtgcggacttagaactagaacgggctactaatgtgaaatgggaggaccaggcagaaataagtggttcaagtccaattctctcgataactatctccgaagatggcagcatgagtataaaaaatgaggaagaagaacaaacactaacaatattaattagaacagggctattggtaatttccggactattccctatatcaatacccatcactgctgcagcttggtacctatgggaagttaaaaaacagagagccggtgtactttgggatgtaccatctccccctcctatgggcaaagcagaactggaggatggggcgtataggatcaaacaaaaagggatcctaggttactcccaaattggggcgggtgtatacaaagaaggcacctttcatacaatgtggcacgtgacacgaggagcggtacttatgcataaagggaaaagaatagagcctagctgggcagatgtcaaaaaggatctcataagctacggtgggggttggaaactagaaggcgaatggaaggaaggcgaagaagtgcaagtattagccctagagcctggaaagaatccaagagcagtgcaaacaaaacctgggctattcaaaaccaatacagggacaataggagctgtatcattagacttttcaccgggaacctcggggtcgccaattatagacaagaagggtaaagtggtcggcctctatggtaatggcgtcgtcacacgaagtggagcatacgtatcggcaatagcacaaaccgaaaaatcgatcgaagacaaccctgaaatagaagatgatatctttagaaaacgacgtttaacgataatggatctgcatccaggggcaggaaaaactaaacgatatcttccagcgatagtaagagaagccattaaacgcggacttcgtacactaatactggctcccactagagtagtcgcggcagaaatggaggaagcattacgaggattaccaattagatatcaaacacccgcaatcagggcggaacatacaggacgagaaattgtcgatctgatgtgtcacgctacatttacaatgcgccttctaagtcctgttagagttcctaattataatttgatcattatggacgaagcccattttacggatccagcatcaattgctgcacgaggctatatatcgacaagagtagagatgggtgaagcagcaggtatttttatgactgcaactccgccaggatcacgagacccatttccacaaagtaatgcaccgatcattgatgaagagcgggaaatacctgaacgtagctggaatagcggacacgaatgggttacagattttaaagggaaaacagtttggttcgtaccttcaattaaggccggaaatgacattgcagcttgcctacggaaaaatggaaaaaaagtgatccaactatcaagaaaaactttcgattcggagtacgtaaaaacgcgcactaacgattgggactttgtggttactacggacatttcggaaatgggagcaaattttaaggccgaacgagtaatagatcctagacgctgtatgaaaccagtaatattaacagatggtgaagaaagggtaatcttggctggaccaatgcccgttacacattcatccgcagcacaaagaagaggaagaataggtagaaaccctaagaatgaaaacgatcagtacatatatatgggtgaaccattggaaagcgacgaggactgtgcccactggaaagaagccaaaatgctcctagataacattaacactccagaaggaatcataccttcaatgttcgaaccagaaagggagaaggtagacgccattgatggtgagtacaggttacgtggagaagctaggaagacttttgtagatctaatgagaagaggtgatttacctgtctggttagcttataaagttgcggctgaaggtataaattatgcagatagaagatggtgctttgatggaattaaaaataaccaaatattagaggaaaatgtagaagtagaaatctggacgaaagaaggtgaacgaaaaaaattaaaaccccgctggctcgacgctagaatatattcagacccactcgcacttaaagaattcaaggaatttgcggcaggaagaaagagcctaacccttaacctgataacggaaatgggcaggctcccaacttttatgactcagaagacgcgggatgccctggataatctagcagtgcttcatacggcagaagcaggcggaagagcgtacaaccacgcgctatcagaactcccggaaaccctagaaacactactccttttaactctacttgcgacggtgaccggcggcattttcttgtttctgatgagcggcaggggaataggaaaaatgaccctgggaatgtgttgcattattaccgcttctatattactatggtatgcccagatacaacctcattggatcgcagcttcaattatactggagtttttcttaatagtgttattaataccagagcccgagaagcagcgtacgccacaggataatcaactaacgtacgtcgtaatagctattttaacagtagtagcggctaccatggcaaacgaaatgggtttcttagaaaaaacaaaaaaggatttaggattggggagcattgcgacacagcaaccagaaagtaatatacttgatattgacctaagacccgcatcggcgtggaccctgtacgctgtagctacaaccttcgtaacacctatgttacgtcattcaatagagaattccagtgtaaacgttagcttaacagcaattgcaaatcaagccacagtcttaatgggacttggtaaaggctggcctttaagtaaaatggatataggggtgccgctattagcaataggatgttactcacaggtaaatccgataactttaacggcggcattactactactagtcgcgcattacgccataattggtcccggccttcaagcaaaagcgactcgggaggcccaaaaaagagcagctgccggaatcatgaaaaatcctaccgtagatggaataactgtcatagacctagatccaattccttatgatcctaaatttgaaaaacaattgggacaggtgatgttattaattctttgtgttacccaggtcttgatgatgcggactacatgggccttgtgtgaagcgctaactttagcaaccggaccgataagcacattgtgggaaggaaatccgggtcgcttctggaatacaactattgctgttagcatggctaatattttcagaggatcttatttagctggagcaggcttactattctcgataatgaagaatacaacaaatactaggcgaggaactggtaacataggagaaacgttaggagaaaagtggaagtctcgacttaatgctttggggaaaagtgaatttcaaatctataaaaaatcaggaattcaagaagtggatcgaacattagccaaagaaggtataaagagaggagaaaccgaccatcatgcagttagcagaggatcagcgaaattacgttggtttgtagaaaggaacatggttacacccgaggggaaagtagtagatcttggatgcggtagagggggttggagttattactgtggaggattaaagaatgttagggaagtgaagggattaacaaaaggcggtccaggacatgaagagcccatacccatgtcaacgtacggctggaatctcgtgcgactgcaatccggcgtagacgtgttctttattccaccggaaaagtgtgataccctgttatgtgacataggcgaaagttctcccaatccgacagtagaagcaggaagaaccctaagagtgcttaatctagtggaaaactggctaaataataatactcaattttgtattaaagttttaaatccgtatatgccatctgtaatcgagaaaatggaagccttacagagaaaatatggaggagccctggtaagaaatccattgagcagaaattctactcatgaaatgtactgggtttcaaatgcttcgggaaatatcgtatcaagtgtaaatatgataagtcgcatgctcataaatcggttcactatgagacacaagaaagcaacctatgagccggacgttgatttgggcagcggaactagaaacataggaatcgaaagcgaaatacctaatctagatataatagggaaaagaattgagaaaataaaacaagaacacgaaacatcatggcattatgatcaagaccacccatataaaacgtgggcctatcatggtagctatgaaacaaaacaaaccggaagtgcttcaagtatggtaaacggggttgtccggttactaacaaagccatgggatgttctcccaacagttacacaaatggctatgacagatacaacaccattcggccagcaaagagtattcaaagaaaaagtagatacacgaacccaagaaccaaaagaagggacaaaaaaacttatgaaaatcacagcagaatggttatggaaagaactaggtaagaagaagacaccaagaatgtgcacaagagaagagtttactcggaaagtacgatcgaacgcagctctgggggcaatctttaccgacgaaaataaatggaaaagcgcaagggaagctgttgaagattcacgtttctgggagctagtcgataaagaaagaaatttacacctagaaggcaaatgtgagacgtgtgtatataacatgatgggaaaaagagagaaaaagctgggagagtttgggaaagcaaaaggcagccgcgccatttggtatatgtggcttggtgctcgttttttagaattcgaagcactaggattcttaaacgaagatcactggtttagccgggagaatagcttatccggagtagagggagagggattgcacaaacttggctacatcttacgagacgtaagtaagaaagagggaggagcaatgtacgcagacgacacagcgggctgggacacaagaataacgttggaagacctcaaaaacgaagagatggtaacaaaccacatggaaggggagcacaagaaattagcagaggcaatttttaaattaacgtatcaaaataaagttgtaagagttcaaagaccgacacctcgaggaaccgttatggatataatatcacgtagagaccaacgtggctcaggtcaagtcggaacatacggtctaaacaccttcaccaatatggaagcacaattaattcgtcaaatggaaggagaaggagtgttcaagaatatacaacaccttactgtaactgaagaagttgcagtacataactggttggccagagtagggagggaacgcttgtcaagaatggccattagtggcgatgattgcgtagtaaaaccactagacgataggtttgcaaatgcactgacagctttaaatgacatgggaaaaatacgcaaagacatccaacaatgggaaccatccaagggatggaacgactggacacaagtaccattttgctcacaccacttccatgagctgataatgaaagacggaaggattctcgtagttccttgtagaaatcaggatgaactaatagggagagcccgaataagtcaaggagcaggctggagcctcagagaaactgcgtgtttaggcaaatcatatgcacaaatgtggtccttgatgtacttccacagaagagatctaagactcgcagcaaatgctatttgttcagcagtgccttcacactgggtacccacatcaagaaccacatggtcaattcacgctaaacatgaatggatgacaacggaggatatgctgacggtatggaacagggtgtggatccgagaaaacccatggatggaagataaaactcctgtagagtcgtgggaagaaattccttacctcggcaaacgggaagatcaatggtgcggatctttaattggcctgacgtcaagggccacttgggctaaaaatatacaagcagctatcaaccaagtgcgcagccttatcgggaatgaagaatataccgattacatgcctagtatgaaaagattccgacgcgaagaagaggaagctggggttctatggtaa

SEQ ID NO: 22716 - RNA, 9876 nt, synthetic construct
  misc_feature 1..9876: note = derived and/or modified CDS sequence (opt6) from DENV-2__FJ410228__SS-prME
  source 1..9876: mol_type = other RNA
agtgcaggaatgataattatgcttatacccactgttatggcttttcatctgaccactcgtaatggagaaccacatatgatagtcgggattcaagaaaaagggaaatctcttttgtttaaaacagaagatggggtaaatatgtgtacattaatggctatggacttaggagaactctgtgaagatacgataacatataaatgccccctgctacgtcaaaacgaacctgaagacatagattgctggtgtaatagtacatcaacatgggtgacctatggaacgtgcacaacaactggggaacatagacgtgaaaaacggtcggtagcactggtgccccacgtcggtatgggtttggaaacacgcacagaaacctggatgtctagcgaaggagcttggaaacacgcacaacgcattgaaacatggattctgcgacaccctggattcacaattatggccgcaattctggcgtacactataggtacgacgcattttcagagggtactaatattcatactacttacagctgttgctccttcgatgacgatgcgttgcattgggatatctaatagggatttcgtagaaggagttagtggtggatcttgggtagacatagtacttgaacacggaagttgtgtaacaactatggcgaaaaataaaccaactctggattttgaattaataaaaaccgaagctaaacaaccagcaactctcagaaaatattgtatcgaagcaaaattgacaaatacaacgactgaaagtcggtgtcctacacaaggtgaaccgtcattaaaagaagaacaagacaaacggtttgtctgtaaacattcaatggtggacagaggatggggaaacgggtgtggtctcttcggaaaaggaggaatcgtaacatgtgctatgttcacttgtaagaaaaacatggaaggaaaaatagttcaacctgaaaatttggaatacacgatcgtagtcactccacacagtggagaagaacatgctgtaggtaacgatacgggaaaacacggaatggaaatcaaagtcacaccacaatcgtcaataacagaagccgaacttactggctatggtacggtaacgatggaatgtagcccaagaactggattggatttcaacgagatggtacttttacaaatggaaaacaaagcctggttggttcataggcaatggtttctagacctcccattaccttggcttcctggcgccgacaaacaagagtcaaactggatacaaaaagaaactcttgttacgttcaaaaatccccatgctaagaaacaagatgttgtagtgttaggctcacaagaaggtgcaatgcacacagccctaacgggagccactgagatacagatgagctcaggtaatttactttttactggccacttaaaatgcagactaagaatggacaaattacaattaaaaggaatgtcttattcgatgtgcacagggaaatttaaagtagttaaagaaatcgcagaaacccaacacgggaccattgtaattagagtacaatatgagggagatggcagcccatgtaaaataccgtttgagatcatggatctagagaaaaggtatgtcctgggccgactcattacagtaaatcctatagtcacggaaaaagattctcctgtcaatattgaagcagaaccaccctttggagattcttacatcataataggcgtagaaccgggacaactcaaattgaactggtttaagaaaggatcatcgattggccaaatgttcgaaactacaatgaggggcgcaaaacgtatggcgatactaggagacactgcttgggattttggttcattaggaggagtatttacgagtattggtaaagcacttcaccaagtctttggcgctatatacggagcagcgtttagtggggtctcctggaccatgaaaattttaattggcgtcatcataacttggataggaatgaactcgagatctacaagcctcagtgtgagtttagtactcgtcgggatagttacgctctatttgggtgtaatggttcaagcggacagtggttgtgtagtcagctggaaaaataaagagttaaaatgtggaagcgggatctttataacagacaatgtgcatacatggaccgaacaatataaatttcaacctgagtcgccttcgaaattagcatcagccatccaaaaagcccaagaggaaggaatctgtggcattagatcagtgacacgcttagaaaatctcatgtggaaacaaattacgcccgaactaaatcatattctggccgaaaacgaggttaaactaacaataatgacaggggacattagaggaattatgcaggcaggtaaacgtagcttaaggccacaaccgacagagctaaagtacagctggaaaacatggggtaaggctaaaatgctgagcacagaaagctataatcaaactttcctaattgatggcccagaaacagcggaatgtccaaatactaatagagcatggaactcgttggaagttgaagattatggatttggggtattcactacaaatatttggctgaagttaaaagaaaaacaagacgcattctgtgactctaaactaatgtcagcggcaattaaagataaccgagcagtacatgcagatatgggctattggatagaatcagcattaaacgatacttggaaaatagagaaagcatcttttattgaagtcaaaaactgtcactggccaaagtcgcacactctgtggagtaacggggtactcgaatctgaaatgataatacccaaaaatttagccggtcctgtatcacaacacaattaccgaccgggataccatacacaaatagctgggccatggcatcttggaaaacttgaaatggactttgacttctgtgacgggacaactgtcatagtaacagaggattgtggaaacagagggcccagtctacgcacaaccacagcatcaggaaaactaataacggaatggtgttgtaggtcatgcacacttccgccattaagatatcggggagaagatggatgttggtatggtatggagattcgtccattgaaagagaaagaagagaacttagtaaattccctagttaccgccggtcatggtcaagtagataactttagtcttggagtattaggaatggctctatttttggaggaaatgcttcggactcgagtaggcaccaaacacgctatattacttgtcgctgtatcatttgttacgttaataacaggaaatatgtcttttaaggatcttggcagagtagtagtaatggttggagccacgatggctgatgatattggaatgggagtaacgtacttagcattactggcagcattcaaagtaagaccaacgttcgcggcaggattactgctgagaaaactcacatcaaaagaacttatgatgacaactataggcattgttttgttatcacaaagtacaatacccgagacggtattggaactcacagatgctctcgcacttggaatgatggtactaaaaattgtgagaaatatggaaaaatatcaattagcggtaacaattatggccattctttgtgtgccaaatgccgtaattcttcaaaatgcctggaaggtaagctgtaccatactcgctgtcgtcagtgtatcaccattactacttacctctagtcagcagaaaacagattggatcccgctggcgctgacgataaagggacttaatccaacagcaatctttttaacaactctaagcagaactaataaaaagcgatcatggccactaaatgaggccattatggccgtcgggatggtatctatacttgcttcaagccttcttaaaaatgacatcccgatgactgggccattagtggccggcggtctcctaacagtttgttatgtattaacaggacgatcggccgatttggaattagaacgagctactgatgttaaatgggaggaccaagctgaaatctcaggttcaagtcccatattatctatcacaatatcagaagacgggtccatgtcaatcaaaaacgaagaggaagaacaaactctcacaattctgataagaactggactattggtgatatccggactatttcctatatcaattcctataaccgcagccgcatggtacctttgggaagttaaaaagcaacgagcaggcgtgttatgggatgtcccaagtccacctccaatgggcaaagcagagttagaagatggagcgtatcgaataaaacaaaagggcatactaggctatagtcaaatcggagcgggcgtatacaaagagggtacatttcatactatgtggcatgtgacacgaggcgctgtccttatgcataagggaaaaagaatagagcccagctgggccgatgtcaagaaagacctcatttcttatggaggtggatggaaattagaaggcgagtggaaagaaggagaagaagtccaagtactagctttagagccgggcaaaaatccacgagcagtacaaacaaaacccggactcttcaaaacaaatacaggtactataggagcagtgagtttagacttctcaccgggaacaagcggcagtccaataattgataagaaaggaaaagtagtggggttgtatggaaacggagttgtaacgagatcgggagcgtacgtctcagctatcgcacaaaccgagaaatctattgaagacaaccctgaaatagaagatgatatattccgcaaaagacgattgaccattatggatttacatccaggagcaggaaaaacgaaacgatatttgccggctatagttcgtgaagccattaagagaggtctaaggacactgatattagccccaactagagtcgtagcagctgaaatggaagaagcattaaggggattacctataagataccagactcctgctataagggccgaacacacaggcagagaaattgtagatctaatgtgccacgcgacatttacaatgcgactgctttctcctgttagagtaccaaactataatctgattataatggatgaagcacattttacggacccagcgtcaatagccgctcgtggttacatatcgacgcgtgtggaaatgggagaggccgcaggaatattcatgacagcaacaccaccaggctcccgggatccgtttccccaatctaatgcaccgataatagatgaagaaagggaaataccagagcggtcctggaatagtggtcacgaatgggtgacagactttaacgggaagaccgtatggttcgttccgagtattaaggcaggtaacgatattgcagcatgtctcaggaagaacggcaagaaagttatacaactatcacggaaaacatttgattcagaatacgtgaaaacaaggacaaatgattgggacttcgttgtaacaacagatataagtgaaatgggtgcaaatttcaaagctgaaagagtcatagatccacgcagatgtatgaaacccgtgattctaaccgacggcgaagaaagagttattttagctggcccaatgcccgtgacacattcgtcagccgctcaacggcgcggtcggattggacgaaatccaaagaacgagaatgatcaatacatctatatgggagaacctttggaaaatgatgaagactgtgcacattggaaagaagcaaaaatgctactagataacataaatacaccggaaggcatcataccttctatgtttgagccagaaagggaaaaggttgatgctatagatggagaatatcgactaagaggtgaagctcggaagacatttgtagatctcatgagacgtggggatttaccggtatggttagcctataaagtcgcagctgaagggattaattatgcagatagaagatggtgctttgacggaatcaaaaacaaccaaattttagaagaaaatgtagaagtagaaatctggacgaaggaaggggaaagaaagaaattaaaaccgaggtggcttgacgctaggatctattcggatcccttggcactaaaagagttcaaagagttcgctgccgggagaaaatcccttacattgaatttaatcacagaaatgggaagattaccaacttttatgacacagaaaacgagggatgctttagacaaccttgcggtcctccacaccgcagaagcaggaggcagggcatacaaccacgccctttcagaattacctgaaacgttggagaccttgctacttcttactcttctcgcgacagttaccggaggtatctttttatttctaatgtctggtagaggaatagggaaaatgacacttggaatgtgttgtataatcactgctagcatactcctatggtatgctcaaatacagcctcattggattgccgcatctattatcttagagttctttttgattgttctattaataccagaacctgagaaacagcgaactccacaagataatcagttgacttatgtggtaatcgcaattctaacggtagtggctgccacaatggcaaatgagatgggtttcttagaaaagacaaagaaagacttgggactgggtagcatcgcaacccaacaaccggaatctaacatactagacatagatctaagaccggcaagcgcctggacattgtacgccgtagcgaccacattcgtaacgcccatgctacgacattctatcgaaaactcgtctgtgaatgtttcactaacagcaatagctaatcaagcaacagtcttgatggggctaggaaaaggttggcctttatctaaaatggatataggtgttccattgttagctattggctgttattctcaggtaaatccaattaccctaacggctgcattactgctactggttgcccactacgctataataggcccaggcttacaagctaaagctactcgtgaagcccagaaacgagccgcggcaggaataatgaagaatcctacagttgatggtataacagtcattgatctagacccgatcccgtatgacccgaaatttgaaaaacaactgggacaggtgatgcttctaatactatgtgtgacgcaagtcttgatgatgcggactacttgggcattatgcgaggctttaacgttagctactggacctataagtactttatgggaaggaaatccaggacgattttggaacaccacaatagcagttagcatggcgaacatatttagaggttcctatctagcaggagcagggttattatttagtattatgaaaaacactacaaatacacgtcgcgggactggaaacataggagaaactctaggggaaaaatggaaatcgcgactcaatgcattaggtaagtccgagttccaaatatataaaaagtcgggtattcaggaagttgatcgcaccctggcaaaagaagggatcaagagaggtgagactgaccaccacgctgtaagccgtggtagtgcaaaattaaggtggttcgtagagcgaaatatggtaacgcctgaaggtaaagtggtagatcttggctgtggacgaggaggatggtcttactattgcggaggtcttaaaaacgttagagaggtaaagggtctaacaaaaggtgggccaggtcatgaggaaccaataccaatgagcacctatggatggaacctagtgagactccaatcaggagtagatgtgtttttcattccaccggaaaaatgtgataccttattatgcgacataggggaatcatctccgaaccctacagtagaggcaggcagaaccttacgtgttttgaatcttgtggaaaattggctaaataacaatactcaattttgcattaaagtgttaaacccgtacatgccttcagttatagagaaaatggaagcactgcagagaaaatacggaggtgccttagtaaggaaccctttgagccgtaattcgacccatgaaatgtattgggtgagcaacgcgagcggtaacatcgtaagttctgttaacatgatatcaaggatgcttataaataggtttactatgcgccacaagaaagccacttacgaacccgacgtggatttaggatctggaacgaggaatatcgggattgaaagtgaaatccctaatctggacataatagggaaaaggattgagaaaattaaacaagaacatgaaacatcgtggcattacgaccaggatcatccatataagacatgggcctaccatggaagttacgaaactaagcagacaggcagtgctagttcaatggtcaacggggttgtaagattgctaacgaagccatgggatgttctcccaacagtaacacaaatggctatgacagataccaccccatttggccaacaacgtgtatttaaggaaaaagtagatactcgaactcaagaaccaaaagagggcacaaagaagttaatgaaaatcactgcagaatggttatggaaagagttggggaagaagaaaactccgaggatgtgtacacgagaggaatttactagaaaggtcagatcgaacgcagcgcttggagccatattcacagacgaaaacaagtggaaaagtgcccgagaagcagttgaagatagccggttttgggagcttgtagataaggagagaaatttgcatctggaaggaaaatgtgagacttgtgtttataatatgatggggaagcgcgagaagaaattaggagaatttggaaaagccaagggcagcagagctatctggtacatgtggttaggtgcgcgattcttagagttcgaggcattaggctttctcaatgaggatcactggttttcgagggaaaatagtcttagtggcgtagagggagaaggccttcacaaacttggttatattttacgtgacgtgagtaagaaagagggaggcgctatgtatgctgacgataccgcaggatgggatacccgaattaccctagaagatctaaagaatgaggaaatggttacgaaccacatggaaggagaacacaagaaattagcagaagctatatttaaattaacatatcaaaataaagtagtgagagtacaaagaccaacgcctagagggactgtcatggacataatttcacgacgagaccaaagaggatctggccaggtgggaacatacggactaaatacatttactaatatggaagctcaactcatccggcaaatggaaggcgagggcgtattcaaaaacatccaacacttaaccgtgacagaagaagtagcagtacacaactggttagcccgtgtaggcagggaaagattaagtagaatggcgatctcgggggatgattgtgttgtgaaaccactcgacgatagatttgcaaatgccttaaccgccttaaacgacatgggaaagatacgaaaggatattcaacaatgggagccaagtaaggggtggaacgattggacgcaagtcccattttgttcacaccattttcacgaattaattatgaaggacggaaggattcttgtagtgccatgtagaaatcaagacgaactgataggacgagctaggataagtcaaggagcgggatggtcacttcgtgagacggcatgccttggaaagtcatatgcgcagatgtggagcctcatgtactttcatcgaagggacttaaggttagcagcaaacgcgatatgctcagccgtaccctcacattgggttcctaccagtcgaacgacttggagcatacatgcaaagcacgaatggatgacgacagaagatatgctgactgtgtggaaccgagtctggataagagaaaatccttggatggaagataaaaccccggtagaatcctgggaagagataccgtacttaggaaaaagagaagaccagtggtgtggatcactaataggcctaacgtctcgcgcgacatgggctaaaaacatacaggcggctataaatcaagtaagaagcctcataggtaacgaagaatatactgactatatgccctcgatgaaacgttttagaagagaagaagaagaggcaggagtattatggtaa

SEQ ID NO: 22717 - RNA, 9876 nt, synthetic construct
  misc_feature 1..9876: note = derived and/or modified CDS sequence (opt6) from DENV-2__FJ410233__SS-prME
  source 1..9876: mol_type = other RNA
tctgcaggcatgattataatgttaattcctaccgtgatggcgttccacttaactactagaaatggtgaaccacatatgatagtaggaatacaagaaaaaggaaaatccttattgttcaaaactgaagacggagtaaacatgtgtaccttgatggcaatggacttaggtgaattatgtgaagacactataacgtacaaatgtccacttttaaggcaaaatgaacctgaagacatagattgttggtgcaattctacaagtacatgggttacttatggaacgtgtaccaccactggggaacatagacgtgaaaaacgctctgtggcattagtaccgcatgtaggtatgggcctagaaaccagaactgaaacatggatgagttctgaaggagcttggaaacatgctcaacgaatagaaacttggattcttaggcatccaggatttacaatcatggcggcgattctcgcatacacaatcggaactacccacttccaacgcgtactcatattcattctcctaacggcggtagctccttcaatgactatgaggtgcatcggaataagtaatagagactttgtagaaggcgtaagcggaggtagttgggtggacatcgtacttgaacatggttcttgcgtcactactatggccaaaaacaaacccaccttagattttgagttaataaaaacggaagcgaaacaaccggctactctacgcaaatattgtatagaagcaaaactcacaaacacgactactgaaagtagatgtccaacgcaaggggaaccatccttaaaagaggaacaagacaaacgttttgtatgtaaacattccatggttgacagaggatggggcaatggttgtggtctctttggaaaaggaggtatagtaacatgcgctatgttcacatgcaagaaaaatatggagggtaaaatagtgcagccagaaaatttggaatacacaatcgtagttacgccacattcaggcgaggagcatgcagtcgggaacgatactggaaaacatggacaagaaattaaagtcacaccacaaagtagcatcaccgaagcagaactaaccgggtatggtacagtgaccatggagtgctcaccaagaacaggattagattttaacgaaatggtattgctgcaaatggaaaataaagcatggcttgtacacagacaatggtttttagacctaccactgccgtggttacccggagcagacaaacaagaatcaaattggatacagaaagaaacactcgtaacatttaaaaatcctcacgccaagaaacaggacgtagttgtcctgggaagccaagaaggggcaatgcatactgcactcacaggcgcaactgaaatccagatgagtagtggtaatcttcttttcacaggtcacctaaaatgccgacttcgaatggacaaactccagctaaaaggtatgtcttattcaatgtgcaccggaaaattcaaagtagtaaaagaaattgcagaaacacaacacggaacaatagtaataagggtacaatatgaaggggatggttcgccgtgtaaaattccctttgaaatcatggacctagaaaaacgatatgttctcggtcgtttgattacagttaatccaattgtaacagagaaagatagccctgtcaatatagaggcagagcccccttttggagattcatatataattataggagtagaaccaggccaattaaagttaaattggtttaaaaagggctccagtataggacaaatgttcgaaacgactatgagaggggctaagcgaatggctattctgggggatacagcatgggattttgggtctttaggtggcgtattcacgagcattggaaaagctctacaccaggtatttggtgcgatttatggagctgcattctcgggcgtatcatggacaatgaaaatcttaattggggttatcatcacctggatcggaatgaatagcagatcaacttcacttagtgtaagcctagtactcgttggaatagtgacattatatttgggagtcatggtacaagcagattctggttgcgtagtctcttggaaaaataaggagctaaaatgtggtagcggtatattcattaccgataacgtccatacatggacagaacaatataaattccagccagaaagcccctccaaacttgcaagcgctatacaaaaggcgcaagaagaagggatatgtggcataagaagcgtcaccagattagagaatttgatgtggaagcaaataacccctgaattaaatcacatacttgcagagaacgaagtaaaactaactatcatgacaggggatataaagggtataatgcaggcgggtaagaggtctttgcgaccacaaccaaccgaattaaagtattcatggaagacctggggaaaggcaaaaatgctatcaaccgaaagttataatcaaacatttttaatagatggaccggaaacagcagaatgtcctaatacgaatcgagcatggaacagcctagaagtcgaagattacgggtttggagttttcactacaaacatatggttaaagttaaaagagaaacaagatgcattttgcgacagtaaactaatgagtgcggccattaaagacaatagggctgtacatgcggacatgggatattggattgagtcggcacttaatgatacatggaagatcgaaaaagcgtctttcatagaagtaaagaactgccactggcctaagtcgcacactctttggagcaatggagtactcgaatcggaaatgattattccaaagaatctcgcagggccagttagccaacacaattaccgcccaggctatcatacgcaaatcgcaggtccgtggcatctcggtaaattagaaatggactttaatttttgtgatggaacaacagtaattgtcactgaagattgtggaaatcgaggaccatcattgcgtacaactacagcgtctggaaaattaattactgaatggtgctgtagatcctgcacactaccacccctgagatatagaggggaagacggttgttggtatggaatggaaataagacctctgaaagaaaaagaagagaacttagtaaactcgcttgtcacagcaggtcatggacaagtggacaacttctcattaggtgtactcgggatggcactatttctagaagaaatgttaagaacaagagtgggtaccaaacatgcaattctattggtagcagtaagtttcgtaacattaatcacaggaaacatgagttttaaagatctaggtcgagtcgtagttatggtaggggctacgatgaccgatgatataggaatgggtgtaacgtacctagcattactagcagccttcaaagtccgacccacgtttgcagctggattacttctgagaaagctcacatcaaaagaactaatgatgactaccattggaatagttctactcagccagtccactattcccgaaactgtgttagagctaacggacgctttggccttaggtatgatggtcttgaaaatagtacgaaatatggaaaaatatcaattagcagtcactattatggctattctgtgtgtacctaatgcggtcattctccaaaatgcatggaaagtatcctgtacaattctagcagtggtttcagtgagcccgttactattaacatcaagtcaacaaaagacagactggataccacttgctctaaccataaaagggcttaatcctacggcgatctttctaacaacgctctcacgcactaataagaaaaggtcctggcccctaaacgaagcgataatggctgtaggaatggttagtatactcgccagttccttactcaaaaacgatataccaatgaccggtccgcttgtcgcaggaggattattaacagtatgctacgtcctgacaggtcgttcagctgacttagaacttgaaagagcaactgatgtcaagtgggaagatcaagctgaaatatcgggtagtagtccaatattgtcgattactataagcgaagatggaagcatgagtatcaagaacgaagaagaggaacaaactctgaccattttaatccgaactggccttcttgttatatctggtttattccctatctccattccgattactgccgccgcatggtatttatgggaagttaagaaacaaagggcgggtgttttatgggatgttccttctccgccgcctatggggaaggccgaactcgaagacggagcttaccgtattaaacaaaaaggcatcttgggatactcacagattggcgcgggtgtgtataaggaaggtacatttcatacaatgtggcatgtaactagaggcgcggtgctaatgcacaaaggaaaaagaatcgaaccttcttgggcagatgttaagaaagatctaatatcctatggtggtggatggaagttagaaggtgagtggaaagaaggagaagaagtacaagtcctagctttggaaccagggaagaacccacgtgccgtgcaaacaaaacccggcctatttaaaacgaacacagggacaataggcgcggttagcctcgacttttccccgggaacctcaggaagcccaataatcgataagaaaggtaaagttgtaggactatatggcaacggagtggttacaagatctggggcgtatgtatcagcaatcgcacagacagagaaaagtattgaagacaatccggaaattgaagacgatatattccgaaaaaggagattgaccataatggacttacaccctggcgcaggaaaaacgaaacgctatctgcccgccatcgtccgagaggccataaaacgaggcctacgcacgctaatcttagcaccaacgagagtagtggcagctgaaatggaagaggcattacgagggctcccaatcagatatcaaacgccagcgataagagcggaacataccgggagagagattgtcgatttaatgtgtcatgccacgtttacaatgcgattattaagtcctgtaagagtgcctaattacaaccttataatcatggacgaagcgcatttcaccgatccagctagtatagctgcgcgcggatacatctctactcgtgtagaaatgggagaagccgccggaatatttatgactgctacaccaccaggttctagagaccctttccctcaatctaatgcgcccatcatagacgaggaacgagaaatacctgaacggagttggaactcaggtcacgaatgggtaaccgactttaaaggtaaaacagtgtggtttgttccctccattaaagctggaaatgatatagctgcttgcctacgtaagaatggtaaaaaggtaattcaattaagtcgaaagacctttgacagtgaatacgttaaaacccgaaccaacgactgggatttcgtagttactacagacatcagcgaaatgggagcaaactttaaagcggaacgcgtaatagatccaagacgctgtatgaagccagtaattttaacggacggggaggaacgagttatattagctggtccgatgcctgtaacacatagtagtgcggcacaaagaagggggagaattggacgtaatcccaaaaacgagaacgaccaatatatctatatgggtgaacccttagaaaacgatgaagactgcgctcactggaaggaagctaaaatgctgctggacaacataaacaccccagaaggtattatcccctcaatgttcgaacccgaacgggaaaaagtagatgctatcgacggagagtatcgactacgtggagaagctagaaaaacatttgttgacttaatgagacgtggcgatttaccggtatggttagcatataaagttgcagcggaaggaataaattatgctgaccgaagatggtgtttcgacggcatcaaaaacaaccaaattctagaggaaaacatggaggtagaaatatggacaaaagaaggagaacgtaagaagttgaaacctagatggctagacgctagaatttattcagacccattagcactaaaagagttcaaagaatttgcagctgggagaaagagcttaactctcaatctgataacagagatggggcgactaccaaccttcatgacacaaaagactagggacgctttagataacctcgcagtgttgcatacagccgaagcagggggtagagcatacaaccacgctttatcagaacttcctgaaacattagaaactttattattgctaacattactagctacagtgacagggggaatttttctattcttaatgagcgggcgtggtattggaaagatgacactaggcatgtgctgcattataactgcgtccatactgctatggtatgcacagatacaaccacactggatagcagcgagtattatattagaatttttccttattgtcctattaatacctgaacctgagaagcaaagaacaccacaggataatcagttaacttacgtagtaattgcgatactcaccgtggtcgcagccactatggcgaatgaaatgggctttttagagaaaactaaaaaggatctaggcttagggagcattgctacaagacagccagagagtaacattttggacatagatttacggcccgcctccgcatggacattatatgccgtggctacaacgttcgttaccccaatgctacggcatagcatagaaaactcctcagtgaacgtctcgttaacagccatcgctaatcaagcaacagttttaatgggattaggcaaagggtggcctctcagcaaaatggacatcggagttccacttcttgcaattggatgctactcgcaagtaaacccaattactctcaccgctgcgttattgttgttagtcgcacattatgcgataatagggcctggtttacaagctaaagctacgagagaagctcagaaacgggctgcggctggtataatgaaaaaccccaccgtagacggaataactgtaatagatttagatcctataccatacgacccaaaatttgagaaacaactaggacaagtaatgctattagtactctgcgtaacacaagtgctaatgatgcgaactacgtgggcactctgcgaggcgcttacactagctactggacctataagtactttatgggaagggaatcctggacgattttggaacaccaccatagctgtatcaatggctaatatttttaggggttcgtatctagctggagctggacttttgttcagtattatgaagaataccaccaatacgagaagaggcacaggtaatatgggagagacactaggggagaaatggaagtccagactaaatgctctagggaagtcagaatttcaaatctacaaaaagtctggaatccaagaagtggatagaaccttggcaaaggaaggaataaaacgaggggaaaccgaccatcacgcggtctctcgcggaagtgccaaattacgatggtttgttgaaaggaacatggtaactcccgaagggaaagtagtggaccttggctgtggtcgaggaggatggtcctactactgcggaggcctcaaaaacgttcgcgaggtcaaaggattaaccaaaggagggcccggacatgaagaaccgatcccaatgagtacatatggatggaacttagtacgcctacagagtggagtagatgtatttttcattccgccagaaaaatgcgataccctattgtgcgatataggagagagcagtcctaatcctacagtggaagccgggagaacacttagggtgctaaaccttgtagaaaattggttaaataataacacacaattttgtataaaagtattaaatccatacatgccgtcggttattgagaaaatggaagcattgcaaagaaaatatggaggagctttagtacgaaatccactctcaagaaactctacacacgaaatgtattgggtatcaaatgcgagtggtaacatagtgagtagcgtcaatatgatctcaagaatgctgataaatcgtttcacgatgaggcacaagaaagctacatacgagcctgacgtagatttgggctcgggaactagaaacataggcatcgagagtgagatacccaatttagatataattggaaagcgaattgagaaaattaaacaagaacatgagacatcatggcattacgatcaagatcatccgtataaaacttgggcctaccacggttcctacgaaactaagcaaacagggtctgcatcctcaatggtcaatggcgtagtaagattgttaactaaaccatgggatgtccttcctacggttacccaaatggcaatgacagacaccacaccctttggacagcaaagagtgtttaaagaaaaggttgataccagaacccaggaaccgaaagaggggacgaaaaagctaatgaagatcacagctgaatggttatggaaagaactaggtaaaaagaaaacacccagaatgtgtacacgagaagaatttaccagaaaggtaaggtccaatgccgcactgggagccatattcacagacgaaaacaagtggaaatccgcacgagaagccgttgaggacagtcgattctgggaactggtcgacaaagaacgaaatttgcatttagaaggaaaatgcgagacatgcgtttataatatgatgggtaaaagagagaagaaacttggagaatttggaaaggctaaaggatcgagagcaatttggtatatgtggttaggagctagatttcttgagttcgaagcattaggtttcttgaacgaagatcactggtttagtcgcgagaacagtctcagtggggtcgaaggagaggggctacataaactgggttacatattaagagatgttagtaagaaagaaggcggtgccatgtatgctgatgacacagccggatgggacacaagaataaccctagaggacctaaagaacgaagaaatggtgactaaccacatggaaggcgaacataaaaagttagctgaagcaatcttcaaattaacatatcagaataaagtagtacgtgtccaaaggccgactccgagaggaacagttatggatatcatatcacgacgagatcagagggggtctggacaggttggaacttacggattgaatacatttacgaacatggaggcccaactaatcagacaaatggagggtgaaggcgtctttaaaaacatacaacatctcactgtcacggaggaagtcgcagtcaaaaattggctcgcaagggtggggcgagaacgtcttagcaggatggcaatcagtggggacgattgcgttgtcaaacccttagatgacaggtttgctaatgctttaacggctttgaacgacatgggaaagattagaaaagacatacaacaatgggaaccgtcgaaaggatggaacgactggacgcaagtacccttttgcagtcaccattttcacgaattaatcatgaaagatggaagggtgcttgttgtcccctgcagaaatcaagatgagttaatcggacgagctagaatatcacaaggagcgggatggagtctacgtgagaccgcatgtctagggaaatcctatgcacagatgtggtcactaatgtattttcatcgtagggatcttagacttgcagctaatgctatctgtagtgcggtacctagtcattgggtgcctacatcaaggacaacctggagtattcatgcaaaacatgaatggatgactacagaagacatgttgacagtttggaatagagtttggatacgcgaaaatccgtggatggaggacaagacaccagtagagtcttgggaagagataccctatctaggaaaacgagaagatcagtggtgcggctcattaattggattaacaagtcgcgcgacttgggccaaaaatatacaagcggccataaatcaagtccgttcattgattggaaatgaagaatacactgattatatgccatctatgaaaagattccgtcgggaagaagaagaagcaggagttttgtggtaa

SEQ ID NO: 22718 - RNA, 9876 nt, synthetic construct
  misc_feature 1..9876: note = derived and/or modified CDS sequence (opt6) from DENV-2__FJ410237__SS-prME
  source 1..9876: mol_type = other RNA
tcagctggaatgattattatgctaattccaacggttatggccttccatctaactactaggaacggtgaaccacatatgatagtggggattcaagaaaaagggaaaagccttttatttaaaactgaagacggtgtaaatatgtgcacacttatggccatggacttaggagaactatgtgaagatacaataacgtataaatgcccactacttaggcagaatgaaccagaagacatagattgttggtgtaactcaacaagcacatgggtaacgtatggaacctgtacaacaactggagaacacagaagggaaaaacgttcagtggctttagtgcctcatgtaggaatgggtcttgaaaccagaacggaaacttggatgtcaagtgaaggggcttggaaacacgcccagcggatagaaacttggatcctacgacatccaggctttacgataatggctgcaatccttgcctataccataggtacgactcacttccagagagtgttaatctttattctcttaacggccgtagcaccttctatgactatgagatgtatcggaattagtaaccgagacttcgtcgaaggtgtcagcggagggtcatgggttgacatagtacttgaacatggaagctgtgttacaactatggcgaaaaataaacctacactagattttgaactaataaaaacagaagccaaacaaccggcaaccttaagaaaatattgtatagaagccaaattgacaaatactacgacagaatcaaggtgtccaacccaaggagaaccttcgttaaaagaagaacaagacaaaagatttgtttgcaaacatagcatggtcgacagaggatggggaaatggatgcgggttatttggaaaaggaggaattgtaacttgtgcaatgttcacgtgtaagaaaaatatggaaggcaaaatagtacagccggaaaacttagaatacacaatagtggtcaccccacacagtggagaagaacatgcagtcggaaatgatacaggaaaacatggacaagaaataaaagtgacaccgcaatcaagtatcaccgaagcagaattgacaggatatggaacagtgaccatggaatgctccccaaggacggggctagacttcaatgaaatggtcctattacaaatggagaataaagcatggttagtgcacaggcagtggttcttagaccttcctctgccgtggctgcctggagcagacaaacaagaaagcaactggatacaaaaagaaaccttagtaactttcaaaaatccacacgccaagaaacaagatgtcgtcgtcctcgggtcacaagaaggagctatgcatacagctctaacaggtgctaccgagatccagatgagtagcggaaatttactctttaccggtcatctcaaatgcagattaaggatggataaactccaattaaaaggtatgtcatacagtatgtgtacaggtaaatttaaagtggtaaaagaaatcgccgagacacagcatggaacgatcgtaataagggttcaatatgaaggtgatggcagcccatgtaaaattccatttgaaataatggatctagaaaaacgttatgtcttaggcagattgataactgtcaaccccatagttacggaaaaagactcaccggtaaatattgaagctgagccaccctttggcgattcttatataattatcggcgtagagccgggacaactaaaattgaattggtttaagaaaggttcttcgattggtcagatgttcgaaactacgatgagaggtgcaaaacgtatggccatactcggagatacagcgtgggactttgggtcactcggaggagtatttacaagcattggcaaagcgctgcatcaagtttttggcgcaatctatggtgcagcgttttcaggagtttcatggacaatgaaaatactaatcggtgtaatcataacttggatcggcatgaactcacgatccacatctttaagcgtatcgctagttctggtaggaatagttacactgtacctaggagtgatggttcaagcggattctgggtgcgtcgtttcatggaaaaacaaagagctaaagtgtgggtctggcatctttataaccgataatgtacatacctggaccgagcagtataagtttcaaccagagtctcccagcaagttggcgtcagccatacaaaaggctcaggaggaaggaatttgcggcataagatctgtaacacgactcgagaatctcatgtggaaacaaatcacaccggaactaaaccacatcttggcagaaaacgaggtcaagttaactattatgacgggagatattaaaggtataatgcaagcggggaaacgctctctgcgacctcaaccaacagagctcaaatattcgtggaaaacttggggtaaagcaaaaatgctctctacagagtcctataatcagacatttcttatcgatgggccggagaccgcagagtgccctaatactaacagggcatggaactccttagaggtggaagattatggctttggggtatttactaccaacatttggttaaaactgaaagagaaacaagatgcattctgtgattcaaagctgatgagtgcagcgataaaggataacagagctgtacacgccgatatgggctattggattgaatctgcgctcaacgatacttggaaaatagaaaaagcgagcttcatagaagtgaaaaattgccattggccaaagagtcacactctctggagtaatggagtcctagaatcggaaatgataatacccaaaaatctggcaggaccagtaagtcaacacaattatcgtccggggtaccacacacagattgcgggaccctggcacttaggaaaactcgaaatggactttgatttttgtgacggtacaacagtgattgtaacagaagattgtggaaatcgaggaccaagccttcgaacgacaactgccagtggtaaattaataacagaatggtgttgtcgaagttgcacacttccacctctacgttatagaggcgaagatggttgctggtacggaatggaaatccggccattaaaggagaaagaagaaaacctggtaaacagtctcgtaacagcaggtcacggacaagttgacaatttttcattaggggtcttagggatggctctgtttttagaagaaatgcttagaactagagtaggaacaaagcacgcgattttacttgttgcggtttcattcgttacgctaattacaggtaatatgagctttaaagacctaggaagagtggtagttatggttggtgcaactatgacagatgatatagggatgggcgtgacctatttggcacttctcgcggcatttaaagtccgacccacatttgcggcgggcttattgttaagaaaacttacatcaaaagagttaatgatgaccactatagggattgttctactcagtcaaagcacgattcctgaaacggttttagagttaaccgatgcgctagcactcggtatgatggtattaaaaatcgtaagaaatatggaaaaatatcaactagcagtaacaataatggctatattatgtgtacctaatgcagtaattttacaaaatgcctggaaggtaagttgtacgatattagctgtagtaagtgtaagtccattattattaacaagttcgcaacagaaaacagattggataccattggccttaactataaaaggtctcaacccaacagcaattttccttactacgcttagcagaacaaataagaaaagatcatggccattaaatgaagcaataatggcagttggaatggttagtattcttgcgagcagcttgctcaaaaacgatatacctatgactggtcctctcgttgctggtggcctgttgacagtgtgctatgtgctaactggccgatcagcagatttagaactagaaagggcaacagatgttaaatgggaagatcaggccgaaatctcagggagctctccaatattgagtataaccatatctgaagacggctctatgtcaatcaaaaatgaagaagaagaacaaacattaacaatactgataagaacagggttattagtaatatctgggctatttccaatttctataccaatcactgcagctgcgtggtacctatgggaggttaagaaacaaagagctggtgttctctgggatgttccatctccaccacccatgggtaaggctgaactagaagacggtgcgtatagaattaagcaaaaggggattctgggttatagtcagataggagcaggagtgtacaaagaaggaacatttcatacaatgtggcatgtgacgcgcggagctgtcctaatgcacaaggggaagcgaatagagccgtcttgggcggacgttaagaaagacttgatctcgtacggtggaggctggaaattggaaggcgaatggaaagagggcgaggaggtgcaggtattagcgttggaacccggtaaaaaccccagagcagtccagacgaaaccaggcctatttaaaacaaatacggggactattggtgcagtaagtttagatttttctcctggcacttcaggaagccctataatagataagaaaggcaaagttgtaggcttgtacggaaatggcgtagtaaccaggtctggtgcctatgtatcagccatagcacaaacagaaaaatctatagaggataatcctgaaatcgaagacgacatattccggaaaagacgtttaacaataatggacttacacccaggggcaggtaaaactaaaagatatctgccagcaattgtaagggaggcaataaaaagaggactacgcacactaattctagcacccactcgtgtggtcgctgctgaaatggaagaagctctacgaggactgcccatacgctaccagacacccgcaattagggcagagcatacaggcagggaaatagtggaccttatgtgtcatgccacttttacaatgaggctactttcacccgttcgagtaccaaattacaacttgattattatggatgaggcacactttactgaccctgcttcaattgccgctagaggttacatatccacgcgagttgaaatgggtgaggcggcaggaatatttatgacagcaactcctcctggctcacgggatccatttccccaaagcaatgctcccattatagacgaagaaagagagatcccagagagaagttggaactccgggcacgaatgggtcacagattttaagggcaaaacggtttggttcgtaccatctatcaaagcgggtaatgatatcgcagcctgcttgcgaaagaacggcaagaaagtgatacaactatctagaaaaacttttgacagtgaatatgtcaaaacaaggacaaatgactgggacttcgtagtaacaacagacatcagtgaaatgggagctaactttaaggcagagcgtgtaatagatccgcgtcgctgcatgaaacccgtaattctaacggatggtgaagaacgcgtaatactagcgggtcctatgcctgtgacgcactcatcggctgcacagagaagaggaaggataggtagaaatcccaagaatgaaaatgatcaatatatttacatgggggagccgttggagaacgatgaagattgtgctcattggaaggaggctaaaatgttgctagacaatataaacacgccggaaggcataatacctagcatgtttgaaccagaaagagaaaaagtagacgcaatagatggagagtatagattgagaggcgaagctcgaaaaacgtttgttgacttaatgagaaggggtgatttgccagtatggttagcctacaaagttgccgcagagggcataaattatgcagataggaggtggtgtttcgacggaattaaaaacaaccagatactagaagagaatgttgaagttgaaatatggacaaaagaaggtgaaaggaaaaagttaaaaccgaggtggttagatgcgcgtatctatagtgacccacttgccctaaaggaatttaaagagttcgcagccggtcgaaaatcactaactctcaacctaataacagaaatgggtagactaccgacattcatgacacagaaaaccagagatgctctggataaccttgcagtacttcacacagcagaagccggaggccgagcatacaatcatgcactcagcgaattgcccgaaacactggaaacgttactactgttaactcttcttgctacagtcaccggagggatatttttatttctgatgtctggtagagggataggaaaaatgacgttaggaatgtgttgcataataaccgctagtatattattgtggtatgcccaaattcaaccacattggatagcagcttcgataatactcgagtttttcttaatagttttactcataccggaaccggaaaaacaaagaacaccccaagataaccaacttacgtatgtggtgattgcaattctcaccgttgtggccgcaactatggcaaatgaaatgggatttttagagaaaacgaagaaagacctaggtttaggttccatcgctacacagcaaccagaatcgaacatactcgatatagatttgagacctgctagtgcatggacactctatgcagtcgcaactactttcgtaactccgatgttacgacacagcattgaaaattcaagcgtaaacgtgtcgttaacagctattgcgaatcaagccacggttttaatggggctagggaaaggatggccacttagtaagatggacataggcgttccactattagctataggctgctattcccaagtgaacccgattactcttacagcagcccttctgttgttagttgcgcactatgccataatcggaccggggctgcaagcaaaagccacaagagaagctcagaaaagagccgcagcaggtatcatgaaaaatccaacagtggatggaataactgtaattgacttggatccaataccgtatgatcccaagtttgaaaaacaattaggtcaagtcatgcttttaatcttatgtgtgacgcaagtattaatgatgagaacaacatgggctttgtgcgaagcattaacgttagcgacaggtccaatctcgactctgtgggaggggaatcctggacgattttggaacactacaattgcggtcagtatggccaatatctttcgcggatcttatttagccggagccggattattatttagcataatgaaaaataccactaatacacgaagagggacaggaaacatgggggagacattgggcgaaaaatggaaatcgcgtttgaatgcacttggaaaaagtgaatttcaaatatataagaaatcgggaatccaggaggtagacaggacccttgcaaaagaagggattaagagaggtgagactgatcaccacgcagtaagcaggggatcagcaaagctaagatggttcgtcgaaagaaacatggtcactccggaaggtaaagtagttgacttggggtgtgggagaggaggatggtcatactattgtggcgggcttaaaaatgtaagggaagtaaaaggcctaacaaaaggcggtccaggccatgaggaaccaattcctatgtccacatacggttggaatctagttaggctacaatcaggtgtagatgtatttttcattccgcccgagaaatgtgacacgttgctgtgtgatataggggaaagttccccaaaccctacagtggaagctggtagaacgctaagggtactaaatctagtcgaaaattggctcaacaataatacgcagttctgtataaaggtattaaacccatatatgccttcggtaatagagaaaatggaagcgcttcaaaggaaatatggtggcgccttagtgcgaaatccactatcaagaaattcaacccacgagatgtactgggtaagcaacgcttcgggaaatatagtaagttcagttaatatgataagtaggatgctaataaacagattcaccatgcggcataagaaagccacgtacgaacctgatgtagacttaggttcaggtacacggaatatcggtattgaatcggaaataccgaatctagatatcatagggaaaagaattgagaaaataaagcaagagcatgaaacaagttggcattatgatcaagaccatccatataaaacttgggcataccatggtagttacgaaaccaaacaaaccgggtcggcgtcatctatggtaaatggggtggtcagacttttaactaagccctgggatgtattaccaactgtaacacaaatggctatgacagataccacaccgtttggtcaacagagggtctttaaagaaaaagtagataccagaacccaggagcctaaagagggaacaaagaagttgatgaagataacggcagagtggttgtggaaagaactagggaagaagaaaactccacggatgtgtactcgcgaagagtttacgcgtaaagtacggagtaatgccgcccttggtgcaatcttcactgatgaaaataaatggaaaagcgccagggaggcggtagaagactctaggttctgggagttggtagataaagaaaggaatctgcacctggaagggaaatgtgaaacatgcgtatataacatgatgggcaaaagagagaagaaacttggtgaatttggaaaagctaaaggaagccgagctatctggtacatgtggctaggagctcggtttttggagttcgaggctttagggttccttaacgaagatcattggtttagtagggagaactcactttcaggggtagaaggtgaaggattgcataaacttggatatattctaagagatgttagtaaaaaggagggaggagctatgtatgcggacgataccgcgggatgggacacgcggataactttagaggaccttaaaaatgaagaaatggtgactaatcacatggaaggagaacataagaagctagcagaggccatctttaaactgacatatcaaaataaagtggtcagagtacaaagacctacgccaagaggcacagtgatggacataatatcccgcagagatcagcggggctctggacaagtgggtacctatggattaaatacattcacaaatatggaagcccaattaataaggcagatggaaggagaaggagtctttaaaaacattcagcatttaactgttacagaagaagtcgccgtcaaaaactggttagcccgagtaggaagagaaaggctctcaagaatggcaataagcggcgatgattgcgttgtcaaaccacttgacgatagattcgctaatgctcttactgctttaaatgacatgggaaagatacgaaaggacatacaacaatgggaaccatccaaaggatggattgattggacgcaagtgcctttttgcagtcatcacttccacgaactcattatgaaagacgggagggtattagtagttccctgccgaaatcaagatgaattaattggtcgggcaagaatatcgcaaggagccggttggtctttgagagagacggcgtgtctaggaaagagttatgcacagatgtggtcattaatgtactttcataggagagatttacggttagcagcgaatgccatctgctctgccgtaccctcgcactgggtaccaacaagcagaacgacctggtcaatacacgccaaacatgaatggatgacaacagaagacatgttaactgtttggaatagggtttggatcagggaaaatccttggatggaggacaagacaccagtagaatcgtgggaagaaataccatatcttggtaaacgggaggaccaatggtgtgggtctctcattggtctaacgtcacgagccacgtgggccaagaatattcaagctgcaattaaccaggtgagatcgttgatagggaatgaagaatacgcggattatatgcccagcatgaagaggttcaggagagaagaagaggaagcaggagttttatggtga

SEQ ID NO: 22719 - RNA, 9876 nt, synthetic construct
  misc_feature 1..9876: note = derived and/or modified CDS sequence (opt6) from DENV-2__FJ410241__SS-prME
  source 1..9876: mol_type = other RNA
agtgctgggatgatcataatgcttattccaactgtaatggcttttcacttaactaccaggaatggggaaccacacatgatagtgggcatccaggaaaaaggcaaatcgttattgtttaaaaccgaagacggggtaaacatgtgcacgctaatggcaatggatttaggagaactatgcgaagacactatcacctacaaatgtcctctattgagacaaaatgaacccgaagacatcgattgttggtgtaactcaacgtccacgtgggtaacatatggaacctgcacgaccactggagaacacaggagagagaaaaggagtgtggcactggtaccccacgtagggatggggttggaaacacgtacagaaacctggatgtcgagtgaaggcgcatggaaacatgcgcaaagaatagaaacatggatattaagacatccaggatttactattatggcggcaatactagcatatactattgggacgacacattttcaacgggttctaatatttatactattaaccgcggtcgcacctagcatgaccatgaggtgcatcggtatatcaaaccgagactttgtcgaaggcgtatctggtggatcatgggtcgacatagtccttgagcatggatcgtgtgtaactacaatggctaaaaataaacctacactggattttgagctaataaaaactgaagctaaacagcctgcaacactacgtaaatattgcatagaggctaaattaacgaacactacaactgaatccagatgcccaactcaaggagagcctagcttaaaagaagaacaagacaaaagatttgtctgcaaacactcgatggtagatcgtgggtggggtaatggttgtggattatttggaaaaggagggatcgtaacttgtgcaatgtttacgtgcaagaaaaatatggaaggtaaaatagttcaaccagaaaatttggaatacactatcgtcgtaactccacattcaggcgaagaacacgcagtcggcaatgacaccgggaaacacggtcaagaaattaaagtcaccccacaaagttctatcaccgaagctgagctaacgggatacggtacagtcacaatggaatgtagtcctagaacgggactagattttaacgagatggtgctgctacaaatggagaataaagcgtggctcgtacaccgtcaatggtttctcgatttaccattaccatggttaccaggggcagacaaacaagaaagtaattggatacaaaaagaaacattggtaacatttaaaaacccacatgccaagaaacaagacgtagtagtacttggatcacaggaaggtgcaatgcatactgcgctgacaggagcaacagagattcaaatgagctctgggaatctgctctttaccggacatttaaaatgtcgtcttcgtatggataaactacagctaaaaggcatgtcgtacagcatgtgcacaggtaaattcaaagtggtaaaagagatagcagaaacacaacacggcacaatagttatcagagtacagtatgagggagatgggtcaccttgcaaaattccattcgaaattatggatttagagaaaagatatgtattgggaagacttatcacagtcaatcctatcgtaacagagaaagattcacccgtgaatatagaggcagaaccaccctttggggacagttacataataatcggagtagaacctggtcaactaaaattgaactggtttaaaaaggggtcatctataggacaaatgttcgagactactatgagaggcgccaaacgaatggctatactcggagatacagcatgggacttcggaagtttaggaggggtcttcacaagtatcggaaaagcgctacaccaagtgttcggggcgatttacggggcagctttctcgggtgtatcttggaccatgaagattctgatcggggtaataataacctggatcggaatgaactcacgctcgacaagtctatcagtcagcctcgttttagtaggaatagtgacattatacttaggagtgatggttcaagcggattctggatgcgtagtttcatggaaaaacaaagagctaaaatgcggatctggcatattcatcacggacaacgttcacacatggaccgaacaatataaatttcagccagaaagtccaagtaaacttgcctctgcgatacaaaaagcgcaggaggaaggaatttgtggtatacgatcagtaactaggctagaaaatttgatgtggaagcaaataacaccggaacttaaccacattctcgcagaaaatgaagtgaaattaacgattatgaccggagacattaagggcattatgcaggcgggcaaaagaagcctgagaccacaacctacggaattaaaatacagttggaagacatgggggaaggccaaaatgcttagtacggaaagttataatcagacttttctcatagacggacctgaaacagcagaatgtccaaatactaatagagcatggaacagtcttgaggtggaagattatggattcggggtatttacgacaaacatatggctaaaactcaaagaaaaacaagacgccttttgtgactctaaactaatgtctgcagccataaaagacaaccgagctgtccacgccgacatgggttattggatagaatcagcattgaatgacacatggaaaatagaaaaagcatcattcattgaggtgaaaaattgtcactggcccaaaagtcatacgttatggtccaacggagtgctagaaagtgaaatgataattcccaaaaacctagctggccctgtgtctcagcacaactaccggcctggctaccacactcaaattgcaggaccatggcatttaggaaagctagaaatggactttgatttctgcgatgggacaaccgtaatagttacagaagactgcggaaatagaggaccttctttacgaaccacaacagcgtctggaaaattaattacggaatggtgctgtcgctcatgtacgctaccgccattaaggtatcgaggtgaagatggctgctggtacggaatggagatacgacctctcaaagagaaagaagagaatctcgtaaactctttggtaaccgctggacatgggcaagtagacaacttctcgttaggtgtattaggtatggcgctgttcctagaggaaatgctaaaaacacgggtcggcacaaaacatgcgatattattggttgcagtttccttcgttacactcatcacagggaacatgagtttcaaagacctaggaagagtcgtagttatggttggagcaactatggctgatgatataggcatgggagtaacatatttagccctactagctgcttttaaagtaagaccaacgtttgccgcaggattattattgagaaagttgacaagtaaagagctcatgatgacaacaataggaatcgtgctactatcacaaagtaccatcccagaaacagttctagagctgacagacgcattggcacttggtatgatggtgttacgaatcgtccgtaatatggaaaaataccaattggcagtaacaatcatggctatattatgcgtacctaacgctgtaatattacaaaacgcgtggaaagtaagttgtactatattagccgtagtaagcgtaagccccttgctgctcacaagctctcaacagaaaactgattggattccattagcacttacaataaagggcttaaaccctaccgccatatttctaactacattatctcgtacgaacaagaaacgatcgtggccgcttaatgaagctataatggcagtaggaatggtcagtatcctagctagttctctattaaagaatgatatccctatgacgggaccactcgtagctggaggattactgacagtttgctatgtgcttactggcagaagtgccgatctggagctcgaacgagcgacagatgttaagtgggaagatcaagcggaaatcagtggatcaagtcctatactatcaataactatttcagaggatgggtcaatgagtatcaaaaatgaagaagaagaacaaactttaaccattcttattagaacaggacttttggtaattagtggcctattcccaatatcaataccaataacagcagcagcttggtatctgtgggaggttaagaaacaacgagcaggcgtgttatgggatgtaccgtctccaccaccgatgggcaaggcagaactagaagacggagcatatagaatcaaacaaaagggcattctaggttatagccaaattggtgccggtgtatataaagagggcacattccatacaatgtggcatgtaaccagaggggccgttttaatgcataaaggtaaacgaatcgaaccgagctgggcagacgtcaagaaagatttgattagttatgggggaggttggaaactagaaggcgaatggaaggaaggtgaggaagttcaagtattagctttagaaccaggcaaaaatcccagagccgttcaaactaaacctggattgttcaagacgaatactggcacaataggcgccgtcagtcttgacttctccccaggtacaagtggctcgcctataatagataaaaagggaaaagtcgtaggtttgtacgggaatggtgtcgttactagatctggcgcctatgtaagcgccatagcacaaaccgagaagagtatcgaagataatccggaaattgaagatgatatatttagaaagagacgcctgacaataatggatttacacccaggtgccgggaaaacaaaaaggtatctcccggctatcgtaagagaagccataaaaagaggtttgaggacacttattctagcgccaaccagagtagttgcagccgagatggaagaagctctacgaggactaccaatccgataccaaacgcccgctattcgcgcggaacatacaggtcgtgaaattgttgatctgatgtgccatgccacattcactatgagactactaagtcctgtgagagtacctaactataacctcattatcatggatgaagctcactttacagatcccgcgtctattgctgcacgaggctacatttcaacaagagttgaaatgggagaagcggctgggatttttatgaccgcaacaccgcccggaagtagggatcctttccctcaatcaaacgccccaataatagacgaagaacgggagataccagaaagatcatggaactctggacatgagtgggtaacagatttcaagggaaaaactgtttggttcgtccccagtattaaggcggggaatgacattgctgcatgtttacgtaaaaacggaaagaaagttatacaattatcaagaaaaacgtttgatagtgaatatgttaagacgagaacaaatgattgggatttcgttgtaactacggacatttcggagatgggggcaaattttaaagctgaacgtgtaattgacccccgaagatgtatgaagcctgtaatattaacagacggtgaggagagggttatcttagcaggtccaatgccggtcacacatagtagtgccgcacaacgaagaggtcgaataggtcgtaacccgaaaaacgagaacgatcagtatatttacatgggtgaaccacttgaaaacgatgaggattgtgcccattggaaagaagcaaaaatgttattagacaacattaacacaccggaaggtatcatacccagtatgtttgaacccgaaagggaaaaagtggatgccattgacggagagtatcgcctcagaggagaggcaagaaagacattcgttgatttaatgcgacgaggagatctgcccgtttggttggcctataaagttgcagctgaaggaattaactatgcagaccgaaggtggtgtttcgatggtattaaaaataaccaaattttggaggaaaatgttgaggtggagatatggacaaaagagggagagagaaagaaattaaagccaagatggctagacgccaggatatatagtgaccctcttgccctgaaagagtttaaagagtttgcagctggaaggaaatcattgacactgaacttaatcactgaaatgggccgcctccccacatttatgacacaaaagacgagggatgctctagataatttagctgtcttacatacagcagaagcaggaggaagggcatataatcatgcgctatcagagttgcctgaaactttagaaacactgctactcctaacattattagcaaccgtcactggagggatatttttgttcttaatgagtgggcgagggattggtaaaatgacattaggaatgtgttgtataataaccgcttctatactgttatggtatgcacaaattcaaccccattggattgcagcttctataatcttggagtttttcctcatagttctcttaattcctgaacctgagaaacaaagaacgccccaagataaccaactaacctatgtggtgattgcaatattgaccgtggtggccgcaacaatggcaaatgaaatgggattcttggagaaaacgaagaaagacctaggattaggatccatagccacgcaacaattagaaagcaacatattagacatagatttgcgtcctgccagcgcatggacattatatgctgtcgctactacttttgtaacacctatgttaagacatagtatagaaaactctagcgtaaacgtaagtctgacagctatagccaatcaagcaacagtcctaatggggctcggaaaagggtggcctctgagtaagatggacattggcgtaccgttacttgcaataggttgctatagccaggtaaatcctatcacacttacggcagctttactgcttcttgtggcacactatgccattattggtcctggtcttcaagcgaaagcaaccagagaagcacaaaagagggcagcagcaggcatcatgaagaatccgacggtagatggtataactgtaatcgatctcgacccgattccttatgatccgaaatttgaaaaacagttagggcaggttatgttactaatcctatgcgtaacacaggtgcttatgatgaggactacctgggctctgtgtgaagcgctgactttggctacgggaccgatttcaactttatgggaaggcaaccctggaagattttggaataccacaatagcagtgagcatggcaaatatcttcaggggaagttatcttgcaggggcaggtctgttattttcaatcatgaaaaatacaactaatacgagaagaggaacgggcaatatgggagaaacccttggagaaaagtggaaaagtcgtctgaatgctctaggcaagagtgaatttcaaatttacaagaaatcaggtattcaagaagtagacagaacacttgcgaaggaaggtattaaacggggtgagacagatcatcacgctgtctctaggggatctgctaaactacgctggtttgtcgaaagaaacatggtgacgccagaaggaaaagttgtagatctaggctgcggaagaggagggtggagctattactgtggaggacttaagaatgtaagggaagtgaaagggctgacaaaaggagggccaggtcatgaagaacctataccgatgtcaacatatggatggaatttagtaaggctacagagtggagtggatgttttctttatcccgccggaaaaatgtgacactcttctttgcgacattggagagtccagccctaacccaacagtggaagctgggagaaccctacgagtgttgaacctagttgaaaattggctaaataataatacccaattttgcataaaagtcttaaatccatacatgccaagcgtaatagagaaaatggaggctttacaaagaaaatatggcggtgcgctagtcagaaaccctctatcaagaaattcgacgcacgaaatgtactgggtatcaaatgcatctggtaatatcgtctcaagtgtgaatatgataagccgtatgcttataaacaggtttacgatgagacataagaaagctacctatgagccagacgttgacctagggtcaggaacgcgtaatataggtatagaaagtgagataccgaatctagatataatagggaaaagaatcgagaaaatcaaacaggaacatgagacatcttggcactacgatcaagaccatccttacaaaacatgggcgtatcatggttcttatgaaactaagcaaacgggatctgcgagttctatggtcaatggggttgtacgactacttaccaaaccctgggatgtactccccacagtcactcaaatggcgatgacagatactactccgtttggacagcaacgtgtcttcaaagagaaagtagatacccgaacacaggaacccaaagaaggcacgaagaaattaatgaaaatcactgccgaatggctatggaaggagttagggaagaagaaaactcctagaatgtgtacgagagaagaatttactaggaaagtaagaagtaacgctgctttaggcgctatattcacggacgagaataagtggaaaagcgcccgtgaagcagtcgaagatagcaggttttgggaattagttgataaagaaagaaatctacaccttgaagggaaatgcgaaacctgcgtatacaatatgatgggcaaacgtgagaagaaattaggagagttcgggaaagctaaaggctccagagcaatttggtacatgtggttaggagccagatttttagaatttgaggcactaggctttcttaatgaggatcactggttttccagagaaaattcattatccggagtagagggagagggattgcataaactaggatatattctgcgcgacgtaagcaagaaagagggtggcgcaatgtacgcggatgatacggctggatgggacacccgcataactcttgaagatctcaaaaatgaggaaatggtgactaaccatatggaaggtgagcacaaaaagctggcggaagctatctttaaacttacctaccaaaataaagtagtacgggtacaaaggcccacgccccgaggcacagtaatggacataatttcaagaagagatcaacgaggctccggccaagttggaacttatggattaaatacctttacaaatatggaagctcagctaattcgacagatggagggagaaggagtatttaagaatatccaacacttgacagtaacagaagaagtagctgttcaaaactggttagcgcgcgttgggcgcgaaaggctatctagaatggctatatcaggtgacgattgcgttgtcaaacccctggatgatcgatttgcgaacgcactaacggcattgaatgatatgggaaaaattagaaaagatatacagcaatgggaaccctcaaaagggtggaatgattggacccaggtacccttttgttcgcatcatttccacgaactcattatgaaagacggtagagtcctagtagttccatgccgaaaccaggacgaattaataggccgtgcaagaatatcacaaggtgccggatggtccttacgagagacagcttgcttaggaaaaagttatgcacaaatgtggtctctaatgtatttccatagacgagacctaagactggcagcaaatgcgatatgttccgcagtgccaagtcactgggtgcccacatcgcgaaccacatggagcatacatgctaaacatgaatggatgactacggaggatatgttaacggtctggaatcgcgtttggataagagaaaatccctggatggaagataaaacaccagttgaatcttgggaagaaattccgtatttaggcaagcgggaggaccaatggtgcggttcattaatagggctcacgtcaagagccacctgggcaaagaatatccaggctgctatcaatcaagtcagatcgttaatcggaaatgaagaatacacagattacatgccatccatgaaaagatttaggcgagaagaagaggaagccggggtgctatggtag

SEQ ID NO: 22720 - RNA, 9876 nt, synthetic construct
  misc_feature 1..9876: note = derived and/or modified CDS sequence (opt6) from DENV-2__FJ410259__SS-prME
  source 1..9876: mol_type = other RNA
tcagcaggtatgatcattatgctaatacccacagtaatggcgtttcatctaaccactaggaacggagaaccacacatgattgtaggcattcaagagaaaggaaaaagtttactattcaaaactgaagacggagttaatatgtgcacacttatggctatggatcttggagaactttgtgaagatactatcacttataaatgtcctttattaagacaaaatgaaccagaagatattgactgctggtgtaattcaacatcgacctgggtaacgtacggaacatgcaccactacaggtgaacaccgacgtgaaaaacgaagcgttgcattagtaccgcacgtaggcatgggcctggaaacaagaacagaaacatggatgtcgagtgaaggtgcatggaaacatgctcaaagaatagaaacctggatactgcgacatccaggtttcacaataatggcagcaatactggcatatacaatcggaacaacacactttcaaagagtgttaatttttatattgttgacggcagttgctcctagtatgacaatgcgatgcattggtatctcaaacagagattttgtcgaaggggtttcaggcggctcttgggtagatattgtactggaacatggatcatgtgtaacgactatggccaaaaacaaaccgactttagatttcgaactgatcaaaacagaagccaaacaaccggctactttgcgaaaatattgcattgaagcgaaattaacaaatacaactacagaatcccgatgccctacacaaggagaaccgagcctcaaagaagaacaagataaaaggtttgtatgtaaacactctatggtagatcgtggttggggaaacggatgcgggctctttggtaaagggggaatagtaacatgcgcgatgtttacatgcaagaaaaatatggaaggcaaaattgtgcaacccgagaatttagagtacacaatagtagttactccccattccggtgaagaacatgctgtgggcaatgatacaggtaaacacgggatggaaatcaaagtaacaccgcaatcatccactacagaagcagagctaactgggtatggtactgtaaccatggaatgctctccgcgaacggggctagattttaatgaaatggtactcctacagatggagaataaagcgtggctagtacatcgacagtggtttttagatttaccacttccctggctacctggcgctgataaacaggagagtaactggatacaaaaagaaactttagtgacattcaaaaacccacatgccaagaaacaagatgttgtagtattgggttcacaagagggggcaatgcataccgctttaactggcgcaacagaaatacagatgagctctggaaatctattatttacagggcacttaaaatgtcgactacgaatggacaaacttcaattaaaaggaatgagttacagtatgtgtacgggaaaatttaaagttgtgaaagagatagccgagacacaacatgggaccatcgtaataagggtccagtacgaaggtgacggtagcccctgtaaaataccatttgaaattatggatcttgagaaaaggtatgtattagggcgattgattacagtgaaccctattgtcaccgaaaaagacagccccgtaaatattgaggcagaaccaccatttggggactcatatataataattggagttgaaccaggacaactaaaactaaattggttcaagaaagggagttcaatcggccaaatgttcgagaccaccatgcgaggagcaaaaaggatggctattctcggagatacggcatgggattttggctcattaggcggcgtttttacatcaataggaaaagcattacaccaagtatttggagctatatacggcgcggccttcagtggggtttcatggacgatgaaaatactaataggagtgatcattacatggattggaatgaacagccggtccacatctttatccgtatctttagtactggttggtatagtaacactatatttaggagtgatggtccaagcagactccggatgcgtggtcagttggaaaaacaaagaattaaaatgtggtagtggcatatttataacagataacgtccatacttggactgaacagtataaatttcaacctgagagtcctagtaaattagctagtgccatccaaaaagcacaagaggagggtatttgtggaattaggagcgtgactaggttggaaaacttaatgtggaaacaaatcactcccgagttaaaccatatactcgcagaaaatgaggtaaaacttacaataatgaccggggatatccgcgggattatgcaggcagggaaaagaagtctgaggcctcaaccaaccgaattgaaatatagctggaaaacttggggaaaagcgaaaatgctcagtactgagagctataaccaaacatttttgattgatgggcctgaaactgcggagtgtcctaacactaatcgtgcatggaactcattagaggtagaagactatggatttggggtgtttaccactaatatatggttaaaattaaaagaaaaacaagatgcgttctgcgatagtaaattgatgagcgcagctattaaagataacagagctgttcacgcagacatgggatactggatagaaagcgccttaaatgatacatggaaaattgaaaaagcatcatttatcgaagtcaaaaattgccattggcctaaaagtcatacattgtggtcaaatggtgttttagaatcagagatgatcataccaaagaaccttgccggcccagtttcgcaacataactatcggccaggttatcatacgcaaattgcaggtccctggcatttgggtaaactcgaaatggatttcgatttttgcgacggaactacggtaatagttacagaagactgcggcaatagagggccatcactcagaacaactactgcatcgggaaagctaataacagagtggtgctgcagatcatgtactttgcccccgctgagatatcgaggtgaagatggctgctggtatgggatggaaattagaccacttaaggaaaaagaagaaaatctagttaactcattagtcacagctggccatggacaagtagataatttttctttgggcgtcttaggaatggcactattcctagaggaaatgctgagaacacgcgttggcacaaaacatgctatcttactggcagcagtatctttcgttacattaataacaggtaacatgtcttttaaagacctaggcagagtagtagttatggtaggcgcaaccatggcagatgacatcgggatgggggttacatatcttgctctgttagcggcttttaaagttcgtccaacgttcgcggcgggacttttattaaggaaattaacatcgaaggaattaatgatgacgactataggtatcgtattattgtcgcagagcactatcccagaaacggttcttgagcttacagatgcgttagcgttaggaatgatggtcttaaagatagtacgcaacatggagaagtatcaactcgcggttacaattatggctatattatgcgtaccgaatgcagttatcctgcaaaatgcgtggaaagtgtcatgtacaatattggcagtagtatcagtcagcccactactcctaacctcatcacagcagaaaactgattggatcccattggcgcttacaattaaaggacttaatcccacggctatattcttaacgacgctatctcggacgaacaagaaacgatcctggccgttaaatgaagcaattatggcagtcggaatggtatcgatcctcgcatcatctttacttaaaaacgatatccccatgactgggcctttagtggctgggggtcttttgacggtatgttatgtactaactgggagaagcgcagatttagaactggaaagggcaacagatgtaaaatgggaggaccaggcagaaatctcgggaagtagtcctatcctcagtataacgattagtgaagatggaagcatgtctatcaaaaatgaagaagaagaacaaacgctaacgattctaatccgaacgggcctattagtaataagtggactgttcccaataagtattccaataaccgccgccgcatggtatctatgggaggtcaagaaacagcgagcaggggtgctctgggatgttccatctccaccaccaatgggaaaggctgagttagaagatggtgcctatagaatcaaacagaaaggaattttgggctattcacagataggtgcgggagtttacaaggagggaacatttcacactatgtggcacgttactagaggggcggtcttaatgcataaaggcaaacgaatcgaaccatcatgggctgacgttaagaaagatttgataagctacggaggcggttggaaattagaaggagaatggaaggaaggagaggaggtccaagtgctagcactcgagccaggaaagaatcctcgggcagttcaaacgaaaccgggactatttaagaccaatactggtaccataggcgctgtgagtctagacttcagtcctggtacttcaggaagcccaataatagacaagaaagggaaggttgtcggcctctatggaaatggagttgtgacaagaagtggggcctacgtcagcgcaattgcacagactgaaaagtcaatagaggacaatcctgaaatagaggatgatatattccgaaaacgtaggttaacaattatggacctacatccaggagcaggtaaaacaaaacggtacctacctgctattgtccgtgaagcaatcaagcgaggccttagaactttaatcttagctccaaccagggtcgttgcggccgaaatggaagaagcattgcgaggactaccgattagatatcaaacgcctgcaataagggcagaacataccgggagagaaattgtagatcttatgtgccacgcaacattcacaatgagattgttatcccccgttcgagtacctaattacaatctaattatcatggacgaagctcattttactgatccagcaagtattgcagcacgggggtatatcagcactcgtgtagaaatgggggaagccgcgggaatatttatgactgcaactccacccggaagcagggacccttttccacaatctaatgcacccataatagacgaggagagggaaatccccgagcgatcttggaactcagggcatgaatgggttactgattttaaaggaaaaacagtatggtttgtaccttcaatcaaagcaggcaatgatatcgcggcttgcctgagaaagaatggcaagaaagtcatccagctaagtagaaaaacattcgatagcgaatacgtaaaaacaaggacaaacgattgggatttcgttgttacaacggatataagcgaaatgggggcaaattttaaagcggagagagttatcgacccacgacggtgcatgaaaccggtaatactaactgacggtgaggagagagttattctagcggggccaatgccggtcacacattcctcagctgcacaacgtaggggccgtataggtagaaaccctaaaaatgaaaacgatcaatatatttacatgggagagccattagaaaatgacgaggactgtgctcactggaaagaagctaagatgttactagacaatataaacactccagagggaataataccgagcatgtttgaaccagagcgtgaaaaggtagatgcaatcgacggagaataccggttgagaggagaagctcgcaaaacatttgtagatcttatgcgcagaggggatttgccagtgtggttagcatataaagtggcagctgaaggcataaattatgccgatcggaggtggtgttttgatggaattaaaaacaatcagatattagaagaaaatgtagaggttgaaatttggacaaaagaaggagaacgcaagaagctgaaacccaggtggctagacgcaagaatatatagtgacccattggcacttaaggaatttaaagagtttgcagcaggaagaaaaagtcttaccttaaacttaattactgagatgggtaggcttcccacgttcatgacacagaaaactagagatgccctagataatctagccgttttacacaccgctgaagctggcggacgcgcctacaaccatgcgttaagcgaacttcctgaaacgctcgaaacattactcctactcacactacttgctactgtaaccggaggaatatttttatttctcatgtctggccgaggaattggaaaaatgacgttgggaatgtgctgcatcatcacagcgagtatcttactatggtatgctcaaattcaaccacattggattgctgcaagtataatcctagagttctttttaatagtgcttcttatcccagaacccgaaaaacaacgaacacctcaagacaaccaactaacgtatgtggttattgcaatattgaccgtagtagctgcaacgatggcgaatgaaatggggtttctggagaaaaccaagaaagatctaggtctcggttccatagcaacgcagcagccagaaagtaatatcttagatattgatttaagaccggcttctgcatggaccttatatgctgttgcaactacctttgtcacccctatgttaagacattctattgaaaatagttctgtcaacgtatcactaacagctatagcaaaccaagcaacagttttgatggggcttgggaagggatggccactatctaaaatggatattggagtaccgcttctggcaataggctgctactctcaagttaatcccattactctgaccgcagcattgttactcttagtagcacactatgctattatagggcccggtttacaagcaaaagcgactcgagaagcacagaagagagctgccgcaggaataatgaaaaatcccacggtagatggaattacagttatagatctcgatccgataccatatgaccctaagtttgaaaagcaactagggcaagtcatgttacttatcttatgcgttacacaggtattaatgatgagaactacctgggctctttgtgaagcgttaacgttggcaacaggtccgatctcgactctatgggaagggaatcctggaagattctggaacactacgattgcagtgtcaatggctaatatattccgggggtcatatttagcgggtgcaggattactattttctattatgaagaatacaactaacacgagaagaggaactggcaatattggagaaaccctaggagagaaatggaaatccagattaaatgcattaggcaagtccgagtttcagatatataagaaaagtggcattcaggaagttgatagaactttagctaaagaaggtattaaaagaggggagaccgaccatcacgcagtatcaagaggatcggcgaaattgagatggtttgtcgaacgtaatatggtaacaccggaaggcaaagtggtagatctgggatgcggacgaggaggatggtcatactattgtggtgggctaaagaacgttagggaagtgaaggggctaacgaaaggaggacctggacacgaagaacccatcccaatgagtacatacggttggaatttagtccggttacaaagtggtgtcgacgttttctttattccacccgaaaaatgtgatacattactgtgtgatataggagagtcctcacccaatccaacggtggaggcaggtcgcactctccgtgtcttaaatttagtagagaattggctaaataacaacactcaattctgtataaaagtgcttaatccttacatgccctccgtaatagagaaaatggaggcacttcaaagaaagtatggaggagctcttgtaagaaatcccttaagcagaaacagcacacacgagatgtattgggtatcgaatgccagtggaaatattgtaagctcagttaatatgatatcacgtatgttaattaatcgatttacaatgagacataagaaagctacctacgagccagatgttgatctggggtctggaactagaaacataggaatagaaagcgaaatacccaacttagacatcattggtaaacggattgaaaagatcaaacaagaacacgaaacttcctggcactatgatcaagatcacccatataagacatgggcttaccacggatcatatgaaacaaaacagacaggtagcgcatcttcaatggtgaatggggtagtgcgactattgacgaaaccgtgggacgtattgccgacagtcactcaaatggctatgacagatactacaccatttggacagcagcgcgtatttaaagagaaagtagatacaagaacccaggagcccaaggaggggacaaagaaattaatgaaaatcacagctgaatggttatggaaagaattgggtaaaaagaaaactccccgaatgtgcacgcgtgaggaatttactaggaaggtacgatcaaacgcagcactcggggctatattcacagatgaaaacaagtggaaaagcgcccgtgaagccgtagaagacagtaggttctgggaattagtggataaggaaagaaacttacatcttgaagggaaatgtgaaacttgtgtgtacaatatgatgggcaaaagggagaagaaactaggagagttcggcaaggcaaaaggtagtagagccatctggtacatgtggttgggagcaaggttcctggaatttgaagccttggggtttttgaatgaagatcactggttcagtagagaaaactcattgtcaggagtagagggagaaggcttacataaactaggatacatattgagagatgtttcgaagaaagaaggaggggcaatgtacgctgatgatacggctggatgggatactagaatcacgctagaagatctaaagaatgaagaaatggttacaaaccacatggaaggcgaacataagaaactagcagaagcgatattcaaattaacctaccagaataaggtagttagagtgcagcgtccaacacccagaggaaccgtgatggatataatatcgcgtagagatcaaagaggatcggggcaagttggtacatatggtctaaacacatttaccaatatggaggcacaactaatccgacaaatggagggagaaggtgtatttaaaaatatacaacatctaaccgtgacagaggaggtagccgtccacaattggctagctagagtaggacgggaacgactatcgaggatggcaatctccggagatgattgtgtggtaaagcccctggacgatcggtttgctaacgctcttactgccctgaacgatatgggtaaaatacgtaaagatatacaacagtgggagccctcaaagggctggaacgattggacacaagttccgttttgctcacaccattttcatgagctaataatgaaagatggtcgtattcttgttgtcccgtgtcgcaaccaagatgaattaataggaagggcaagaatctcccaaggtgcaggatggagtttaagagaaactgcatgcttaggtaaatcttatgcccagatgtggtcactaatgtacttccacagaagagatttaaggttagcagctaacgctatatgttccgcagtaccaagtcactgggtaccaacgagcagaacaacgtggtccatacatgccaaacatgaatggatgactaccgaagatatgctaaccgtgtggaatagagtgtggatacgggagaacccctggatggaagataaaacccccgttgaatcatgggaggaaataccttatttaggaaaaagagaagatcaatggtgcgggtcactcatcggcctaacctctagggccacatgggccaagaatatacaagcagcaattaaccaagtacgatcgttaatcggaaacgaagagtatacagattacatgcccagcatgaagcgatttagaagagaagaagaagaggctggtgtattatggtga

SEQ ID NO: 22721 - RNA, 9876 nt, synthetic construct
  misc_feature 1..9876: note = derived and/or modified CDS sequence (opt6) from DENV-2__FJ547067__SS-prME
  source 1..9876: mol_type = other RNA
tccgcgggtatgataataatgttaataccaactgtgatggcattccaccttactacgcgaaatggagaaccacatatgatagttggaatacaagaaaaaggaaaatcactactatttaaaacagaagacggcgtgaacatgtgtacattgatggctatggatctaggcgaactatgcgaagatactattacatacaaatgcccattgttacggcaaaacgaacctgaagatatagattgctggtgcaatagcacatcgacgtgggttacatatggaacatgtacaacaacaggcgaacacagacgagaaaaacgttcagtagctctagtaccgcatgtaggtatgggattagaaacaaggactgaaacttggatgtcctcagaaggagcatggaaacacgcacagagaattgaaacatggatccttagacatccaggcttcacaataatggcagcaattttagcgtatacaattggaaccacacacttccagagggtattgatatttatattacttacggccgtagcacctagcatgacaatgagatgtataggaatatcaaacagagatttcgttgagggggtatcaggaggttcatgggttgatatcgtccttgaacatgggtcatgtgtgacaacgatggctaaaaataaacccacattagattttgagctaatcaaaactgaggccaaacaacctgcaacactcagaaaatactgtatagaggcaaaactaaccaatacgacaacagaaagtcgatgtcctacgcaaggagaaccttctttgaaagaagaacaagacaaaagatttgtttgtaaacattcaatggtcgatcgtgggtggggaaacggatgcggcctattcggaaaaggaggcatagtaacgtgtgctatgttcacatgcaagaaaaatatggaaggtaaaatagtgcagcccgaaaatctcgagtatactatagtagtcacaccgcacagcggtgaagaacatgcagtgggtaatgacacaggcaaacacgggcaggagataaaagtgacgccccaatcatctatcacagaggcagaactaaccgggtatggtaccgttacgatggaatgttctcccaggacaggactagactttaatgaaatggttttactacaaatggagaataaggcttggctagttcatagacagtggtttctagacctcccactgccttggctacctggggcagataaacaagaatcaaattggatccaaaaagagaccttagtaacgttcaaaaatccgcatgcgaagaagcaagacgtggtagtgctaggctcgcaagaaggagctatgcacactgcattaactggagcgaccgaaatccaaatgagtagcggaaatctactattcactggacacttaaaatgtaggcttagaatggataaattacagttgaaaggaatgtcatatagtatgtgtacaggaaaattcaaggttgtcaaggagatagctgaaactcaacatggcacgatagtgataagggtacaatatgagggcgatggaagtccttgtaaaataccatttgaaataatggatctagaaaagaggtatgtattaggacgattaataacggtgaaccctattgttacagaaaaggattcacctgtaaacattgaggcagaacctccatttggggacagttacataattattggagtcgaacccggacaacttaaattaaattggtttaagaaaggttcgtctattggtcaaatgttcgaaactacaatgcgaggggcaaaaaggatggcaattttgggggataccgcttgggacttcggttcattaggtggagtattcaccagtataggaaaagcgttacatcaggtattcggagcaatatatggtgcagcgttttcaggagttagttggacaatgaaaatattaattggagtaattataacatggataggaatgaacagcaggagcaccagcttgtcggtatcattagtcttagtaggaatagttacactttacctcggggtgatggtacaagcggactctggttgcgtcgtcagctggaaaaacaaggaactaaagtgcggatcaggtatatttataaccgacaatgtacatacatggacagaacaatataagttccagcccgaatcaccatcaaaattggcaagtgcaatacaaaaggctcaggaagaaggcatatgtggaataaggtccgtgacacgattggaaaatttgatgtggaaacagattaccccagaattgaatcatatacttgcagaaaacgaagtaaaactgacaatcatgacaggtgacatcaagggaatcatgcaagctggtaagaggagtttgcgtccacaaccaaccgaactaaaatacagttggaagacatggggaaaggcaaaaatgctctctactgaaagctacaaccaaaccttcttaatagacgggccggaaactgcggagtgcccgaacactaatagagcatggaactcacttgaggtagaagactacggatttggtgtattcacgacgaacatatggctaaagttgaaagagaaacaagacgcattctgtgatagcaagctcatgagtgccgctattaaggataatcgtgcagttcatgcagatatgggttattggattgaaagtgctttgaatgatacttggaaaatcgaaaaagcatcttttatagaagtcaaaaattgtcattggcccaaatcgcacacgttgtggagtaacggcgtattagaatcagagatgataattcctaagaatttggcggggccagtaagccaacacaactatcgtccgggttatcatactcagatagcaggaccatggcatctaggcaaacttgagatggatttcgacttctgtgatggaactactgtgattgtaactgaggactgcgggaataggggcccatcactcagaacaacaactgcatcaggaaaacttatcacagaatggtgttgtagatcatgcactctaccaccactaaggtatcggggtgaagacgggtgttggtacggaatggaaatcagaccgctaaaagaaaaagaggaaaatctggtaaatagtctagtcactgccggtcatggccaagtcgataacttttccctaggagtacttggaatggctttattccttgaggaaatgttaagaacacgagttgggactaaacacgctatactattagttgccattagcttcgtaacactaataaccggcaatatgtcttttaaagatctaggaagagttgttgtgatggtaggcgcgaccatggcagatgacattggcatgggggtaacatacctcgcgctcctagctgcttttaaggtaagaccaacgttcgctgcagggcttttacttagaaaacttacatctaaagaactaatgatgaccacaataggtatcgttctgctaagccagtcaacaattccagaaacagtccttgaattaactgatgcgttagcgctcggaatgatggtgctgaaaattgttcgtaacatggaaaaatatcagttggcagtaacaatcatggcaatcctatgtgtccctaacgctgtaatcctccagaatgcatggaaggtaagctgcacaattctagctgctgtatcggtcagtccactacttctgacgtcaagtcagcagaaaacggactggataccactagctttaacgataaaaggtctgaatccaacagcaatatttctgactactctatccaggacaaacaagaaaagatcatggccgctcaatgaagcaatcatggcagtcggtatggtcagcatattagcatcaagtctgcttaaaaacgacatacccatgacgggaccactggtggctggtggtcttctaactgtatgctacgtcctgacaggtagaagtgctgacttagagttagaaagagcaaccgacgtaaagtgggaggaacaagctgaaatttctggatccagcccaatattgtcaataacaatatcggaagatggtagtatgtccatcaaaaatgaggaagaagaacagacattaaccatattaataagaacaggactattagtgatctctggcctgtttcccatatcgatccctatcactgcagctgcgtggtatctatgggaagtcaagaaacaacgagcaggcgtgttatgggatgttccgagtcctccaccaatggggaaagccgaattagaggacggtgcatatagaattaaacaaaaaggtatactaggatactctcaaataggcgctggtgtatacaaagaagggacgttccacaccatgtggcatgtaacgcgaggggcagtattaatgcataaaggaaaacggattgagccatcatgggcagacgtaaagaaagacttaatttcgtacggtgggggctggaaattggaaggcgaatggaaagaaggggaggaagtgcaagtacttgcattagagcccggcaaaaatccacgggccgttcaaacgaaaccaggactatttaagacaaatacagggacaataggagcagtctcattagatttttcaccaggaacatccggatcccctataattgacaagaaagggaaagtcgtaggtctttacggcaacggggtggttacgagatccggtgcatacgtatctgcaatcgctcaaacagagaaatcaattgaagataaccccgaaattgaagatgacatattcagaaagaggagactgactataatggacctacatccgggtgccggtaaaaccaaaagatacctgccggcgattgtacgagaagcaataaaaagaggactcagaacgctcatcctagcacctacacgagtcgtagcagcggagatggaagaagcattaaggggactacccataagatatcaaactcccgcgataagagctgagcatactggaagggaaatagtcgatttaatgtgtcacgcaacgtttaccatgagattactaagccctgtcagggtccctaattataatttaataataatggacgaagctcacttcacagatcccgcaagtattgcggctaggggatatatctcaacgagagtggagatgggagaagccgcaggaatatttatgacagccactcctccaggtagtagagatccatttcctcaatcaaacgcaccaattatcgacgaagaaagagaaatacctgagagatcgtggaactccggacatgaatgggttaccgattttaaaggtaaaacagtgtggtttgtacccagtattaaagcagggaatgacatagcagcctgtcttaggaaaaatggcaagaaagtaatacaattatcaaggaaaacgtttgattctgagtacgttaagacaaggaccaatgattgggattttgttgtaactactgatataagcgagatgggagcaaatttcaaggcagagagggtaatagatccgagaagatgtatgaaaccagtgatactcactgatggggaagagagagtaattttagcaggccctatgcctgtgacacatagttcagcagcacaacgccgtggacgtattggtaggaatcccaaaaatgaaaatgaccagtacatttatatgggagaaccgttggaaaatgatgaagactgcgcgcactggaaggaagcaaagatgcttttagataacataaatactccagaaggaataataccatcaatgttcgaaccggaacgggagaaagtagacgcaatagacggagaatataggttgaggggtgaagccagaaagacttttgtcgatctcatgaggcggggagatcttccggtatggttagcgtataaggttgctgccgaagggataaattatgccgacaggaggtggtgttttgatgggatcaaaaacaatcagatattagaagaaaatgtcgaagtagagatatggactaaggagggtgagcgaaagaaattaaaaccacgctggcttgatgctcgaatctatagtgaccctcttgctttaaaagaatttaaagagtttgctgcaggacgcaaatccttaacgttaaatttgataactgaaatggggcgcctaccaacatttatgacacagaaaacaagggacgcactagacaatttagctgtattacatacggctgaggcgggtggacgagcttacaatcacgcactatctgagctaccagaaactcttgaaactctactacttttaacattactcgctacggtgaccggaggaatcttcttgtttttaatgagcggtagaggtattggtaaaatgactctaggtatgtgctgcattataacagcttcaatactcctgtggtatgcacagatccaaccacattggatagcagcctcgattatattagaatttttcctaatagtcttgctaattcccgaaccagaaaaacaaaggactccgcaagacaaccaattgacctatgtagtaatagctattctaactgtggtagcggctacaatggcaaacgaaatgggatttttagaaaagaccaaaaaggatttaggtcttggcagcatcgctacccagcaaccagagtcaaatatactggacattgatttgcgaccagctagcgcatggacactctacgccgtagcaacgacttttgtaacccccatgctaagacactcgatagaaaacagttcagttaatgtcagtcttactgctatcgctaatcaagcaaccgtattaatgggactaggtaaaggctggccgttgtccaaaatggatataggtgttccattactagcaattggatgttatagccaagtgaatcccatcacattaactgcggcactactcttgcttgtcgcacattatgccattattggtccaggacttcaagctaaagctaccagggaagcgcaaaagagagcagcagctggaattatgaagaatccgacagtagatggaataactgtaattgacttagatccaatcccttacgatcctaaatttgaaaaacagctcggtcaagtaatgttattaatcctatgcgttacacaagtattaatgatgaggactacatgggccttatgcgaagccttaacgttggccactggcccaataagtacactatgggaggggaatccagggagattttggaacacaactatcgcagtctccatggcgaacatattccgtggcagttatttagccggtgccggccttctattctcaatcatgaaaaacacaaccaatacaagaagggggacaggtaatatgggagaaacgttgggggagaaatggaaaagtagactgaatgcgttaggaaaatcagaatttcaagtgtacaagaaaagcggcattcaggaagttgaccgcacattggcgaaggagggaattaagagaggtgaaactgatcaccatgctgtgtctagaggctctgctaaattaaggtggtttgtggaacgaaacatggtaacaccggaaggtaaggtggttgacttgggttgcgggagagggggttggagctactattgcggaggcctaaagaatgttcgagaggtcaagggtctgactaaagggggtccaggacatgaagaaccaatacctatgtctacgtatggttggaacctagttagactccaatcaggagtagatgttttcttcataccgcctgaaaaatgtgacaccctattatgtgatataggcgaatcatcacctaatccaactgtggaagccggaagaacactaagggtacttaaccttgttgaaaactggttaaataacaacacacaattctgtataaaagttctaaacccatatatgccttcggtaatagagaaaatggaggcactacagcgaaaatacggtggagccttagtgcgaaatcctctatcaagaaattcaacacacgaaatgtattgggtatcaaacgcgagcggaaacattgtctcgagtgtaaatatgataagtcgaatgttaataaataggtttacaatgcggcataagaaagccacatatgaacctgatgtcgacttaggctcgggaacgcgcaatataggcatcgaaagtgaaataccaaatctagacatcataggcaagaggatcgagaaaataaaacaggaacatgaaacttcctggcattacgaccaagatcatccttacaagacgtgggcgtaccacggttcgtacgagacaaaacaaactgggagcgcgtcttccatggtcaatggcgttgtgcgcctactgacaaaaccatgggatgttttaccgacagtaactcaaatggcgatgacggacacgacaccgttcggccagcaaagagtgttcaaagaaaaagtcgacacacgcacacaagaacccaaggaagggacgaagaaattaatgaaaatcactgcagaatggctatggaaggaactaggaaggaagaaaacaccaagaatgtgcacacgagaagaatttacccgaaaggtgagatcaaacgcggcattaggagcaatattcacagacgaaaataagtggaaaagtgcaagagaagcagtagaagatagtcggttctgggaattagtagataaagaaagaaaccttcatctagagggaaagtgcgaaacttgtgtctataacatgatgggcaagagagagaagaaactgggagagtttggaaaagctaagggaagccgcgctatatggtacatgtggttaggagctagattcctcgaatttgaagcgttgggtttcttaaatgaagaccactggttttctagagaaaattcgttatctggagtagagggtgaaggcttacataaactcgggtacatactaagagatgtaagcaagaaagagggcggggctatgtacgctgatgatacagcaggttgggataccaggatcacgctagaagacctgaaaaatgaagaaatggtaacaaaccatatggaaggtgaacataagaagctagctgaagcaatctttaagttaacgtatcagaacaaagtagtacgggtccaaagacctacaccacgtgggaccgttatggatatcatatcaagaagagaccaaaggggctcgggtcaagtaggaacttacggactcaacacatttactaatatggaggcacaactgatacgtcagatggaaggggaaggtgtttttaaaagtatacaacaccttacggtcaccgaagaagtcgccgtgcaaaattggctcgctcgtgttggacgagaacgcttgagcagaatggcaattagtggagacgactgcgtcgtaaagccattagatgatcgttttgcaaacgcactaaccgcattaaatgatatgggaaaaataagaaaagacatacaacaatgggaaccctcaaagggatggaatgactggactcaggtcccattttgctcacaccacttccatgaattaataatgaaagatggacgcgtcctagttgttccatgcaggaatcaagatgaattgattggccgggctcgcataagccagggcgcaggatggagcttacgagaaacagcttgtctaggaaaaagttacgcacagatgtggtctttgatgtacttccatagaagagacctaagacttgcagcaaacgcgatatgttccgcagtgcctagtcattgggttcccacctcaagaacaacttggagcattcacgcaaagcacgagtggatgacgaccgaggacatgttgacagtatggaatcgcgtgtggattagagaaaatccgtggatggaagataaaacacctgttgaatcgtgggaagaaataccttatttaggaaaacgagaagatcaatggtgtggtagtctaattggcctaaccagcagggcgacgtgggccaaaaacatccaggctgcgataaaccaagtaagaagtctgatcggcaatgaagaatatactgattatatgccttctatgaaaagatttagaagagaagaggaagaagcaggcgtactttggtaa

SEQ ID NO: 22722 - RNA, 9876 nt, synthetic construct
  misc_feature 1..9876: note = derived and/or modified CDS sequence (opt6) from DENV-2__JN819418__SS-prME
  source 1..9876: mol_type = other RNA
acagcaggggtcattataatgttaataccaacagcaatggcatttcatttgactacaagaaacggggaacctcatatgattgtcggaaggcaagaaaaaggaaaatcgttactatttaaaacagaagatggggtgaacatgtgcacgctcatggcgattgacctaggcgaattatgtgaagatacaatcacgtacaaatgcccactactgaggcaaaatgaacctgaggatatagattgctggtgcaactctacgagtacatgggtgacgtatgggacgtgtactactacgggtgaacacaggcgggaaaaacggagtgtcgcgctagttccacatgtagggatgggactagaaacgcgaacagaaacatggatgagtagtgaaggtgcttggaaacacgtccaaagaattgaaacttggatattgcgccaccccggtttcacaatcatggcagcaatactcgcgtatacgatcgggacaactcactttcaacgtgcgttaatatttatcctcttaacagcagtcgctcctagcatgactatgaggtgcattggaatatcaaatagagattttgtagaaggagtatctggaggctcatgggtagatattgtgcttgaacatggatcttgcgttaccactatggccaaaaataaacctaccttggatttcgaactaataaaaaccgaagcaaaacaacccgcaacactccgaaaatactgtatagaagccaaattgacaaacacgacaaccgagagccgatgtccaacacagggggaaccgagtctcaatgaggagcaagataaaagatttgtatgtaaacatagtatggttgacaggggctggggaaatggctgtggactctttgggaaaggtggtattgtgacttgcgcgatgtttacatgtaagaaaaatatggaaggaaaagttgtactgcccgaaaatctcgagtacacaatagtaattacaccgcatagcggagaagaacacgcggttgggaatgatacgggaaaacatggtaaagaaattaaaattactccacaatctagcattacagaagcagaactcactggttatggtacagtgacaatggaatgctccccaaggacaggtttagactttaacgaaatggtacttttacaaatggaggataaagcatggcttgttcatagacaatggtttttagaccttcctttgccctggctacccggggcggatacacagggtagcaattggattcaaaaggaaacactcgtaacatttaaaaatccacacgcaaagaaacaagatgtagttgtgctaggttcacaggagggggctatgcatacagccctaacaggagcaaccgaaatacaaatgtccagtggcaatttgctatttaccggtcatctaaaatgtagactaagaatggataaacttcagctgaaagggatgtcatattctatgtgcacagggaaatttaaaattgtaaaggagatagcagaaactcagcatggaacgattgtgatacgggtgcaatacgaaggggacggctctccttgtaagattccatttgaaattatggatctcgagaaaagacatgtactaggtaggcttataacagtaaacccaatagttacagaaaaagatagccccgtaaacatcgaagcggaaccgccttttggcgactcatatattattattggggttgagccgggtcaactgaaactcaactggtttaagaaaggatctagtataggacagatgttcgagacgaccatgcgaggggccaagcgcatggctatattgggtgatactgcatgggatttcggaagtctaggaggggtgtttacaagcattgggaaagcgttgcatcaggtattcggggctatttatggcgcggccttttcaggggtatcgtggacaatgaaaatcttaattggtgtgatcataacatggataggtatgaactctagatcaacttcattaagcgtatctctagtgctagtaggagtagttactctctatctcggggcaatggtacaagcagactctggttgtgtcgtaagttggaaaaataaagaactaaaatgtggaagcggcatctttatcacagataatgtacatacttggactgaacaatataaattccaaccggaatctccgtctaaacttgctagtgcgatacagaaagcccatgaggaaggaatttgtggtatcagaagtgtgacacgactagaaaatttgatgtggaagcaaattactcccgaattgaatcatatcttatcggagaacgaggtaaagctaacgattatgacaggagatattaagggaatcatgcaagctggaaaacgcagtttaagaccccaaccaactgagctcaaatactcttggaaaacgtggggaaaagctaaaatgttatcaacagagtcacataatcaaacatttttgattgacggaccagaaacagcagaatgtcccaacacaaaccgagcatggaactccttggaggtagaagattatggattcggggtcttttcaacgaatatttggcttaaactaagggaaaaacaagatgtattttgtgatagtaaacttatgagcgcggcaatcaaagataacagggcagtccatgcagatatgggctactggattgaaagtgccttgaatgacacttggaaaatggaaaaagctagttttatagaggttaagtcatgtcattggccaaaatcccatacactatggagtaacggagtattggaaagtgaaatgataataccgaaaaacttcgcaggcccagtatctcagcacaattatagaccggggtaccatacacaaacagcgggaccgtggcacctaggaaaattggaaatggatttcgacttctgtgaaggaacaaccgtcgtggtgacggaggactgtggaaatagaggcccaagtctaagaacgacaacagcaagcggtaaactgattactgagtggtgttgcaggtcatgcacactacctccattaaggtatagaggggaagacgggtgttggtacggaatggaaatccgcccactgaaagagaaggaggaaaaccttgtaaattctctagtgacagcagggcacgggcaaattgataatttcagtctcggagtactcggtatggctctgttcttggaggagatgttacgcactagggtagggacgaagcacgcgatactattagtagccgtgagcttcatgacgttgattaccgggaacatgtccttccgagatctaggacgtgtaatggtcatggtgggtgccacaatgaccgatgatatcggtatgggagtcacgtatctagcacttctagctgccttcaaggtaagacctacatttgcagcaggtctgttactaaggaaacttacgtcgaaagaactcatgatggcaacgattggcatagctcttttatcacaaagtaccatacctgaaactattttggaattaacagacgcattggcgttaggtatgatggtgttaaagatcgttagaaatatggaaaaatatcaactagctgtgacaattatggcaatatcatgcgtaccaaacgccgtaattctacaaaatgcatggaaagtaagttgtacaatattagcagctgtctccgtttccccgctgctactaacaagttcacaacagaaggcagactggatacccttagccctcacaataaagggattaaacccaaccgccatctttttaaccaccttaagccgaaccagcaaaaagagatcatggcccctaaatgaagctataatggcagtcggcatggtaagtatattagcttctagtttgcttaaaaatgacattccaatgacggggcctctagtagctgggggactcctgaccgtatgttatgttctcactggtagaagtgctgacctagaactagaaagagctgctgacgttaagtgggaggatcaggcagaaatatctggttcaagtcccatcctctccataacaattagtgaagacggaagtatgagtattaaaaatgaagaggaagaacaaacactaactatattaattagaactggattattagtaatctccggattattccccgtctcaataccaattacagccgcagcatggtatttatgggaagtgaaaaagcagagagcgggggttctttgggatgtaccatccccaccaccagtgggaaaagcggaactagaagatggggcatatagaataaaacaaagaggaattttaggatatagtcaaataggtgcaggagtatataaagaagggaccttccatacaatgtggcatgttacgcgaggtgcagtactaatgcatcgtggaaaaagaatcgaaccatcatgggcagatgtcaagaaagacctaatcagctatggaggaggatggaaattagaaggggagtggaaagaaggtgaagaagtccaggttttagccttagaaccgggcaaaaatccccgagcagttcagacaaagccgggtttatttaaaacgaatacaggcacaataggcgcagttagccttgattttagtcctggcacatctggaagccctatcgtagataggaaaggaaaggttgttggattatatggtaacggtgtagttacaagaagcggtgcatatgtttccgcaatagcacaaacagaaaagagtatagaggacaacccagaaattgaggatgatatattcaggaagaaaagacttaccatcatggacttacatcccggtgccggaaaaactaaaagataccttccagctatagtcagagaagctattaaacgcggattacggactctaattcttgcacctactagagtagtagcagcggaaatggaagaagcattacgaggtcttccaatacgataccagacaccagcaatacgtgcagaacatacgggccgggagatagtagatctcatgtgtcatgcgactttcacaatgaggttgttaagtccagttcgagtgccaaattacaacttaatcatcatggatgaggcccatttcactgatccggccagcatagcagcaagaggctacatatcaacgcgggttgagatgggtgaggcagctggaatttttatgactgcgacgcctcctggtagcagggacccattcccgcaatctaacgcaccgattatggacgaagaaagggagatacccgagagatcgtggaactcaggacatgaatgggttacagatttcaaaggcaaaactgtatggtttgtgccaagcataaaagctgggaatgacatcgcggcatgcttaaggaaaaatggtaagaaagtgatccaattaagtcggaaaacattcgattcagaatatgttaaaactagagcaaatgactgggatttcgtcgtgacaaccgatatttctgagatgggggctaattttaaagcagaaagggtaatcgatcctagaagatgtatgaaaccagtaatattaacagacggagaagaacgtgtcatattggccggacctatgccggttacgcacagctcagctgcacagagaaggggtaggattggccggaatcccaaaaatgagaatgatcagtatatctatatgggagaacccctagagaatgatgaagactgcgcacattggaaagaagccaagatgttactagataatattaacacacctgaaggcattataccctcaatgtttgagccggaaagggagaaggttgatgcgatagacggagaataccgcttaaggggagaagctcgaaaaactttcgtagacctaatgagaaggggcgacttgccagtgtggttagcctatagagtagccgctgagggtatcaattacgctgacagacgatggtgcttcgatggcataaagaataatcaaatactagaagagaatgttgaggtcgaaatatggaccaaagaaggagaaaggaaaaagctcaaacctaggtggttagatgcaaggatttatagcgaccccttggctttaaaggagttcaaagaatttgctgctggaaggaaaagtttgacactcaatttgataactgaaatgggtcgcttaccgacattcatgacacaaaaggctagagatgcgttagataacttagcagtattacacacagcagaggctggtgggcgagcgtataatcacgctttatcggaattaccagaaactcttgagacgttactactcctaacacttttagcaactgtaacagggggcatatttctatttttaatgtctggtaaggggatagggaaaatgacgctgggtatgtgctgcataataacggcatcgatactgctctggtatgcacaaatacaaccacattggatcgcagcttcaataatactggagttctttttaattgtacttttaataccggaacccgaaaaacaacgaacaccgcaagataatcagttaacttatgtagtaattgcgatactaacggtagtagctgctaccatggcaaacgaaatgggtttcctcgaaaagaccaagaaagatcttggcctgggaagcattacgacgcaggaaagcgaatctaatattttagacatagatctcagaccagcgtctgcctggaccttatatgcggtagctaccacattcgttactcctatgctacgtcatagcatagaaaactcctcagtgaacgtttcattgactgcaattgctaaccaagcaaccgttttaatgggattaggaaaaggatggccattgtctaagatggacattggggtcccgttgttagcaataggatgttattcacaagtcaatccgattacattaacagctgcattgttacttttagttgcgcattatgcaattataggcccaggactacaagctaaagcaactagagaagctcaaaagagagcagcagcggggataatgaaaaatcctacggttgatggaataaccgtaattgatttagacccaataccctatgatccaaaatttgaaaaacaattaggccaagtgatgttgttaatcttatgtgttacgcaagttctaatgatgagaacgacatgggcattgtgtgaggcactaacattagcaactggaccgattagcaccctatgggaaggaaacccaggtaggttttggaacacaacaatcgcggtatcaatggcaaacatctttagaggatcttacctcgctggagcaggactcttattctctatcatgaagaatacaactaatacacgccggggaactggtaatataggagaaacgctcggagaaaagtggaaatcacgactaaatgccttagggaaatccgagttccaaatctacaagaaaagcgggatccaagaagtagaccgtacattagcaaaagaaggcatcaaacgcggtgagacggatcaccacgctgtaagtcgtgggtctgctaaattacgatggtttgtggaacgaaacatggttactcctgaggggaaggtagtggatcttggatgtggccgtggaggatggtcatattattgtggtggactaaagaatgtaagggaagtaaaaggactaacaaagggtggaccaggtcacgaagaacctattccaatgagcacttacggatggaatttagtaagactacaatcaggagttgatgtattcttcacgccacctgaaaaatgcgacactctactatgtgatataggagaatcttctcctaatccaacaatcgaagctggaagaactttgagagttctgaatttagtggaaaattggctgaacaataacacacagttctgtatcaaagtgttaaacccgtatatgccgagtgttattgagaaaatggagactttacagagaaaatatggaggtgccttagttcgaaatccactatcgagaaattctacacatgagatgtattgggtgagcaacgcaacaggtaatatagtttcatcagtaaatatgataagtcggatgctaataaatcgttttaccatgaaacacaagaaagcgacttatgaaccagatgtagatctaggtagcgggactcgtaacattggcatagaaagtgagattccaaatctagacattattgggaaaagaattgaaaagataaaacaagaacacgagacatcttggcactacgaccaagatcatccttacaaaacgtgggcttatcatggctcatacgaaacgaaacagacaggatccgcgtccagtatggtgaatggggtagtaagactactaacaaagccctgggatgtagtacctatggtaactcaaatggcaatgactgatacaacaccctttggacaacaaagagtgtttaaggaaaaagttgatacaaggacccaggagccaaaagaaggtaccaagaaattaatgaaaattacggcggaatggttgtggaaggagctagggaagaagaaaacacctagaatgtgtactcgggaggaatttaccagaaaagtacgatctaacgcagcactaggggccatattcacagacgaaaacaaatggaaatcagcaagagaagccgtggaagacggtagattttgggaattggtcgaccgtgaaagaaacctacatctagaaggtaaatgtgaaacttgcgtatataatatgatgggtaaaagggagaagaaacttggagaatttgggaaggctaaaggtagcagagctatctggtacatgtggttaggggctagatttttggaatttgaagcactcggctttttaaatgaagatcattggttctcccgagaaaactcattgtctggagtagaaggggagggactccacaaactcggttatatccttagagatgtttcgaaaaaggagggaggagcaatgtacgcagacgacactgcagggtgggataccagaataactcttgaggatctgaaaaatgaggaaatggtaactaaccatatggaaggagagcataagaaactggcagaggccatatttaaattgacttatcaaaacaaggttgttagagtacaaagaccaacacctagaggtaccgtaatggacataattagccgaagggatcaaagaggatccggacaggttgggacgtatggattgaacaccttcacaaatatggaagcacaattaatacggcaaatggaaggcgaaggaattttcaaaagtattcaacacttaactgtaacggaagaaatagcggtccaaaactggctagctagagtcggaagggaacgcttgtcaagaatggcaataagtggggatgactgtgtcgtcaaacccctcgatgatcgcttcgcgtcagctcttacagcactgaatgacatgggtaaagtgaggaaggacatccaacagtgggagccgagtagaggttggaacgattggactcaagtgccattctgcagccaccactttcatgaattaataatgaaagacggaagagtattggtcgtgccatgcaggaatcaagacgagttaattggccgcgcgagaatcagtcagggggctggatggtctttaaaggagaccgcatgtttaggaaagtcttatgcccaaatgtggaccctaatgtactttcatcgacgtgacctacgattagctgcaaacgccatttgttcagcagttccttcgcactgggttccaacatcacgtacgacttggtcaattcacgcaaaacatgagtggatgactactgaggatatgctagcagtgtggaatagagtgtggatccaggagaatccgtggatggaagataagactccagtggaaagctgggaagaagtgccttatttaggaaaacgtgaagatcaatggtgtggctcattaataggtcttacatcacgtgctacatgggcgaaaaacatacaaactgcaatcaatcaagtaagatcgcttataggtaatgaagaatacacagattatatgcctagcatgaaacgatttcgaagagaagaggaagaagcgggggtgttatggtaa

SEQ ID NO: 22723 - RNA, 9876 nt, synthetic construct
  misc_feature 1..9876: note = derived and/or modified CDS sequence (opt6) from DENV-2__EU482640__SS-prME
  source 1..9876: mol_type = other RNA
acggctggaataataatcatgatgataccaacagttatggcatttcaccttacaacacgtaatggtgaaccacatatgatcgtatcacgacaagaaaaaggaaaatcactgttattcaaaacggaaaacggagtaaatatgtgtacattgatggctatggatttaggagaattatgtgaagatacaataacttataactgcccattacttagacagaatgaacctgaagatatcgattgttggtgtaatagcacaagtacatgggtaacatacggaacatgcactgcaactggggaacaccggcgcgagaaaagaagtgtggcgttggttccacatgtcggaatgggtcttgaaacgcgaacggaaacgtggatgtcgagtgaaggagcatggaaacacgcacaaagaatcgaaacctgggtcttacgacacccaggatttacaataatggctgcaattttagcatataccatcggtaccacatactttcaaagagtattgatcttcattcttcttacgacagtagcgccatcaatgactatgcgatgtataggtataagtaatcgagacttcgttgaaggtgttagtgggggctcttgggtggacatagtacttgaacatggatcatgtgtaactacaatggccaaaaacaaaccgactttagacttcgaacttataaaaaccgaagctaaacatccagcaacattgcgcaaatattgtatcgaagcaaaacttacaaatacgaccactgccagtcggtgccctactcagggagaaccctcacttaatgaagaacaagacaaacgatttgtttgtaaacacagcatggttgatagaggttggggaaacggatgtggtctctttggaaagggaggaatagtcacatgcgctatgttcacctgtaagaaaaatatggaaggtaagattgtccaaccagagaacttggaatatacaattgtcattacaccacatagcggcgaagaaaatgctgtaggtaacgatacaggcaagcacggcaaagaaataaaagtcacaccgcaatcatctattactgaagctgaattaacaggttatggcactgttactatggaatgttcaccccgtacgggccttgattttaatgaaatggtgcttttgcaaatggaaaacaaggcatggttggtccatagacaatggtttttggatctaccactaccgtggttaccaggagctgatactcaggggtcaaattggattcagaaagaaactttggtaaccttcaagaacccacatgccaaaaagcaagatgtagttgttctagggtcccaagaaggcgcaatgcatactgctttaaccggagctacagaaattcaaatgtcctcggggaacctacttttcaccggacatttaaaatgtcgcctcagaatggataagttacaattaaagggaatgtcctacagtatgtgtacaggtaaatttaaagtcgtaaaagaaatagcggagacacaacacggaacgatagtcataagagtccaatacgagggtgatggttcaccatgcaaaataccttttgaaatcatggatctggagaagagacatgtcctgggcagattaatcaccgtcaacccgattgtcaccgaaaaggatagtccggttaacatagaagctgaacctccattcggggatagttatataattataggagtcgagccaggacaactaaagttatcatggttcaagaagggctcaagcatcggtcaaatgtttgagacaacaatgagaggcgcaaagcgaatggctatactaggcgacaccgcttgggattttgggagtttaggaggggttttcacgtcgataggaaaagcccttcatcaagtattcggagcaatttatggcgcagcatttagcggagtatcttggaccatgaagatactaataggggtggtcataacttggattggaatgaactcgcgatcaacaagtttatcggtctcattagtcctagtaggcgtagtaacactatatctaggagtaatggtacaggctgatagtggatgtgtagtatcttggaagaacaaggaattaaaatgcggctcgggaattttcatcacagataacgtccacacatggaccgaacagtacaaatttcaaccagaaagcccaagcaagctggcctcagctattcaaaaagcacatgaggaaggaatctgcggcattcgtagtgtaactagacttgagaacttgatgtggagacaaataactccagaactaaatcatattttatcagaaaatgaggtaaaattaaccataatgactggtgatataaagggaataatgcaagctggcaagaggtctctacgacctcagcccacggaattaaagtattcctggaaggcttggggcaaggcaaaaatgttgtcaacagagttacacaaccacacattcttaatagatggtcccgaaactgctgaatgtccaaatactaatagagcatggaactcccttgaagtagaggattatggtttcggcgtgtttacaactaatatttggctgaaacttaaagagagacaagacgtattctgtgattccaaacttatgtctgctgcaataaaagattcaagagcagtacatgccgacatgggatattggatagaaagcgcattgaacgacacttggaaaatcgaaaaagcgagctttattgaggtaaagagctgtcattggcccaagagtcacactttatggtcaaacggagttttggaatcagaaatgattatacccaaaaacttcgcggggccggtcagccaacacaactacaggccaggataccatacacaaacggcgggcccgtggcacttaggcagattagaaatggactttgatttttgcgagggaacaaccgttgttgttacggaagattgcggaaatcgaggaccgagtttacgaacaacaacagcctccggcaaattaataacagaatggtgctgccggtcatgtactttgccgccactccgatatcgtggtgaagatggatgttggtacggaatggagatacgtccactaaaagaaaaagaagaaaacttagttaactcgcttgtcactgccggtcatggacaaatagataattttagcctcggagttctaggcatggcgctatttttggaggagatgttacgcacgagaattggaacaaaacatgcaatactgttagtagcagtttcatttgtaacgttaatcacgggaaacatgtcttttagagatttagggagagtaatggtaatggtgggtgccactatgactgatgacatcggaatgggggtgacatatttggctctcctagcagcatttaaagtgcgaccaacatttgccgccggacttctgttgagaaaattaacaagtaaagaacttatgatgacgactattggaatcgtattacttagtcaatctacagtacctgaaacaatactggaacttacggacgctttggctctcggaatgatggttttaaagatagtccgcaacatggagaaatatcagctagccgtcacgatcatggcaatattatgcgtaccaaatgccgtcatcctacagaatgcatggaaagtctcttgcacaactttagcggtcgtatcagtctcaccactattattaacatctagccgtcaaaaggcggactggattccgttagcattgactataaagggtttgaaccccacagctatattcctaacaacactttccaggacgagcaagaaacgatcctggcccctaaatgaggctataatggctgtaggaatggtaagtatacttgctagctcactgctaaagaatgatataccgatgacgggaccattagtcgctggtggtctactaactgtatgttatgtattaactggaaggtccgcggaccttgaattggaaagagcagcggatgttagatgggaagaacaagcagaaataagtggttcatctcccatcctatcaataacaatttcagaggacggaagcatgagcatcaaaaatgaagaagaagaacaaacacttacgatattaattaggacaggactattagtaatcagtgggttatttcctgtatctataccaataacagcggcggcgtggtatttatgggaagttaagaaacaaagggcgggtgtgttatgggacgtacctagtcctccaccggtcggaaaagccgaactagaagacggcgcgtacaggattaaacaaaaaggaattttaggatacagccaaataggtgcaggcgtatataaggaaggtacattccacaccatgtggcatgtaacacgaggtgcggttcttatgcacaagggaaaaaggattgagccttcatgggcagatgtcaagaaagacctaatttcatacggtggaggatggaaattagaaggtgaatggaaagaaggtgaagaagtacaagttttggcattagaaccaggcaaaaatccaagagcagtacaaacaaaaccaggtttatttaaaacgaacaccggtactattggagctgtatcattagatttcagccccggaacctcaggatcacctattgtcgacaagaaaggaaaagtagtcggtctctatggcaacggcgttgttactagatctggaacatatgtatccgcgattgctcagacagagaaaagtatcgaagacaatccagaaatagaagatgacatttttaggaagaaaagacttacaattatggatttacatccaggcgcaggcaagacaaagagatatttgcctgccattgttagggaggcaataaagcgaggattgcgaacattaattttagcaccgacgcgagtagtagcagcagagatggaagaggccctcagaggtttaccgataagatatcaaacccccgctattagagcagagcacacaggccgcgaaatagtggatttaatgtgtcatgctacatttactatgagactactttcacctatcagagtgcctaattacaatttgataattatggacgaagcacattttactgacccagcatcaatcgcagcccggggatatatatccacgcgagtagaaatgggtgaggcagcgggtatcttcatgacagcgaccccgcctggatctagagacccctttccacaaagcaatgctcctatcatggatgaagaacgagagattcctgaaagatcatggaactccggacacgagtgggtaacggacttcaaaggaaaaactgtgtggtttgtgccttctataaaagcgggtaatgacatcgcggcatgtcttaggaaaaacggcaagaaagtaattcaattgagtcgaaagacttttgattcagaatatataaaaacaagaacgaacgattgggatttcgtcgtaacaacagatatctcggagatgggggcaaattttaaagctgagcgagtgatagatccccgaagatgtatgaaacccgtaatactaactgacggcgaagaaagggtaatactagcaggtcctatgcctgtaacccactcatcagcggcgcaacgccgaggaagagtgggacgtaaccccaaaaatgaaaatgatcaatacatatacatgggagaaccactagagaatgatgaagattgcgcccactggaaagaagccaagatgctgctcgacaatataaataccccagaaggcattatcccgtctatgttcgagcctgagcgagaaaaagttgacgccatagacggtgaatatagactaagaggtgaagcacgtaaaacatttgttgacctaatgagaagaggtgaccttcctgtatggcttgcgtatcgagtagctgcagaaggaataaattatgcggaccgaaggtggtgtttcgatggagttaagaataaccaaattctagaagaaaatgtcgaagtagaaatatggacaaaagaaggagaaaggaagaaacttaaaccaagatggttggatgcaagaatctattctgacccattggccctaaaagagttcaaggagtttgctgcaggaaggaaatcattaacactaaatttaatcacagagatgggaagactaccgacatttatgacacagaaagcacgtaacgcattagataacctagccgtattgcatacagctgaagctggcggcagagcttacaatcacgccttatcagaattacctgaaactttagaaacactactgttgttaacccttttagctacggtaacaggaggcatatttctatttttaatgtctggtaaaggtatcggaaaaatgacgctaggaatgtgctgcattataacggcgtcaatacttctgtggtacgctcaaatccagccccactggatagcagcctcaattattttagagttcttcctaatagtgttattaattcctgagccagaaaagcaacgaacgccacaagacaatcaattaacatatgtggttattgcgatcttaactgttgtagcagctactatggccaatgaaatgggattcttagagaaaactaaaaaggactttggacttggaagcattacgactcaacaaccagaaagtaacatattagacattgacttaaggccagcatcagcatggactctatatgctgtagcaacgacattcataacaccaatgctacgacatagcattgaaaactctagtgtcaacgtgtcgctcaccgccatagccaaccaagcaactgtgttgatgggcttaggaaaaggttggcccttgtctaaaatggacattggcgtacctcttttagcaataggatgctactcacaagtaaacccgataactttaacggcagcattgctactattagtggcccattatgccataattggcccaggactgcaggccaaagcaactagggaagcacagaaaagagcagctgcaggaattatgaaaaatccaactgtagatggaattacggtaatagacttagatcctattccatacgatcctaaatttgaaaagcaactcgggcaagtaatgctattagttctttgcgtaacacaagttctaatgatgcgtacaacttgggcactatgtgaagcgttaacgctagctactggcccaatatctacattatgggaaggcaatccaggtagattctggaataccacaatagccgttagtatggcaaacatctttcgtggatcttatttggcgggcgctggcctcttattctcgattatgaaaaacaccgcaaatacgcgaagaggaactggcaatacaggagaaacgttgggtgaaaagtggaagaatcgcttaaatgcactgggtaaaagcgagttccaaatctacaagaaaagtgggattcaagaagtagacaggacacttgcgaaagaaggaataaaacgaggtgagacagatcatcacgccgtatcgcgaggatcagctaagctcaggtggttcgtagagcgaaacctcgtaacacccgaagggaaagtagttgatttggggtgtggtcgcggaggatggtcatactattgcgggggactcaaaaatgttaaggaagtaaagggtttaacaaagggaggaccagggcatgaagaaccaattccaatgagcacatatggatggaatttagtacgactccaaagtggtgttgatgtatttttcaccccacctgaaaaatgtgacacgttgctgtgcgatatcggagaatcaagccccaatccgactgtagaagcgggtagaacattgcgagtgttaaatttagttgaaaattggttaaacaacaacacacagttctgtataaaagttctaaatccttatatgccgagcgttatcgagaaaatggaagcgctacaacgaaagtacggaggagcattggtgaggaacccattaagcagaaactctacacatgagatgtactgggtgtccaatgctagcggcaatatcgtatcgtcagtcaatatgatatccaggatgcttataaatcgcttcacgatgcgacataagaaggcgacatatgaaccagacgtagatctagggagcggaaccaggaatattggaatcgaatctgaaactcctaacttggacataataggtaagagaatagaaaagataaaacaagaacatgagacatcgtggcattatgatcaagatcatccttataaaacctgggcttaccatggttcgtacgaaaccaaacaaacagggtctgcttcatctatggtaaatggtgtagtgaggcttttgacaaagccctgggacgtaattccaatggttacacagatggcaatgacagacacgacaccgtttggacaacagagagtattcaaagaaaaagttgatacaaggactcaagaaccgaaagagggcactaaaaagctaatgaaaattacagcagaatggctatggaaagagttgggtaagaagaaaacaccaagaatgtgcactagagaagaatttactagaaaagtaagatccaatgcagcgctcggcgccatcttcaccgacgaaaacaaatggaaatcagcaagggaagcggttgaggacagcggattctgggaattggttgacaaagaacgaaatcttcatctcgaaggcaaatgtgaaacgtgtgtttacaatatgatgggcaaacgcgagaagaaattgggtgagtttggaaaagcaaaaggttcccgcgccatatggtatatgtggctaggcgcacgtttcttagagttcgaggcattggggttcttaaatgaagatcactggttttccagagaaaactcattgtcaggtgtagagggtgaaggtttgcacaaactgggatatatcctaagagatgtctctaagaaagaagggggcgctatgtacgcagacgatactgctggatgggacacccgtataacattagaagaccttaaaaacgaagagatggtcacgaatcacatggagggagaacacaagaaactagctgaggcaatctttaagttaacctatcaaaacaaagttgttagggttcaacgcccaacaccaagaggaacagtcatggatatcatttcgcgaagagatcagagagggtctgggcaagtggttacttacgggctaaatactttcactaatatggaggcgcagttaataaggcagatggagggtgaaggtgtctttaaaagcatacaacaactaacggttaccgaagaaattgcagtgaagaattggttagcgagagttggaagagaaagactcagcaggatggccatttcaggggacgattgtgtcgttaaaccactggatgatcgctttgcaagtgcactcacggcgctaaacgatatgggtaaggttcgtaaagatatacagcaatgggaaccctccaggggatggaatgattggacacaagtaccattttgtagtcaccattttcacgaattaataatgaaagacggtagggtgctggtagtaccatgccgaaatcaagatgaactaattggtcgtgcaaggatcagtcagggggctggctggtcaatgagagaaacagcatgcttaggtaaaagttatgcgcaaatgtggagcttaatgtactttcataggcgtgatttgagacttgctgccaacgccatatgctcagcagtaccaagtcactgggttcccacttctaggactacatggtcgatccatgcaacccatgagtggatgactaccgaagacatgctaacggtatggaacagggtatggatacaggaaaacccttggatggaagacaaaacacctgttgaaagttgggaggaaataccgtacctaggtaaaagagaagatcaatggtgtgggagcctgatcggactaacttcacgagcgacgtgggccaaaaatattcaaacggcaataaatcaggtacgcagtttaatcggtaacgaggaatacacagactatatgccgtccatgaagagattccgacgtgaagaagaggaagcaggagttctttggtag

SEQ ID NO: 22724 - RNA, 9876 nt, synthetic construct
  misc_feature 1..9876: note = derived and/or modified CDS sequence (opt6) from DENV-2__EU482641__SS-prME
  source 1..9876: mol_type = other RNA
tctgcaggaatgataattatgctgattccgacagtaatggcattccacctaacaacgagaaatggagaaccacacatgatagtagggattcaagaaaaaggaaaatcattactgtttaaaactgaagatggagtgaatatgtgtacattaatggcaatggatttaggagagctatgcgaagacacaataacttacaaatgtcccttactaagacaaaatgaacctgaagacattgactgttggtgcaatagcacaagcacgtgggtgacatatggcacatgcaccataacgggagaacatcgacgagagaaaagatctgttgcactggtgccccacgttggaatgggactggaaacaagaacggaaacctggatgtcctcagaaggagcatggaaacatgcccaaagaattgaaacctggatcctgagacatccgggatttacgatcatggccgcaatcttagcatacactatcggtaccacacattttcagcgagtacttatattcatactattaactgctgtagcaccatcaatgacaatgagatgtattgggataagtaatcgtgattttgtagaaggggtatcaggaggaagttgggtagatatagttttagaacacggctcttgtgtaacgaccatggccaaaaataaaccgacattagacttcgaacttataaaaaccgaagcaaaacagccggcaaccctacgaaaatattgcatcgaggcaaaattgacaaatactactacagagtcgagatgtccaactcaaggggagccatcattaaaagaggaacaagataaaaggttcgtatgcaaacatagtatggttgatagaggctggggtaacggttgtggtttgttcggaaaaggcgggatcgtaacatgcgcaatgttcacgtgtaagaaaaatatggagggaaaaattgtacagccagaaaacttagaatacactattgttgttacaccacatagtggtgaggagcacgccgtgggaaacgacactggcaaacatggcatggagataaaagtgacacctcaatcatcaataacagaagccgagcttactggatacggcactgttaccatggaatgttccccacgcactggtcttgactttaacgaaatggtattactacaaatggaaaataaagcctggctagtacatagacaatggtttcttgatctgccactaccatggcttcctggagcagacaaacaagagtccaactggattcaaaaagaaacactcgtaacttttaaaaacccacatgcgaagaaacaagatgtggtggttctgggtagccaagagggtgccatgcatacggctttaacaggagcaactgagattcaaatgtctagcggcaacttactgtttacaggacacttgaaatgtcgtctacggatggataaattacaacttaaaggaatgtcttattctatgtgcacaggcaaattcaaagtcgtaaaagaaatagcagaaacacaacatggcaccattgtcataagagtgcagtatgaaggagatgggagtccgtgtaaaataccctttgaaatcatggatcttgagaaaagatatgtgctcggaagactgataactgtaaatcccatcgtaactgagaaagattcaccggttaatatagaagcagagccaccttttggagatagctacataattataggtgttgaacccggacagctaaaactcaattggttcaagaaaggaagctcgataggccaaatgtttgaaacaacaatgcggggagcaaaaagaatggcaattttaggagacacggcatgggacttcggcagcttgggaggtgtttttacatcaataggcaaagcattgcaccaagtgtttggggctatatacggagcagctttctcaggtgtttcttggacgatgaaaatcttaatcggcgtaattatcacatggataggcatgaactcaagaagcacgagcctgtctgtgagcttagtcttagtaggaatcgtcacactgtacctaggggtcatggtccaagctgatagcggatgtgtagtttcttggaaaaacaaagagcttaaatgcggatcaggaatctttataacagataacgtccacacatggactgaacaatataaatttcaacctgagtccccgtcgaaactagcgtctgcaatacaaaaagcgcaagaggaaggtatctgcggtattagatcggtgacaaggctcgagaacctaatgtggaaacaaattacccctgaacttaaccatatattggcggagaatgaagtaaaacttacaatcatgacaggagacattcgaggcataatgcaagcaggaaaacgatcgctacggcctcagccaacagagcttaagtacagttggaaaacctggggcaaagccaaaatgttgtcgacagaatcatacaatcaaacatttttaatcgacggcccggaaacggccgagtgtccaaatacaaacagggcatggaactcactggaagtcgaggactacggttttggtgtcttcactaccaatatatggctcaaattaaaagagaaacaagacgcgttctgcgattcgaaactaatgagcgctgcaattaaagacaatagagcggtacacgctgatatgggatattggatagaatcagcactgaacgacacttggaaaatagaaaaagcctcatttatagaggtcaaaaattgtcactggccgaagagtcatacattatggagtaatggtgtcctagaaagcgaaatgattataccaaagaatttggcaggacctgtctcacaacataactatagacccggttaccatacgcaaattgcgggaccgtggcacctaggaaaattagaaatggatttcgacttttgcgatggcacaacagtaatagtaaccgaagattgcggaaacagaggacccagtttaagaaccacaactgcaagtggcaaattaatcacagaatggtgttgccgttcatgtaccctacccccactgagatatagaggcgaggatggctgctggtatggtatggaaattagaccgctcaaagagaaggaggaaaacctcgtaaattcactggtaacggcaggacatggccaagttgataatttctcgttaggggtactaggtatggctctatttttagaagaaatgttgcgaacaagagttggaactaaacacgcaatattattggtagcagtttcatttgtaaccctaattaccggcaatatgagttttaaggatctaggtcgcgtcgtcgtcatggttggagcaaccatggcagatgatattggtatgggtgtaacatacttagcattattggcggcattcaaggttcgccctacctttgcggcagggcttcttctaaggaagctaacatcaaaagaactaatgatgacgactatcggaatagttctcttatcacaaagtactattcccgaaactgtactagaattaacagatgcacttgcactcggcatgatggttttaaagatagttcgtaacatggagaaataccaattggcggtaactatcatggcaatattatgcgtacccaatgctgtaatcttacaaaacgcatggaaagtaagttgtacaatattggccgtagtatctgtaagtccactactgttaactagctctcagcagaaaacagactggatcccgttagctctaacaataaaagggttaaatccaactgccatcttccttacaaccctaagtcgaacgaacaaaaagaggtcgtggccattgaacgaggccattatggccgtcggtatggtgtctatcctggcttcatcattactcaaaaatgacattccaatgaccggacccctagtcgctggaggtcttttaaccgtgtgttatgttttaactggaaggtccgcggacctagagttggagagagctactgatgttaagtgggaggaccaagctgaaatctcgggttcttcgcccatattatcgataacaatcagtgaagacgggtcaatgtcaatcaaaaatgaagaagaagaacaaacacttacaatcttgatccggaccggacttctagtaatatcgggcctatttcccatttcaatacctattacagccgcagcctggtacctctgggaagttaagaaacagagggctggagttttatgggatgtaccaagcccaccaccaatgggaaaggcagaactagaagacggtgcatatagaataaagcaaaaagggatcctgggatacagtcagattggtgccggggtatacaaagaagggacctttcatacgatgtggcatgtgacaagaggggcagtattgatgcataagggcaaaagaatagaaccctcttgggctgatgtcaagaaagacttgatatcgtatggagggggatggaaactcgagggcgagtggaaagaaggtgaagaagtccaggtgctggcactcgagccgggcaaaaatccaagagcagtacaaaccaaaccgggactatttaagactaataccggcaccataggagctgtatctctagacttttcacccggaacatccggatcacctataatcgataagaaagggaaagtagtcggtctatatggtaatggggtagtaactcgcagtggcgcatacgtttcggcgatagcccaaacagagaagtctatcgaagataatccagaaattgaagacgatatatttaggaagagacggttaaccataatggatttacacccaggtgcaggtaagactaaacggtatctacctgcgatagtaagagaagcaattaaaagaggactgcgaacactaatactagcacccacacgagtagtagctgcagaaatggaagaagcacttagaggattacctataagataccaaacccctgcaatcagagccgaacacacgggtagagaaatagtagatctaatgtgccacgcaaccttcactatgcgcctcctaagcccagtaagagtgccaaactataatttaattattatggatgaagcccatttcactgatccagccagtatagccgcaagaggatatatcagtactcgcgtcgagatgggtgaagcagctggtattttcatgacggcaacgcctccggggagtagggatccgttcccacagagtaacgctcctattatagatgaagaaagagaaattccagagcgttcttggaatagtgggcacgaatgggtaactgacttcaagggcaaaacagtttggtttgtgccgtcaattaaagcgggtaatgacattgccgcatgtctgcgcaaaaatggcaagaaagtaatacaactatcacggaaaacatttgattctgaatatgtgaagacacgaaccaatgattgggatttcgtggtcaccaccgatatatctgagatgggagcgaattttaaagccgaaagagtcatagatccaagacgatgcatgaaaccagttatattaacagatggggaagaacgagtaatattggcaggccctatgccggtaacacattcgagtgcagctcaaagacgtggaagaattggtagaaatcctaaaaatgaaaatgaccagtacatctatatgggtgagccgcttgaaaatgatgaagattgtgcacattggaaggaagccaagatgttattggacaatatcaatacacctgagggtattataccaagcatgttcgaacctgaaagggaaaaggttgatgccatagatggtgagtaccgcttgcgaggagaagccagaaaaacctttgtcgacttgatgagaagaggagatcttcccgtatggttagcttacaaggtggctgcagaaggaataaattatgcagacagaaggtggtgttttgatggaattaaaaataatcaaatcctagaggaaaatgttgaagtcgagatctggactaaagaaggagaaaggaagaaacttaaacccagatggttagatgctcgaatatactcagatccgttagcactaaaagaatttaaagagttcgcagcgggcagaaaatcacttaccctaaatttaataacagagatggggaggctaccaacgttcatgacacagaaaactcgggacgcactagacaatctagctgttttacatacagcagaagcagggggacgagcctacaatcatgccttgagtgaactgcctgaaaccctcgagacacttttactactaacactcttagctacggtaactggcggaatatttttgttcctcatgtccggacgtggtattgggaaaatgacgctagggatgtgttgtatcattactgcatccatactcttgtggtacgcacagatacaacctcattggatagcagcgtccataatacttgaatttttccttattgtgttattaataccagagccggaaaaacagcgtaccccacaagacaatcaattgacatacgttgtgatagcaattttaacggtcgtggctgcaacgatggcaaatgagatgggattcttagagaaaacaaagaaggacttgggtttagggagtatcgccacccaacaacccgagtccaatatcctagatatcgacttaaggccagcaagtgcttggactctgtatgcagtagcaacaacttttgttacgcctatgctaagacattctatagaaaattcctctgtcaacgtatctctcaccgcgattgctaatcaagcaacagttttaatgggattgggtaaaggatggccactatctaagatggatataggggtaccccttcttgctattggatgttatagccaggtaaaccccataacgctcacggctgctctgctgttattagtggctcattatgcaattatcggtccgggactacaggcaaaagcaacgagagaggctcagaagagggctgcagcgggcataatgaaaaaccctacggttgacggaatcacagtgatagacctagacccaatcccatacgacccaaaatttgaaaaacaattaggccaagtaatgttactcatactgtgtgtcacccaagtgttaatgatgagaactacttgggccctctgcgaagcactaacgctggctacaggtcctatcagcactttatgggaaggtaacccgggacggttttggaatactacgatagctgtcagcatggcaaacatatttaggggatcatatctcgcaggggcaggtttgttgttctcaatcatgaagaacaccacaaatacacgaagaggcaccggaaatattggtgagaccttaggagaaaaatggaaaagcaggcttaatgccttaggcaaatctgaatttcaaatatacaagaaatcaggtatccaagaggtagacaggactttagcaaaagagggaataaaacgcggagaaaccgaccatcatgcggtgagcagaggcagtgccaagttaagatggttcgtagagcgtaatatggttaccccggaaggaaaggttgtagacttgggctgcggccggggtgggtggagctattactgcggaggcctaaagaatgtgagagaagttaaaggattaacaaaaggaggacctggccacgaggaacccatccctatgtctacatacggatggaatcttgtacgcctacaatccggtgtggatgtgttctttatacctcctgaaaaatgcgacaccttattgtgtgacatcggagaatccagtcctaatcccacagtagaggcaggtcggaccctgagggtactgaatcttgttgaaaactggcttaataacaacacccaattctgtataaaggtattgaacccatacatgcctagcgtcatagagaaaatggaagcgctacaacgtaaatacggcggagcgctggtacggaatccactatcacgcaattccactcatgaaatgtattgggttagtaatgcctcaggaaatatagtctccagtgtaaatatgattagtcgaatgttgattaatcgctttacaatgaggcataagaaagcaacatacgaaccagatgtagacctcggaagcggaacgagaaacattggtatagagtcagaaattccgaatttagatataattggtaaacgaatagagaaaataaaacaagaacatgaaacatcctggcattacgaccaagatcacccttacaaaacatgggcatatcacggctcgtatgaaacaaagcaaacggggtcggcatcatcaatggtgaacggcgtagttagattattaactaagccgtgggacgtattacccactgtaacccagatggcaatgacagatacaacaccctttgggcagcaaagggtatttaaagaaaaagtcgatacgcgaacccaagaacccaaagaaggcactaagaaactaatgaaaattaccgcggaatggttatggaaagaattaggcaagaagaaaacacccagaatgtgtacacgagaagaatttaccagaaaagtcagatctaacgctgcattaggagcaattttcaccgacgaaaataaatggaagagtgctagggaagctgttgaagattcaaggttttgggaactcgtggataaagaaagaaaccttcacttagaaggtaaatgcgagacgtgcgtgtataatatgatggggaagcgggaaaagaaattaggagagtttgggaaagctaaagggtcccgggctatttggtatatgtggttgggcgcaagattcttagagttcgaggctctcggatttttgaatgaagaccattggttcagcagagaaaatagcttaagcggagtcgagggagagggtctgcataaactaggttatattcttagagatgttagcaagaaagaaggaggggcaatgtatgcagatgacactgcagggtgggacacaagaataacattagaagatctcaaaaatgaagaaatggtcaccaaccatatggaaggagagcataagaaactggctgaagctatatttaaattgacgtatcaaaacaaagttgtacgtgtacaacgaccgactccccgaggaactgttatggatattatatctcgacgcgatcaaagaggcagtggccaagttggcacatacggattaaacacctttacaaacatggaagcgcagctgattagacagatggaaggagaaggggtatttaagaatattcaacacctaacagtgacagaagaagtagcagtacacaactggttggcacgagttggtcgtgaacgtctctctcggatggctatcagcggggacgattgcgtggttaaaccactagatgaccgctttgcaaacgctttgaccgcgttaaatgatatgggcaagatcaggaaggacatccaacaatgggaaccatctaagggatggaacgattggacgcaagtaccgttttgctcgcaccactttcacgagttaatcatgaaagatggcagaattttagtcgtcccatgccggaatcaggacgaattaatcgggagagctcggataagccaaggagctggttggagccttagggaaacagcttgtctcggcaagtcatacgcacaaatgtggagtttgatgtattttcaccgaagagatctgagactagctgcaaatgcaatttgttcagcggtaccatcacactgggtgcccacctcacgtactacttggtcgatacatgccaaacatgaatggatgactaccgaagatatgttaacggtgtggaacagagtctggatccgggaaaatccttggatggaagataaaacacctgtagaatcatgggaagaaataccctatttgggaaagagggaggatcaatggtgtgggtcattgattggattaacaagcagggctacatgggcgaaaaatatacaggccgccataaatcaagtaagaagtttaatagggaatgaagaatatactgattatatgccaagcatgaagaggtttcgaagagaagaagaggaggctggtgtcctttggtag

SEQ ID NO: 22725 - RNA, 9876 nt, synthetic construct
  misc_feature 1..9876: note = derived and/or modified CDS sequence (opt6) from DENV-2__EU482642__SS-prME
  source 1..9876: mol_type = other RNA
tcggcaggcatgattataatgcttattccgacagtaatggcatttcacctaacaacaagaaatggtgaaccacacatgatagttggtatacaagaaaaagggaaatctttactattcaaaactgaagacggcgttaatatgtgcaccctaatggcgatggatttgggcgaactttgcgaagatacaattacctataaatgcccgttgctacgacaaaatgaaccggaagacatagattgttggtgtaatagtacgtcaacctgggttacatacgggacatgtactacaactggtgaacataggagagagaaaagaagcgtggccttagttccacacgtaggcatgggtctcgaaaccagaacagaaacgtggatgtcttcagaaggagcatggaaacacgcacaaagaatagaaacttggatactacgtcacccaggcttcacaatcatggcagcaatattagcgtacacaataggtacaacgcactttcaaagagtattaattttcatattattaacagcagtagcaccatcaatgacaatgaggtgtatcggtatcagtaatcgggattttgtagaaggggtatcaggaggttcttgggtcgatattgtcttagaacacggaagttgtgttacgaccatggccaaaaataaacctacacttgattttgaactaataaaaacagaggcaaaacaacctgccaccttaagaaaatattgcattgaagcaaaacttaccaacacaaccactgaaagccgctgtccaacccaaggagaacccagccttaaagaggaacaagataaaagattcgtatgtaaacattccatggtagatcgcggatggggaaatggctgcgggttattcggcaaaggtggcatagtaacttgtgcaatgttcacatgcaagaagaatatggaaggaaaaattgtccaaccagaaaaccttgagtacacaatagtagtaacccctcattcaggagaggaacatgcagtaggaaatgatactggaaaacacggaaaagaaatcaaagtcacaccacaatccagcataacggaagcagagttaactggttatggaacagtaaccatggagtgtagcccgagaacaggattagactttaatgaaatggtattactacagatggagaacaaagcctggttagtacacagacagtggttcctggacttacctctaccctggctgcctggagcagacaaacaggagagcaattggatccaaaaagaaaccctagtgacatttaaaaatccccacgcaaagaaacaggatgttgtagtactaggaagccaggaaggtgctatgcatacagcattgacaggtgcaaccgaaattcaaatgagttcaggtaatctgttattcactggacatttaaaatgccgtctaagaatggataaattacaactgaaaggtatgtcctattctatgtgcacaggaaaatttaaagtcgtgaaagaaatagccgagactcagcatggcacgatagttattcgagtccaatacgaaggtgatggatcgccctgtaaaataccatttgaaattatggatttggaaaaacgatacgttctcggaaggctaataacagtaaatcctatagtgacagaaaaagactcgccagtaaatattgaagccgaaccgccgttcggagactcttacattattataggagtagagccgggtcaattaaaattaaattggtttaagaaaggcagtagtataggacaaatgttcgaaacgacgatgcgaggcgccaaacggatggccatactaggcgacacggcttgggatttcggatcgttgggaggtgtctttacatctataggaaaagcattacatcaagtattcggggcaatttatggagctgcattctcaggggtatcctggactatgaagattctaataggagtaataattacgtggatagggatgaacagcagatccacgagcctatcagtatccctagtactcgttgggatagtcacactctaccttggagtcatggtccaagcagatagtggatgtgtagtgagttggaaaaataaggagctaaaatgtggaagtggcatattcattacggacaatgttcacacttggaccgaacaatataaatttcaaccagagtccccatctaaattagcatccgccatacaaaaggcacaggaggaagggatctgtgggattcgaagcgttacaagattggaaaacctgatgtggaaacagattacgccagaacttaatcatatactagctgaaaatgaagttaaattaacaattatgacgggcgatataaagggaatcatgcaggccggaaaaagatcactacgaccacaaccgacagagttaaaatactcctggaaaacgtgggggaaagccaaaatgttatcaactgaaagctataatcagacttttcttatagatggaccggaaacagcggaatgtccaaatacaaacagagcctggaactccttagaagtggaagattatggtttcggagtctttacaactaacatttggctaaaactgaaagaaaaacaggacgcattctgtgactcgaaattaatgtcagcagcaatcaaagataacagagccgttcacgccgatatgggttactggatagaatcggcgctaaatgacacttggaaaattgaaaaagccagcttcatcgaagtaaagaactgccactggccaaagtcccatacattatggtctaacggcgtcctagaaagcgagatgatcattcctaagaatttagctggcccagtaagccaacataattataggcctggttaccacacgcaaatcgcgggtccatggcatctagggaaactggaaatggacttcgatttttgtgatggtacaaccgtaatagtgacggaagattgcggtaaccgagggccatcactaagaaccacaaccgcctctggaaaactaattacggaatggtgctgcagatcgtgcaccttaccacctctgcgctatcgaggggaagatggatgttggtacggtatggaaatccgtccgttaaaagagaaagaagaaaatctagttaattccttagtgacagcgggtcacggacaagtagataattttagtctgggggtactaggtatggcgttatttttagaagaaatgctgagaactagagttggaacgaaacatgcaatacttttagtggcagtttcttttgtgactctaataacgggtaatatgtctttcaaagacctaggaagagtagtagtcatggtgggagccacaatggcagacgatataggaatgggagtaacgtatctagcgttattagctgcattcaaggtacgaccaacgttcgcagcagggctattgcttagaaaattaacttcaaaagaattaatgatgaccacaataggtattgtcctgctatcccaatctacaattccggaaacagtattcgaacttacggacgccctcgcgttaggaatgatggttctaaagatagtaaggaacatggaaaaatatcaacttgccgttaccattatggcaatcctatgtgtgccgaatgcagtaatcctgcaaaatgcatggaaagttagctgtaccattctggcggttgtctcggtgagtccactgctactaacttcatctcaacagaaaactgactggattcccctggctctgacaattaagggtctaaatccaacagcaatctttctaacaacattgagcaggacaaacaagaaacgatcttggcctttgaacgaagcaataatggccgtcggaatggtttctatactggcgtcttcgttactaaagaacgatattccaatgacaggaccattagttgctggtgggcttttaactgtgtgttatgtgttaacagggagaagtgcagatttggaattggaacgtgcaactgatgtaaaatgggaagatcaagcagaaatatcgggaagcagtccgatcctcagcattactatatcggaggacggatctatgtccattaaaaatgaggaagaggaacaaacgctcaccatactgatacgaacaggtctattagttatcagtggattatttccaatttctataccaataacagcagcagcgtggtacctatgggaggttaagaaacaacgagcaggcgttttatgggatgtcccaagtccgcccccaatgggtaaagctgaacttgaagacggcgcttatagaataaaacagaaagggatacttggttacagccagattggagctggcgtttacaaagagggtaccttccacacgatgtggcacgtgacaagaggggcagtattaatgcacaaaggcaaaagaattgagcccagttgggctgatgtaaagaaagacttaatcagctacggaggtggatggaaattagagggagagtggaaagagggtgaagaagttcaagtcttagctttagagccgggcaaaaatcctcgagcggttcaaactaaacccggattgtttaaaacaaatacaggcacgataggtgctgtttctctggacttttcgccggggacatccggtagtcctattatcgacaagaaaggaaaggtcgtaggactgtacggaaatggtgtggttacccgtagtggagcatacgtttctgccattgcacaaacggaaaaatcaatagaagacaatccggagatagaggatgacatattcagaaaaagacgtctaaccataatggacctgcatccaggagctgggaagactaagcggtacctacctgccatagtgagagaagcaataaagcgcggattacgaaccttaatactagcaccaacaagagtagtggctgctgagatggaggaggcccttagaggtctaccaataaggtatcagactcctgcaataagggctgagcacacaggacgcgaaatagtagatctaatgtgtcacgcgacattcacaatgcgactattgtcaccagtgagagttccaaattataatcttattataatggatgaggcacattttactgacccagcatcgattgcagcaagagggtatatctcgacaagagtagaaatgggggaagcggctggaatttttatgacagcaaccccgcccgggagcagggacccatttccacagagcaatgcacctataattgatgaagaacgagagatacctgaaaggagttggaatagcggccatgaatgggttaccgatttcaaaggaaaaacagtatggtttgtacctagtattaaagctggaaacgatattgcagcctgcttgaggaaaaatggcaagaaagtcattcagttaagccgcaagacattcgattctgagtacgtaaaaactagaactaatgattgggatttcgtggtcacaacagatatatcagagatgggtgcaaactttaaagctgaacgagtcatagatccaaggaggtgtatgaaaccggttatacttacggacggtgaagaacgagtaatacttgctggaccgatgcctgtaacacactcatcagcagcacagagacgaggtaggatagggagaaatcccaaaaatgaaaacgaccaatacatatatatgggagaacctttagaaaatgatgaagattgtgcccattggaaggaagctaaaatgttacttgataatattaatacaccagaggggataatacccagtatgttcgaacccgagcgcgaaaaggtagacgccatagatggagagtaccgtttacggggagaagcaagaaaaaccttcgtagacttgatgcgtcgaggtgacctaccagtttggcttgcatacaaagttgcagctgaaggcataaactacgcggatagacgttggtgcttcgacgggatcaaaaataatcagatactagaagaaaatgtagaggtagaaatatggaccaaagagggcgaacgtaaaaagttaaaaccaaggtggctagacgctagaatttactctgaccccttagccttaaaagagttcaaagaatttgcagctggaagaaaatcgttaacgcttaacctaataacggaaatgggccgactccccacctttatgactcagaaaactcgtgatgcgcttgataacctcgcagtcctgcacacagcagaagctgggggcagagcatataatcatgcactaagcgaactacctgagactttagaaactttattattactaacacttttggcgacggtaactggagggatatttttatttcttatgtcaggacgtggaataggtaaaatgactctaggaatgtgctgtatcatcacagctagtatcctattgtggtacgcccaaattcaaccacactggatcgctgcctcaataattctagagttcttcctaatagtcctattaattccagaaccagaaaaacagaggactccgcaggataaccaattaacttacgtggtaatcgctatattaacagtagtcgccgctactatggcgaatgaaatgggatttttagagaaaactaagaaagatcttggcttaggttcaatagcaacacaacaacctgagagcaatatactggatatagatttaagacctgctagcgcttggacgctctatgcagtagcaacgacatttgtcactccgatgctaaggcacagtatagaaaattctagtgtaaacgtttcattaaccgcgatagcgaatcaagcgacagtattaatgggtttaggcaaaggatggcctctatcaaaaatggatataggagtacccttattagcaataggttgttattcccaagtgaatcccatcactcttaccgcggcactcttactgctcgtagcgcattacgctataataggaccaggtttgcaagctaaagccacaagagaagcgcagaagagagcagcagcaggcattatgaaaaatccaacagtggacggtataaccgtcattgatctcgatccaataccttatgatcccaagtttgagaagcagctgggacaagttatgttattgattttgtgtgtaacccaagtactgatgatgcgaactacatgggcattatgcgaagcccttacgctcgcaacaggacctatttctaccctctgggaaggaaatcctgggcgattttggaatacgacaatcgccgtcagcatggcgaacatctttaggggtagttatttagcaggcgccggcctacttttcagtattatgaaaaatactacgaacaccagaagaggcacaggcaatatgggagaaactttaggagaaaaatggaaatccagactaaatgccttgggtaaatcggagttccaaatatataagaaatccggcattcaagaagtcgatcgaaccctcgcgaaggaaggtatcaaaagaggtgaaacagatcatcacgcggtatctagaggatccgctaaacttagatggtttgtggaacgaaacatggtgaccccagaaggcaaagtcgtagacctagggtgtggaagaggtggatggtcttattactgtggaggtttaaagaatgtaagagaagtaaagggcctaacaaaaggcgggccaggtcacgaggaaccaataccaatgtccacctatggctggaatctggtaagactgcaaagcggtgtggacgtatttttcataccacccgaaaaatgcgataccttactatgcgatataggcgaaagctctcctaatccaaccgttgaagctggcagaacactgagagtcctcaatttagtggaaaattggttaaataataacacccaattttgtataaaggtattaaacccatatatgccaagcgtgatcgaaaagatggaggctttgcagcggaaatacggcggagcacttgtaaggaatccgctatccagaaattctactcatgagatgtattgggtaagtaatgcctcaggaaacatagtatcatcggtcaatatgatatcccgcatgctaattaatcggtttacaatgcgacacaagaaagcgacatatgaacctgacgtagatttaggatcagggactagaaatataggaatcgagagtgagatacctaacctagacataatcggaaaaagaatcgagaaaataaaacaagaacacgaaacaagttggcactacgatcaagaccacccttacaaaacttgggcatatcacgggagctatgaaactaaacaaactggatcagcatcatcaatggtgaatggggtagtaaggttgcttacaaagccttgggacgtacttccaaccgttacccaaatggctatgacagacacgaccccatttggacaacaaagagtttttaaagaaaaagtagatacccgaacacaagaaccgaaagaaggtactaagaaacttatgaaaattacagcagaatggttgtggaaagaattagggaaaaagaaaacaccaagaatatgtacaagagaagaatttactcggaaagtacgatccaatgccgctctaggagcaattttcaccgatgaaaacaaatggaaaagcgctcgcgaagcagttgaagattcccgattttgggagctagtagataaggagaggaatttacacttagaagggaaatgtgaaacatgtgtttataacatgatgggtaaaagagagaagaaattaggggagttcggtaaggcaaagggatcaagagcaatttggtacatgtggttaggtgccaggttcctagagtttgaagccctagggtttttaaatgaggatcattggttttcaagagagaatagcttaagtggagtcgaaggtgaaggcttacataaattagggtatatcctacgagatgtatccaagaaagaaggaggggcaatgtatgcggacgatacggcaggatgggatacgcgcatcaccctagaagacctcaaaaatgaagaaatggtcactaaccatatggaaggtgagcataagaaattagcagaagcaattttcaaattaacctaccaaaataaggtggtaagagtacaacgccctacacctcgcggaaccgtcatggatattatatctagaaaagatcaaagaggtagtggtcaagtagggacttatggactgaatacatttactaatatggaggctcagttaatacgccagatggaaggagagggagtctttaagaatatacaacatctaaccgtgacggaagaggttgcagtgcagaattggctagctagagtgggcagagaaagactatctaggatggcaatatcaggtgatgattgtgtagtaaaacctcttgacgaccgattcgcaaatgcattaacagcacttaacgatatgggtaaaataaggaaggatatccagcaatgggaaccctcaaaaggttggaacgactggacacaagtccccttttgttcccaccattttcatgaacttattatgaaagacggaagagttctagttgtaccatgtcggaatcaagacgaattaataggcagagcgcggattagtcagggtgccgggtggtctttaagagaaacagcttgtttaggaaagtcatacgcacagatgtggtcgctcatgtatttccatagacgagatctgagattagcagccaacgcaatatgtagcgcagtcccctcccattgggtaccaactagccgaacaacctggtctatacacgccaaacatgagtggatgacgactgaagatatgttaacagtatggaacagagtatggatacaagagaacccgtggatggaggacaaaacccctgtggaaagttgggaggaaataccttacctgggcaaacgagaggaccagtggtgtggcagtctcataggtctaacctcaagggcgacctgggccaaaaatatacaagccgcaatcaaccaagtaagaagtcttataggtaacgaggaatacacagactatatgccctcgatgaaaagatttcgccgagaagaagaggaagcgggtgttctgtggtaa

SEQ ID NO: 22726 - RNA, 9876 nt, synthetic construct
  misc_feature 1..9876: note = derived and/or modified CDS sequence (opt6) from DENV-2__EU482643__SS-prME
  source 1..9876: mol_type = other RNA
tcagctggtatgattataatgctaattccaactgtgatggcattccacctaacaaccagaaatggcgaaccacacatgatagtagggatacaagaaaaaggaaaatcactactatttaaaacagaagacggggtaaacatgtgtacactaatggcaatggatcttggtgaactatgtgaagacacaattacatataaatgcccactcctcagacaaaacgaacctgaagacattgattgttggtgtaattccacttctacatgggttacctacgggacatgtactaccactggggaacatcgcagagaaaaacgctctgtggctttagtacctcatgttggaatgggattagaaacacggacagaaacatggatgtctagtgaaggagcctggaaacatgctcaacgcatagaaacttggatattacggcatccaggattcacgattatggctgcaatattagcgtatacaattggaactacacatttccaaagagttcttatttttatcctactaacagcagtagcaccctcaatgacgatgcggtgcattggtatatcaaatagagactttgtagaaggagtaagcggaggttcttgggtggatatagtcttagaacatggaagctgtgtcaccactatggccaaaaataaacctacacttgactttgaacttataaaaaccgaagctaaacaacctgcaaccttaaggaaatactgtattgaagcaaaattaacaaacacaacgaccgaatcacggtgtccaacgcaaggcgaaccatccttaaaagaggagcaagataaaaggtttgtctgcaaacatagcatggttgatagaggttggggaaatggatgtggtttattcgggaaaggagggatagtcacatgcgctatgtttacctgtaagaaaaacatggaaggtaaaattgttcaacccgaaaaccttgaatatacaatagttgtaacacctcacagcggtgaagaacacgcagtgggaaatgatacgggaaaacatggaaaagaaataaaagtaacaccccaaagctcaattacagaagccgaactgaccggatacggtaccgttacgatggaatgctcaccgagaactggtctagatttcaatgaaatggtattattacaaatgaaaaataaggcttggcttgtgcataggcaatggtttttggacttaccactcccatggctaccaggagcagataaacaagagagcaactggatccaaaaagaaactctcgtaacgttcaaaaatccccatgccaagaaacaagatgtagttgtgcttggtagtcaagaaggagcaatgcataccgccttaacaggagctaccgaaatacaaatgtcttcgggaaacctcttatttactggccaccttaaatgtagactgcgtatggataaattgcaactaaaaggtatgagttattcgatgtgcaccgggaaatttaaagtggtaaaagaaatagctgaaactcaacatggaactatagtcatcagagtacaatacgagggcgatggcagtccttgtaaaatcccgtttgagattatggatctagagaaacgttatgtactcggaagactaattaccgtaaatccgatagtaactgaaaaagactctccggttaacattgaagcagagcctcccttcggcgatagctatataataataggcgtagaaccaggacaacttaaacttaactggttcaagaaagggagtagtatcggccaaatgttcgagacaactatgcgtggcgcaaaacggatggctatactaggtgatactgcatgggactttggtagtcttgggggagtgtttacgagcattggaaaggcactgcatcaagtattcggagcaatatatggtgcggcgttttcgggcgtctcttggaccatgaaaatattaattggagtcatcatcacttggattggaatgaacagtagaagtacatcactttccgtatcgctcgtacttgttggaattgtcactttatatcttggtgtaatggtacaggcagattctggatgtgtagtatcatggaaaaataaagaactaaaatgtggttcaggaatattcataacagataatgttcacacctggactgagcagtataagttccagcctgaatcaccaagtaagttggcgagcgccatccaaaaagcacaagaagagggaatttgcgggatccgaagtgtcactcggctcgaaaatttaatgtggaagcaaataacaccagaattgaaccatatcttggctgaaaatgaagtaaaactgaccataatgactggtgatataaagggtataatgcaggcaggaaaaagaagtctaagaccgcaacctacggaattaaaatacagttggaaaacatgggggaaagccaaaatgctatcgaccgaatcgtacaatcaaacatttcttattgacggaccagaaactactgaatgtcctaacacaaacagagcgtggaatagtctggaagttgaggactacggatttggagtctttacaacaaatatttggttaaagttaaaggaaaaacaggatgctttttgtgattcaaaattgatgtctgctgcaattaaagacaatagggcagtccacgctgatatgggctactggatagaatctgccttaaacgatacatggaaaatagaaaaggcatcatttatcgaagtcaaaaattgccattggccaaagagccataccctctggtcaaatggtgtactagaaagcgaaatgataatacccaaaaatcttgctggaccagtcagtcagcataattaccgcccggggtaccacacccaaatcgcgggaccctggcacctcggtaaattagaaatggattttgatttttgcgacggaacaacagttattgtaaccgaggactgcggcaacagggggccatccttacgaactaccacagcaagtggcaaattaataacagaatggtgttgtcgtagttgtaccctaccgccattacgttatcgaggtgaagacggatgttggtatggtatggaaataagaccgttgaaggaaaaagaagaaaatttagtaaattcattggtaaccgcaggtcatggccaagttgacaatttttccttgggggttttggggatggcattgtttctggaagaaatgctgcgtactagggttgggacaaaacatgccattctactggtgacagtttcttttgttaccctaataaccggtaatatgtccttcaaagatttagggcgtgttgtggtcatggtcggagcgactatggcagacgatattggaatgggagtaacttacttagcactactagctgcgttcaaggtcagacccacctttgcagctggtttgctcttaagaaaactaaccagtaaagagctcatgatgacaactataggaatagtacttctatcacaatcaacaatacctgagactgtattagaacttaccgacgccctggctctaggaatgatggtacttaaaatcgtgagaaatatggaaaaatatcaacttgcagtaactatcatggcaatactatgtgttccaaacgcagttattctacagaatgcatggaaagtatcatgcactattctcgccgtcgtttcagtgtcaccattgctcttgacatcatcacagcagaaaactgactggataccgttagcacttaccataaagggcttaaacccgacagcaatctttttaaccacactgtcccgaactaataagaaacgttcatggcctttgaatgaagccataatggctgttggaatggtctcgatattagcttctagccttcttaagaacgatatccctatgactggacctctagtcgccggcggcttactaacggtttgctatgtactcactggtcgaagcgcagacctagagcttgaaagagcaactgatgtcaaatgggaagatcaagcagagatttccggatcatcccccatacttagcataactatctcagaagacggaagcatgagtatcaaaaatgaagaagaagaacaaacattaacgatcttgattagaactggactcctagtgatcagcggtctgtttccaataagtattccgattacagcagcagcttggtatctttgggaagtcaagaaacaaagagctggagttttgtgggatgtaccctcgccaccaccgatgggcaaagcagagttagaggatggtgcttatcgtataaagcagaagggcatcttgggctactcacaaataggagctggcgtgtacaaagaaggaacatttcacactatgtggcacgttacgcgcggagcagttctaatgcacaaagggaaaagaatagagccaagttgggcggatgttaagaaagatcttatcagttatggcggcggttggaaacttgagggcgaatggaaagagggtgaagaagttcaagttctagctctggaacccgggaagaatcctagagccgtccagaccaagccgggtctgtttaagacaaacaccggtacgattggagcggtgtcactggactttagcccggggacgtctggatcaccaataattgacaagaagggcaaagttgttgggctctacggaaatggagtagtgacaagaagtggagcatatgtaagtgcaatagcgcaaaccgaaaaatctatagaggataaccctgaaatcgaagatgatatcttcaggaaaaggcgtttgacaatcatggatctgcaccctggggcagggaaaacaaaacgctatttaccagcgattgtaagagaggccataaaaaggggactaagaacattgatattagcgccaacacgtgtcgtagcagcggaaatggaggaggccctacgaggacttcctatcagatatcaaacacccgctatacgagcagaacacacaggtcgcgaaatagtggatctaatgtgccatgcaactttcacaatgaggctgttatcaccagtgagagtaccaaactacaatttgataataatggacgaagctcatttcacagatccagcaagcattgccgcaagagggtatatatccaccagagtggaaatgggagaagctgccggaatttttatgacagctacaccgccaggaagcagagatcctttccctcagagtaacgcaccgatcatagatgaggaaagagagatccccgagcgcagttggaactcaggtcacgagtgggtcacagattttaaaggcaaaacagtgtggttcgtaccatccataaaagcaggaaacgatattgcagcgtgtctaagaaagaatggtaaaaaggtaatacagttaagcagaaagacctttgatagcgaatatgtaaaaaccagaaccaatgactgggattttgttgtaacaacagacatatccgaaatgggcgccaatttcaaggctgaaagagtcattgatcccagaagatgtatgaaaccagttatcctaacagacggagaagaaagagtgattctggctggtcccatgcctgtaactcatagcagcgcagcacagcgcagaggccgaataggtaggaaccccaagaatgaaaacgaccaatatatatatatgggcgaaccattagagaacgacgaagactgtgcacactggaaagaagcaaaaatgttgctggacaatataaatacaccagaaggcatcatacctagtatgtttgagcccgaaagagaaaaagtcgatgccattgatggagaatatagattaaggggagaagcacgtaaaacctttgttgatttaatgcgtcgaggggacctacctgtatggctagcctataaagtcgctgcagagggaataaactacgcagatagacgatggtgttttgacggaatcaagaataaccagatcctagaggaaaatgtagaggttgagatctggacaaaggaaggcgagaggaagaaattaaagcccagatggctagatgcaagaatttactctgacccacttgccctaaaagagttcaaagaatttgcggcaggacgcaaatcactcacattaaatctaataacggaaatgggacgactaccaacgtttatgacgcagaaaaccagagacgcattagataacctggcggtattacatacggccgaagcagggggtcgggcatataatcacgctctgagtgaactgcctgaaacgttggaaacccttttactactaactctactagcaactgtcactggaggtatttttctgttcttaatgagtggtcgcggcataggtaaaatgaccttgggcatgtgttgtattatcaccgcctctatattattatggtacgctcaaattcaaccacactggattgcagcaagtataatcctagagttctttttgatagtcctactaattccggaacctgaaaagcagcgtacaccccaggataaccaattaacttatgtagtgatcgccattctaacagttgtagcagcaacgatggccaatgaaatgggatttctagagaaaacgaaaaaggatctggggttagggtcaatagctacacaacaaccagaatccaacattctagatatcgacctacgtccagcttcggcttggaccttgtatgcagttgcaacaacgttcgtaacgccgatgttgagacattcgatagaaaattcctcagtcaatgtaagtctaacagcaatagcaaaccaggcgacagttctaatgggattgggaaaagggtggccgttgtcgaaaatggatataggggtccctttattggcaatagggtgttactcccaagtaaatccaatcactctaactgccgctctactacttctagtagcacactatgcaataatcggtccagggttacaagcaaaggcaacaagagaagcgcagaaaagagcagctgcgggtataatgaaaaacccaacagtagatggaattactgttatagacttagacccaattccttacgaccccaaatttgaaaaacaactgggacaggtcatgcttcttatactttgtgtaacacaggtcctcatgatgcgaacaacttgggcgttatgcgaggctttgacattggcgacgggcccaattagtactttgtgggagggtaacccgggaagattttggaatacaactattgcagtaagtatggcaaatatatttagaggtagttacctagcaggagccggactcctattcagtataatgaaaaatactacaaatacgaggagaggaactgggaatattggagaaacgcttggagaaaaatggaaaagtcgtttaaacgcattaggtaaatccgaatttcagatatataagaaatccgggattcaagaagtagaccgaactctagcaaaagaaggcataaaacgcggagagacagatcaccatgctgtaagtagggggtccgccaaacttcgttggttcgttgagaggaatatggtaactccggaaggaaaagttgtagaccttggctgtgggcgaggtggctggagttactactgtgggggcttgaaaaatgttagggaagttaaaggactaacgaaaggagggccggggcatgaagaacccatacctatgagtacatatggctggaatttagttaggctacagtctggagtagatgtcttcttcataccgcctgagaaatgtgacacattactatgtgatatcggtgaatcatcaccaaacccaaccgttgaggccggtagaactttaagggtactaaatctagtggaaaactggttaaataataatactcaattttgtataaaagttttaaatccctacatgccttcagtcattgaaaagatggaggcccttcaaagaaaatatgggggagctctagtgagaaacccacttagcaggaactcaacacacgaaatgtactgggtaagtaatgcaagcggtaatatagtaagttctgtaaacatgatctcaagaatgttaatcaatagattcacaatgcgccacaagaaggcaacctatgaacctgatgttgatttaggctcaggaacccgcaatattggcatagaatcggaaatacctaatttagatataatagggaaaaggattgagaaaattaaacaagaacatgagacaagttggcactatgatcaagatcatccttataaaacttgggcctatcatggtagctacgaaactaagcagacaggatcagcatcttcgatggtgaatggggtagtgaggttgctaacaaaaccttgggacgtgcttccaacagtaacgcaaatggctatgacagacactactccgttcggtcaacagagagtattcaaagaaaaagtagatacacgaacccaagaaccaaaggagggaaccaagaaacttatgaaaataactgcagaatggctttggaaagaattaggtaaaaagaaaacaccgaggatgtgtacacgagaagaatttacaagaaaagttaggtcaaatgcggcattaggtgcgatcttcacggatgaaaataaatggaaaagcgcacgggaagctgttgaagactcacgattttgggaattagtagacaaagagcggaatttacacctggaaggcaagtgtgagacctgcgtatacaacatgatgggcaaaagggaaaagaaactaggcgagttcggaaaagccaaaggaagcagagctatatggtatatgtggttaggcgcgagatttttagaatttgaagcgctaggatttctcaacgaggatcattggtttagcagggaaaactcattatccggggtagagggtgaaggattacataagttgggatacatattacgagatgtttcgaagaaagaaggcggtgcaatgtatgcagacgataccgcaggatgggataccagaataacacttgaagatctcaaaaatgaagaaatggtcaccaaccatatggaaggtgaacacaagaagttagctgaggccatattcaagctcacctatcaaaacaaagttgtgcgcgtgcagcgaccaactcctagaggaacggttatggatataatatcaagaagagatcaaaggggctccggacaagtgggtacatacggtttgaatacatttacaaatatggaggcacagttaattcgacagatggaaggagaaggggtgtttaaaaatattcagcacttgaccgttaccgaagaagtagcagtccagaattggctagcaagggttggacgagaaagattaagcaggatggcaataagcggtgacgattgtgtagttaagccgctcgatgatcggttcgcgaacgccttgacagctctaaatgatatgggaaaaatccgaaaagatatacaacagtgggagcccagcaaaggatggaatgactggactcaagtgcccttttgctcccatcacttccatgagctcataatgaaggatggtcgggttttggttgtaccatgcagaaatcaagatgaattaatcggacgcgctcggatttcgcagggggcggggtggagcctacgtgaaacagcatgtttaggaaaatcgtacgcccagatgtggagcctgatgtatttccatcgaagagacctgagactagcagcgaacgctatatgctctgcagtaccctctcactgggtcccaacttcaagaaccacatggagcatacacgcaaaacatgaatggatgacgactgaagacatgctcacggtttggaatagggtctggataagagacaatccatggatggaagataaaactccagtcgaaagttgggaggagattccatatctaggtaaaagggaggatcaatggtgcgggtctttgatcgggctaacatcgcgagcaacatgggccaagaacatacaagctgcaatcaatcaggtaaggagcttaatgggaaacgaagaatacacagattatatgccaagtatgaagaggtttcgaagagaagaggaagaagcaggcgtgctttggtaa

SEQ ID NO: 22727 - RNA, 9876 nt, synthetic construct
  misc_feature 1..9876: note = derived and/or modified CDS sequence (opt6) from DENV-2__EU482644__SS-prME
  source 1..9876: mol_type = other RNA
tcagcgggtatgataattatgttaataccaactgtaatggcatttcatttaactacaaggaacggtgaaccccacatgatagtaggtatccaagaaaaaggaaaatcattactcttcaaaaccgaagacggcgtgaatatgtgtactttgatggctatggatttaggcgaactatgtgaagataccattacgtataaatgtcctctacttcgtcaaaatgaacctgaagacatcgattgttggtgtaatagtactagcacatgggtaacgtatggtacttgtacgactacaggcgaacatcgcagagagaaaagatctgtggctctcgtaccgcacgtaggtatgggccttgaaacacgaactgaaacatggatgagctctgaaggagcttggaaacatgcacaaagaatagaaacctggatattacggcatccggggtttactattatggcagctatactagcatatacgattggtacaacccacttccaaagggtgctcatatttatattattaactgctgtagcaccatcaatgactatgcgatgtataggaatatctaaccgagatttcgtcgaaggcgtaagtggcggctcttgggtagatatagtacttgaacacggctcctgtgttactacgatggctaaaaacaaacccaccctggacttcgaacttataaaaacagaagctaaacaacccgctacattgagaaaatattgtatcgaagcaaaactcacaaacaccacaacagaatctcgatgtcctacacaaggtgaaccatcattgaaggaagaacaagataaaagatttgtatgtaaacattcaatggttgatagaggttggggtaacggatgcggactcttcggtaaaggaggtatagttacttgtgccatgtttacatgtaagaaaaatatggaaggcaagatagtgcaaccagaaaatcttgaatatactatagtagtcacaccgcatagcggagaagaacatgcggttggtaacgacacaggtaaacatggacaagaaataaaagttactccacaaagttcaataacggaagcagaacttactggatatggaactgttaccatggaatgcagccccagaactgggctagactttaatgaaatggtactcttacaaatggagaataaagcatggttagtccataggcagtggttcctcgatttaccgctaccatggctacctggagctgacaaacaagaatcaaactggatacaaaaagaaaccctcgtaacttttaaaaacccgcacgccaagaaacaggatgttgttgttttgggatcacaagaaggtgctatgcacactgccttaacaggagcaaccgaaatacagatgagttctgggaacctattgttcacaggccatttaaaatgtaggttgcgtatggacaagttgcagctgaaaggcatgtcgtatagtatgtgtactggcaagtttaaagtagtaaaagaaatagccgagacgcaacatggtacaatagttatcagagtacaatacgaaggagatggatccccttgcaaaatcccgtttgaaattatggatctggagaaaaggtatgttctaggacgactgataacagttaatcctattgttacggagaaagatagcccagtcaatattgaagctgaacctccattcggcgacagctacattataataggtgtagaaccaggtcaactgaaattaaattggttcaagaaagggtctagtataggtcagatgtttgaaacaacaatgcgcggagcgaaaagaatggctatccttggagacactgcctgggatttcggatcgcttggaggagttttcacaagtataggaaaggctttacaccaagtatttggggcaatatatggcgccgctttttctggagtgtcttggacaatgaaaattctaattggcgtaataataacttggataggaatgaatagcaggtctacaagcctatctgtctctttagttttagttggaatagtaacattatatctaggcgtaatggtccaggctgattcagggtgtgtagtaagctggaagaacaaggaactgaaatgtggatcgggcatctttattactgataacgttcacacatggacggagcaatataaatttcaacctgaatcaccaagtaagttagccagtgcaatccaaaaagcacaagaagagggaatatgtggaatacgtagtgttacacggctcgaaaatttaatgtggaaacaaattacaccagagctaaatcacatcctagcagaaaatgaggtaaaattaactataatgaccggtgatattaaagggattatgcaagctggaaagaggtcgctgagacctcaacctacagaattgaaatattcttggaaaacatggggaaaggcaaagatgttatcaaccgagagttacaaccaaacattcttaatcgatggtccggaaacagcagagtgccctaatacaaatcgcgcatggaactctctagaggtagaagattacggattcggagtttttactacaaacatatggttgaaattaaaagagaaacaggacgcgttctgtgacagcaaactaatgtctgccgcgataaaggataacagggcagtacatgccgacatgggttattggatagaatccgcactcaacgatacttggaaaatagagaaggcttcttttatcgaagtgaaaaattgccactggcccaaaagtcacacgctatggtccaacggagtgctagaatctgaaatgatcatacccaaaaatctagctggaccagtttcccaacataattatcgtccgggttatcacacacaaatagctgggccatggcatttagggaaacttgaaatggactttgacttttgcgatggaacaactgtgatcgttactgaggactgtggaaatagagggcccagcttaaggaccacaacagcgtcaggcaaattaataacggaatggtgttgcagaagttgtactttacctccactccgttacagaggagaagacggatgctggtacggaatggagattaggcccttaaaagaaaaagaagaaaatttagttaatagcctagtaacagcagggcatggtcaagttgacaacttttcccttggagtcttgggtatggcactgtttctagaggaaatgttgagaacacgagtaggtaccaaacacgcaattctattagttgccgtttcatttgtcacattaattactggcaacatgtcattcaaagatttaggtagggttgtagtgatggttggcgcaactatggcagacgatataggaacaggggtcacttacctagctttgctcgctgcattcaaggttagaccaactttcgcagctggattacttctgagaaaactaacctcaaaagagctaatgatgaccacgatcggtattgtcctgttatcgcaaagtacgataccggaaacagttctagaactcacggacgccctggctctcggtatgatggtactaaaaatcgtcagaaatatggagaagtatcagttggcagtaacgatcatgactatactctgcgtcccaaatgccgtcattttacaaaatgcatggaaggtgtcgtgcacaatactagctgtagtaagcgttagcccacttttactaacctcgtctcagcagaaaactgattggataccacttgctctgactatcaaaggcctaaaccccacagcaatatttttgacaacgctctcgcgaaccaacaagaagaggagctggccacttaatgaagctataatggcagttggaatggtgtcaatattagcaagctcacttctaaagaacgatataccaatgacaggacctctggtggctggaggattgctcacagtctgctatgtattaacggggcggtctgctgacctagagcttgagagagcaacggacgtaaaatgggaagaccaagcagaaatttcgggaagtagtcccattttaagcattacgataagtgaagacggctcaatgagcatcaaaaacgaagaagaggaacaaacacttaccattttaatacgaactggtcttctagtcatttcaggtctattccctatatcgataccgataaccgcggcggcctggtatctttgggaagtcaagaaacagcgtgcgggagtactttgggacgtaccttcaccgcctcctatgggtaaagctgagctggaggacggcgcatataggataaaacagaaaggaatactcggctattcccagattggagctggtgtttataaagaaggtaccttccatacgatgtggcatgtaacaagaggggcagttttaatgcataaaggaaaacgaatagaaccttcctgggcagatgtaaagaaagatttaataagttatggaggtggctggaagctcgaaggagagtggaaagaaggagaggaagtgcaagttcttgcattagaacccggtaagaacccacgagcagtacaaaccaaacctggactctttaagacaaatacaggtactattggggcagtgagtctcgatttttcaccaggaacatccggtagtcccatcatagataaaaagggaaaagtcgtcggtctatatggaaacggtgttgtaacgcggagcggtgcgtacgtatcagcaatcgctcaaactgagaagtcgatagaggataaccccgaaatagaagacgacatcttccgtaaaagaagattgactataatggacctgcatccaggtgcagggaaaacaaaacgatatttaccagcgattgtccgtgaagcaatcaaacgtggactccgaacattaatactagcgccgacgcgagtagtagcagcggaaatggaagaagcacttcggggcttaccgattcggtatcaaacccccgctattagagctgaacatacgggacgtgagatcgtagaccttatgtgtcatgcaacatttactatgaggctattatcaccagtgagggtcccaaattacaatctgatcatcatggatgaagcacacttcacagatccggcatctatcgccgcgagaggatacataagcacaagagtagaaatgggggaggccgcaggtatatttatgaccgcaactccgccgggttcacgagatccctttccgcaaagtaatgccccaataattgacgaggagagagagattccggagagatcctggaactctggacatgaatgggtaacggacttcaaaggaaagactgtgtggtttgttccatcaatcaaagcgggtaatgacatagccgcttgtctgagaaagaatggcaagaaagtgatacaattgtcaagaaagacctttgacagtgaatatgttaagacacgaacaaatgactgggactttgtagtaacaactgacataagcgaaatgggagcaaattttaaggctgaacgcgttatagacccaaggagatgtatgaaaccagtaatattaactgatggcgaggagagggtaatattggcgggtccaatgcccgtaacacactcaagcgccgcccaacgtagaggtagaattggaagaaatcccaaaaacgaaaatgatcagtacatctatatgggtgaacccttagaaaatgatgaggattgcgcgcactggaaagaagctaaaatgttactagacaacattaatacaccagaagggattattccatcaatgttcgaacctgaacgagaaaaagttgacgcgatagatggtgaatacagacttaggggagaagcccgtaaaaccttcgtagacctaatgagaagaggcgacctgccagtttggctcgcttataaagttgccgctgaaggaatcaactatgcagaccgtaggtggtgtttcgacgggatcaaaaataatcaaatactagaagaaaacgttgaagttgaaatatggactaaagaaggggaacgtaaaaagctgaagcccaggtggttagatgcaagaatatatagtgatccgctcgcactgaaggaatttaaggaatttgctgccggtaggaaatctttaactttaaacctcataacagaaatgggcagactgcccacgttcatgactcagaaaactagagacgccttagacaacctagctgtacttcacacagcagaagccggtggtcgagcatataaccacgcgttaagcgaactacccgaaacactggaaaccctattacttctaactctactagcaacagtgacaggcggtatctttctatttttgatgtcaggtagagggatcgggaaaatgactttaggaatgtgctgcattataaccgctagcatattgctttggtacgctcaaatacaacctcattggatcgcagcatctataatcttagagttctttttgatagttttattgatccccgaacccgaaaaacaaagaacaccgcaggacaatcaactcacatacgtggtcatcgccatactcacagttgttgcagccactatggcaaacgaaatgggatttttagagaaaactaagaaagatctcgggctgggatctatagcaactcaacagcctgaaagcaatatcctcgatatagatcttaggcccgcgagtgcttggaccttatacgctgttgcaactactttcgtgacacctatgctacgtcactccatagaaaatagttcagtcaatgtgagtttaacggcaatagctaatcaagcaacagttctaatgggtttgggaaagggttggccgttgagcaagatggatattggagttccgttactagcaataggttgttatagtcaggtcaacccaataaccctaactgccgccctcctattactcgtagcccattatgcgataatcggccccggactacaagccaaagcaactagggaagcccaaaagcgtgcagcggcaggtattatgaaaaatccaacagttgatggtattacagtcatagatctggaccctataccatatgaccctaaattcgaaaaacaattaggccaagtaatgttattgatactatgtgtcactcaggttttaatgatgcgaacaacatgggcgctatgtgaagcgcttacgctagctacagggccgattagcacactgtgggaaggtaaccctggacgcttttggaacacaacgatagcagtctctatggctaatatatttagaggaagttacttggccggggcagggctactattttcaattatgaaaaatacaacaaatacacgaagaggcactggaaacatgggtgaaacactaggtgaaaaatggaaatctcgcttaaatgcactcggaaaaagtgagtttcagatatataagaaatccggtatacaagaagtagatcgcacactagcaaaagaagggataaaacggggtgaaacggaccatcatgccgtctccaggggctcagctaaattgagatggttcgttgagcgaaacatggtaacacctgagggcaaagtagttgatctgggttgtggaagaggagggtggagctattattgtggcggtttgaaaaatgtacgagaagtcaaaggactaacaaaaggtggacccgggcatgaagaaccaataccgatgagcacctatggatggaatcttgtccgtttacaaagcggagtcgatgtcttctttatccctcccgaaaaatgcgataccttactatgcgacataggagaaagttctcccaaccctactgtagaagctggccgtacccttcgtgtgttaaatctagtggaaaactggttaaataataacacacaattctgtataaaagtacttaacccttatatgccgtctgtgatagagaaaatggaagcgttacaacgaaaatatggaggagcccttgtgagaaatcctttatcaaggaacagtacacatgaaatgtattgggtttcaaatgctagtggtaatattgtcagtagtgtaaatatgatcagcaggatgttaattaatcgattcacgatgagacataaaaaggccacgtatgagccagatgttgatttggggtcggggacacgaaatataggcattgaatcagagatacctaacttagatattattgggaaaaggatagagaaaattaagcaggaacacgaaacaagttggcattatgaccaagatcatccttataaaacatgggcgtatcatggatcctacgaaactaaacaaaccggaagtgccagttctatggtcaacggggtagtaaggttactcacaaaaccatgggacgtgttaccaactgtcacccaaatggccatgaccgacacaaccccgtttggccaacaaagagtttttaaagaaaaagtggatacgcgcactcaagaaccaaaggaaggaactaagaaactaatgaaaataaccgccgaatggctctggaaagaattgggtaaaaagaagaccccaagaatgtgcactcgagaagagttcaccagaaaagtccggtctaatgcagcactaggggcaatatttacagatgaaaacaaatggaagtcagctagagaagctgttgaagatagccgtttttgggaattagtagataaagagagaaatctccatctcgaaggtaaatgcgaaacatgtgtatataacatgatgggtaaacgagagaagaaattgggtgagtttggaaaagcaaaaggctccagagcgatatggtacatgtggctaggtgcaaggttcctagaatttgaggcccttggcttcttgaacgaagatcactggttttctcgagaaaattcgctttccggtgtagaaggagaagggcttcataaactcggatatattcttagagatgtgagtaagaaagagggaggtgctatgtatgcagacgatacagcgggatgggacaccagaatcactttggaagatttaaagaacgaggaaatggtcactaaccatatggaaggggaacataagaaactagctgaggcgatattcaaacttacttaccaaaataaagtagttagagttcagcgtccaacaccaaggggcacagtgatggatataatctctagaagagatcagaggggctctgggcaagtgggaacttatggattaaacacctttaccaatatggaggcacagctaatccggcaaatggagggtgagggagtcttcaaaaatatacaacaccttacagttactgaggaagtggcagtacaaaactggttagccagagtaggacgggaaagactttcaagaatggcgatttcaggggacgattgtgtggttaagccattggatgacagatttgcgaatgcattaacagcattgaacgacatgggaaaaatacgtaaggacatccaacaatgggaaccatcaaaagggtggaatgattggacacaggtacctttttgcagtcaccatttccacgaactaataatgaaggacggtagggttcttgtagtaccatgccgtaatcaagatgaattaattggccgtgcaagaataagtcaaggtgccggatggtcactccgagagactgcgtgcctgggaaaatcatatgcgcaaatgtggtccctaatgtatttccatcgtcgtgaccttagattggctgctaatgcaatatgcagcgccgtgcccagccattgggtaccaacaagcagaacaacctggtccatacatgcaaaacatgagtggatgacaacggaagatatgctgacagtatggaatagagtctggattagagaaaatccctggatggaagataagacgccagtagaatcttgggaagaaatcccttacttgggtaaaagggaagatcagtggtgtggatcactgatagggttgacttcgagagctacatgggctaaaaatatccaagccgccataaaccaagtaaggagcctaatcggcaacgaagaatacacagattacatgccatcaatgaaaagattcagacgagaagaggaagaagcaggcgtgttatggtaa

SEQ ID NO: 22728 - RNA, 9876 nt, synthetic construct
  misc_feature 1..9876: note = derived and/or modified CDS sequence (opt6) from DENV-2__EU482645__SS-prME
  source 1..9876: mol_type = other RNA
agcgcgggaatgattataatgctcatccctacggtaatggcgtttcacctaacgactcgaaatggggagccacacatgatagttggaatacaggaaaaaggtaaatcgctcctatttaaaacagaggatggggttaatatgtgtactttaatggcaatggacctaggagaattatgtgaagacactataacctacaaatgtcccctactacggcaaaacgagccagaggatatagattgctggtgtaactctacatcgacatgggtgacgtatggtacatgcacaacgactggcgaacatcggagagagaaaagatctgttgctttagtgccacatgtcgggatgggattggagacgcgaaccgaaacatggatgagttccgaaggagcctggaaacatgcgcaaagaatcgagacatggattctgagacacccaggattcaccatcatggccgctatactagcgtataccattgggacaactcacttccagaaggtactcatattcatattattaactgcagtggcccctagtatgaccatgagatgcatcggtatatccaatcgagacttcgtagaaggcgtgtcaggaggatcgtgggtagatatcgtactggagcacggatcgtgcgtaacaacaatggcaaaaaataaaccgactttagattttgagttaattaaaacagaagcaaaacaaccggcgacgttacgaaaatactgtatagaagctaaattaacgaacacaaccacggaatcacggtgccctacgcaaggagagcctagcttgaaagaagaacaagataagcgctttgtttgtaaacactcaatggttgaccgaggatggggtaatggttgcggactattcggcaagggaggcattgtaacatgcgcaatgttcacgtgtaaaaaaaacatggagggaaagattgtgcaacctgaaaatctcgaatacactatcgttgttaccccccattcaggagaagaacatgcagtaggcaacgacactggtaaacatgggcaagaaattaaagtaactccccaaagctcaatcacagaggcagaactcactggatatggcaccgtaacaatggagtgcagccctagaactgggctggactttaatgaaatggtattattacaaatggaaaataaggcttggcttgtgcatagacagtggttcttagatttgccactgccatggctacccggagctgataagcaagagagtaactggattcaaaaggaaacactcgtaacatttaaaaatccccatgcaaaaaagcaagatgtcgtcgtcctaggctcacaggaaggagcgatgcatacagcattaacgggggctactgaaatacaaatgtcgtccggaaatttactattcacaggtcatcttaaatgcaggctgagaatggacaaacttcaactcaaaggaatgtcttatagtatgtgtactggaaaatttaaggtagtaaaagaaatcgcagagactcaacatggcacaattgtaatacgcgtccaatacgaaggggatggtagtccttgtaaaatcccctttgaaataatggacttagaaaaaagatatgtgctaggacgcttaattacagttaacccaattgtaaccgagaaagacagtccagtcaatatagaagcagaacccccatttggagatagttatataattataggcgtagagccaggacaattaaaactaaattggtttaaaaaaggaagcagtattggccaaatgttcgaaacgactatgaggggagcgaagagaatggcaatactcggtgatacggcgtgggattttggaagcctaggtggcgtatttacaagtatcggaaaggcattacaccaagtatttggtgctatatatggtgcagcattcagtggcgtatcatggaccatgaaaatactaatcggcgtgataattacgtggatagggatgaattcacgaagtacatctctgagcgtcagcctagtactcgtagggattgttaccctgtatttgggtgtgatggtccaggcagacagcggttgcgtagtgtcgtggaaaaataaagaactcaaatgtggatccggtatctttattacagacaacgtgcatacgtggacagagcaatataagttccagccggagtctcctagtaagttagcaagtgcaatccaaaaagcccaggaagaaggtatatgcggtattagaagtgtaacgagattagaaaatctcatgtggaagcaaataacaccggaactgaaccatatcctagccgaaaatgaagttaaattaacgataatgacaggcgacataaaaggcataatgcaagcaggtaaaagaagtctgcgaccacagccaactgaattaaaatattcgtggaaaacatggggaaaagctaaaatgctgtccacagagtcctataaccaaacttttttaatagatggacccgaaacagcggaatgtccaaacaccaatagagcatggaatagtctcgaagtggaagattatggatttggagtcttcacgacgaatatatggctgaagctaaaggagaaacaagatgctttttgcgacagtaaacttatgtctgcagctataaaagacaatagagcggtccatgccgatatggggtattggatagaatctgcattgaatgatacttggaaaatcgaaaaagcatcattcatcgaggtaaaaaattgccactggcccaaaagccatactttatggtcaaatggagtgttggaaagtgaaatgatcatcccaaaaaatctagcaggaccagtctcacaacataattacaggcctggctaccatacacagattgcaggtccatggcatcttggcaaattagaaatggactttgatttctgtgatggtactactgtcatagtcacggaggattgcggaaacagaggcccgagtttacgtacaacaacagcgtcagggaaactgattacagaatggtgttgtagatcgtgtacattgccgccactaagatatcgtggcgaagatggttgctggtatggaatggaaataagacctttgaaggaaaaagaagaaaatctggtgaatagccttgttactgccggacacggacaggttgacaacttctctctaggagtgctagggatggctctatttttagaagaaatgctaagaacaagggtgggtacaaagcatgcaatcttactggtagcagtttcgttcgtaacacttataaccggtaacatgtcgtttaaagatttaggccgggtagtggtgatggtaggtgcgacaatggctgacgacatcggaaccggtgtcacgtatttagcactactcgctgcctttaaagtgagaccaaccttcgctgcaggtctattgctaagaaaactaacttcaaaagaattaatgatgactaccattggcatcgttttgctaagccaatcaacaatacctgagacagttctggaacttacggacgcactggcacttgggatgatggtcctaaagatagtgaggaatatggaaaaatatcaactagcggtaaccataatgactattctatgtgtaccaaacgctgtaatattacaaaatgcatggaaagtatcatgtacaatactagctgtagtcagtgtgtctcctttgttactaactagtagccagcaaaaaacagactggatacctctagcacttacaattaaaggccttaatccaacagctatatttctaacaaccttatcaagaaccaacaagaaacgatcatggccgttaaacgaagcaataatggcggtaggtatggtatcgatcttagcatcaagtttacttaaaaatgatataccgatgacaggaccgcttgtggcaggtggacttttgaccgtgtgttacgtgctgacgggacgaagtgccgatctcgagttagaaagagcgaccgatgtcaaatgggaagatcaggccgaaatttcagggtcgagtccaatattaagcataaccataagcgaagatggctcaatgagcattaaaaacgaagaagaagagcaaactcttacaatactgattcgaacaggactactagtaataagcggcttgttcccaatatcaatcccaattacggcagctgcctggtacttatgggaagtaaagaaacagcgcgcaggggttttgtgggacgtaccatcacctcctccaatgggaaaagctgaattagaagatggagcgtatagaataaaacaaaagggaatattaggatactcgcaaataggagccggagtctacaaagagggtacgttccatactatgtggcatgttacaaggggcgccgttttaatgcataagggtaaacgaatagaaccctcatgggctgatgttaaaaaagatctaatatcatatggcggaggttggaagctggaaggggaatggaaagagggagaagaagtacaagtgctagcacttgaacccgggaaaaatcccagagctgttcaaacaaaaccaggattgtttaaaacaaatacaggtactataggagctgttagcttagatttctcccctggaactagcggatcaccaatcatagacaaaaagggaaaagttgttggtttatatggaaatggggtcgttactagatcaggagcatacgtatctgcgatagctcaaacagaaaagtccatagaagataatccagaaatcgaggatgacattttcaggaaaagaaggttaaccataatggatttacatccaggggcaggcaaaacgaaacggtatctccccgccatagtgcgtgaggccataaaaaggggactaagaactcttattttagcacctacgagggttgttgcagcggagatggaggaagccctcagaggactaccaataagataccaaacaccagccataagagccgaacataccggacgcgaaatagttgacttaatgtgtcatgcaacatttacaatgcggctattaagccctgtaagggttcctaattataaccttatcataatggatgaggcacactttaccgatccagcaagtattgctgctaggggatatatctcaactcgggtagagatgggggaagcagcaggaattttcatgaccgcgactcctccaggttcaagagatccattccctcaaagcaatgcccccataattgatgaagaaagagagatccctgagagatcatggaactccggtcacgagtgggtaacggacttcaaagggaaaacagtatggttcgtgcctagcataaaggcgggaaatgatatagcagcatgtcttcgaaaaaatggtaaaaaagtaatacaattatcacgaaagacgttcgattcagagtacgttaaaactcgaacgaacgactgggatttcgtagtaacaactgatataagcgaaatgggagcaaattttaaagctgagcgagttatagacccaagacgctgtatgaagccagtaatattaacagatggagaagaaagggtaattttagcaggtcccatgccggtaacgcatagcagcgcagctcaacgaagaggaaggataggacgcaacccgaagaatgaaaatgatcagtatatatatatgggtgaaccgctggaaaacgacgaagattgtgcacactggaaagaggcgaaaatgctgctagacaacattaatactccagaaggaataattccgagcatgtttgagcctgagagggagaaagtagatgcgatcgatggtgaataccgacttcgaggggaagcaagaaagacgtttgttgatttgatgagacgtggtgatctaccagtatggttagcttacaaagtagcagcagagggtattaattacgctgataggcgatggtgtttcgatggaataaaaaataaccaaattctagaagagaatgttgaggtggaaatctggacaaaagaaggcgaacggaagaagctcaaacctagatggctcgacgcaagaatatattcagaccctctagcattaaaggagttcaaagaattcgctgcgggtagaaagagcctaactttaaatttaataactgaaatggggaggttaccaacgtttatgacgcagaaaactcgtgacgcattagataatctagctgtcttacacactgctgaagcaggtggcagagcatataaccacgcattgagtgaattaccagaaacactggaaactctgttactcttaacgttattggcaactgtcactggtggtattttcctatttttaatgtcaggaagaggcattggtaaaatgactttaggcatgtgctgtatcattacagcatcaatattactctggtacgctcaaatccaaccacattggatcgctgccagtataattctcgaattttttttaatagtgctactaattccagaaccagaaaaacagaggacaccacaagataaccaactaacatatgtcgtaatcgccattctgacagtagttgctgcaactatggcgaatgaaatgggatttttggagaaaacaaagaaagatttaggtctgggatcaattgccacccaacaaccggaatccaatatactagacattgacctaagaccggcatctgcttggacgttgtatgcagttgccactacattcgtcacccccatgctacgacatagcatcgaaaactcaagtgtgaatgtctccctaacagcgatagccaatcaagctacagtactcatgggactgggcaaaggttggcccttgagtaagatggatataggtgtaccactattagcgattggatgttacagccaagttaacccaattacactcacagcggctttgttattattagtcgcgcattacgcaataataggacccggattgcaagcaaaggctacgcgggaggcacaaaaacgggcagctgcaggtataatgaagaacccaaccgtcgacggaataactgtcattgacttggaccctattccgtatgatccaaaattcgagaaacaactcggacaggttatgcttcttatattatgcgttacgcaggtccttatgatgcgtacaacatgggcactgtgtgaagcattaactctcgctacaggtccaataagcaccctatgggaaggtaatccgggcagattttggaatacaactattgcggtaagtatggcaaatatttttaggggtagttacctcgcaggagcaggactgctattctctattatgaaaaacacaactaatacaagaagaggaactggaaatatgggagagactttaggtgaaaaatggaagagcaggttaaatgctttaggcaaatcagaatttcaaatttacaagaagtcaggtatacaggaagtagatagaacactagcgaaagagggcatcaagagaggtgaaacagaccatcatgcagtttctagggggtcagcaaaattaagatggtttgttgagcgtaatatggtaacacccgaagggaaagtggtagatttgggttgcggtcgcgggggctggtcttattactgcggagggttaaaaaatgtacgagaagtcaaagggctaacaaaaggtgggccagggcatgaggaaccaataccaatgtcgacgtacggatggaacctagtacgattgcagtcaggagtcgatgtattctttattccgccagaaaagtgtgacactttattatgtgacattggagaatctagccctaatcctacggtagaagcggggcgaacgttacgcgtactaaatcttgtagaaaattggctaaacaataacacacaattctgtattaaggtcctcaatccatatatgccttccgttatagaaaaaatggaagccttacagagaaaatacggcggagcactggtccgaaaccctttgagtaggaatagtactcatgaaatgtattgggtaagcaacgcttcgggaaacatagtttcttccgtaaatatgataagcaggatgctcattaacagatttaccatgcgacataagaaagccacctatgaacccgatgtcgacctaggatcaggtacaaggaacataggaattgaatctgaaattccaaacttagatatcataggtaagaggattgaaaaaattaaacaagaacatgaaacgagctggcactatgatcaagaccatccctataagacctgggcatatcatggctcttatgagaccaaacaaacgggttcagcttcgagtatggtaaatggagtggttaggctactaacaaaaccttgggacgtattacctacagttactcaaatggccatgacagataccacaccttttggtcaacaaagagtattcaaagaaaaagtagatactagaacgcaagaacctaaagaaggaaccaaaaaattgatgaaaataacggcagagtggttatggaaagagttaggaaagaaaaaaactcctcgtatgtgcacccgggaagaatttactaggaaagttcgatctaacgcagccctaggagcaattttcacagatgaaaataaatggaagagtgcgagggaggcagtagaagatagcagattttgggagttggttgataaagaaaggaatctacacctagaggggaaatgtgaaacatgcgtatataatatgatgggcaagagagaaaaaaaactaggagagttcggaaaagcgaaaggaagtcgggccatctggtacatgtggctaggagcaaggtttttagaatttgaagccttgggctttctgaacgaggatcactggtttagccgcgagaactcattaagcggagtcgaaggggaaggtctacacaagttaggttatattctgagagatgtatcaaagaaagaggggggcgctatgtatgcggatgatactgcgggttgggatactagaataactttagaagatctaaaaaatgaagaaatggtgacgaaccacatggagggagaacataagaagctcgctgaggcaatttttaaattgacgtaccagaacaaagttgttcgagttcagcgaccaacaccgcgcggaactgtgatggacatcatatctcgtagagaccagcgagggtcaggacaagttggtacgtacggactaaatacgttcacaaatatggaagcacaacttatcagacaaatggaaggagaaggggtattcaaaaacatccaacaccttacagtgactgaagaagtggctgtacagaattggctagcacgtgtgggaagagagaggttaagtagaatggcgatttcgggcgatgattgtgtagttaaacccttggatgatagattcgcaaacgcattgactgcacttaacgatatgggaaagattagaaaagatatccagcaatgggaaccttcaaagggctggaatgattggactcaagtacccttttgctcacatcattttcatgaattaattatgaaagacgggcgagtactcgtagtgccatgtagaaaccaagacgagcttataggtagggcaagaataagtcaaggagctggttggagcttacgagagacagcttgtctggggaaaagttatgctcagatgtggtcattaatgtattttcaccgtcgtgatctcagactcgctgcaaatgcaatctgctctgcggtgccaagtcattgggtcccgacatccagaacaacttggtcaatacatgcaaaacatgagtggatgacaacggaagatatgttaactgtttggaatcgagtatggattagggagaacccttggatggaggacaagacaccagtagagagttgggaggagataccctacttagggaagagagaggatcagtggtgcgggtccttaataggcttgacgagtagagcaacatgggcaaaaaatatacaagcagcaataaaccaagtccgatctctcattgggaacgaggaatacacggattatatgccaagtatgaagagatttcgtcgcgaggaagaggaggcaggggtcctttggtaa

SEQ ID NO: 22729 - RNA, 9876 nt, synthetic construct
  misc_feature 1..9876: note = derived and/or modified CDS sequence (opt6) from DENV-2__EU482646__SS-prME
  source 1..9876: mol_type = other RNA
tctgcaggcatgataattatgttgataccgactgttatggcgtttcatttaactacaagaaatggtgaacctcatatgatagttggaatccaagaaaaaggaaaaagtttactatttaaaacagaagacggcgttaatatgtgcacattgatggcaatggacttaggagaactatgtgaagatacaattacatataaatgtcccctacttaggcagaatgaaccggaagacatcgactgctggtgcaacagcacatctacttgggtaacgtacggaacatgcactacaaccggagagcatcgaagggagaaacgaagcgtagctcttgttccgcatgttggcatgggcttagaaacaagaacagaaacttggatgtcctcagaaggtgcatggaaacatgcacaaagaatagaaacatggatactccgacaccccggatttacaataatggcggctatccttgcctacactattggaaccacacatttccaacgagtgctaatatttatcttactgacagctgtggcaccgtccatgacgatgcgttgcataggcatctctaaccgtgatttcgtagaaggcgtatcgggaggttcatgggttgacatcgtattagaacatggaagctgtgttaccacaatggctaaaaacaaacccactttggacttcgagttaatcaaaaccgaagcaaaacaaccagccactctaagaaaatattgtatagaggcaaaactgaccaatacaactacagaaagtagatgcccgacgcagggtgaaccttccttgaaagaagaacaagataagcgatttatctgtaaacatagcatggtggacagaggctgggggaatggttgcggattatttggcaagggagggatagtcacatgcgcaatgtttacatgcaagaaaaatatggaaggaaaaatagttcaaccagaaaatcttgagtacacaattgtagtgacacctcatagcggcgaagaacacgcggttggcaatgatacagggaaacatggaaaagaaataaaagtaactccccaatcatccataacagaagcagaactaaccggttatggaacggtgactatggaatgcagcccacgaacaggattagatttcaacgaaatggtgttactacaaatggaaaataaagcatggctagtccataggcagtggttccttgaccttcctttaccttggctacccggcgcagacaaacaagaatctaattggatacagaaagaaactctagtcacgttcaaaaatccacatgctaagaagcaagacgtcgtagtattaggttcacaagaaggggcgatgcatactgcactaactggtgctaccgaaatacaaatgagctccggtaacttattattcacgggccatttaaaatgtagacttagaatggataaacttcagctaaaagggatgtcatactcaatgtgtaccgggaaattcaaagtagtcaaagaaatagcagaaacgcaacatgggacaatagtcataagggtgcaatacgagggagacgggtccccttgcaaaatacctttcgagattatggatcttgaaaaacgatacgtactaggccgtttaatcacagtaaaccctatcgttactgaaaaggattcacctgtcaatatcgaagcagaaccaccatttggagattcgtatataataataggagttgaaccgggacaattaaaactaaattggtttaagaaaggaagttcaattggtcaaatgttcgaaaccactatgagaggtgcaaaaagaatggctatactaggagataccgcttgggatttcggatcattaggtggggtgtttacttcaataggaaaagccctccatcaagtatttggagccatttatggggcagcatttagcggagtgagctggaccatgaaaatccttatcggagtaattataacatggataggcatgaactcacgcagtacttcactatccgtgtcattagttttagtaggtattgtcactttgtatcttggagtaatggtgcaagctgattctggatgtgttgtctcatggaagaataaagaacttaaatgcgggtcgggtatatttataacagacaatgtccacacctggacggaacagtataaatttcagccagaatctcctagcaaattagcttcagctatacaaaaagctcaagaggagggaatctgtggcataagatctgtgacgcgcctagaaaatttaatgtggaaacaaattacacccgaattgaatcacatcctggccgaaaacgaagtaaaattaacaattatgacaggggacattaaagggataatgcaagccgggaaacgatcactacgcccacagccaaccgaattaaagtactcatggaaaacctggggcaaagcaaaaatgcttagcacagaaagctataatcagacgtttcttatagacgggcctgaaacagctgagtgccctaataccaatcgagcatggaactcgttagaggttgaggattatggatttggagtgtttactacgaatatttggttaaaattaaaagaaaaacaggacgctttttgcgatagtaaactgatgagcgctgccataaaagataatcgagcagtacacgcggatatgggttattggatcgagtccgcattaaatgatacgtggaaaattgaaaaagcctcctttatagaggtcaaaaactgccattggcccaaatcccacactctatggagtaacggagttctagaatctgaaatgataattcccaaaaatctcgccggaccagtaagccagcacaattaccgtcctgggtaccacactcagattgcaggtccatggcatttgggaaagttagaaatggactttgacttttgcgatggtacaacggtcatagttaccgaagattgtggtaaccgcggacccagtctcagaacaaccactgcttcaggaaaattgataacagaatggtgttgccgttcttgtaccctcccacctttacgatatcgaggagaagacgggtgttggtatggtatggaaattcggccattaaaagaaaaagaagaaaacttggttaactcgctcgtgacggctggtcatggtcaagttgacaacttttccttaggggtcttaggcatggctttgtttctagaagagatgctcagaacgagagttggcacaaaacatgcgatattgctcgtagccgtctctttcgttacactcataaccggaaatatgagttttaaggatctaggtagagtagtggtaatggtcggagcaacaatggcagacgatatagggatgggtgtgacttatttagcacttctggcagcgtttaaggtcagaccaacgtttgcagcaggtcttctattacgaaaattaacctcaaaagaactaatgatgactacaataggaatagtacttttatcacaaagcacaataccagagactgtcttggaattaactgatgctttagcattaggtatgatggttttaaaaatcgtacgcaacatggaaaaatatcagctagccgtaactattatggcaattttatgcgttcctaatgccgtaatattacaaaacgcctggaaagtcagctgcacaatattggccgtagtatccgtttcccctctactcttgacgtcgagccaacagaaaactgattggatacctttggcactaacgattaaaggcctcaatccaacggccatatttctaacgacattgagtcgcacaaataagaaacggtcttggccacttaacgaggcaatcatggctgtagggatggtatctatccttgcatcatccctcctgaaaaatgatattccgatgacaggtcctctagtagccggtgggctattgacagtttgttatgtattaaccggtcgaagtgcagatttagaattagagagggctactgatgtgaaatgggaagaccaagcagaaataagcggctcgtccccaatactatcaattacgatttcagaggatggttcgatgtctatcaaaaatgaagaggaggaacagacattaacaatactaatcagaacaggattattagtgatatccgggttattccccataagcattccaatcacagctgcggcctggtatctatgggaagtcaagaaacaacgagccggcgtattgtgggacgtaccgtcgccgcctccaatgggaaaagcggaattagaagacggcgcttatcggattaaacagaagggtatccttgggtacagtcaaataggggccggtgtatacaaggaaggtacctttcacactatgtggcacgtcactcgcggcgccgtgcttatgcacaaaggtaaaaggatagagccaagctgggctgacgtcaagaaagatctaataagctacggtggcgggtggaagttggaaggagaatggaaagaaggtgaggaagttcaagtcctcgcattagagcccggtaaaaatccaagggctgtgcagactaaaccaggattgtttaaaaccaacacaggcaccattggtgcagtttcattagacttctctccaggaacaagtggaagtcccataatagacaagaaaggaaaagtagtaggcttatatggaaatggagtggtaacaagatcaggagcatatgtaagcgccattgcgcagactgagaaaagtattgaagataaccccgaaatagaagacgatatatttagaaaaagaaggttaaccattatggatcttcaccctggcgctggtaaaacaaagagatacttaccagcaattgtacgagaagccattaaacggggattgcgtactctcatcttagcaccaaccagggtcgtagctgcggaaatggaggaagccctaagaggtctgccgattcgttatcaaactccagcaatccgtgccgaacacacgggtagagaaatagtagacttaatgtgtcacgcaaccttcacaatgagacttttaagtccagtaagagtacctaactataacctaattataatggacgaagctcactttacggatcctgcctcaatcgctgcgcgagggtatatatcgacccgagtagaaatgggtgaagccgcgggcatcttcatgactgcaaccccgcccggaagtagagaccccttcccgcaatcaaatgcccccattatcgacgaggagagagaaataccggaaagatcctggaactccggtcacgagtgggttacggactttaaaggtaaaactgtctggtttgtacctagtataaaagcgggcaatgatatagcagcgtgcctgcgcaagaacggaaagaaagtaatacaattaagtcgaaaaaccttcgacagtgagtacgtcaaaactagaacaaacgattgggattttgtcgttacgactgatatatcggaaatgggcgcaaattttaaagctgaacgtgttatcgaccccagaagatgtatgaaacctgtaatactaacggatggagaagaacgagtcatactcgcaggcccaatgcccgttactcattcgtcagcggcacaacgccgaggaaggatcggacgcaacccgaaaaatgagaatgaccaatacatttacatgggtgaacccttagaaaacgacgaagactgtgctcactggaaagaggctaaaatgctgcttgataatataaacactcctgaaggaataataccttcaatgtttgagcctgaaagagaaaaagtagacgctatagacggcgaataccgactgcgcggagaggcaagaaaaacattcgtagacttgatgcgcaggggagatttaccggtgtggctagcctacaaagttgccgctgagggaataaattatgccgataggaggtggtgctttgatggaattaaaaataatcaaatattagaggaaaacgtagaagtcgagatatggaccaaagaaggagaaagaaagaaattgaaaccacgctggcttgatgcaaggatatactctgatccgctagctctaaaagagtttaaagaatttgcagcaggtaggaaatcattaaccctaaatttaataacagaaatgggacgactaccgactttcatgacccaaaagacgagagatgcattggataacctggcggtattgcatacagcagaggctggaggtcgagcgtataaccacgccctaagcgaattacctgagactcttgagaccctgcttctattaaccctactagctacagtaacaggtggaattttcttgtttcttatgtcgggcagaggtataggtaagatgacgttaggaatgtgctgcataaccacggcctcaatacttctctggtacgctcaaatccaacctcattggatagcagcaagtataatattggaatttttcctaatagttttattgataccagagccagagaaacaaaggacgccacaagataatcaacttacatatgtagtaatagcaatactcaccgtggtagctgcaacaatggcgaatgaaatgggattcttagagaaaactaaaaaggatttagggcttggatctatagcaacccagcagcccgaatcgaacatacttgacatcgaccttaggcccgcaagtgcatggacactatacgccgtagctactactttcgtgacacctatgttaagacatagtatagaaaattcttcagttaacgtcagtcttacagccatcgcaaatcaagcaactgttctaatgggattaggcaagggatggcccctctccaaaatggacatcggtgttccattattggcaattggatgctattctcaggttaatcctataacgctcacagccgccctattgttactcgtagctcattatgctataatcggaccgggactacaggccaaagcaacaagagaagcccaaaaacgagcagcagcaggaataatgaaaaaccccacggtcgatggtataaccgttatagatctcgaccctattccgtacgacccgaaatttgaaaaacaattaggtcaagttatgctactaattttgtgtgttacgcaagtattaatgatgcgtacgacgtgggctttatgtgaggcattaactctcgcgacaggtcctatctcaacgttgtgggaaggaaatcccggccgtttctggaatactacaattgcagtaagtatggctaacatatttagagggagttatttagcaggcgcagggttactgttcagtataatgaaaaatacgacaaataccaggcgaggaacaggaaatatgggagaaacacttggtgaaaagtggaaatcccgcttaaatgcgttagggaaaagcgaatttcagatttataaaagatcaggaatacaagaagtagatagaacacttgccaaagagggaattaaaagaggagagacggaccatcatgcagtatccagaggtagtgctaaattaaggtggtttgtagaaagaaacatggtaacgccggaaggaaaagttgtagatctagggtgcggaagaggaggttggagttactattgcggtggactcaaaaatgttcgagaagtaaaaggtctaactaaaggaggaccaggacatgaagaaccaattcctatgtctacgtatggatggaaccttgtccgtttacaatcaggggtagacgtctttttcattccaccagagaaatgtgataccttattatgtgacatcggggagtcatctcctaatccgacagtagaggctggcaggactctgagagtactaaatttagtagaaaactggctaaataataatacacaattctgtataaaagtgcttaatccgtatatgccttccgttatcgagaaaatggaagcattacagagaaaatatggtggagccctggtgagaaaccctttaagcagaaattccactcatgagatgtactgggtaagtaacgctagtgggaatatagtttcaagtgtaaacatgatttcgcgcatgctgataaaccgatttacgatgagacataagaaagctacatatgaacccgacgtggatctcgggtccggcacaagaaacatcggaatcgaaagtgaaattccaaacttagacatcatcggcaaacgaatcgagaaaattaaacaggaacatgaaacatcatggcactatgatcaagatcatccatataagacatgggcgtatcatggctcgtatgaaaccaaacaaaccggttctgcttcgtcaatggtaaacggggttgtacgactgctgacaaaaccatgggacgtattacccacagtcactcaaatggcaatgacagacacgacaccttttggtcaacaaagagtttttaaagaaaaagttgacacacgaacgcaagaaccaaaagaaggtactaaaaagctaatgaaaattaccgcagagtggctatggaaggagctagggaagaagaaaacgccacgtatgtgtacaagagaagagtttacccgcaaagtaagaagtaatgcagcgctgggagctatatttacagacgaaaacaaatggaaatccgctcgcgaagcggttgaggattctagattttgggaattggtagataaggaacgtaaccttcacttggaaggtaagtgcgaaacatgtgtctataacatgatgggtaaaagagagaagaaattaggagaatttggtaaagcgaaagggagccgagccatatggtacatgtggctaggagcacgtttcttggaatttgaggccttaggtttccttaatgaagatcattggtttagcagagaaaattcattaagtggagtggaaggtgaaggattacacaagctaggttatatacttagggatgtatcaaagaaagaagggggagcaatgtacgctgacgacacggccggttgggacacaagaattacactagaagacttaaagaatgaggaaatggtaacgaatcatatggagggagagcataagaaattggccgaagcaatttttaaattaacataccaaaacaaagtcgtacgagtacagagaccgacaccgcgaggcacagttatggacataatctcaagacgtgaccagagagggagtggtcaagtaggaacgtacggactcaatacttttactaatatggaggcgcaactaatacgccaaatggaaggcgagggagtgttcaaaaatatacaacaccttaccgtaacggaagaagtcgctgtacaaaattggttagcccgagtggggcgagaacgactcagtcgaatggccatctctggagacgattgtgtcgtaaaacccctagacgacagatttgcaaatgcactaaccgcattgaatgatatgggtaaaatacgaaaagatatacagcagtgggaacccagcaagggttggaacgattggacacaagtgcctttctgtagccatcacttccatgaattgattatgaaagacggacgagtcctggtagtaccatgcagaaatcaagatgagctaattggacgcgcccgcatttcacaaggcgcaggttggagtttgcgggagacagcatgtctcggtaaaagttacgcccagatgtggagcttgatgtacttccatcggagagatctgagattggcagctaacgctatttgttctgcagtcccatcacattgggtacctacaagtcggacaacttggtctatacacgcaaagcacgaatggatgactacagaagacatgttaacagtatggaatagagtttggatcagagaaaatccatggatggaggataaaacaccggttgagtcgtgggaagaaataccttacttgggtaaaagagaagatcaatggtgtgggagtcttataggattaacatcaagagcaacatgggccaaaaatatacaagcggctattaaccaagtacgtagtctgatcggtaatgaagaatacacagattatatgccctctatgaaaagatttcgtagagaagaggaggaagcgggagtgttatggtga

SEQ ID NO: 22730 - RNA, 9876 nt, synthetic construct
  misc_feature 1..9876: note = derived and/or modified CDS sequence (opt6) from DENV-2__EU482647__SS-prME
  source 1..9876: mol_type = other RNA
tctgcggggatgataattatgcttattccaacggttatggcatttcatctaacaaccagaaatggtgaaccgcacatgattgttggcattcaagaaaaaggtaaaagtcttcttttcaaaactgaagatggtgtaaacatgtgcacattaatggccatggatctcggcgaattatgcgaagataccattacttataaatgtcctttgcttagacaaaatgaacctgaagacatagactgttggtgcaactcaacgtcaacatgggttacatatggtacatgcacaacaactggagaacatagacgagagaaaagatccgtagctcttgtaccacatgttggtatgggcctggaaacaagaacagaaacatggatgtcgagcgaaggtgcatggaaacatgcccaacgcattgaaacatggattcttagacaccctggatttaccattatggcagcaatactcgcttacacaatagggacgacccatttccaacgtgtacttatatttatattactaaccgcagtagccccaagcatgacaatgagatgtataggaatcagcaaccgcgactttgtagaaggagtaagtggaggctcatgggtagatatcgtgctcgaacatggttcctgtgtaactactatggcgaaaaacaaacctactttagacttcgaactcattaaaacggaagcgaaacaaccagccacgctcagaaaatactgcattgaagctaaactcacaaacacaacaactgaatccagatgccctacacaaggggagccgtcgttaaaagaagaacaggataaacgatttgtatgcaaacattcaatggtagaccgagggtggggaaatggatgtggactgttcggcaaaggaggaatcgttacttgcgctatgtttacttgcaagaaaaatatggaaggaaaaatagtacaaccagaaaaccttgaatatacaatcgtagtaacgcctcactcaggcgaagaacatgcagtcggaaatgatacagggaaacatggaaaagagattaaagttacgccgcagtcaagcataacggaggcagaactaacaggctatggaactgtcaccatggaatgtagccctaggactggtctcgatttcaatgaaatggtattgctccaaatgaaaaataaagcatggcttgtccacagacaatggtttctcgatcttcccctaccatggttacccggagcagataaacaggagagcaattggattcaaaaagagactctcgtcacatttaaaaatcctcatgctaagaaacaggatgttgtagtactaggatcacaagaaggagcgatgcatacggcattaacaggggcaacagagatacagatgagttctggcaatctgttatttacagggcacctaaaatgcagactccgtatggataaattacaactcaaaggaatgtcttactcgatgtgtacagggaaattcaaagtggttaaagaaatagcggaaacgcagcatggaactatagtgatcagggtacaatacgaaggagatggaagtccatgtaagataccattcgagataatggatttagagaaaagatatgtattaggacggctaattacagtaaatccaattgtcactgaaaaagatagtcccgtgaatatcgaagctgaaccaccatttggtgattcatatatcataatcggggtcgagccaggccaactaaaattgaactggtttaagaaaggctcatcaataggtcagatgtttgaaacaactatgagaggagccaaaagaatggccatactgggggatacagcatgggattttggatcacttggtggagttttcacaagtatcggaaaagcgctacaccaagtcttcggtgctatctacggagcagcattttcgggcgtgtcctggacaatgaaaattttaataggggtgataattacttggattggaatgaactcacgtagtacaagcctatcagtgtctctagtattagtcgggatagtaacactatacctcggggtaatggttcaggctgatagtggttgtgtagtctcgtggaaaaataaggagctaaagtgtggatctggtatcttcataacagacaatgttcatacatggacagaacaatataagtttcaacccgaatcaccctcaaaattagcaagcgcaatacaaaaagctcaagaagaggggatatgcggaatacgttcggtaactaggctagaaaacctaatgtggaagcaaatcacacctgagctcaatcacattttggcagagaatgaagttaaactgacaattatgacaggcgacataaaaggaataatgcaggcaggaaaacgaagtctcagacctcagccaacagaattaaaatattcatggaaaacatggggtaaagcgaaaatgctatcaaccgaatcatataaccaaacttttctaatagatggtcccgaaacggcggagtgtccaaatactaacagggcatggaactcactcgaggtagaggactacggatttggtgtatttacgactaacatatggctaaaactaaaagaaaaacaagacgcgttctgtgattctaaacttatgtctgccgccataaaggacaaccgagctgtgcatgccgacatggggtactggatcgaatcagccttaaacgatacatggaaaatagagaaggcgagctttatcgaggtcaaaaattgccattggccaaaatctcatacgctttggagcaacggagttctagaaagcgaaatgatcatacccaaaaatctagccggacccgtatcacaacacaattacagaccgggatatcacacacaaatcgcgggtccttggcatttgggaaaactagaaatggatttcgacttttgtgatggaactacagttatagtaacagaagattgcggtaatagaggcccatctcttagaactaccactgcctctggtaaactgataacggaatggtgttgtagatcctgtactctcccgccattacgctataggggtgaagacgggtgttggtacgggatggaaatccgtccactgaaagaaaaagaagaaaatctagttaattcattagttacggctggacatggccaagttgacaatttttcgttgggagtacttggaatggccctatttttagaagaaatgctaagaactagagtggggacaaagcatgcaatactgttagtcgcagtgagtttcgtgacacttattactggaaatatgtcatttaaagaccttggaagggttgttgtaatggtaggggctaccatggcagatgacatcggaatgggagtcacatatctagcattattagcagcattcaaagtgaggccaacttttgcagcaggactcctgttgaggaaattaacatctaaagaattaatgatgaccacaatcggaattgtgttattaagccaaagtacaattcctgaaacagttcttgaactaaccgatgccctagctttaggtatgatggtcttaaaaatcgtaagaaacatggagaaatatcagcttgccgtaacgatcatggcaattttgtgcgttcctaacgctgtaattcttcaaaatgcatggaaagtatcatgtacgatccttgcagtcgtatcagtatctccattactattaacaagtagtcaacagaaaactgattggataccattagcattaaccattaaaggcttaaacccaactgcaatattcttaacaactttatcgagaactaataagaaaaggtcctggccacttaacgaggctataatggccgtaggaatggtatctatattagcatcctctttattgaagaatgacataccgatgacgggaccattagtggcagggggtttgctgacggtttgttatgtcctcacgggaaggagcgcggatctagagcttgaacgcgctaccgatgtcaaatgggaagatcaagcagagatctcaggctccagtccaattttaagcattaccatatctgaagacgggtcaatgagcatcaaaaatgaggaagaggaacaaacattaactatactgatacggacagggttgttagtcatcagcggtttatttccgatatcaatcccaataaccgccgcggcttggtatttatgggaggtcaagaaacagcgtgcaggcgttctttgggatgtgcctagtcctccaccaatgggaaaagctgaattagaggacggagcatatcgtattaagcaaaaaggcatattaggatatagccagatcggagctggggtatacaaagaaggaaccttccacacaatgtggcacgtaacgagaggcgcagtactaatgcacaaaggcaaaagaatagaaccctcatgggctgatgtcaagaaagatctgataagctacggcgggggatggaaattggaaggcgaatggaaagaaggtgaagaagtacaagtgttagcactagaacctggtaaaaatccaagggctgtacaaacaaaaccgggattgttcaaaaccaatactggtacgattggagcagtttcattggatttctcaccaggaacatcaggcagtcctataattgataaaaagggaaaagttgtcggcctttatggaaatggagttgtaactcggtcaggagcctatgtatcagcaatagcgcagactgaaaaatcgatcgaagataacccagagattgaagacgacatcttcaggaaacgtcgcctaacgataatggatttacaccctggggccggtaaaactaaacgttaccttcctgcgatagtgagggaagcgataaaaagaggtttgaggacactaatactcgctccaacgcgcgtcgtagcggcagaaatggaagaagcgctaagaggcttaccaattcgttaccagacgccagcaattcgggcggaacacaccggcagagaaattgtagacctaatgtgtcatgctacctttacaatgcgactactttcaccggtacgtgtccccaactacaacttaataattatggatgaagcacatttcacggatccagcaagcattgcagcgagggggtacattagtacaagagttgagatgggagaagctgcggggatttttatgactgctactccacctggatcacgagatccctttccacagtctaatgcaccaattatagacgaagaacgcgaaattccagaaagaagctggaactccggtcacgaatgggtaacggactttaagggcaaaaccgtttggtttgttccctcaataaaggcgggaaacgatatagctgcttgcttacgcaaaaatggcaagaaagtaatacagttatcacgtaaaactttcgattctgagtacgtaaaaacacgaaccaacgactgggattttgtagttacaacagatatatccgagatgggtgctaattttaaggctgaaagagttatagaccccagaagatgcatgaaaccagtaatattaaccgacggagaagaaagagttatattggccggacccatgccagtaacacatagttcggcagcacaaagaaggggaagaattggtcgtaaccccaaaaatgaaaatgatcagtatatttacatgggtgaacccttagagaatgacgaagactgtgcacactggaaagaagctaaaatgctcttagacaatattaatactccggaaggtatcataccgagtatgtttgaacccgaaagagaaaaggtagatgcaatcgacggggaatacagactccggggtgaagcaagaaaaacattcgtagatttaatgcgtagaggagatttacccgtatggctagcttacaaggttgctgcagagggcataaattatgcagaccgtcgctggtgctttgatggcattaagaacaaccaaattctcgaagaaaacgttgaagtcgaaatctggacaaaagaaggagagaggaagaaacttaagcctagatggcttgacgctagaatttacagtgatcctttagcgttgaaagagttcaaagaatttgcagcgggccggaaaagtttaacgctgaatttaataacagaaatgggacgactacccacatttatgactcaaaagacaagagatgcgcttgacaacttagcagtgttacatactgccgaagccggcggacgcgcatataaccacgcgttatccgagttgccagaaacgctggaaacactccttctattaacactcctcgctactgttacaggaggaatattcttattcttgatgtctggaagaggaataggcaaaatgactctcggtatgtgttgtataataactgcaagtatattgctctggtatgcacaaattcaaccacactggatcgcagctagtataatcctggagttctttttgattgtcttattgataccggagccagaaaaacaacgtacaccgcaagacaaccagttaacatatgtagttatagcaattctgactgtagtagctgccactatggcgaatgaaatgggatttttagagaaaacgaagaaagacctcggactgggcagcatcgcaactcaacaacccgaatcaaatatcttggacatagacctacggcccgcttccgcctggacactttatgctgtagctaccacctttgttactcccatgctgcggcattctatagagaactcttccgtaaacgtaagtcttaccgctatagctaatcaagctaccgtactaatgggtctaggcaagggttggcctctatcgaaaatggacataggagtcccccttcttgcaataggatgctatagtcaagtcaatcccatcacactaactgctgcactattattgctagttgcacactatgcaattataggaccgggactacaagcaaaagcaacccgtgaagcgcagaaacgggcggccgcagggattatgaaaaatcctacagtggatggcataacagtaatcgacctggatccaataccatacgatccgaaatttgagaaacaactgggccaagtaatgttgcttattctatgcgttactcaagtactaatgatgcgtactacgtgggcactatgtgaagcgcttacattggccacaggcccaatatcaactttatgggaggggaaccctgggaggttttggaatacaacgatcgcggtcagcatggcgaatatattcaggggatcttatctggccggtgctggtttactcttctctataatgaaaaatacgacaaatacgcggagagggacaggtaacataggtgaaacgttaggcgagaagtggaagtctcgtctaaatgcactcggtaagagcgagttccagacttataagaaaagcggtattcaggaagttgaccgaactctcgcaaaagagggtattaaaagaggtgaaacggaccatcatgccgttagtcgaggatctgctaaactaagatggtttgttgagcgtaacatggtaacgcctgaaggaaaagttgttgatctcggatgcggtagaggcggttggtcctactattgtgggggacttaaaaacgtgagagaagttaaaggcctaacgaaaggtggtcctggtcacgaagaacctattccgatgagtacgtatggttggaatttagttagactccagagcggtgtagacgtattcttcataccgccggaaaaatgcgacacgctgctatgcgatatcggtgaaagtagtcccaatccaacagtagaagccggtagaacactaagagttctcaacctggtagaaaattggttgaataataacacacagttttgcatcaaggttcttaacccatatatgccctctgttatagagaaaatggaggcactacagaggaaatatggaggcgccttagtacgaaacccattgagccgaaactcaacccacgaaatgtattgggttagcaatgcaagtgggaacatagtgtcatccgtaaacatgatctccagaatgttaattaaccgatttactatgcgacacaagaaggcaacatacgaaccagatgttgatctaggaagcggaacgagaaatataggcattgagtctgaaattccaaatctggacattataggaaagcgtattgagaaaatcaagcaagaacacgagacttcctggcattacgaccaggaccatccgtataagacatgggcctatcacgggtcctacgaaaccaaacaaaccggaagtgccagtagcatggtcaatggtgtggtacgtctactaacaaaaccatgggatgtcttaccaacagtgacacaaatggcaatgacagatacaaccccatttggacagcaaagagtcttcaaagaaaaggttgatacacgcacacaagagcctaaggaaggaacaaagaaactaatgaaaatcactgccgaatggctctggaaggagcttggcaaaaagaagacaccgagaatgtgcactagggaagagttcactcgcaaagtaagaagtaatgccgccctaggcgcgatatttacagatgaaaacaaatggaagtcagccagagaagccgtagaagatagtagattttgggaattagtagataaagaaagaaatctacatttagaaggaaagtgtgagacgtgtgtatacaatatgatgggtaaaagagagaagaaattaggcgaatttggaaaagccaaggggtctagagcaatttggtatatgtggttaggcgcgaggtttttagaatttgaagccttaggctttctgaatgaagatcattggttttcgcgagagaactccctgagcggagtcgaaggtgaaggactccacaaattaggttacattttacgagacgtgagcaagaaagaaggaggcgcgatgtatgccgacgacaccgcaggttgggatacaagaatcacgctggaagatttgaagaatgaggaaatggtaactaaccacatggaaggggagcataagaaacttgcagaagccattttcaaattaacataccaaaataaggtggtacgtgtacaaagacccacccctcgaggcacggtaatggatatcatcagcaggcgagatcaaagaggaagtggacaagttggaacatatgggctaaacaccttcaccaatatggaagcgcagttaatccgtcagatggaaggagaaggggtatttaaaaatatccagcacttaacggtcaccgaggaggtagctgtacagaactggttggctcgggttggtcgtgagcggctcagccgcatggcgatctcaggagacgattgtgtggtcaaaccattagatgacagatttgccaatgcactaacagctctcaatgatatgggaaaaattagaaaagatatccaacaatgggaaccgagtaagggatggaatgattggacacaagttcctttctgttcgcatcattttcacgaactaattatgaaagatggtcgagtattagtagtaccgtgcagaaatcaagatgaattaatcggcagagcaagaataagccaaggggctggatggagtcttcgcgaaactgcttgccttggtaaatcgtatgcacaaatgtggagtttaatgtatttccataggagagacctgagattggccgcgaacgctatatgttcagcagtaccgtcccattgggtccctactagccgaacaacctggagcatacatgctaagcatgaatggatgactaccgaagatatgttaaccgtgtggaatagggtatggattcgcgagaatccatggatggaagataagactccggtcgaatcgtgggaagaaattccttacctaggaaaacgggaagaccaatggtgtggctctttaatcggactcacaagtagagcaacatgggcgaaaaacatacaagcggccattaaccaggtacgtagtttaataggtaatgaagaatacacagattatatgccatcaatgaaacgatttagacgcgaagaggaagaagcgggagtcctttggtaa

SEQ ID NO: 22731 - RNA, 9876 nt, synthetic construct
  misc_feature 1..9876: note = derived and/or modified CDS sequence (opt6) from DENV-2__EU482648__SS-prME
  source 1..9876: mol_type = other RNA
acggctggagtaataataatgttaattcccaccgcgatggcgttccatctaaccactcgtaatggggaaccccatatgatagtaggaaggcaagaaaaaggtaaatcattgctatttaaaacagaagacggagttaatatgtgtaccctaatggctatagatttaggtgaattatgcgaagatactataacctataaatgcccactattacgccaaaacgaaccggaagacatcgactgttggtgcaattccacatcaacatgggtaacttatggtacgtgtactactaccggagaacatcgacgcgagaaaagaagtgtagctttggtaccacatgtaggtatgggactagaaactcgaacggaaacatggatgtcaagtgaaggggcgtggaaacatgcacaacgtatagaaacttggatcttaagacacccaggattcacaattatggcagcaatcctagcttatacaataggaaccactcatttccaaagagcactaatatttatactactcactgcagtagccccttcaatgacaatgcgatgtataggtatatcaaacagagactttgttgaaggcgtgtctggagggtcgtgggttgatattgttctggaacatggctcttgcgtaactacaatggctaaaaataaacctacactagactttgaactaataaaaaccgaagcaaaacaaccagcaacattgagaaaatactgtatagaagctaaactaactaatacaactacagagagcagatgcccaacccagggtgaacctagccttaatgaagaacaggataaacggtttgtttgtaaacattcaatggtagaccgaggctggggaaatggatgcgggttgtttgggaaaggcggtatcgttacatgcgcgatgttcacatgtaagaaaaacatggaaggtaaaatagtacagccggaaaatttagaatatacgatcgttataacccctcattccggtgaagaacacgcagtaggaaacgataccggaaaacatgggaaagaaattaaaatcacacctcaaagttcaataacagaagctgaattaacaggttacggaacggtaaccatggaatgttcgccacgcacggggctagacttcaatgagatggttttgttgcaaatggaggataaagcatggttggtgcatcgtcaatggtttttagatttgccactaccttggcttccaggtgcagacacccaaggatcgaactggatacaaaaagaaaccttagtaacatttaaaaacccgcatgccaagaaacaagatgtagtcgtacttggatcccaagaaggtgcaatgcatacagcgcttaccggggctacagaaatacaaatgagttcgggcaatttacttttcacaggacacttaaagtgccgattaagaatggacaaactgcaattgaaaggaatgtcatattcaatgtgtacgggtaaatttaaaattgtcaaggaaatcgcagagacccaacacgggacaattgtcataagagttcagtatgaaggcgacggtagtccctgtaagattccttttgagataatggatctcgagaaaagacatgtactgggacgcttaataacagtcaaccccattgtaacggaaaaagatagtccagtaaatatcgaggcagaaccaccgttcggagactcatatattattatcggagtagaaccaggccagcttaaattaaattggtttaaaaagggatcgtccattggccagatgttcgaaaccaccatgcgaggagcgaagagaatggcgattttaggtgacacagcttgggattttggctcccttggtggcgtttttacatcaataggcaaagcactacaccaagtatttggagctatttatggagcagcgttttccggagttagctggactatgaaaatactcataggagccatcattacatggataggaatgaactccagatcaacgtcattaagcgtgagcctagtgctagttggagtcattaccttgtatcttggagcaatggtacaagcagactccggctgcgtagtttcatggaagaacaaagagttaaaatgtggttccgggatctttataactgataatgtacacacatggaccgaacaatacaaattccaaccagagtctccgtctaagctagcgagtgctatacaaaaagcgcatgaagagggtatatgtggtattcgatctgtcacacggctagagaacttaatgtggaagcagataacaccggaactaaatcatatcttaagcgaaaatgaagtaaaattaactattatgactggggatatcaaaggaataatgcaagcaggtaaaagaagtcttcggcctcaaccgacagagctcaagtatagttggaaaacctggggtaaagcgaaaatgttatcaacggaaagtcataatcaaactttcctgatagatggaccggaaaccgctgagtgcccgaacaccaacagggcatggaatagcctggaggtggaagattacggattcggggtatttacaactaacatatggcttaagctccgtgaaaagcaggatgtattttgtgattcaaagctaatgtcagcagctatcaaggacaatcgagctgttcatgcagatatgggatactggatagagtctgctttgaacgatacttggaaaatggaaaaagctagctttatcgaggtaaaatcatgtcactggcctaaaagccatactctatggtctaatggagtgctagaaagcgaaatgataattcctaaaagtttcgccggtcctgtgtcacagcataactatcggccaggttactatacacaaacagctggaccatggcacctaggaaaattagaaatggatttcgacttctgtgaaggtacgacggttgttgtaaccgaagattgtggtaataggggaccatcattaagaactacaactgcaagtggcaaacttataacagagtggtgctgccgatcgtgcacattgccacccctacgatacagaggggaggacggttgttggtacggcatggaaatcagaccacttaaagaaaaagaagaaaatttagtaaacagcttagttaccgcggggcacgggcagatagataatttcagcctgggagtcctaggtatggcactcttcctagaagaaatgttgagaacacgagtcgggaccaaacatgcgattttactggttgcagtgagttttatgacactcataactgggaatatgtcattccgagacctcggcagggttatggttatggtaggagcgactatgactgatgatattgggatgggggtgacctatcttgcattactagcggccttcaaagtacgtcctacctttgcagctggacttttattgcggaaattgacatctaaagaactgatgatggcaactatcgggatcgcattattaagccaatccactatcccggaaaccatccttgagttgactgacgcattagctctggggatgatggtactgaaaatagttagaaatatggagaaataccaattagctgtaacaataatggcaatatcatgcgttccgaacgctgtcatacttcaaaatgcatggaaggtaagttgcacgatactcgcggccgtcagcgtaagtccattgttattaacaagttcgcaacaaaaagcagactggataccattggcattgactataaaaggactaaacccaacggcaatctttctaaccacactatccaggacgtctaagaaaagatcctggccactaaatgaagcaatcatggcagtaggaatggtgtctatattagcatccagtctgcttaaaaatgatattccaatgaccggccccctagtagctggtggattgctgactgtttgttatgttttaacaggtagaagtgcagatctagagttagaaagggcgaccgacgttaaatgggaggatcaagctgaaattagcggaagctcaccaattttaagtatcacgatttcagaagatggttctatgtctatcaaaaatgaagaagaagaacaaaccctgaccatactgattagaacaggtctattagtaataagtggattgtttccagtaagcattccaattaccgctgcagcgtggtatttatgggaagtcaagaaacaacgcgcaggagttctatgggatgttccttcaccacctcctgttggcaaagcagaattagaagatggtgcgtatcgtattaagcagaaaggaatattaggatattctcagataggtgcaggggtatataaagaagggacatttcatacgatgtggcatgttacgcgaggagcggtgctaatgcatcgtggaaaacgtattgagccaagctgggcagatgtcaagaaagacctgatatcatacggcggcggttggaaactagaaggagaatggaaggagggagaagaagtacaagttcttgctttagaaccgggcaaaaatccgagggctgttcagacaaagccagggttatttaaaacgaatacaggtacgatcggtgcagtgagcttggactttagccctggaacaagtggctcacctatcgtggatcgaaaagggaaagtagtcggcttatacggcaatggagtggttacgcgcagcggagcttatgtgagcgcaattgcgcaaacagaaaaatcaatcgaagacaatccggaaatagaagatgatatatttcgtaaaaagcgcttaactataatggatctgcatccaggtgctggaaaaactaaacgatatcttcctgcaattgttagagaggcaataaaacgtggattacgaactttaatactggctccaaccagagtcgtagcagcggaaatggaggaagcacttagaggactgccaataagatatcaaactcccgctattagagcagaacatacagggagagaaatagtagacctaatgtgtcacgcaacattcacgatgagactactcagtccagttagagtaccgaattataaccttataattatggatgaagcccatttcacagatcccgcaagcattgcggcgagaggatacatctcgactcgtgttgagatgggagaagcagcaggtatcttcatgacagctacaccacccggatctcgagatccttttcctcaatcaaacgctccaataattgatgaagaaagagagattccagaaaggtcgtggaactcaggacatgaatgggtaaccgactttaaaggaaaaactgtctggttcgtaccgagtataaaagcaggtaacgatattgcagcctgtctcaggaagaatggtaagaaagtaatccaattatcccgtaaaacattcgacagtgaatatgtcaaaacccgaacaaatgattgggactttgtcgtaactacagacatctccgaaatgggggcaaactttaaagcagaaagagttatagatcctagacgatgcatgaaacccgtaattctgacagacggagaggagagagttatcctagccgggccgatgcctgttacacacagttcagcggcgcagagaagaggaaggatcggcagaaaccctaaaaatgaaaacgaccaatatatttatatgggagaacccttagagaatgacgaagattgcgcgcactggaaagaagcaaaaatgctattagataacattaatacaccagaagggataataccgagtatgttcgaaccagagcgagaaaaagtagacgctatagacggcgaatacaggctcagaggagaagcacgcaaaacgtttgtcgatctaatgcgaagaggagacttaccggtatggctagcgtatagagtcgccgcagaagggattaactatgcagatcgccgttggtgttttgatggagtcaaaaataatcaaatactagaggagaacgtagaagtagaaatctggacaaaagaaggagaaagaaagaaattaaaaccccgatggctagacgctagaatatatagcgacccacttgcgttaaaagagttcaaagagtttgctgctggtagaaaatcattgacattaaaccttataacggaaatgggaaggttacctacatttatgacgcaaaaagctagggacgcactcgacaacttagctgtcctgcatacagcagaagccggtgggcgggcatataaccacgctctatctgaacttcccgaaacactcgaaactcttctcctattaacattgttagcaaccgttacaggagggatattcttattcttaatgtctggtaagggagtgggtaaaatgacgttaggtatgtgctgcatcataacagcttctattctattatggtatgctcaaatccaaccccattggatagcggcatctataatactcgagttcttcctgatagtgttgctaattcccgagcccgaaaaacaaagaactcctcaagataatcagctcacttatgtagtgatcgcgatcctgacagtcgttgcggctactatggctaacgagatgggatttctggaaaagacgaagaaagatctaggattgggaagtattgcgacccaagaaccagaaagcaatattctggatatagatttgaggcccgcaagtgcatggacactttatgcagtagccactacgttcgtgacaccaatgttgcgccatagtatagaaaattcctcagtaaatgtcagcttaacagctatcgctaaccaggcaacggttttaatgggtcttggaaaaggttggcctttgtctaagatggatatcggcgttccattattggcaatcggctgttattcccaagtcaatccaattacattgacagccgcattgctactcttaattgctcactacgcaattattggtccaggcctccaagcgaaggcaacccgcgaagcacaaaaacgtgctgccgctggaataatgaaaaatcctacagtagatggtataacagtaatagatttagatcccatcccctatgatccaaagtttgaaaagcaattaggccaggtgatgttacttatcttatgcgtaacgcaagtcctaatgatgagaacgacttgggcactctgcgaggctctaactctagcgactgggccaatatcgacactttgggaaggtaaccccgggaggttttggaataccacgattgctgtcagtatggcaaatatatttcgaggaagctacttagctggagcaggacttttattttcaataatgaaaaacacaactaacacaaggaggggtacaggcaacatcggagaaacattaggagaaaaatggaaaagtcgcctaaacgcgttgggaaaatccgaatttcagatatataagaaaagtggcattcaggaagtagaccgaacgttagcgaaagagggaataaaaagaggcgagacagaccaccatgcggtatctagaggatcagctaaactacgatggtttgtagaaagaaacatggtcacacctgaaggtaaagtcgtcgaccttggctgcggaagaggagggtggtcatattattgtggaggattgaagaatgtccgcgaagtcaaaggactaacaaaaggtgggccaggacatgaggagcctataccaatgtctacatatgggtggaacttggtcagactacaatcaggagtcgatgtcttctttacgccgccagaaaaatgcgacaccctcctctgcgatattggggagtcgtcaccaaatccaacaatcgaagcgggaaggacactccgggtattgtctctggtagaaaactggttaaacaatgatacgcaattctgtattaaagtactaaatccgtacatgccttccgttatagagaaaatggaaacgctacagcgaaaatacggaggcgctttagttagaaacccgttatcacgaaacagcacccacgaaatgtactgggtctcgaacgctacgggaaatatagtaagctcggttaacatgatctctcggatgctaattaatcggtttaccatgaagcataagaaagcaacctatgaacccgatgtggaccttgggagcggcacaaggaatattggtatcgaatccgaaatacctaatttagacattatcggtaaaaggattgaaaagattaaacaagaacatgaaacgagttggcactatgaccaagatcacccgtataaaacctgggcttaccatggaagttatgaaactaaacaaacagggagtgcatcctccatggtcaatggagtagttcgcttgttaaccaagccatgggatgttgtacccatggttactcaaatggcaatgacagacactacacctttcggacaacaaagagtatttaaagaaaaagtagacacgagaacacaagagccaaaagaaggtacgaagaaattaatgaaaataacagcagaatggttgtggaaagaactaggcaagaagaaaacaccaagaatgtgtacgagagaagagtttacaaggaaagttcggtccaacgctgcactaggtgcaatattcacagatgaaaacaaatggaaatcggcaagggaagcagttgaggactcaagattctgggagttagtagataaagaacgaaacctccatcttgaaggaaaatgtgaaacatgcgtgtataatatgatgggtaaaagagagaagaaattgggggagttcggaaaagcaaaaggttctcgtgctatttggtacatgtggctaggtgctcgatttctcgagtttgaagccctaggattcttaaacgaagaccattggttttctcgggaaaactcgttatcaggagttgaaggtgaaggtcttcataaacttgggtatattttaagagacgtgtccaaaaaggaaggcggtgccatgtatgccgacgatacagcaggctgggatacaaggattactctagaagacctcaaaaatgaagaaatggttacgaatcacatggaaggtgaacacaaacgactagccgaagctatctttaagctaacataccaaaataaagtcgtgcgtgttcaaagaccaactcccagaggtaccgtcatggatataatttcaaggcgcgaccagagaggctcaggacaagtagggacctacggccttaatacattcactaatatggaggcgcagcttattagacagatggaaggagaaggaatattcaaaagcatacaacatctgacggtaacagaagaaatagccgtacaaaactggctcgcaagggttggaagagaaagactttcacgaatggcaatatctggtgacgattgcgtcgttaagccactagacgaccgattcgcttcggccttaacggcactaaatgatatgggcaaagttagaaaggacatacagcagtgggagccaagcaaaggctggaatgactggacccaagtgccgttttgttcacaccatttccatgaattaataatgaaagacggcagagtcttagtcgtcccatgccgaaatcaagatgagctgataggaagggcacgtatttcccagggggcaggttggagcttaaaagaaactgcttgtctcggtaagagctacgcccaaatgtggagtctaatgtactttcataggagagacttacgcttagcggcaaacgccatatgtagcgcagtaccatctcattgggtcccaacatctaggaccacatggtcaatacacgccaaacacgaatggatgacaacagaagatatgttaacggtatggaaccgggtgtggatccaagaaaatccgtggatggaagataagactccggtagaaagttgggaagaagtaccgtatttagggaaacgagaagatcagtggtgcggcagcctaattggacttacatcaagagcgacatgggccaaaaatatacaaactgcgattaaccaagtacgatcattaatcgggaatgaagaatacactgattatatgccgtcaatgaaaagattccgtcgagaagaagaagaggcaggggtgctttggtag

SEQ ID NO: 22732 - RNA, 9876 nt, synthetic construct
  misc_feature 1..9876: note = derived and/or modified CDS sequence (opt6) from DENV-2__EU482649__SS-prME
  source 1..9876: mol_type = other RNA
tcagctggaatgataataatgctaattccgactgttatggcatttcatctcacgaccagaaatggggaaccacacatgattgtaggtattcaagaaaaaggaaaaagcctcctattcaaaacggaagatggagtcaatatgtgcacgttgatggctatggatttaggagaattatgcgaagatacaattacatacaaatgtccattgctacgacaaaacgaaccagaagatattgattgttggtgcaattcaactagcacatgggtaacatatggaacttgtacaacaacaggagaacacagaagagagaaaagaagtgtagcactggtaccacatgttgggatgggtcttgaaacaagaacagaaacgtggatgagctcagaaggagcatggaaacatgcacagagaatagaaacgtggatattaagacaccccgggttcactattatggcggctattctagcgtacacgataggtacaacccactttcagcgagtattaattttcattctactaacggctattgcacctagtatgacaatgagatgtataggaatatcaaacagggactttgtagaaggcgtttcagggggaagctgggtggatatagtgttggaacacggatcatgcgttacaactatggcgaaaaacaaaccaactttagattttgaattaataaaaacagaagcgaaacaaccggcaactctcaggaaatactgtatagaagctaaacttaccaatacgaccactgaatccagatgtccaacacaaggagaaccatcgttgaaagaagaacaagacaaacgatttgtatgtaaacactcgatggttgaccgcggttggggcaacggttgcggcttattcggcaaaggaggcattgtgacatgcgcaatgttcacttgcaagaaaaatatggaaggcaaaatagtccagccggaaaacctcgaatataccatagtagtaaccccgcattcaggagaagaacacgccgtcggcaacgatacgggcaaacatggtaaagaaataaaagtaacgccacaaagttcaattactgaggctgaactcactggatacgggacggtcactatggagtgctctcccaggacaggattagatttcaacgagatggttttactacaaatggaaaataaagcatggttggttcatcgccaatggttcctagatctaccgctaccatggctaccaggggctgacaagcaggaaagtaattggatacaaaaagaaactttagttacgtttaaaaacccccatgcgaagaaacaagatgttgtagtcttaggttcacaagaaggagcaatgcatactgctttaactggtgcgacagagatacagatgagttctggtaacttgttatttacgggacatctaaaatgccgattgagaatggataaacttcaactcaaaggaatgtcctattcaatgtgcacagggaaattcaaagtagtgaaggagatcgcggaaacgcagcacggtacaatagttatccgagttcagtatgaaggtgatggaagcccatgtaaaataccctttgagattatggatctggagaaaagatacgtactaggacgactcataacggttaacccaattgtcacggagaaagatagtccagtaaatattgaagccgaaccaccctttggcgatagctatatcataataggtgtagagcctgggcaattaaaacttaattggtttaagaaaggatccagtataggccaaatgtttgagacgacaatgagaggagctaaaagaatggctattctaggagataccgcctgggactttggcagcttaggtggggtctttacatcgataggaaaagcgttacaccaagtatttggagccatatatggcgccgcttttagtggtgttagctggacaatgaaaattctgataggagttataattacgtggattggcatgaacagtcgatccacatccttgtctgtatctttagttctcgtgggaatagtaacactatatctgggggtgatggtacaagcagactcaggctgtgttgtgagttggaaaaacaaagagttgaagtgcggaagcggaattttcatcactgataatgtgcatacatggacggaacagtataaatttcaacctgaaagcccctccaagttagctagcgctatacagaaagcacaagaagagggaatatgtggtattagatcagtaacacgattggaaaatcttatgtggaaacagataaccccagaattgaaccacatactagcagaaaacgaagtcaagttgactatcatgacgggggatattaagggtataatgcaagcgggtaaaagaagtttaagacctcaaccaacagagcttaaatattcgtggaaaacgtggggaaaggccaaaatgctatcaacagaatcgtacaatcagacctttttgatagacggtccagagacagctgagtgtcctaacacgaatagggcctggaactcattagaagtagaagactatggtttcggtgtatttactacaaatatctggcttaaattgaaagaaaaacaagatgcgttttgtgattcaaaactcatgtcagctgcaataaaagataatagagcagtacatgctgatatgggctactggatcgaatcagcattaaatgatacctggaagatagaaaaagcaagtttcattgaggtcaaaaattgtcactggccaaagagtcatacactatggagcaacggtgtcctagaaagtgaaatgattattccgaagaatttagccggtccggtttcacagcacaattatagacctggctaccatacacaaattgcaggtccttggcatctaggtaaattagaaatggactttgatttttgcgatggcacgacagtcattgttacggaagactgtggaaacagaggccccagcttaagaacaacaacagccagtggtaaattaataacggaatggtgctgtagatcgtgtaccttacccccgttaagatacagaggtgaagatgggtgttggtatggtatggaaataaggcctctgaaagaaaaggaagagaatttggttaatagtctcgtgacagccggacatggacaggttgataatttttcgctaggagtgttaggaatggctctcttcttggaagagatgttaagaaccagagtaggtactaagcacgcaatactattagttgctgtttcattcgtaacactgataacaggtaacatgagttttaaggacctaggaagggttgtagtgatggtcggtgctacaatggcggacgatattggtatgggtgtgtcatatctagcgctcttggccgccttcaaagtacgaccaacttttgctgccgggctattattaagaaaattgacctccaaagaattgatgatgacaactataggcatagtattattatctcaaagcaccataccagagaccgtattagaattaacggacgcattagctcttggaatgatggtcctgaagatcgttcgtaatatggaaaaataccaattggctgtaacaatcatggcaatactatgtgtcccaaatgcagttgtgcttcagaatgcatggaaagtatcgtgcaccatcttggccgtcgtatctgtatcacctttgctattgacaagctcacaacagaaaacggattggatacctcttgcattaaccattaaaggtctgaacccaacggcaattttcctcacaacactatccagaacaaacaagaaacgttcctggcctctgaatgaagccatcatggcagtaggtatggtatcaattttagcatctagtttactgaaaaacgatataccgatgacaggtccgctagtcgccggagggttactcacggtatgctatgtattaacgggtcgatcggcagacttagagctggaaagagctactgacgtaaagtgggaagatcaagcggaaatatctggcagctcacctatattatctattacaatttcagaagacggctcaatgtcaatcaaaaatgaagaagaagaacaaacactcacgatcttaatacgcacaggattgttggtaattagtggtcttttccccatctcgataccgataacagccgcggcatggtatttatgggaggttaagaaacagcgagcgggagtactatgggatgtcccaagtccaccacccatgggaaaagctgaattagaagatggagcttatagaataaagcagaaagggattctagggtactctcagatcggtgctggagtatacaaagaaggaacatttcacacaatgtggcacgttacacggggagcagtcctaatgcataaagggaaaaggatcgagccgagttgggccgacgtcaagaaagaccttatctcctacggaggcggatggaaattggagggagagtggaaagaaggagaagaagtacaagtcctagcattagaaccgggcaaaaatccaagagcagtccaaaccaaaccaggactctttaaaaccaataccggaacaatcggcgccgtttccctagacttcagtccaggaacaagtggctcccctattatagacaagaaaggtaaagttgtcggactctatggtaatggagttgttacgagatccggagcatacgtaagcgccatagcccagacagaaaaatcaattgaagacaatcccgagatcgaagacgatatcttccgtaaaaggcgccttacaataatggacttacaccctggcgcaggaaaaacaaaacgatatctacctgcaatcgtacgtgaagcaatcaaaagaggcctccgaaccttaatattggcaccaacgagagtcgtagctgcagagatggaagaagcattaaggggattacctattaggtatcaaacaccagccataaaggctgagcatacgggaagagaaattgtggatttaatgtgtcatgcaacatttacaatgcgattactgtccccggttagggtaccgaactacaatctgataataatggatgaggcccactttactgatcccgcatctatagcagctagaggttacataagtacacgagtcgagatgggggaagcagctgggatttttatgacggctacaccacctggaagcagagatccgtttccacagtcgaatgcacctataattgatgaagaaagggaaatcccagaaagatcatggaacagcggtcatgaatgggtcactgatttcaaaggtaagacagtctggtttgttccctccataaaggctggaaatgacatagcagcatgtctaagaaagaacggcaagaaagttatacaattaagtcggaaaaccttcgattcagaatatgtcaaaactcgcactaatgactgggatttcgtcgttaccactgacataagtgaaatgggtgcaaattttaaagcagaaagggtaatagaccctagacgttgcatgaagcctgtaatacttacggacggagaagaaagagtaatcttggcaggacccatgccagttacgcatagttccgctgctcaacggagaggtagaataggccgtaatcccaagaatgaaaatgatcaatacatatacatgggagaaccgttggaaaatgatgaggattgcgcacattggaaagaagccaagatgttactggataacattaacacaccggaaggtataattccatcaatgttcgaaccagaaagagaaaaagtcgatgccattgatggtgaatatagactaagaggtgaagcaagaaaaactttcgtggacctaatgagacgaggagatttacctgtttggctagcgtataaagtagcagcggagggtataaattacgccgaccgccgttggtgttttgacggaatcaaaaacaaccagatactggaggaaaacgtggaagttgaaatatggacgaaagaaggggaacgcaagaagctaaaaccacgttggttagatgcaaggatatattcagatcccctcgctttaaaagagtttaaagagtttgcggcagggcgtaaaagtctcacattaaatttgataacagagatgggtagattacctacctttatgacccaaaagacaagggatgctttggataacctagcggtactacacactgcggaggccggtggacgagcatacaatcacgccctatcagagttacccgaaactcttgagactctcttactacttaccctcctggcaacggttacaggaggaatatttttattccttatgtccggtagagggataggaaaaatgaccttggggatgtgttgtattataacggctagtatattattgtggtatgcccaaattcaaccccattggatagctgcatcaatcattctagaatttttcctaatagttctactgatccctgaaccagaaaagcaaaggactccccaagataatcaattaacatatgtagtcatagcaatattaacagtagtagcggcgacgatggcgaacgaaatggggtttctagagaaaaccaagaaagacttgggactaggatcaattgcgactcaacaaccagaatccaacatactcgatatcgacttgagaccagcatcagcttggacgctatatgctgtagcgactacattcgtaacgccgatgctgagacattcaatagaaaatagtagtgttaatgtaagtttgacggcaatcgcaaaccaagctactgtgctcatgggactaggtaaaggatggcctttatcgaagatggatataggtgtcccacttctggctattggttgctactcacaagtcaatccgataacgctcaccgctgccttactcttgttggtggcgcattatgcaattataggcccaggattgcaggcaaaagcgacgcgtgaagctcaaaagcgagcagctgcgggtataatgaaaaaccccacagtggatggcataacagtaatagacctagacccaatcccctatgatcctaagtttgagaagcaactaggacaagtaatgctgctcatattatgcgtgactcaggtcttaatgatgcgtacaacctgggctctctgcgaagccttgacgttggccacagggccaatatcaaccctctgggaaggaaacccaggaagattttggaatacaacaattgccgtttcaatggcgaacatcttcagaggtagctatcttgcaggggcgggtttgttgttctctataatgaaaaacacaaccaacactagacgggggacaggaaatattggagaaacactaggcgaaaaatggaaaagccgcctaaatgcattaggtaaaagcgagttccaaatttacaagaaatcaggcatacaagaagtagacagaacgctagcaaaagagggaatcaaaagaggggaaacagatcaccacgctgtaagtagaggatctgccaaactcaggtggttcgttgagagaaacatggtaacacctgaaggaaaagttgtggaccttggatgtggaagaggtggatggagttattattgtggaggactgaagaatgtaagggaggttaaagggctaacaaaagggggccccggacatgaagaaccgattccaatgagtacatatgggtggaacctagttagactacaatcaggagtcgatgtattctttattccaccagagaagtgcgatacattactgtgcgatattggtgaaagcagccccaacccaactgtagaagctggaaggactctccgcgtcctaaatctggtagaaaattggcttaacaataatacgcaattctgcatcaaagtattaaacccctatatgccatccgtcattgagaaaatggaagctctccaaagaaagtatggcggcgccttagtacgtaaccctctaagtcgaaatagtacccacgaaatgtattgggtttcgaatgcatcaggaaacatagtttcgagtgttaacatgatatcccgtatgttgatcaatagattcacaatgagacacaagaaagcaacatatgagccggacgtagacctcggcagtggtactagaaacatagggatagagagtgaaatcccaaatttagatataatcggaaaaaggatcgaaaagattaagcaagaacacgaaacatcttggcattatgaccaggatcacccgtacaaaacctgggcctaccatgggtcatacgaaacaaaacaaaccggatctgcaagttccatggttaatggagttgtacgccttttgacaaaaccttgggacgttcttccgactgtaacacagatggcaatgacagatacaacaccattcgggcaacaacgagtattcaaggaaaaagttgacacccgaacccaagagcctaaagaaggtacgaaaaagttaatgaagataactgccgaatggctatggaaagaattgggaaagaagaaaacgccccgcatgtgtacaagggaggagttcactagaaaagtacggagtaatgcagccttaggcgcaatctttacagatgaaaataaatggaaaagcgcgcgggaggctgtagaagacagccgattctgggagttagtagataaagaaagaaatttgcatctcgagggtaaatgcgaaacatgcgtttataatatgatggggaaacgagagaagaaactaggagagttcggcaaagcaaaaggatccagagcaatttggtatatgtggttgggcgcaagatttcttgagttcgaggcattaggatttcttaacgaggatcattggttttctagggaaaattctttaagcggggtcgagggggagggtctccacaaactaggatatatacttcgggatgtttctaagaaagaaggaggtgcaatgtacgcagatgacactgcaggttgggatacaagaataactttagaagatttgaagaacgaggaaatggttacgaaccacatggaaggcgagcataagaaactagcagaggctatttttaaattaacctaccaaaataaggtcgtaagagtacaacgacctacaccaaggggaacggtcatggatatcataagccgaagggaccaaagagggtcaggccaagtcggaacctacggtttaaatacatttacaaatatggaagctcaattaataagacagatggagggggagggggtgtttaagaacatacaaaacttaactgtaaccgaagaggtcgcagttcaaaattggttggctcgggttggaagggaacgcctgagcaggatggccataagtggtgatgattgtgtggtcaagccattagatgatcgattcgctaatgctctaacggccttaaatgacatgggaaaaataagaaaagatatccaacaatgggaaccgagcaaaggatggaatgattggacacaagtaccgttttgcagccaccatttccatgaactaataatgaaagatggccgggtgttagtagtaccatgtcggaaccaagatgaactgattggccgggcacggatatcccagggagcagggtggagtctccgtgaaacagcttgtctgggaaagtcatacgcgcaaatgtggagtctcatgtactttcaccgcagagatttaagattagcagcaaacgcaatctgctcagcggtcccatctcattgggttcctacatctagaacaacatggagtatacatgctaagcatgaatggatgacgaccgaagatatgttaacagtctggaatagagtgtggatacgcgaaaatccatggatggaagacaaaactcccgtcgaatcttgggaggaaatcccttacttaggaaaaagagaggatcaatggtgtggaagtcttattgggttgacttctagagcaacctgggcaaagaacattcaggcagcaattaatcaagtgaggagcttaattgggaatgaggaatatacagattatatgcccagcatgaaacgttttagaagggaagaagaagaagctggggtattatggtaa

SEQ ID NO: 22733 - RNA, 9876 nt, synthetic construct
  misc_feature 1..9876: note = derived and/or modified CDS sequence (opt6) from DENV-2__EU482650__SS-prME
  source 1..9876: mol_type = other RNA
agtgcaggcatgatcataatgcttattcccacggtgatggcatttcatcttactactcgaaatggagaaccccacatgattgttgggattcaagaaaaaggtaaaagtctgttatttaaaactgaagatggggtaaacatgtgtacgttaatggctatggacttaggtgaactatgtgaagatacaataacatacaaatgccctctactaagacaaaacgaacccgaagacatagattgctggtgcaacagcactagcacatgggtaacgtacggcacatgcacaacaacgggagaacatagacgtgagaaaagaagtgtagcattagtaccacacgtgggaatgggactagaaacacggacagaaacatggatgtcatctgaaggggcgtggaaacacgcacaacggattgaaacgtggatactaaggcatccaggttttaccattatggctgctatacttgcatataccatcggaaccacgcattttcaaagagtactgatatttatattactaacggctgtagctccttcaatgacaatgaggtgcataggcatcagcaatcgcgattttgttgaaggggtttcgggaggtagctgggtagacatagttttagagcatggatcatgcgtaacgacgatggcgaaaaataaacccacattagattttgaattaataaaaacagaagcgaaacaaccggcaacactgagaaaatattgcatcgaagcaaaattaacgaataccacaacagaatcacgatgtccaacacaaggagagccatcattgaaagaagaacaagacaaaagattcgtctgtaaacactccatggtagatcgaggatggggaaacggatgtgggcttttcgggaaaggagggattgttacatgtgctatgttcacttgtaagaaaaacatggaaggaaaaatagttcaacccgaaaaccttgaatacaccatagttgtaacaccgcactcgggggaagaacacgcggttggcaacgacaccggtaaacatggacaggaaataaaagtaaccccacaaagttcgatcactgaagcagagctcactggctatggcactgtaacgatggaatgctccccgcgaacaggtctagactttaacgaaatggtattgttacagatggagaataaagcatggttggtacacagacaatggtttctcgaccttcccttaccctggctcccgggggctgataaacaagaatccaactggatccagaaagaaaccttagttacattcaaaaacccacatgccaagaaacaggacgtagtcgttctcggatctcaggaaggagctatgcacactgcgttaacaggcgctacagagatacaaatgagtagtggaaaccttctgtttacaggacatttaaaatgtcgcttaagaatggataaattacagctgaaaggtatgagctattctatgtgcacaggaaaatttaaagttgtaaaagagatcgccgaaacacaacatggtaccatcgtaatccgtgtacaatatgaaggagacggcagtccttgtaaaataccttttgagatcatggatctagagaaaagatatgtactaggacgtctaataactgtaaacccaatagttacagaaaaagattctcctgtgaatatcgaagccgaaccaccgtttggagatagttacatcataataggtgtagaaccaggccaattaaaattaaactggtttaagaaaggcagcagtataggtcaaatgtttgaaactactatgaggggtgcaaaaaggatggcgattctaggtgatacagcatgggacttcggatcattgggcggagtctttaccagtatagggaaagccttacatcaagtatttggggcaatctatggcgctgcgttcagcggtgtcagttggacaatgaaaattctcattggtgttataattacatggattggcatgaatagtagatccacgtcacttagcgtttcgctagtattagtaggaatcgtaactctttacttgggcgttatggtgcaagcagacagcggttgcgttgtgagttggaaaaacaaagaactaaaatgtgggtcaggaatttttataactgataatgtacacacgtggacagagcagtataaatttcaacccgaatcaccctcaaaattagcttcggccatacaaaaagcccaagaagagggtatatgtggcatccggtccgtaacacgattagagaatttaatgtggaaacaaataaccccagagttaaatcatattcttgcagaaaatgaagttaaattgactatcatgacaggggacattaaaggtataatgcaggcagggaaaagatctcttaggcctcaacccacggaattaaaatattcatggaaaacttggggaaaagcaaaaatgctatcaacagaatcttacaatcaaacattcctaatcgatggccccgaaacagccgaatgtcctaatacaaaccgtgcgtggaactcactggaagtcgaggattacggattcggtgtttttacaacaaacatatggttgaaattgaaggagaagcaagatgcattctgcgacagtaaactaatgtcggccgcaatcaaagacaacagagcggttcatgcagatatgggatattggatagaatcagctctaaatgatacttggaagatcgagaaagcatcatttatagaggtgaaaaactgtcactggccaaagtcacacacactttggtcaaacggggtgctcgaaagcgaaatgataattcccaaaaatttagctggacccgtttcacaacataattatcgacccggctaccacactcagattgcagggccttggcacctcggaaaattagaaatggatttcgacttttgtgatggaacgaccgtaatagtaacagaagactgcggaaatagggggccttctctccgtacgactaccgcatcagggaaattaattacagaatggtgctgtaggtcttgtacgcttccaccgctacgctatcgaggagaagatggatgttggtatggaatggagatacggcctttgaaagaaaaagaagaaaacctagtaaattccttggtgacggctggacacggacaagttgacaatttctccctgggtgtattagggatggcgctatttctggaagagatgttacgtactagagtcggcacaaaacatgcaatattattggtggccgtctcatttgtaaccctaataacgggtaatatgagcttcaaagacttgggtagagtagtagttatggtgggtgccactatggctgacgatataggtatgggtgtgacttatttagcgctgttagcagcattcaaggtgcgaccaacatttgcagccggtcttcttctaaggaaacttaccagtaaagagctaatgatgactacaattggaatagtcctactaagtcagagcacaataccggaaacagtcctcgaactaacggacgcattagcgttgggaatgatggttttaaagatagtgaggaacatggagaagtaccagctagcggtcactattatggctatattgtgtgtaccaaacgctgtaatattacagaacgcttggaaagttagttgtacaattttagctgtagttagtgttagcccactactactcacaagttcacagcagaaaacggactggataccacttgctttaacaataaaagggttaaatccaactgcgatattcctaacaacattatccagaacaaataagaaacgtagctggccattaaatgaagctattatggccgtaggcatggtctcaatattagcaagtagtcttctgaaaaacgacattccaatgacagggcccttagtggcaggcggtctgttaacggtatgctatgttttaaccggtaggagcgcagacttagagttagagcgagcaactgacgtaaagtgggaagaccaggcagaaataagcggctcgtctcccattttaagtataactatatctgaagacggatcaatgtccatcaaaaacgaagaggaagaacagactctcaccatattaatcagaacaggattgctagtaataagtggactattccctatatcaatccctataactgcggcggcttggtacctttgggaagtcaagaagcaaagagcaggcgttctatgggacgtacctagcccgccacccatgggtaaggctgaacttgaagacggagcttatagaattaaacaaaagggtatactaggctactcacagatcggtgccggtgtatataaagaagggacatttcatacaatgtggcatgtgaccagaggagcagtactcatgcacaaaggaaaaaggatagaacccagttgggctgacgtcaagaaagacctcatatcatacggaggagggtggaaactagaaggtgaatggaaagagggagaggaagtgcaagtactcgctctggaaccgggcaaaaaccctagagccgtccaaactaagccaggattatttaaaacaaatacagggacaattggtgcggttagcttagacttctcacccggtaccagtggaagtcctataatagataagaaaggcaaagtagtaggtttatatggtaacggcgtcgttacaagatccggtgcttacgtatctgccatcgcccaaacggaaaaatcaatcgaagacaacccagagatcgaggacgacatttttaggaagcgaagactaacaattatggatctacatccaggtgcaggaaaaacaaaacgatacttaccggcaattgtacgtgaagctataaagcgtggacttagaacgttaatactagctcctacgcgggtcgtcgccgctgaaatggaagaagcattgagaggtttgccaatcagataccagactcccgctatacgcgccgaacatacgggtagagaaatagtagatctaatgtgtcacgcaacttttactatgcgattattatcgcctgttagagtcccaaactataatctaattatcatggacgaagcccatttcacagaccccgcgtctatcgcagcaaggggatacatcagtacacgtgttgaaatgggcgaggctgctggaatttttatgacggctacacccccaggatccagagacccatttcctcagtcgaatgccccaatcattgatgaggaacgagaaatacccgagcgatcttggaatagtggccatgaatgggttacggacttcaagggaaaaactgtatggttcgttcctagtattaaggcaggtaacgacatagcagcatgtcttaggaaaaacgggaagaaagtcatacaattaagccgaaaaacattcgactcagaatatgtaaagacaaggaccaatgattgggatttcgtcgttaccacagacatatcagaaatgggcgcgaattttaaggcggaaagagtaatagacccacggcgctgtatgaaaccagtaatcttgaccgatggcgaagaaagagtcattctagccggaccaatgcctgtgacacatagttctgccgcacaacgaagggggcgtattggacgcaaccctaaaaacgaaaatgatcaatatatctacatgggagagccactagaaaatgatgaagattgtgcacactggaaggaagcaaaaatgctcctagataacataaacacacccgaagggattataccatccatgtttgaacccgagagagagaaagtcgatgcgattgacggtgaatacagattgaggggagaggctcggaagacattcgtcgatttgatgcgaagaggagatcttccagtttggcttgcgtacaaggtagctgcagaaggaatcaattacgcagatcggcgatggtgtttcgacggaatcaaaaataaccaaatccttgaagaaaacgtggaggtagagatctggacgaaggaaggagaaaggaagaaacttaaaccgaggtggttagatgctcgcatctactcagatccattggcattgaaagaatttaaggaatttgcagcaggtagaaaatcgttaactcttaatcttataacagaaatgggacgtttacctacattcatgacccagaaaacccgagatgcgttagataatctagccgtcctccatacagccgaggctggtggacgagcatacaatcacgctctctcagagttaccagaaactttagaaactctcctactattaacattattggccactgtgacagggggtatatttctcttcttaatgtcaggccgggggatcggaaaaatgactctaggaatgtgttgtatcataacagcatctattctactctggtatgcacaaatacaaccacattggatagctgcatctataatactcgaatttttcctgatcgtattgctgattcctgaaccagaaaagcaaagaacacctcaagataatcagttgacatacgtagtaatagccattctcacagtcgtcgcagcaactatggcaaatgaaatgggattcctagaaaagacaaagaaagacttaggtctagggagtatagcaactcaacagccggaaagtaatatccttgatatagatctcaggccggcctctgcttggacactttacgccgtcgcgacaacattcgtgacaccaatgttaagacactctatagaaaattcatccgttaatgtatcactcacagctattgcaaaccaggcaactgtcctaatgggtctaggaaaagggtggcctctttcaaaaatggatatcggcgttcccttactagccataggatgttacagtcaagtcaatccaataacactaacagcggcacttctattgcttgtagcacactacgctataattggacccggacttcaagcaaaagcaaccagagaagcacaaaaacgggccgcagccgggatcatgaaaaaccctacagttgacgggataacagtgattgatctagatccgattccatacgatccaaaatttgaaaaacaattaggtcaagttatgttgcttatcttatgtgttacacaagtactaatgatgagaacaacttgggctctctgtgaggctttaacattagcaacaggtccgataagtacactttgggaaggaaatccaggcaaattttggaatacaactatagctgtcagcatggcaaacatattccgcggctcttaccttgcaggagcgggattactattttcaataatgaaaaacactacaaatactcggcgtgggacaggaaacatgggagaaactcttggagaaaaatggaaaagccgtctaaacacactgggcaaaagcgaatttcaaatatacaagaaaagcggtattcaagaagtagatcgtacgttagcgaaagagggaatcaaaaggggcgaaactgaccatcatgctgtctcacgaggcagtgcaaaactccgttggttcgtagaaagaaatatggtaacaccagaaggaaaggtggtggacttagggtgtgggagaggcggatggagctattattgtggaggtttaaagaacgtgcgtgaagtgaagggccttactaaaggaggcccaggtcatgaagaaccaatcccgatgagtacttacggttggaatcttgtacgtttacaatcaggagttgatgttttcttcattccacccgagaaatgtgacacattattatgcgacataggagaatcatctcccaatccaactgtagaagcgggtcgtaccttgagagtactaaacctcgtagaaaactggttgaataataatacccaattttgtataaaggtactcaatccctatatgccctcagtaatcgagaaaatggaagcgttacaaagaaagtatggtggcgccttagttcgaaatccactcagcaggaactcaactcatgagatgtactgggttagtaatgcatcaggaaacatagtatcttcagtaaacatgatttcgaggatgcttattaaccgattcacaatgaggcataagaaagctacgtacgagcccgatgtggacttagggtcgggtacaagaaatatcggaatagaaagcgaaatacctaacttagacatcatcgggaaaaggatagaaaagatcaaacaagaacacgaaacttcttggcattatgaccaagaccacccttacaaaacatgggcgtatcacggatcatacgagacaaaacaaacaggaagtgcttccagtatggtgaacggcgtagtgaggcttctcacgaaaccgtgggatgtactaccgactgtgacacaaatggcaatgacagacactactccgttcggacaacaaagagtcttcaaagaaaaagttgatacaagaacgcaggaacccaaagaaggaacgaagaaattaatgaaaataactgcagaatggctctggaaagaacttggcaagaagaaaacaccccgaatgtgtacacgagaagagttcacacgaaaagtaagatcaaacgcagctttaggagcaatatttactgatgaaaataaatggaaatcagctcgagaagctgtggaagatagtagattctgggagttagtagacaaggagcggaatttgcacctagaaggaaaatgtgaaacgtgcgtttataatatgatgggcaaaagagagaagaaattaggcgaatttggcaaagcaaaaggcagtcgtgccatctggtatatgtggctaggcgcaagattcttagaatttgaagcactaggtttcctaaatgaagatcactggttttcgcgagagaactcactatcaggtgtagaaggtgaaggtctacataaattgggatatattctaagggatgtaagcaagaaagaagggggagcaatgtacgctgatgatacagctggatgggacaccaggattacattggaagatttgaaaaacgaagagatggtgacaaatcacatggagggagaacacaagaaacttgcagaagcaatttttaaacttacctatcaaaacaaagtcgttcgagttcaaagaccaacacccagaggcactgtgatggacataataagtcggagagatcaacgggggtcgggacaagttggcacttacggattaaacacatttaccaatatggaagcacaattaataagacaaatggaaggagagggagtttttaagaatatacagcatttaacagtaactgaagaagtcgccgtacaaaattggttggcacgagttgggagggaaagattaagcagaatggcaataagcggagatgactgtgttgtgaaaccattggacgataggttcgctaatgcgctcacggcattaaacgacatgggaaagatacgaaaagatatccaacagtgggagccatcaaaaggttggaacgactggacacaagtacctttttgctcacaccacttccatgaactgataatgaaagatggacgagtattagtggttccatgcagaaatcaagatgaactcataggacgtgcaaggatcagtcagggagctggctggtcgctaagagagacagcatgcttagggaagtcgtacgcacaaatgtggtccttgatgtatttccataggagagacttgagattagccgcaaatgctatatgctccgcggtaccttctcattgggtaccaacatcacggaccacttggtccatccatgcgaagcatgaatggatgactaccgaggatatgctcacagtatggaatagggtttggatacgcgaaaacccttggatggaggataaaactcctgttgagagttgggaagaaataccatatctaggtaaaagagaagaccagtggtgtggctctctgataggtcttacaagtcgtgccacttgggccaaaaatatccaagctgcaattaatcaagtgcggagcttaatcgggaatgaagaatatacggactacatgccctccatgaagagatttcggcgcgaagaggaggaggctggagtactttggtaa

SEQ ID NO: 22734 - RNA, 9876 nt, synthetic construct
  misc_feature 1..9876: note = derived and/or modified CDS sequence (opt6) from DENV-2__EU482651__SS-prME
  source 1..9876: mol_type = other RNA
tcggcaggtatgataataatgctaatacctactgtcatggcattccacctaactactcgcaatggagaacctcatatgatagtcggcatacaggaaaaaggaaaaagtcttctttttaaaacggaggatggtgtaaatatgtgcacactaatggcgatggacttgggtgaactatgcgaagatacaattacctacaaatgtcctcttctacgtcaaaatgagcccgaagatattgattgctggtgtaactcgacaagtacgtgggtaacatatggcacatgtacaacaacaggagaacatagaagagaaaaacggagtgtcgcattggtgccccacgtaggaatgggattagaaacccgtacagaaacgtggatgagttcggaaggagcgtggaaacatgcacaaagaatcgaaacctggatattaagacacccaggatttaccattatggcagctatcttagcttacacgataggaacaacacactttcaacgggtactaatatttatcttattaactgccgtagccccatcaatgactatgagatgtattggcatatcgaacagagattttgtagaaggggtatcgggcgggagttgggtagatatagtactagagcatggaagctgtgtaacgactatggccaaaaataaacctaccctagacttcgaactaataaaaacggaggcaaaacaaccagccacactacgaaaatattgtatagaagcgaaattaacaaatacaacaactgaatccagatgcccgacccaaggtgagcccagcctaaaagaagaacaagacaaaagatttgtgtgcaaacacagtatggtagaccgagggtggggtaatggatgcggtttattcggaaaaggtggtatcgtaacttgtgccatgttcacctgtaagaaaaatatggaaggaaaaatagtacaacctgaaaacctagagtatacaattgttgtcactcctcatagcggagaagaacacgcagtgggcaatgataccggtaaacatggaaaagagataaaagtgacaccacaatcaagtattacagaggcagaactcacaggttacggcacagtaacgatggaatgttcgcctagaacgggtctggattttaatgaaatggtgctgttacaaatggaaaataaagcgtggcttgtccacagacaatggtttctagatttgccattaccctggctgcccggagccgataaacaggaaagcaactggatccagaaagaaacattagtaacattcaaaaacccacacgccaagaaacaagatgtcgtagttcttggaagccaagaaggtgcaatgcatacggcattaactggcgctacagaaatccaaatgtcgagcggaaatctgctgtttactggacatttgaaatgccgtctaagaatggataaactccaattaaaaggaatgtcctactctatgtgtacaggcaaatttaaagtagtcaaagagatagccgaaacacagcatggaacgatcgttattcgcgtgcaatatgaaggcgatggaagtccctgtaaaataccattcgagataatggatttagagaaaagatatgtacttggccgacttataaccgttaatcctattgtaacagaaaaagactccccggtaaacatagaagccgaaccaccatttggagactcttatatcattataggtgttgagccgggtcaattgaaactaaattggtttaagaaaggatcatccattgggcagatgtttgaaacgacgatgagaggagctaaacgtatggctattttaggagatacagcatgggactttggatctttaggtggtgtattcaccagtataggtaaggctttgcatcaggtcttcggagcaatctatggtgcggcattttctggtgtctcctggacaatgaagatacttataggggttattataacatggattggtatgaactctcgaagtacaagtctgtctgttagcttagtattggtgggcatagttactttatatctcggagtcatggtacaagccgatagtggctgcgttgtatcctggaagaataaagagctgaagtgcgggtctggaatattcataacagacaatgtccatacatggactgagcaatacaaattccaaccggaaagtccttcaaaactggcaagcgcaatccaaaaggcacaagaagaaggtatctgtggaataagatcagttactcgtctggaaaatttaatgtggaaacaaattacacccgaattgaaccacatacttgctgagaatgaggttaaacttaccattatgacaggagatataaaaggaataatgcaagcaggaaaacggtccttaagaccacaaccgactgaattaaaatatagttggaaaacatggggtaaagctaaaatgcttagtacggaaagctataatcaaactttcctcattgatggcccggaaacggcggagtgtccaaataccaacagagcgtggaacagtctagaagtagaagactatgggttcggagtctttactacaaatatctggttaagactcaaagaaaaacaagacgcattctgtgactcaaaattaatgtctgctgccatcaaggataatagggcggtgcatgcggatatgggatactggatagaatctgcactaaatgacacgtggaaaatagaaaaggcttcgtttatagaagtcaaaaactgtcattggcctaaaagccatacgttatggagtaacggagttcttgaatctgaaatgataatacccaaaaatctggctggcccagtctctcaacataactatcgaccaggttatcatactcaaatcactggaccgtggcatcttggtaaactcgaaatggacttcgatttctgcgacggcaccaccgtaatagttacagaagattgtggcaaccggggaccttcactaagaactacgacagccagcgggaagttgataacagagtggtgctgcagaagttgtactcttccaccgcttagataccgaggggaggacggctgctggtacggcatggaaattcgaccactaaaggagaaagaagaaaatcttgtcaacagtttagtaacggcgggccacggccaggtagacaatttttctctaggagtcttaggcatggcattatttttagaggaaatgttgcgaaccagagttggcactaagcatgccatactattagtaacggtaagttttgtaacccttatcactgggaacatgtcattcaaagatctgggcagagttgttgtaatggtaggcgcgacaatggctgacgatataggaatgggagtaacgtatttagctctgctagcagcatttaaagtacgtccaacattcgcggcaggattgctattacgaaaacttacttccaaggaactaatgatgacaacaataggaatagtattattatctcagagtacgataccggaaaccgtcttggaacttactgacgcgttagccctaggcatgatggttttgaaaatagtcagaaatatggaaaaatatcaactggctgtaacaattatggcaatcctttgtgttcctaatgccgtagtattacaaaacgcctggaaagtatcctgtacaatattggccgtggtctcagtatcgcctctgctgctaacaagcagtcaacagaaaacagattggatacctttagctcttacgataaaaggactgaatccgacagccatattcttaacaactttatcgagaacaaataagaaacgtagttggccattaaatgaagcaataatggctgtagggatggttagcatattagcttctagccttcttaaaaatgatataccgatgacgggacccctagttgcgggaggcttgctaacagtatgttacgtgctcacaggtagaagcgcggatctagagctagaacgtgcaaccgatgtgaaatgggaagaccaagctgaaatatcagggtcttccccaatactgagcatcaccatatcagaggacggtagtatgtctatcaaaaacgaggaagaggaacagactttgacaatccttatacgtacaggtttattagtaataagtggtttgttcccaataagtataccaataaccgcggctgcgtggtatctatgggaggtcaagaaacagagagccggagttttgtgggatgtaccatcgcctcctcccatgggcaaagctgaattggaagatggggcttaccgcatcaaacaaaaaggaatcctcggatattcacagataggcgccggtgtatataaagaaggtacatttcatacaatgtggcacgtaactcgtggagcagtgctaatgcataaaggaaaacgaattgaaccttcctgggcagatgtgaagaaagaccttatctcgtatggaggaggttggaagctagaaggtgaatggaaagagggtgaggaggtacaagtattagcattagaacctggcaaaaatccaagggcagtgcaaaccaagccaggcttattcaaaacaaacactggaacaattggggctgtctccttagattttagtccaggaacaagtggaagtcccataattgacaagaaaggaaaggtagtaggcctttatggtaacggagtagtcactagaagtggcgcttacgttagtgccatcgcgcaaaccgagaagagtattgaagataatccggagatagaggatgacatatttcgtaaaaggagactaacgatcatggatctccatcccggagcaggaaagacaaaaaggtatcttcctgcaatcgttagggaagccataaaaagaggcttgagaacgctcatccttgctcccacccgagtcgttgcggctgagatggaggaagcacttcgagggctcccaatcaggtaccaaacaccggctataaaagctgaacacacaggacgtgagatagtcgatctaatgtgccatgcaaccttcacaatgaggcttctgagtcctgtgagagttcccaactataaccttatcattatggatgaggcacactttacggatcctgcatctatcgcagcaagaggttatatttcaactcgagttgaaatgggcgaagcagctggaatattcatgactgcaactccgccaggatctagagacccattcccccaaagcaatgccccaattatcgatgaagaacgagaaataccagagcgaagttggaactctggacacgaatgggtaaccgatttcaaaggcaagaccgtatggttcgtaccatcaataaaagccggaaacgatatagctgcatgtctaagaaagaacggcaagaaagtaatccaactgagccgcaaaacatttgacagtgaatatgtaaaaacgagaactaatgattgggacttcgttgttactacagatatcagcgaaatgggagcaaattttaaggctgagagagtgatcgacccccgcagatgtatgaaaccagttatactgacggacggtgaagaaagggtgatactcgcgggacctatgccggtaacacatagttctgctgcgcagaggagaggaagaatagggaggaatccgaaaaatgaaaatgatcaatatatttatatgggtgaaccattagaaaacgatgaagattgcgcacattggaaagaagctaaaatgttgctagataatataaatactccggaagggataatcccaagcatgttcgaacctgaaagagaaaaggtggacgcaatagacggagaatatcgtttgcgaggagaagcacgcaaaaccttcgtagatttaatgagacgtggagatttaccagtttggctcgcgtataaggtagcagcagaaggaattaactacgcagaccggaggtggtgctttgacggaattaaaaataaccaaatcttagaagaaaacgtcgaagttgaaatttggacaaaagaaggagagcgaaagaaacttaaacccagatggctagacgcacggatatatagcgatccccttgccttgaaggagttcaaggaatttgcagcagggagaaaatctctaacactaaatctaataacagagatgggacgacttcccacatttatgacgcaaaagaccagggatgcactcgacaacttagcagtattacacactgcagaagccggaggccgtgcctacaatcatgcattgtctgagctaccggaaacattggaaaccctactactacttactctcttagcaacagtgacaggaggaatttttctatttctcatgagtggccgaggaataggcaaaatgacgttaggtatgtgttgtattattacagcaagcattctgctttggtatgcacagatacagcctcactggatcgccgccagtatcatcctagagtttttcctaatcgtccttctgatacccgagcctgaaaaacaaagaacgccacaagacaatcaattgacatatgttgtcatagctatactaaccgttgtagcagcaacaatggcaaatgaaatgggtttcctagagaaaaccaagaaagatctagggctagggagtatcgctacacaacaaccagagtcgaatattttagatattgacttaaggcccgcatccgcttggaccttatatgctgtcgcaaccacgtttgttactcccatgttacgacacagcattgaaaacagcagtgttaacgtatcattgacagcaatagctaaccaagctactgtgctaatggggttggggaagggttggccgctttcaaaaatggacattggtgttccgttactagcaataggttgctattcacaggttaaccccatcaccttgactgcagcattgctcttactggtggctcattatgctattataggcccaggactccaagctaaagcaacccgcgaagcccaaaagagagccgccgcaggaatcatgaaaaaccccacagtagacggaataacagttatagacctagatcccattccatatgatccgaagtttgaaaagcaacttggacaggtaatgttattaatactctgcgtaacacaagtcttaatgatgagaaccacgtgggccttatgcgaggcattgaccctcgccacgggtccgatatctacgctatgggagggtaacccaggaaggttctggaacacaacaatagccgtatccatggcaaacatattccggggttcatatctagccggagcaggactactattctccataatgaaaaacaccacaaacacacggagaggtacaggaaacataggagaaacgctaggagaaaagtggaaatcaaggttaaatgcgctaggaaaaagcgaatttcagatatataagaaaagtggcatacaagaagtcgacaggaccttggcaaaagaaggcattaaaagaggagaaacagatcatcacgccgtatctcgcggatctgcaaagctgagatggtttgtcgaacgaaatatggtaacccccgaaggtaaggtagtagatcttggatgtggaagaggaggctggagttattactgtggcggtctcaaaaacgtcagagaggtgaaagggctcacgaaaggaggaccaggacatgaagaaccaattccaatgtcaacgtatggctggaatctagtacgactacagagcggagtggatgtcttctttattccaccggaaaagtgcgacacactgttgtgtgatatcggagaaagttcccctaatcctactgtagaggcaggcagaacgttgagagtcctgaacctagtggagaattggttaaataataacacacaattctgcataaaggtgcttaacccctatatgccgtccgtcatagaaaagatggaggcactccaaagaaagtacgggggagctctcgtcagaaacccgttatcaagaaattccacccatgagatgtattgggtaagcaatgctagtggcaatattgttagtagcgtaaacatgatatctaggatgctaatcaatagatttaccatgaggcacaagaaagcaacttacgagcctgacgtcgacctcgggagtgggactaggaacatcggcatagagtcggagatacccaatctagatattattggtaaacgtatagaaaagataaagcaggagcacgaaacctcgtggcactacgaccaagatcacccttacaaaacctgggcctaccatggatcatatgaaactaagcagacagggtcagccagttcaatggtaaacggagtcgtgaggctattgaccaaaccatgggatgtactacctacagttactcagatggcaatgacagacaccacaccattcggacaacaacgtgtttttaaggaaaaggtagacacgagaactcaagagccgaaggaagggactaagaaactaatgaaaattaccgcggaatggttgtggaaagaattggggaaaaagaaaacaccgaggatgtgtacacgtgaagagttcaccaggaaagtgagaagtaatgccgcattaggcgcaatctttactgatgaaaacaaatggaaatctgctagagaagctgtcgaagatagtagattttgggaattagtagataaagaacgtaatcttcacttagaaggaaaatgcgaaacatgtgtctataatatgatgggaaaaagagaaaagaaacttggagaatttggaaaagccaaaggttctcgagctatatggtatatgtggttaggagctcgatttttggaatttgaggctttaggattcctaaacgaagaccactggttttcgagagaaaatagtctatcaggcgtggaaggagaaggtttacataaactaggttacatcctacgagacgtgagcaagaaagaaggtggagcaatgtatgcagatgatacagctgggtgggatacgagaataacattggaagatttaaagaatgaggagatggttacaaaccacatggagggagaacataagaaattagcagaggctatttttaaattaacttatcaaaataaggttgttcgagtacagagacctacacctcgaggaacagtaatggatataataagccgacgtgaccagagggggtcgggacaagtggggacctacggactaaatacgttcaccaatatggaagctcaactgatacgtcagatggaaggtgaaggtgttttcaagaatatacaacatttaacagtgaccgaggaagttgcagtacagaactggcttgctcgcgtaggcagagaaagactgagtcgcatggcaattagcggggatgactgcgttgtaaaacctctcgatgatagattcgcaaacgccctaaccgcacttaatgatatgggcaaaataagaaaagacatacaacagtgggagcctagtaagggctggaatgactggacacaggtacctttctgtagtcatcatttccacgaactaataatgaaagatggtcgtgtattggtagtaccctgtagaaatcaagacgaactaattggtcgagctcgaataagccaaggcgcgggatggagcttacgagaaacagcctgcttaggtaaaagttatgctcagatgtggagtctaatgtatttccacagacgagatctccgactagctgcaaatgcaatatgttcggcagtaccatcacattgggttccgacaagtcgaacaacttggtctatccacgctaaacatgaatggatgacaacggaagatatgcttaccgtgtggaacagagtatggataagagaaaacccatggatggaggataaaacacccgtagaaagctgggaggaaattccttaccttggcaaaagagaagaccagtggtgtggctcgctaatcggtttaacatcacgagcaacctgggccaagaatattcaagccgccatcaaccaagtcagatcattaataggaaatgaagaatatactgactacatgcccagtatgaaaagatttcggcgggaagaggaagaggcaggcgtgctgtggtga

SEQ ID NO: 22735 - RNA, 9876 nt, synthetic construct
  misc_feature 1..9876: note = derived and/or modified CDS sequence (opt6) from DENV-2__EU482652__SS-prME
  source 1..9876: mol_type = other RNA
tcagcagggatgataataatgttaatacccaccgtgatggcttttcatttaacaactcgaaacggtgaacctcacatgatagtaggtatccaagaaaaaggtaaatctctattatttaaaacggaagatggtgttaacatgtgcacactaatggctatggacttaggagaactatgtgaagataccattacctataaatgtcccttattgcgacaaaacgagcctgaagatatcgactgctggtgtaacagcacttccacatgggtaacttatggtacgtgtacaacgactggggaacatcggagagaaaaacgctctgtagccttagtaccgcacgtcgggatgggactcgaaacgagaacggaaacatggatgtcctccgagggtgcatggaaacatgcacaaagaatagaaacatggatcctacgacaccccggatttactatcatggctgcaattttagcgtacacaattggtacaacacatttccaacgtgtccttattttcatcttacttacagctgtggcaccatccatgaccatgagatgtataggaatatctaacagggactttgtagagggggttagtggaggtagctgggtggatatagtcctcgaacacgggtcgtgtgtaactacaatggccaaaaataaacctaccttagactttgaactaattaaaactgaagccaaacaaccagcaactctcaggaaatattgtatagaagcaaaactcacgaataccactacggaaagtagatgtccaacacaaggagaaccgagcctgaaagaagaacaagataaacgttttgtctgtaaacatagcatggtagatagaggctggggaaatggatgcggtttattcggaaaaggaggcatagtcacatgcgcaatgtttacttgtaagaaaaatatggaaggcaaaattgtgcaaccagagaatttagagtacacaatcgtagtcacccctcatagtggcgaggaacatgcagttggtaacgacacagggaaacatggtcaagagataaaagtaactcctcaatcatcaatcacagaagccgaattaacaggatacggcacagttacaatggaatgctcaccgcgtacaggattggattttaacgaaatggttttattacaaatggaaaataaagcatggttggttcatcgacagtggttcctggacttaccattgccatggttgccaggagcagataaacaagaaagcaattggatccaaaaagaaaccctagtaacgtttaaaaatccgcatgctaagaaacaggatgtggtagtactcggaagccaagaaggagcaatgcatacagcattgactggggccaccgagatacaaatgtcgtcgggaaatctattatttactggtcacctaaaatgtagattaagaatggacaaattacaactgaaaggtatgtcatacagcctatgcacaggaaaatttaaagtagtgaaagaaatagctgaaacacaacacggtactattgttataagagtccaatatgagggtgatggaagtccctgtaagataccttttgaaataatggaccttgagaaaaggtatgttttagggagattaattacagtaaaccccattgttacagaaaaggactcgcccgtaaatatagaagcggagccacccttcggagattcctatattattataggcgtagaacctgggcagttgaaattaaattggtttaaaaagggtagcagcatagggcaaatgttcgaaactactatgagaggagcaaaaagaatggcaattctcggagacacggcatgggattttggttctctaggcggagttttcacgtccataggaaaggctctgcaccaagtcttcggcgctatatacggagcggcgttctccggagtaagctggacaatgaaaatcttaataggagtaataatcacgtggattggcatgaactcacgtagcacgtcattgagtgtatcattagtactggtaggcatagtcacactatatttaggagtcatggttcaggctgactctggatgtgttgttagctggaaaaataaggagctaaaatgcggatcaggaatttttatcacagataacgtacacacctggacagagcaatataaatttcagccagaaagtccatcaaagctagcgagcgcaatacaaaaagctcaagaggaaggaatctgtggaataagatcagttacacggcttgagaatctaatgtggaagcaaattacgcctgagctaaaccacatcttggcagaaaatgaagtgaaacttacaatcatgaccggggacataaaaggaattatgcaagctggaaaacggagcctaagaccacaacctacggaattgaaatattcatggaaaacatgggggaaagctaagatgttatccacggaaagctataatcaaactttcttaattgacggtcccgaaactgcagagtgccctaatacaaatagagcgtggaatagcttagaagtcgaagattatggatttggagtgtttacaactaatatttggctaaaactaaaagagaaacaagacgctttctgcgattcgaagttaatgagtgctgccataaaagataaccgcgcagtacatgcagacatgggttattggatagaatcagctctaaatgacacctggaaaattgaaaaagcatcctttatcgaagtcaaaaattgtcattggccaaaaagtcatacattgtggtctaatggagtattagagagtgaaatgattataccaaagaacctcgcgggaccagttagtcagcataattatagaccgggataccacacacagattgctggtccttggcacctggggaagttagaaatggacttcgacttttgcgacgggacgacagtaatcgtcaccgaagattgtggaaacagaggtccatcattgcgtaccactacagcaagcgggaaattaatcacggaatggtgttgtcgaagttgtacattgccaccacttcgttaccgtggcgaggatggatgctggtatggaatggaaataaggccattaaaagagaaggaagaaaacctcgttaatagtctggttactgctgggcatggccaagtggataatttttcactaggagtactgggaatggctctgtttttggaagaaatgttgcgaactcgtgtgggaactaaacatgcaatacttttggtggcagtttcctttgtgaccttaatcacgggaaatatgtctttcaaagatcttggtcgggtggtcgtgatggtcggggcgactatgactgatgacataggaatgggagtaacataccttgcactactagcagctttcaaagtcagacccactttcgctgccgggttactcctcagaaaactcacatcaaaagaacttatgatgacaacaattggcattgtacttctatcccagagcgcaatacctgaaacagtgttagaacttacggatgccctcgcacttggaatgatggtgcttaaaatcgttaggaatatggaaaagtatcaattagctgtcaccattatggctattctgtgcgtccccaacgcagtaatacttcaaaacgcttggaaggttagctgtacgatactagcagtagtctctgtttctcctcttctgttaacaagtagtcaacagaaaactgactggataccgctagcgttgacaataaaaggtttaaatccaaccgctatctttttgacaacattgtctaggactaataagaagcgatcgtggccacttaacgaggcaataatggcggtaggaatggtaagcatattagcaagcagcttacttaaaaatgacataccaatgacgggacccctagtcgcaggcggactcttaaccgtatgttacgtgctaacaggccgatcagcagatctggaattagaaagggccaccgacgtcaagtgggaagatcaagctgagataagcggtagttcccctattctctctataactatatcagaagatggtagtatgagcatcaaaaatgaagaggaagaacagactcttacgatattgattcggacaggactattagtaatatctggattatttccgatatcaattcctattactgccgcagcgtggtacttgtgggaagtcaagaaacagagggccggtgttttgtgggacgtgccaagcccaccacccatgggtaaagccgaattagaagacggagcttatcgcataaagcaaaaaggcatcctaggttatagtcaaataggtgcgggcgtatataaagaaggtacgttccatactatgtggcacgtcacaagaggtgcagtcctaatgcataagggaaagagaattgaacctagctgggctgacgtcaagaaagatttaatttcatacggaggtggatggaaacttgagggtgaatggaaagaaggagaagaagtacaagtgttagcattagaacctggcaaaaatccaagagcagttcaaactaaacccggcttatttaagacgaatactggcacaataggtgccgtatcattagattttagtcctggaacgtcgggatcccctattattgataagaaaggaaaagttgtaggattatacggaaatggagtagtcacaagatctggagcatacgtatcagcgatagcgcaaaccgaaaaatcgatagaagataatccagaaattgaagatgatattttcagaaagaggagactaacaattatggatcttcatccaggagcgggaaaaaccaaacgttatctaccagcgattgttagggaagctataaaaagaggcttaaggacattaattttggctccaacccgcgtggttgcggccgaaatggaggaggcattaagaggactaccgattaggtaccagactcctgcaatccgagcagagcacacaggaagggaaatagtagacctcatgtgtcacgcaacctttactatgcgtctgcttagtccagtacgtgtaccaaattataatttaataataatggatgaagcacattttacagatccagccagtatagcagcgcgaggctatatttccactcgggttgagatgggagaagctgcaggaatatttatgacagctacgcctcctggttcaagagatccttttccacaatctaatgccccaatcatagatgaagaacgagaaattcctgaacgttcgtggaactcgggacatgaatgggtaacagattttaaaggaaaaacagtatggttcgtcccctctataaaagccggtaacgatatcgccgcatgcctgagaaagaatggcaagaaagttatacaattaagtcggaaaacatttgacagtgaatatgttaaaacccgaaccaatgattgggattttgtcgttacaaccgacatatccgagatgggtgcaaacttcaaggctgaaagagtaattgacccgaggagatgtatgaaaccagtcatccttacagacggcgaggaacgagtaatcctagcaggacccatgccagtaacgcactcaagtgcagcacaacgacgaggaagaatcgggagaaacccaaagaatgaaaacgaccaatacatatatatgggtgagccactggaaaatgatgaagactgtgcgcattggaaagaggccaagatgttgttagataatataaataccccagaaggtattattccgagtatgttcgagcctgaaagagaaaaggttgatgcaattgacggagaataccgcctccggggtgaagcaaggaagacctttgtcgacttaatgagacgcggggacctgccagtgtggttagcatataaagttgcggcagaagggataaattacgctgatagaagatggtgttttgatgggatcaaaaataatcaaattttagaggaaaacgtggaagtagaaatctggacaaaggaaggggagaggaagaaattaaaacccaggtggcttgacgctcggatatacagcgatcctctcgccctaaaagagtttaaagaatttgcagcggggaggaaatccttgacattgaaccttataactgaaatgggaagactccctacgttcatgacacagaaaacacgagacgccctagacaatcttgctgtacttcatacagcagaagctggtggaagggcatataatcacgctttatctgaactcccagagaccctagaaactttgttactgctcacccttctggctacagttactgggggaatcttccttttcctaatgtcaggcagggggattggaaaaatgaccctgggtatgtgctgcattattacagctagcacactattatggtatgctcagatacaaccccactggatagcagcttctataatcctagagttctttctaatagttctgctcatacccgaacctgaaaaacaaaggacgcctcaagataatcaattgacttacgtggtaatagcaattttaacggtagtcgcagcgaccatggcaaatgaaatggggtttttagagaaaaccaagaaagatttaggactcggttctatagccacccagcaaccagaaagtaatattcttgacattgatcttcgacccgctagcgcatggacattatatgccgtggcaactacttttgtgacccctatgcttaggcattcgattgaaaacagtagcgtaaacgtctctctaacagcaattgcaaaccaagcaacagtactaatgggtttgggaaaaggctggcctttatctaaaatggatatcggtgtaccattgctcgctataggatgttatagtcaagtgaatccaatcacactcactgccgctttacttcttttagtagcacactacgctattattggccccggactacaagcaaaagcaactcgggaagcgcaaaaacgtgcggccgccggtatcatgaaaaacccaactgtagatgggattaccgtgatagatttggatccaatcccttatgacccaaaattcgaaaaacagctaggccaggttatgctgttaattttatgtgtaacccaagtactaatgatgaggacaacctgggcactctgtgaggctttaacattggccactggaccaataagcactctttgggaagggaatcctggaagattttggaataccacaattgctgtatcgatggcaaatatatttcgaggatcttatcttgcaggcgccggcctattattctctataatgaagaacaccactaatacaaggcgcggtaccggaaacatgggcgagactctgggcgagaaatggaaaagcaggttaaacgcacttggaaaaagtgaatttcagatatataagaaaagtggtatccaagaagttgatagaactttggcaaaagaaggtataaaaagaggagagacagatcaccacgcagtaagtagaggtagtgccaagctgcgttggtttgtcgaacgaaatatggtcacaccagaaggaaaagtggttgatctaggttgtggccgaggtggctggtcatactattgtgggggtttgaaaaacgtcagagaagtgaaggggctgacaaaaggtggcccaggtcatgaagaaccgataccaatgtcaacatatggctggaacttagtccggttacaatctggggtcgacgtgttctttatcccacccgaaaagtgtgatactttactatgtgatataggagagtcgtcacctaatccaactgtagaagcgggacgaacattaagggtattaaatttagttgaaaattggctaaacaataacactcaattttgtatcaaagtgcttaatccttatatgccgtctgttatcgagaaaatggaggcacttcagagaaaatatggaggggccctcgtccggaatccattatctagaaatagtacccatgaaatgtactgggtttcgaacgctagtggaaacatagtatcaagtgtaaatatgataagccgtatgttaattaatcggttcactatgcgccacaagaaagcgacgtatgaaccagacgtagatcttgggagtgggacacgaaatatcggaattgaaagcgaaattcctaacctcgacatcatcggcaagagaattgagaaaattaaacaagaacatgaaacaagttggcattatgatcaggaccacccgtataaaacctgggcttatcacggtagttatgaaacgaaacaaaccggaagtgcatcttctatggtgaatggagtggtaagattgttgaccaagccatgggacgttttaccaaccgtgacgcaaatggctatgacagacacaacaccatttggccaacagagggtttttaaagaaaaagtcgatacccggacacaagaacctaaggaaggaactaagaaattgatgaagataactgctgagtggctatggaaagaattaggcaagaagaaaaccccaagaatgtgcacgagagaagagttcactaggaaagttcgttctaatgctgctctgggagctatatttactgacgaaaataaatggaaaagtgcgcgagaagctgtagaggattctcgtttttgggagctcgtggacaaggaacgaaacttacatttggagggtaaatgtgaaacttgtgtatataacatgatgggcaagagagagaagaaactcggagaatttggaaaagccaaaggttcgagagccatatggtatatgtggctaggcgcccgtttcctagaatttgaggccttagggtttcttaacgaggaccactggtttagtagggaaaactctctatccggagtggaaggggaagggctacataaactaggatacatactacgggacgtaagtaagaaagaaggaggtgcaatgtatgccgatgacaccgcaggatgggacacaaggattacactggaagatctaaagaatgaagaaatggtaaccaaccatatggaaggtgaacataagaaattagccgaggccatcttcaaacttacataccaaaacaaagtggtgagagttcaaagaccaacaccgagaggcaccgttatggatataatatcgaggcgtgaccagcgtggttcgggacaagttggcacatacggcctaaacacgtttacgaatatggaagctcaattgattcggcaaatggaaggtgagggagttttcaaaaatatccaacatcttactgtaactgaagaagtagctgtcaaaaactggctagcgcgagtgggccgggaaagactatcccgaatggcgattagcggggacgattgcgtcgtaaaaccattagacgaccgatttgctaatgcacttacagcactaaatgatatgggcaaaataagaaaagatattcaacagtgggaaccatcaaaaggttggaacgactggactcaagtcccattttgcagccatcattttcacgagctaattatgaaagatggaagagtgctcgtcgtaccctgcaggaaccaagatgagctaatcgggcgagctcgtatcagtcaaggtgcaggctggtctctacgagaaacggcatgtcttggtaaatcatatgcacaaatgtggtcattaatgtattttcatagacgcgatcttcgtcttgcagcgaatgcgatatgcagcgcagtaccgagtcattgggtaccaacaagcaggacaacatggagcatacatgcaaaacatgaatggatgacaacggaggatatgctaactgtatggaatagagtatggataagagaaaatccatggatggaagacaaaacgccagttgagagttgggaagaaattccttacctcggaaaaagagaagaccaatggtgcggctctttaattggattaacatctcgcgcgacctgggccaaaaacatacaagctgctataaaccaggttagatcgttaatagggaatgaagagtatgccgattatatgccaagtatgaagagatttcgcagggaagaagaggaggcaggagttttatggtaa

SEQ ID NO: 22736 - RNA, 9876 nt, synthetic construct
  misc_feature 1..9876: note = derived and/or modified CDS sequence (opt6) from DENV-2__EU482653__SS-prME
  source 1..9876: mol_type = other RNA
tcagcagggatgataattatgttaataccgacagtaatggcattccatttaacaacacgaaatggcgaacctcatatgatagtgggaatccaagaaaaaggtaaatcgctactatttaaaactgaagacggagtaaatatgtgtacactgatggctatggatttaggggaactgtgtgaagacacaataacgtacaaatgtccactactaagacaaaacgaaccagaagatattgattgttggtgtaattcaacgtctacatgggtaacatatgggacatgtacgacaacgggagaacacagaagggaaaaacgatctgtggccttagtaccacatgtaggaatggggttagaaacaagaaccgaaacttggatgtcctccgaaggggcctggaaacatgcgcaaaggatagaaacttggattttaagacacccaggatttacaataatggcggcaattttagcctataccatcggcactacgcactttcaaagagttcttatattcatattattgacagcagtggcaccctccatgaccatgcgctgcataggaatatctaaccgagactttgttgaaggtgtatcaggtggaagctgggtggatatagtgttagagcacggttcctgcgtgactactatggctaaaaataaacctacactagatttcgaactgatcaaaacagaggccaaacaaccggcaacactaagaaaatactgcattgaagcaaaactgactaatactaccacggaatcacgctgtcccacccagggagaaccctcattaaaagaagaacaagataaacgtttcgtgtgtaaacattcaatggtagacaggggttggggtaatggttgcggtctgtttggaaaagggggtattgtaacatgcgcgatgttcacttgtaagaaaaacatggaaggcaaaatagtacaaccagaaaatcttgagtatacaatagttgttactccccattcaggagaagaacatgcagtcggaaacgataccggaaaacacggaaaagaaataaaagtaacccctcagtctagtatcactgaagcagaactcacagggtatggaactgtcacaatggagtgctcgccgagaactggtctggactttaatgaaatggtcttactccaaatggagaacaaagcctggcttgtacacagacaatggttccttgacttgccattaccttggctgccgggtgctgacaaacaggagagtaattggatacaaaaagagacacttgtcaccttcaaaaatcctcacgctaagaaacaagatgttgtagtactcggttctcaagagggtgcaatgcacaccgcattgacgggtgcgaccgaaattcaaatgagtagtggcaatctattatttacgggccacctcaaatgccgcttacggatggataaactacaactaaaaggcatgtcatacagtatgtgcacaggaaaatttaaagtagtgaaagaaatcgcagaaacccagcatggaactatagtaataagagtacaatatgaaggcgacggaagtccatgtaaaattccttttgagataatggacctagagaaaagatatgttctaggtcgattgataacggtcaatcctatagtgacagaaaaagatagtccagtaaacattgaagctgaacctccttttggagacagttatattataataggcgtagaaccaggacagttaaaattaaactggtttaagaaaggatccagtattggccaaatgtttgagactacaatgcgtggtgcaaaaagaatggcaatactaggggatacagcctgggattttgggtcgctaggtggtgtattcacatccattggtaaagccttgcaccaagtgttcggagctatctacggagcggccttttcaggtgtttcatggacaatgaaaatattgataggagtcatcattacatggataggaatgaatagtagaagtacaagtctaagtgtatcattggtattagttggaattgtaaccctttatttaggagtcatggtacaggctgatagtgggtgcgtggtttcatggaaaaacaaagaactaaaatgtggcagtggaatattcgtcacagacaacgtacacacctggacagagcaatataaatttcaacccgaaagccccagtaaactcgcatcggctatacaaaaagcgcaggaagagggcatctgcggaataagatctgttacaaggcttgagaacctgatgtggaaacaaattacaccagaactgaaccatatcctcgcggaaaatgaggtgaaactgacgataatgacaggggacataaaaggaattatgcaagcaggtaagcgcagcctgcgacctcaacccactgaactgaaatattcatggaaaacctggggtaaagctaaaatgctttctactgaatcgcacaaccaaactttcttgatagacggtccagaaactgcggaatgtccgaatacaaaccgagcttggaacagtttagaagtggaagactatggatttggtgttttcaccaccaatatttggttgagactgaaggaaaagcaggatgccttctgtgattctaaattaatgtcagctgcaatcaaagacaatagagcggttcatgcagacatgggatactggattgaaagtgctcttaacgatacttggaagatagagaaggccagtttcattgaagtcaaaaattgccattggcccaaaagtcacactctgtggagcaacggtgttctagaaagcgaaatgatcatccctaagaatctcgcaggtcctgtatcacaacataactacagaccaggatatcacacacaaatagcagggccatggcatttgggaaaattggagatggattttgacttctgtgacggaacaacagtaatagtaacagaagattgcgggaatagaggaccaagcctacgcacgactactgcttccgggaagctaattactgaatggtgctgtcggagctgcacactccctccgctacgatatcgaggagaggacggttgttggtatggcatggaaattcgacccctgaaagaaaaagaggaaaatttggtaaactctttagtaacagccggtcatgggcaagtcgataacttctcgttaggagtattaggaatggcactgtttttagaagagatgttacgaacgagagtaggaactaagcatgccatactacttgtggccgttagttttgttacgttaataacagggaatatgagttttaaagatctaggacgggtagtcgtaatggttggagcaactatggctgacgatataggaatgggcgtcacatatcttgccctattagctgcgtttaaagtccgaccaacatttgccgcaggacttctcctccggaagttgacctcgaaagaacttatgatgacaaccataggaatcgtactgctatcacaatcaacaattcccgaaaccgtactagaattaacggacgctctcgccttaggcatgatggtactcaaaattgtaagaaatatggaaaaatatcaactagctgtaacaataatggcaatattgtgcgtgcctaacgccgtaatcttacaaaatgcatggaaggttagttgtacaatattagctgttgttagtgtttcaccactcctacttacgagtagtcaacagaaaacggactggataccattagcattaacaataaaaggccttaatccaacagcgatatttttaacaactttatcaagaacgaacaagaaacgatcgtggcccttaaatgaggcaatcatggcggtcggaatggtatcaatccttgcgtcctcactactcaaaaatgacatacccatgactggtcctctagtagcagggggattactgacggtttgctatgtgctaacgggtcgaagtgctgacttagagcttgaacgagccacagacgttaaatgggaagatcaagccgagataagtggatcatcaccaatcctatcaataaccatttcagaagatggatcaatgtctattaaaaacgaagaagaggaacaaacccttactatactaataagaaccggtttattagtcatctctggtcttttccctataagtatcccaatcactgcagctgcctggtatttgtgggaagtcaagaaacagagagctggtgttctatgggacgtaccttccccacctccaatgggtaaagcagagttggaagacggtgcttatagaattaaacagaaaggaatttttggatattcacaaataggcgctggagtctacaaagaaggaacatttcacacaatgtggcacgtaacaagaggcgctgttttaatgcataaagggaaacgaatcgagccatcttgggcagacgttaagaaagatctaatttcgtatggagggggctggaaattagagggagaatggaaggaaggtgaagaggttcaggtcctagcactcgagccagggaagaatcccagagccgtacaaacaaaacctggtctcttcaaaactaacacaggtactatcggagctgtatcactagactttagtcctggaacgtctggatcgccaataatagataagaaaggaaaagtcgtgggactatacggcaacggtgtcgtcacacgatcaggtgcatacgtgtccgctatagctcaaaccgagaaaagtatagaggataatccggaaattgaagacgacatctttcgaaaacgccgacttactataatggatctccatcctggtgcaggtaaaacaaagcgttatcttccagcgattgtccgagaggcaataaaacgaggcttgcgaacacttattctagcgccaacacgtgtcgtggcggcggagatggaagaagcattaagagggctccctattaggtatcagacaccagcaattcgtgctgaacatactggtagagaaattgtcgacctaatgtgtcatgccacatttacaatgagattactaagtccagtacgagtgccgaattataatcttataatcatggatgaggcccatttcacagacccagcatcgatagcagccagaggttatattagtacaagggtagaaatgggggaagctgccggtatattcatgacagcaacacctccaggatctagagatccattcccgcaatctaacgctcctataattgatgaggagcgtgagattccagagcgatcctggaactcaggtcacgagtgggtcactgattttaaaggtaagacagtctggtttgttcctagtataaaagctggaaacgatatagcagcgtgtctaaggaaaaatgggaagaaagtaatccaactaagtcgaaaaacatttgactccgagtacgtaaaaacaagaacaaatgattgggactttgtggtaacaacagatataagtgagatgggtgcgaactttaaagccgaacgagtaattgatcctcgtaggtgtatgaaacctgtcatactaactgacggcgaagagagagtcattctcgccggcccaatgcctgtcacacattcatctgccgcccagagacgaggccgcatagggaggaaccctaaaaacgaaaatgaccagtatatatatatgggggagcccttagaaaatgatgaggactgcgcacattggaaagaagcgaaaatgctgcttgacaacatcaatacaccggagggtataataccaagcatgtttgagccagagagagaaaaagtagatgcaattgacggcgaatacagactccgtggcgaagcgagaaaaacttttgtagaccttatgcggagaggtgacttacctgtttggctcgcttacaaagtagcagcagagggaataaattacgcagatagaaggtggtgcttcgacggtattaaaaataatcaaatcctagaagagaacgtagaggtggaaatatggactaaggaaggcgaacgcaagaaactcaaacctcgatggcttgatgcgaggatttatagtgacccgcttgccctgaaggagttcaaagaatttgcagcaggccgaaaatctttgacactaaatttaatcactgaaatggggcgtcttccaacttttatgacacagaagacaagagacgccctagacaatttagctgtattacatacagcagaagcaggcggtcgagcttataatcatgcactaagtgaattacctgaaacattagaaactttattacttttaactctactcgcaacagtgaccggaggcatattcctattcctgatgagtggtcgaggaatcggaaagatgactttaggaatgtgttgtattataaccgcatcaattctcctatggtacgcacaaatacaaccgcattggatagcagccagtatcatattggagttcttcctcatcgtgcttttaataccggaaccagaaaaacaaagaacaccacaggacaatcaattgacttatgtcgttatagccatcctcactgtcgttgcggcaactatggcgaatgaaatgggttttctggagaaaaccaagaaagatctcggactagggtccatcgccacgcaacaaccagaaagtaacatattagatatcgatttacgtcccgcttctgcatggacactgtacgctgtggccaccaccttcgtcacgccaatgttaagacattcaatagaaaatagcagtgttaatgtttccttaaccgcgatcgcaaatcaagcaacagtcctaatgggactcgggaagggttggccacttagtaagatggatatcggcgtgccattattggccataggctgttattctcaagtaaaccctataacacttaccgccgcattactactactcgttgcacactacgcgataataggtccagggttacaagccaaagcaacacgggaagctcagaaaagggcagcggcaggaataatgaaaaacccaaccgtggatggaatcactgttattgatttagatccaatcccgtatgatccgaaattcgaaaaacagttaggacaagtaatgctattgatcctatgtgtaacccaagtcctcatgatgcgaacaacatgggcgttgtgtgaagcactaacactagcgacaggaccgatatcaacattatgggaaggaaatcctggtagattttggaatacaactattgcagtcagtatggcaaacatcttccgtggcagttatcttgcaggcgcaggactattattttcgatcatgaaaaatacaacgaatgctcggcgtggcacaggtaatatgggtgagactttaggagaaaagtggaaatcacgcttgaatgctttgggtaaatccgaatttcaaatatacaagaaaagtggaatacaggaagtagacagaacgttagctaaagaaggaataaaaaggggagaaacggaccatcacgcagtatcacgaggttctgcaaagttacgctggtttgttgagcgaaatatggtaacaccagaagggaaagtcgtagacctagggtgtggtaggggtgggtggagctattattgcggaggactaaagaatgttagagaagttaagggtttaaccaagggaggtccaggacatgaagaacccatcccaatgagtacatatggatggaacttggttagattacaatccggggttgatgttttcttcattccacctgaaaagtgtgatacactgttatgtgacattggggaatcgagtcctaacccgactgtagaagctggtagaacactacgagtcttgaatctagtagaaaattggctaaataacaatacccagttttgcataaaggtactaaacccctatatgccctccgtaatagagaaaatggaggcattacaacgcaaatacggaggtgcattggtgagaaatcccctaagccgcaattctacgcacgaaatgtactgggtaagtaatgcgtcaggtaatatagttagctctgtcaatatgatttcccgtatgctgataaacagattcacgatgcgacataagaaagccacgtacgagccagacgtcgatctaggttctggcaccagaaacattggcattgaatccgaaatacctaacctagatataatcggcaagcgcattgaaaagattaaacaagaacatgaaacgtcgtggcattatgatcaagatcatccgtacaagacatgggcttaccacggtagttacgaaacgaaacaaacaggctctgcatcatcaatggttaatggtgtagtaagacttttaacgaagccctgggatgttctacctaccgtaacccaaatggctatgaccgataccactccatttggacagcaacgagtgttcaaggagaaggtagatacgcgaactcaagagccaaaggaaggaacgaagaaactaatgaagattacagctgaatggttatggaaagaattggggaagaagaaaacgcctagaatgtgtacacgagaagagttcaccagaaaagtcagatctaatgcagcattaggcgcaatattcactgatgaaaataaatggaaatctgctagagaagcggttgaggacagtaggttttgggaacttgttgacaaggagagaaatttacatttagaaggcaaatgtgaaacttgtgtatataatatgatggggaaaagagagaagaaattaggtgagttcggtaaagcaaaaggtagccgagcaatttggtatatgtggttgggggctagatttttagagttcgaggctttgggattcctaaacgaggaccactggttctctagagaaaattcgttgtccggggtcgaaggggaagggctacataaattggggtatatcttaagagatgtttcgaagaaagagggtggtgcaatgtatgccgacgatactgccggatgggacacaagaataacattggaagaccttaaaaatgaagaaatggttacaaatcacatggagggggaacataagaaactagcagaagcaatatttaaattaacgtaccaaaataaagtagtccgagtgcaaagaccaacgccccgcggcactgtcatggatataatctcgagaagggatcaaagaggctcaggtcaagtggggacctatggccttaacactttcactaatatggaagctcaattaataaggcagatggaaggcgaaggtgtatttaagaatattcaacatctcactgtgacagaagaagtagcggttcagaactggctcgcccgagtcggacgtgaaagattgtcaagaatggctattagcggagatgactgtgtggttaaaccattggatgataggttcgcgaacgcgttaacagcattaaacgatatgggaaagatacgaaaggatattcaacaatgggaacccagcaagggatggaacgactggacgcaagtaccattttgctcccatcatttccacgaacttataatgaaagatgggcgagtactcgtggttccatgtaggaatcaagatgaactaatcggtagggcaagaatatcacagggtgcagggtggagtttaagagaaactgcttgcctcggtaagtcatatgcccaaatgtggtcattaatgtactttcatcgtagagacctacgcttagcagcgaacgccatatgctcggcagtaccaagccattgggtgccaacgagtagaacgacttggagcattcacgctaaacatgaatggatgactacagaagatatgttaacagtatggaacagagtatggattagggaaaatccatggatggaggacaaaactccagttgagtcatgggaggagataccatatttaggcaaaagagaagaccaatggtgcggtagcttaatcggccttacatcaagagctacatgggccaaaaatattcaggcggcaataaatcaggtccgttctttaataggaaatgaggagtatacagattacatgccctcaatgaaaagatttaggagagaagaagaggaagcaggcgtattatggtaa

SEQ ID NO: 22737 - RNA, 9876 nt, synthetic construct
  misc_feature 1..9876: note = derived and/or modified CDS sequence (opt6) from DENV-2__EU482654__SS-prME
  source 1..9876: mol_type = other RNA
tcagccggtatgataataatgctaataccaacagtaatggcttttcaccttacaacaaggaatggagaaccacatatgatagtgggtattcaagagaaaggaaaatctcttctatttaaaactgaagacggagttaacatgtgcactctaatggcaatggacttgggtgaactatgcgaagacactattacctataaatgtccgttgttacgacaaaacgaaccagaggatatagattgttggtgtaattcaacatctacatgggtcacctatggaacgtgcactacaacaggagagcataggagagagaaaagatcagtagccttggtaccacacgtgggcatgggattggaaacaagaactgaaacttggatgtcttctgaaggagcttggaaacatgcacaaagaattgagacgtggatcttaagacacccaggttttacaattatggctgcaatattagcgtatacaataggcaccacccattttcaaagagtattgatattcattctacttacagcggtcgcaccaagcatgacgatgaggtgcattggaatatcgaacagggactttgtggaaggtgtatctggtgggagctgggtcgatatagttttagaacatggctcttgcgtaacaactatggcgaaaaacaaaccaacattagatttcgaactaataaaaaccgaggctaaacagccagcaaccttacgaaaatattgtatcgaagcaaaactcacaaacacaacaacagagagtcgctgtccgacacagggggagccgtctcttaaagaagaacaagataaaagatttgtctgtaaacacagtatggtggaccgggggtggggtaacggatgtggccttttcggaaaaggcggaattgttacatgtgcgatgttcacatgtaagaaaaatatggaaggaaaaatagtacaacctgaaaatctcgagtatacaattgttgtaacaccacactcaggcgaagaacacgcggtggggaatgacacaggaaaacacggacaggagataaaagtgacaccacaatcatcgattacagaagccgaattaacaggatatggtacagtaacgatggaatgttcacccagaacaggattagactttaatgagatggttttgcttcaaatggaaaacaaagcatggttagtccatcgccaatggtttttggatttgccattaccttggctacccggcgccgacaaacaggagtcaaattggatacaaaaagaaacattagtcacttttaaaaacccgcacgccaagaaacaagatgtcgtagtactaggctcacaagaaggtgcgatgcacactgctttaacgggggcaactgaaatacaaatgtcaagcggtaatctattatttaccggtcacctgaaatgcagattgagaatggataaactgcaacttaaaggaatgtcatattcaatgtgtacgggaaaatttaaggtagtcaaagaaatcgcagaaacccaacacggcactatagtgataagagttcaatacgaaggagacggcagtccatgcaaaattccgtttgaaataatggacttagagaagagatatgtattaggcagattgattacggtcaaccctatcgttaccgaaaaagatagtcccgttaacatagaagcagaaccgccgtttggtgatagttatataattattggtgtagaacccggtcaattgaaactcaattggttcaagaaaggaagctcgatcggacaaatgttcgaaacgacgatgaggggtgctaaaagaatggcgatcttaggggatacagcgtgggactttggatccttgggtggcgtatttacatccataggcaaagcacttcaccaagtatttggtgcaatttacggtgccgcattcagcggcgtgagctggacgatgaaaatattaataggtgtaataataacatggataggtatgaatagtagatccacaagtctctcagtaagcctagttttggtaggcatcgtaacattgtacctaggcgttatggtacaagctgattcagggtgcgtcgttagttggaaaaataaagaacttaaatgtggatctggtatattcattactgacaacgtacatacatggactgaacaatacaaattccaaccagaaagtccttctaaattagctagtgctatacaaaaagcacaggaagaagggatttgcgggattagatctgttacacgactagaaaatctaatgtggaaacaaataacacctgagttaaatcacatattagctgagaatgaagtaaaaatgacaatcatgacgggggacatcaaaggaatcatgcaagcaggtaagcgaagcctacgtccacagccaactgagctcaaatactcatggaagacttggggcaaagccaagatgctaagcactgaatcttataatcagacattcctgatagatggacctgagacggcggaatgtccaaacaccaaccgggcatggaactcactcgaagttgaggattatggatttggcgtctttactacgaatatttggttgaaactaaaagagaaacaagacgcattctgtgacagtaaactaatgagtgccgccataaaagacaacagagctgttcatgcagatatgggatactggattgaatccgccctcaatgacacatggaaaatagaaaaggcaagtttcattgaagtcaaaaattgtcattggccaaagtcccatactctatggtccaatggcgtattagaaagcgaaatgataattccgaagaacttggcaggtccagtaagtcaacataactataggcctggatatcatacacaaatagcaggcccatggcacttggggaaactagagatggatttcgatttttgtgatggcaccacggtcattgtgacggaagattgcggtaatagggggcctagtttgagaaccacaacagcttccggaaaattaataaccgagtggtgttgtagaagttgtacattaccgcctctacgatatcgcggcgaagatggctgctggtacgggatggaaatccgacctcttaaagaaaaagaagaaaatcttgtgaactccttagtaacagcaggtcatggacaagtagacaatttctcattaggggtcctgggaatggccttattcctcgaagaaatgctaagaacacgcgtaggcaccaaacatgctattctattagtggcagtgtctttcgtgaccctaatcactggaaacatgagctttaaggatttaggccgagtagtagttatggtcggagcaactatggcagacgatataggaatgggggtaacgtacttagcattactagctgctttcaaggtcagaccgacatttgcagcaggtttgctactgagaaaactgacttccaaagagttgatgatgacaacaattggaatcgtactgctttctcagtctaccattccagagacagtactcgaactcactgatgcacttgcattaggtatgatggtgttaaaaatagttcgaaacatggaaaagtaccaactagccgtcacaattatggccatcttgtgtgtcccaaacgcagtaatactacaaaatgcatggaaagtcagctgtactatattagcagtcgtatcagtctcgcctctactactgacttcaagtcagcagaaaacagactggatacctctagctttaacaataaaaggtttgaacccgacggctatttttctgacgactttgtccagaactaacaagaaaaggtcttggccactgaatgaagcgataatggcagtaggtatggttagcatattagctagctcgctactcaagaacgatatacccatgacaggccccctagtagcaggaggcctactcacagtctgctatgttctcaccggccgatctgcagaccttgaactagaaagagcaacagacgttaaatgggaagaccaggcggagatcagtggttcatctcctatattaagcataaccattagtgaggatggttcgatgagcatcaaaaatgaagaggaagaacaaactctaacaattttaatccggaccggccttctcgttattagtggacttttcccaataagtattcctataactgccgcggcgtggtacttatgggaggtcaagaaacagagagccggtgtcctatgggacgtaccgtcgcctccccctatggggaaagccgaactggaggatggtgcatatagaatcaaacaaaaggggatcttaggctatagtcaaattggagcgggcgtctacaaagaaggaacctttcatacaatgtggcacgtcactagaggcgctgtattaatgcataaaggaaaaagaatcgaaccaagttgggcggacgtaaagaaagacctcataagttacgggggcgggtggaaattagaaggtgagtggaaagagggagaggaagtacaggtcttagcattagaacccggcaaaaatccaagggcagttcaaacaaaacccggtctgtttaaaactaatactggaacgataggagccgtatcgctggactttagtccaggcacgagcggatctccaatcattgacaagaaaggaaaggtagttggtctgtatggcaatggggtggtaacccgcagcggggcatacgtatcggcgattgcacagacagaaaagtcaatagaggataatccagaaattgaagatgacatattccgcaaaaggcgtttaactatcatggacctgcacccgggtgcaggaaagacgaaaagatacctaccggccatagtccgagaagctataaagcgaggattaagaacgctaatattagcaccaactagggtcgtagctgctgagatggaagaagcgctacgaggcttacccatacgataccaaacccctgccataagggcagaacacactgggagagaaatagtcgatttgatgtgccatgcaaccttcacgatgcgtcttttatcacctgtgagagtacctaattacaacttaataatcatggacgaagcgcactttacggacccagcaagtatcgcagcaagaggttacataagtacgcgagtagaaatgggcgaggccgcaggaattttcatgacagccacaccaccggggagtagagacccttttccacaaagcaacgcacctataatcgacgaagaacgcgaaataccagagagaagctggaactctggtcatgaatgggtaaccgattttaagggcaaaactgtttggtttgtcccctctatcaaggccggaaacgacattgcggcgtgtctccgtaagaacggcaagaaagtgatccaactttcgagaaaaacatttgattctgagtatgttaaaacgagaacaaatgattgggactttgtagtcaccactgacataagtgaaatgggagccaatttcaaggcagaacgcgtaatagacccacgacgttgcatgaagcctgtgattctaacagatggcgaggagcgggtgattttagcaggaccgatgccagtaacgcactcatcagccgcacaaagaagaggtaggattggcagaaatcccaaaaacgagaatgaccagtatatatacatgggagaacctttggaaaatgatgaagactgtgcgcactggaaagaagcaaaaatgctactagataatattaatacgcctgaagggattataccctccatgtttgaaccggaacgagaaaaagtagatgctatcgatggtgaatatagattacgaggtgaagcacgaaaaacttttgtagatttaatgagaaggggagatttaccagtatggttggcttataaggtagctgctgagggtattaactatgcggatagaaggtggtgctttgatggcatcaaaaacaatcaaatactcgaagaaaatgttgaggttgaaatttggactaaagaaggggaaagaaagaaattaaaacctcgctggttagacgctcgtatttatagtgatccgctagccctgaaagagttcaaagaatttgccgcaggccgtaaatccttaacactaaaccttatcacagaaatgggtagactcccaacgtttatgacacagaaaacaagggacgctctggataaccttgccgttcttcataccgccgaagccggaggccgtgcatataatcacgcattatctgaattaccggaaacgcttgaaacactcttactactaacactattagcaaccgtaacaggcggtatattcttgttcctaatgtctggaaggggaataggtaaaatgactcttggtatgtgttgtatcataacagcgtccatactgctatggtatgcacaaatacagccacattggatagcagcctcaattattcttgaatttttccttatagtattacttataccagaaccagagaagcaacgtacacctcaagataatcaattgacttatgtagtaattgcaatcttaactgtagttgcagcaactatggcaaacgaaatggggttcctcgagaaaaccaagaaagacctaggattagggtcgatcgctacccaacaaccggaatctaacatactggatatagatcttaggcccgcatcagcatggacattatacgcagtggccacaaccttcgttacgcccatgttgcgacattccatagagaacagctcagtgaatgtctccttaacggctatagccaaccaggcaaccgtacttatgggattaggaaaagggtggcctctttctaaaatggatattggggtaccactgctagccataggatgttacagccaggtaaaccccataaccttgacagctgcactcctactattagttgcacactatgccatcatcggcccaggccttcaagcgaaggcaacacgagaagcacagaaaagagccgctgctggtattatgaaaaacccaacagtggatggaataacagttatagacttagatccaatcccttatgatccaaaatttgagaaacaattagggcaggttatgttactgatactatgtgttacgcaggtactaatgatgcgtaccacatgggcattgtgtgaagcgctaacattagcaacaggacccatatctactttatgggaaggaaatcctggccgcttctggaacacaacaatagcggtaagtatggcaaatatatttagaggatcatatctcgctggagcagggctattattcagcataatgaaaaatactactaatacgcgtaggggtacaggaaacatgggggagaccctgggagaaaaatggaaatcgaggttaaatacattaggaaaatctgagtttcaaatctataagaaatcgggtatccaggaagttgatagaacgttagcaaaggaaggaataaagcgaggcgagacggatcatcacgcagtatcaaggggatccgctaaattgaggtggtttgtagaacgtaacatggttacccctgaaggaaaggtagttgacttgggctgtggtagaggagggtggagttattattgtgggggtcttaaaaatgttagggaggtaaaaggcctaacaaagggcggtccaggccacgaagaaccaattcctatgtcgacgtatggctggaacctagtacgactacaatctggtgtagatgtcttctttatacctccagaaaaatgcgatacgctattgtgtgacataggggaatcaagcccaaacccgacagttgaagcaggacgaacactacgagtattaaacctagtagaaaattggttaaacaataatacgcaattctgcataaaagttttgaacccttacatgcctagtgtaattgagaaaatggaagcactacaacgaaaatatgggggagcactcgtccgtaatccattgagtagaaactcgacccacgagatgtattgggtaagtaatgcatctgggaacatagtatcaagcgtgaatatgataagccgtatgttaataaatcgatttaccatgcgacataagaaagctacatatgaaccagatgtagatctggggtcggggacacgtaacataggtatcgaaagcgagacgccaaacttagacataattggcaaaaggatagaaaagataaaacaggaacacgaaacttcatggcattatgaccaggatcacccgtacaagacgtgggcatatcatggcagttacgaaaccaaacaaactggtagcgcatcgtcaatggtgaatggagttgtacgtctgcttactaaaccctgggatgttttaccaaccgtaactcagatggccatgacagatacgactccatttggtcagcaaagagtgtttaaagagaaagttgatactaggacacaagaacccaaagaaggaaccaagaaactaatgaaaataacggccgaatggttgtggaaggaactcgggaagaagaaaacaccacggatgtgcacaagggaagaatttacaagaaaagtaagatccaatgccgcactgggggcaatatttacagatgaaaacaagtggaaatcagctagggaagcagttgaagatagcagattttgggagctagtagacaaagaaagaaatttacaccttgaagggaaatgcgagacatgcgtctataacatgatgggaaagagagagaagaaacttggagaatttggtaaagcaaaaggttcccgagcaatatggtacatgtggttaggagcaaggttcctcgaatttgaagccctgggtttcttgaatgaggatcattggttttcgcgggaaaattcgttgagtggtgtcgaaggagagggattacataaactaggatatatattaagagacgtcagcaagaaagaagggggagccatgtatgcagatgataccgcgggatgggatactagaataacgttagaagacctcaaaaacgaggaaatggtaacaaatcatatggaaggagagcacaagaaactagcagaagctatatttaagttaacatatcaaaacaaagtggttagagtacaaaggccaacacctcgcggaacagtaatggatataatctctagaagagatcaaagaggaagcggacaagtaggcacttatggactcaatactttcactaacatggaagctcaactcataagacaaatggaaggagaaggggtattcaaaaatattcaacatctcactgtgactgaggaagtcgcagttcagaattggctcgcgcgcgtaggaagagagagattatccaggatggcaattagcggagatgattgcgttgttaaacccttagacgacagatttgccaatgcactaaccgcactcaacgatatgggtaaaatccgaaaagacatacaacagtgggaaccttccaaaggctggaatgactggacacaggtacctttttgcagtcaccattttcatgaactaattatgaaagatggtcgagttcttgtggtgccatgccggaatcaagatgagttgataggcagagctagaataagccaaggagcaggatggagcttaagagagacggcctgccttggcaagtcttacgcacaaatgtggtcactgatgtattttcatagaagagacctacgtcttgcagcaaacgcaatttgtagtgccgtacctagccactgggtgcctacctccaggacaacctggtccatacatgcaaaacacgaatggatgacgaccgaagacatgctaaccgtctggaatcgtgtctggataagagaaaacccttggatggaagacaaaactccagtggaaagctgggaagaaataccctatcttggcaagagggaagatcaatggtgtggcagcttaatcgggctaaccagtcgagccacctgggctaaaaacattcaagcagcgataaaccaagtaagatccttgataggaaacgaagaatacaccgattacatgccttcaatgaaaagattcagacgcgaagaggaagaagctggtgttctgtggtaa

SEQ ID NO: 22738 - RNA, 9876 nt, synthetic construct
  misc_feature 1..9876: note = derived and/or modified CDS sequence (opt6) from DENV-2__EU482656__SS-prME
  source 1..9876: mol_type = other RNA
tcagcaggcatgattattatgttaatacccaccgtaatggcattccatttaacaactagaaatggagaaccacacatgatagtgggcattcaagaaaaaggtaaaagtctattattcaaaacagaagatggagtgaatatgtgtacattaatggcaatggacttaggagaattatgcgaagatacaataacctataaatgtcccctattacggcaaaacgaacccgaagatatagactgttggtgcaactccacaagtacatgggtcacatacggaacctgtacaacgacaggagaacatcgtagagagaaaagatcggttgcgctagttccgcatgtcggaatggggttagaaacaaggacagaaacttggatgtctagtgaaggagcatggaaacatgcacaacgaatagaaacatggatactaagacacccggggttcacgattatggcagcaatacttgcttacactattggtactacgcatttccaaagagtgttgatttttattttgttgacagcagtagcaccatccatgaccatgagatgtataggtatatccaatcgagattttgtagaaggagtctcaggcggcagctgggtagatatagttttagaacacggaagctgtgttacgacaatggctaaaaacaaaccaacattggactttgaactaattaaaacagaagcgaaacaacccgccacattgcgaaaatattgtatcgaagctaaattgacgaataccaccactgaatcaagatgtcccacacaaggcgaaccatcactaaaagaagaacaagataaaaggttcgtctgtaaacattcaatggtagaccgagggtggggcaacgggtgcggactatttggtaaagggggtatcgtgacatgcgccatgtttacctgcaagaaaaacatggaaggcaaaattgtccaacccgaaaatttagaatacacaatagtagtaacccctcatagtggagaagaacacgccgtaggcaacgatactggtaaacacggcaaagaaataaaagttacccctcaatctagtataactgaagcagaactaacaggatatggcacggtaacaatggaatgttcaccaagaactggtttagattttaacgaaatggtattattacaaatggaaaacaaagcatggttagttcatagacaatggtttctagatttaccacttccttggcttcccggagcggacaaacaagagtcaaactggatacaaaaagaaacattggtgacattcaaaaatccacatgccaagaaacaagacgtggttgtgctgggttcccaagaaggagcaatgcatacggcgctaacgggagccacagagattcaaatgagtagcggcaatcttttattcactggtcacctaaagtgtcgattacggatggataaactacaattgaagggaatgtcatattcaatgtgcacaggcaaatttaaagtcgtaaaagaaatagctgaaacacaacatggaactatagtaataagagtccaatatgaaggggacggaagcccctgtaaaataccttttgaaatcatggacctcgaaaaacggtatgtgctcggaagactaataacagtaaatcctattgtaacagaaaaggattctcccgtaaacatcgaagcagaacctccgttcggtgactcatatataataataggtgtcgaaccaggacaactaaaacttaattggtttaagaaaggtagtagtatcggacagatgtttgaaacaacgatgagaggtgccaagagaatggctatactaggggatactgcgtgggattttggaagtttagggggtgtatttacatcaataggaaaagccttgcatcaagtctttggagcaatatatggtgccgcgttctcaggagtttcttggacgatgaaaattcttataggcgtaataattacgtggattgggatgaactctaggtctacgtcattatctgtgtccctagtgcttgtgggcattgtaacgttgtaccttggagttatggtgcaagcggatagtggatgtgtcgtttcatggaaaaacaaagaacttaaatgcgggagcgggatattcgtaactgataacgtccacacctggacagagcaatacaaattccaacctgagagtcccagcaaattagcaagtgctatacaaaaggcccaggaagaaggtatatgtgggattcggtcagtcacgaggttggaaaatcttatgtggaagcaaataacaccggaattaaatcatatactcgcagaaaatgaagttaaattaacaataatgaccggcgatatcaagggcataatgcaagcagggaagaggtctctccgtcctcaaccgacagagttaaaatacagctggaaaacctgggggaaagcgaaaatgcttagcactgaaagccacaaccaaaccttcttaatcgatggacccgagacagctgaatgccctaacacaaaccgagcatggaactcacttgaagtagaagattacggattcggagttttcacaactaatatttggcttaaattaaaagagaaacaagacgctttctgcgatagtaaattaatgtccgcagccataaaagacaaccgcgcggtgcacgctgacatgggatattggatcgagagtgctctaaatgatacatggaaaattgaaaaagccagttttatagaggttaaaaattgccattggcctaagtcccatacgttatggtcaaacggtgtacttgaatcagaaatgatcattcctaagaatcttgccgggcccgtaagccagcataattacagaccaggttaccacacacagattgcgggtccctggcatctgggtaaactcgaaatggatttcgatttttgtgacggaaccactgtgatagtgactgaggattgtggtaaccgcggcccttcgctaagaacaactaccgcgagtggtaaattgattacagaatggtgttgccgatcttgcactttgcctccactacgctaccgtggtgaagatggttgctggtatggcatggagatacgccctctaaaggagaaagaagagaatctggtgaatagcttagttacagcaggtcatgggcaggtagataatttctcccttggagtattagggatggcactctttctagaagagatgttgcgaactagagtaggtacgaaacacgctatactcctagttgctgtatcctttgtaaccttaataactggaaatatgtcatttaaagatcttggtagggtcgtcgttatggtaggagctaccatggcagatgatataggaatgggggttacatatctagcactattagccgcgtttaaagtcaggcctactttcgccgctggtttacttcttcgaaaattaacgtctaaagaattgatgatgacgaccattggaattgtactgcttagccagtctactataccagagaccgtattagaactaactgatgctctagcgttgggaatgatggttctaaaaatcgttagaaacatggaaaaataccaactagcagttacaataatggctatcctatgtgtaccaaatgcggtcatattacaaaatgcttggaaggtatcatgcacaatattagctgtagtgagcgtatcaccactactactgacatcatctcagcagaaaacagactggataccattggctttaacgataaagggcttaaatccgaccgccatctttcttacaacactgtcacggacaaacaaaaagagatcctggccgctgaacgaggcaattatggcagtaggaatggtttctatactcgcgagttcgcttttaaagaatgatataccaatgactgggcctcttgtggccggtgggctactcacagtatgttatgtcctaactgggagatcagcagatttagaattagaacgggcaacagatgtgaaatgggaagatcaagctgaaatatctgggtccagccctatacttagcattaccatatcagaagatgggtcgatgagcatcaaaaatgaagaagaagaacaaactctaacaattttgatacgaacagggctacttgttatcagtggtttatttcccataagtatcccgataacagcagctgcttggtatttatgggaggtaaagaaacagagagcaggagttctctgggacgtcccgtcacctccccctatgggtaaagcagaattagaagatggagcttatagaataaaacagaaaggaatcctcggttatagtcagataggagctggagtatacaaagagggcacattccatacaatgtggcatgtaacgcgaggggccgtgctaatgcataaaggcaaaagaattgaaccatcctgggcagacgtaaagaaagatctaataagctatggagggggttggaaactagagggcgaatggaaagaaggtgaagaggtacaagtattagctttggagcctgggaaaaatccaagagccgtgcaaaccaaacctggattatttaaaacgaatactggtacaataggagctgtatcactggatttctctcccggcacatctggatcacctatcatagataagaaaggaaaagtggtgggattatacggcaatggtgtcgtaactcgatcaggtgcttatgtatcagcaatagcacaaacagagaaaagcattgaggataatcccgaaatagaagatgatattttcagaaaacggagactcacgatcatggatttacatcctggggcaggtaaaaccaagcgatacctacctgcaatagtaagggaggcgataaagcgaggtttacgcactttaatattagctcctacgagggttgtagcagcggaaatggaagaggcactaagaggactccctattcgatatcagacaccagccattcgagcagaacatacaggtcgagagattgtagatcttatgtgccacgcaacttttacaatgcgtttactatccccagtaagagtgccaaattataacttaataataatggatgaagcacatttcacggatccagcctctatagcagcaaggggctacataagtacgagagtagaaatgggggaggcagcagggatatttatgactgccacaccaccaggatctagagatccatttcctcaaagcaacgcccctattttagacgaggaacgagaaattcctgagagatcttggaacagcggtcatgaatgggtaacagactttgagggtaaaactgtgtggtttgtgccatcaataaaagctggaaatgatatagccgcctgcttacgcaagaatggcaagaaagtaattcaattgtctcgcaaaacgtttgattcagaatacgtaaaaactaggacaaatgattgggatttcgtagtaacaacggatataagtgaaatgggtgcaaactttaaggcggaacgcgtgatcgatccacgtaggtgtatgaagccagtaattttaactgatggggaagaacgagttatattagcaggtccaatgccagtcactcacagctcagccgcacagcgtcgcggacgaataggtagaaaccccaaaaacgagaatgaccaatatatatatatgggtgagccattagaaaatgatgaagattgcgctcattggaaagaagcaaaaatgctattagataatatcaatactcccgaaggaattattccctcaatgtttgagccggaacgagaaaaagttgacgcaatcgatggtgagtatagattgagaggtgaagcaaggaaaacatttgttgatctaatgcggcgtggcgatttacccgtttggcttgcgtacaaagtggccgccgaaggcattaattacgcagatagacgatggtgcttcgacggtatcaaaaacaaccaaatactagaagaaaacgtagaggtcgaaatatggacaaaagaaggcgaacgaaagaaattaaaaccgagatggctagatgcaagaatatactctgatccactggcacttaaggagttcaaggagttcgcagctggtcggaaatcactaaccctaaacctaataacagagatgggcagattgcccacattcatgacacagaaaaccagagacgcacttgataacttagcagttctccatacagcagaagcgggtggtcgagcctataatcacgctttaagtgaattgccggaaaccttagaaacgttactactattaacattattggccaccgtaactggcgggatcttcctattcctaatgtcaggaagaggtatcggaaaaatgacgttaggcatgtgctgtattattactgcatctatacttttatggtacgcgcaaatacaaccacattggatagccgcatccataatattagaatttttcctaattgttcttttaattcctgaaccagaaaaacaacgaactccgcaagacaatcagcttacatatgtcgttattgcaattttgacagtagtggccgctactatggccaatgaaatgggcttcttggagaaaacgaagaaagacttgggcctcggttctgttgctactcagcaacccgagtcaaatatcctggacatagatctacgtcctgcatccgcctggacactatatgcagtcgccactacttttgtgactccaatgttaaggcacagcattgaaaacagctcagttaatgtcagtttaacagcgattgcaaatcaagcgaccgtactaatgggactaggaaaaggatggcctttatcaaagatggatattggagtccccttattggctataggttgctatagtcaggtaaacccaattaccttaacagctgctttgttattattagttgcacattacgcgataattggtcctggtctacaagcgaaggcgactcgagaagcgcagaaaagagcagcagccgggattatgaaaaatccaacggtagacggtatcaccgtaattgatctagaccccataccttacgacccaaaatttgaaaaacaactcggtcaagtaatgttgttgattctgtgcgtgactcaagtcttgatgatgcgtacgacatgggctctatgtgaagcattaacactagcaacaggaccgattagcacactatgggaaggtaatccgggaaggttctggaatacaactatcgctgtaagcatggcaaatatatttcgaggatcgtacttggctggggcaggtttattgttttcaatcatgaaaaatacaaccaatactagaagaggcacaggcaatatgggagaaacacttggagaaaaatggaaatctagattaaacgctttgggaaagtcagaatttcaaatatataagaaatcaggaatacaagaagtcgatcgaaccttagcaaaggaaggaatcaaaaggggagaaacagaccaccatgctgttagccgcggatctgccaaattacgctggttcgtagagcgtaacatggtcactcctgagggtaaagttgttgacctagggtgtggtcgagggggatggtcttactactgcggaggtttgaaaaatgtacgcgaagttaaaggattaaccaaaggtgggccaggccatgaggaaccgatacctatgagcacttacggatggaacctagtgagactccaatcgggggtcgatgtcttcttcatacccccggaaaaatgtgatacattactatgtgatattggcgaatcatcgccaaacccaacagtcgaagctggccgtacactccgagtattgaatttggttgagaattggcttaataacaatactcagttttgtattaaagtactaaacccctatatgccttctgttatagagaaaatggaagcacttcaacgcaaatatggtggagccctagtgcgcaatccactaagtagaaacagtactcatgaaatgtattgggtttcaaatgcgagtggaaacatagtttcgtcagttaacatgatctctcgaatgctaatcaacagattcacaatgcgacacaaaaaggcaacatatgaacccgacgttgacctggggagcggtacacgaaacataggaatagagagcgaaatacccaatcttgatattataggtaaacgaatagagaaaataaaacaagaacatgaaacttcgtggcactatgaccaagatcacccgtacaaaacatgggcataccacggatcttatgaaacaaaacagactggctccgcttcatccatggttaacggtgtagttagattattaactaaaccttgggacgttctccctacagttacccaaatggcgatgacagatacaacacccttcggacaacagagagtctttaaagaaaaagtagacactcggacacaggaaccgaaggagggaacgaagaaactgatgaaaattacagctgaatggttatggaaagaactcggtaagaagaaaacacctcggatgtgtactagagaagagttcacacgaaaagtacgttcaaacgcagccctaggtgcgatttttactgacgaaaataaatggaaatctgccagggaggccgtcgaagactcgcgtttttgggagctagtcgataaagagagaaatttacatctcgagggaaaatgtgagacatgcgtatataacatgatgggaaagagagagaagaaactcggggagttcggcaaagcaaaagggtccagagcaatatggtatatgtggctcggagctagattcttagaatttgaggcactcggttttctcaatgaggaccattggtttagtagagaaaacagtctttcaggggtggaaggagagggcttacataaacttgggtacatactccgagacgttagcaagaaagagggcggtgctatgtatgcagacgacaccgcagggtgggatacaagaataactctggaagatctcaaaaatgaagaaatggttacaaatcacatggagggggaacataagaagctagcagaggcaatattcaaattaacgtaccaaaataaggttgttagggtacaaagacctacaccacgaggaacggttatggacattatcagtaggcgagaccagcggggctctgggcaagtaggaacgtacggtctgaacacattcacgaatatggaagcgcaattaataagacaaatggaaggtgaaggcgtttttaagaacatacaacatttaacagtcactgaagaagtggcagtacaaaattggttagcacgtgtaggcagggagcgactatcacgaatggcgatatcgggagacgactgcgtagtgaaacccctagacgatcgctttgcaaatgcactcaccgctctgaatgacatgggcaagataaggaaagacatacaacaatgggaaccgtccaagggatggaatgactggacacaagttccattttgcagtcatcacttccatgagctcatcatgaaagacggaagggtactcgtggtaccatgtagaaaccaagacgagctgataggacgcgcaagaatttctcaaggagcgggctggtcattgcgagagacagcatgcttaggaaaatcttatgcacaaatgtggtctttaatgtatttccaccgtcgcgatctcagactagcagcaaacgcaatttgctccgccgttccgtcgcactgggtgccgacttcaagaacaacatggagcattcatgccaaacacgaatggatgacaacagaagacatgttaacggtctggaacagagtatggataagggaaaacccatggatggaagataagaccccagtagagtcgtgggaagaaatcccatatttgggaaagcgggaagatcaatggtgcgggagcctgattggacttacctcccgcgctacgtgggcaaagaatatacaggccgcaataaatcaagtaaggtccttaataggaaatgaagaatacacggactatatgccttcgatgaagagatttagacgtgaggaagaagaagctggtgtgctttggtaa

SEQ ID NO: 22739 - RNA, 9876 nt, synthetic construct
  misc_feature 1..9876: note = derived and/or modified CDS sequence (opt6) from DENV-2__EU482657__SS-prME
  source 1..9876: mol_type = other RNA
tcggcaggaatgataattatgcttattccaactgtgatggcgtttcatttaacgactcggaacggcgaaccacatatgattgttggaatccaagaaaaaggtaaaagtctattatttaaaacagaagatggtgtaaacatgtgcacgctcatggcgatggatcttggagaactttgtgaagacaccatcacgtataaatgcccattattacgtcaaaatgaaccagaagatattgattgctggtgcaatagcacatcaacatgggtaacgtacgggacttgtaccacgacaggagaacatcgaagagagaaaaggagtgtagctctagtgccgcatgttggtatggggctcgaaacacgaacagaaacttggatgagtagcgaaggcgcgtggaaacacgctcaaaggatcgaaacatggataatgagacacccagggtttactattatggcagcaatactagcatacaccataggaacaacccatttccaacgagttttaatatttatactactgacagctgtcgcgccaagtatgacgatgcgctgtattggaatcagtaacagagatttcgtggaaggggtaagcggaggatcgtgggtagatatagttctcgaacacggctcctgtgtaacgactatggctaaaaataaacctacacttgacttcgagctaattaaaacggaagcaaaacaaccggctactttaagaaaatattgcatagaggcgaaactaacaaatacaacaacagaatcacgatgtcccactcagggtgaaccctccctaaaagaagaacaagacaaaagatttgtttgtaaacatagcatggtggaccgtggatggggaaatgggtgcggactgttcggtaaaggaggaattgttacctgtgctatgtttacctgcaagaaaaatatggaaggaaaaatagttcagcctgaaaaccttgagtatacaatagtagtaactccacattccggagaggagcatgcagtagggaacgatacaggcaaacatggtaaagagatcaaagtgactccacagtcttcaatcactgaagcagagttaactggctatgggacggtaacaatggaatgttcccccagaactggcttggatttcaacgaaatggtacttctccaaatggaaaataaagcatggcttgtacatagacaatggttcttagacttaccgctaccatggttgccaggtgctgacaaacaagaatcaaattggattcaaaaagaaacacttgtgacatttaaaaacccgcatgccaagaaacaggatgtagttgttctaggatcacaagagggggcaatgcacacagccttaactggggcaacagaaattcagatgagctcagggaatttactttttaccggacatttaaaatgtagacttcgcatggataaactccaattaaaaggaatgagttattctatgtgcactggtaaatttaaagtagtcaaggaaattgcagaaactcaacatgggactatagttatacgagtacaatacgaaggcgacggatcaccttgcaagatcccatttgaaataatggatctagagaaaagatacgtacttggaagattaattaccgttaacccaatagttactgaaaaggattctccagttaatattgaggctgaaccaccttttggtgatagttatatcataataggagtagagccaggacaactcaagctaaactggttcaagaaaggtagtagcataggccagatgtttgaaactacaatgagaggtgccaagaggatggcaatattgggagatacagcctgggactttggtagcctgggcggagtattcacaagcatcggaaaagcactccatcaagtgtttggtgcaatatacggagcagccttcagcggagtaagctggactatgaaaattctaataggagttataataacttggataggtatgaactcacgatctacttctctcagtgtgtctttggtcctggtcggaatagtaacgttgtaccttggcgtaatggttcaagcagactctggttgtgttgtctcatggaaaaacaaggagttaaaatgcggaagcggaatctttattactgacaatgtccacacatggacagaacaatacaagtttcaaccagaaagtccctcgaaattagctagtgcaatccaaaaagcacaagaagagggtatatgtgggatccggtccgtaacaagacttgaaaatttgatgtggaagcagatcacacccgaattgaatcatatactagcagaaaatgaggtcaaattaaccatcatgacaggagatattaggggaattatgcaagcaggaaaaagatcactaagaccacagccaacggagctaaaatatagctggaaaacttgggggaaagcgaaaatgctatcaacagaatcttataaccaaacatttttaatcgacggccctgaaacggctgagtgtcccaatacaaaccgagcatggaatagtcttgaggtagaagattacgggttcggtgtatttacaactaatatatggctaaaattgaaagaaaaacaggatgcgttttgtgacagcaaacttatgagcgccgcaataaaagataacagagctgtacatgcagatatgggttactggatggaatccgccctaaacgacacttggaagatagaaaaagcgagttttattgaagtcaaaaattgtcactggcctaaaagtcatacgctatggagcaatggtgtattagaaagcgaaatgattatacctaagaatcttgcaggaccagtatcgcaacataactatcgcccaggataccacacacaaatagcgggcccttggcacttgggaaaattagaaatggactttgatttttgtgatggcacaacagtgatcgtaacagaggactgcggaaaccgaggacctagtttgaggacgacaaccgcctccgggaagctaataacggaatggtgttgtcgaagttgcacacttccgcccctaagatatagaggggaagatggatgctggtatggaatggaaatacgaccacttaaagaaaaagaggagaatttagtcaacagtctagttacagcaggacatggacaagtagacaatttttcactgggtgtattaggtatggcgctatttcttgaggaaatgctacgtactcgagtaggcacaaaacacgcaattttattggtagcggtttcgtttgttacactaatcactggcaatatgagttttaaagacttgggcagagtagtcgtcatggtaggggcaaccatggcagacgacataggcatgggggtaacatacctcgctttgttagcagcatttaaagtgcgacccacattcgcagccggactattattaaggaaattaacctccaaagagctcatgatgaccactattggtatagtgttactatcacaaagtacaataccggaaacagtacttgaattgacagatgcgctcgcattaggcatgatggtactaaagatagtgagaaacatggaaaaataccaattagcagtaacaattatggcaattttatgcgtgccaaatgcagttatacttcaaaatgcttggaaagtttcgtgtaccatactggcagtggtcagcgtaagtcccctattactcacatcgagtcaacagaaaactgattggataccgctcgcgttaactatcaagggtttgaatccgacagccatatttctgaccacactgagcagaactaataagaaaagatcttggcccctaaatgaagccataatggcggtaggcatggtatcgatactggcctcttcactacttaagaatgacatacccatgaccgggcctttagttgctggtggactattgaccgtatgttatgtgttgactggaagatccgcagacctagaattggaacgtgctactgacgttaagtgggaagaccaagcagagattagcggttcgagccctatactatcaataaccatatcggaggatggatcaatgtctatcaaaaatgaagaagaagaacagactctaaccattctcatacgtacaggacttctagtgatctccggtctcttccccataagcatacccattacagcggcggcctggtatttatgggaagttaagaaacaaagagcaggcgtattatgggatgtgcctagtccgccccctatgggaaaagcagaattggaagatggagcataccgtataaagcaaaaagggatcctaggatattcacaaattggagcaggcgtttacaaagaaggtacctttcacacgatgtggcatgtaactcgaggagcggtactaatgcacaaaggaaagcgcatagaaccaagctgggcggatgtcaagaaagatttaatatcatacggaggaggatggaaattagaaggcgagtggaaggagggagaggaagtacaggtactggcgttagagccgggcaaaaatccaagggctgttcaaacaaaaccaggattatttaagacgaacacaggaacaataggtgccgtctcattggacttttcacctggaacaagtggaagtccgatcatagacaagaaagggaaagtagttggtctatacggtaacggagtagtaaccagaagtggagcatacgtaagcgcaatcgcccaaacagaaaaatcaattgaggataatccagaaatagaagatgacattttcaggaaacgcaggcttacaatcatggatctacatccaggtgccggcaagactaaaagatacttgccagcgatcgttcgggaggcaataaaaagaggattacgtacattgatcttagcacccacgagggttgtagctgccgaaatggaagaagcccttcgtggtctccctattaggtatcaaacccctgcaataagagcagaacatacaggtcgggaaatcgtcgatttaatgtgccacgcaacattcacgatgagacttctaagtccagttcgcgtaccgaattacaatttgataataatggatgaagctcacttcacggatcctgctagcatagccgcacggggatacatcagtacaagagtcgagatgggtgaagcggctgggatatttatgacggcaactcctcctggatcacgagaccccttcccacaatcaaatgcgcccattatagatgaggaacgcgaaatacctgaaagatcatggaacagcggacacgaatgggtcactgatttcaagggaaaaacagtgtggttcgtccctagcataaaggcaggtaatgatatagccgcatgtctaagaaagaatggcaagaaagtaatacaactgagtagaaagacttttgactctgagtatgtaaagactaggacaaacgactgggattttgtagtaacaacggatatatccgaaatgggtgcaaactttaaggcagagcgcgtgatagatccacgacgctgcatgaaaccagtaatactgactgacggtgaagaacgggttatcttagcgggaccgatgcctgtaacacactcatcagctgctcagcgaaggggaagaatcggacgcaacccaaagaatgagaatgatcaatacatatatatgggtgagccgctagaaaatgatgaagactgcgcacattggaaagaagcaaaaatgctattggacaacatcaatactccggagggaataataccaagcatgtttgaaccagagcgtgaaaaagttgacgcaattgatggagaatatagattacgaggtgaagcgcggaaaacattcgtagatctcatgcgccgtggagacctaccggtttggttagcatataaggtcgcagcagaaggcataaactatgcggaccgtcggtggtgcttcgatggtatcaaaaataatcaaatcctagaagaaaatgttgaagtagaaatttggactaaggaaggggagaggaagaaactaaaaccaagatggctcgatgcgagaatttactcagatccattagcccttaaggagttcaaagaatttgcagccggtcgaaaatcgttaacactgaatctgattacagaaatgggacggctcccaacatttatgacacagaaaactagagatgccctagacaatctggcagtattacatacagctgaagctggtggacgagcatataatcatgctctgtcagagttaccagagacattagaaaccttgttactgctaaccttgctagctacggttacgggcggcattttcctgtttttgatgagcggtcgaggaataggtaagatgactctgggaatgtgttgcattattactgcttcaaccttactatggtacgcacaaatacaaccacactggatcgccgcttccataatactagagttctttctaattgtgttgttaataccagaacctgaaaaacaaaggacgccccaggataaccaacttacttatgtagtgatagcaatactaacggtagtagcagcaacgatggcgaatgagatggggtttctggagaaaacgaaaaaggatttaggcctaggatctatagcgacacagcaaccagaatcaaacatattagatatagatctgaggcctgctagcgcatggactctatacgcggtagcaaccacatttgtaaccccaatgttaagacatagtatagaaaatagctccgtgaacgtgtcattaacagctattgcaaaccaagcaacagtattgatgggactaggcaaaggatggccgttatctaagatggacatcggtgtacccttattggcaattgggtgttactctcaggttaacccaataacattgactgcagcgttactgttactggttgcacattacgcgataatcgggcctggactacaggccaaagctaccagagaggctcaaaagagggctgctgctggaatcatgaaaaatccgaccgtcgacggtattactgtaatagacttggatccaatcccttatgacccgaagtttgaaaagcaactggggcaagtaatgctattgatactatgtgtaacgcaagttttaatgatgagaacaacatgggcactatgtgaggcactaactcttgcaacaggtccaatatcaacactttgggagggaaacccaggtagattttggaatacgacaattgcggtttcgatggcaaatatattccgaggaagctatttggcgggggcaggattactattctcaattatgaagaatacgaccaacacacggagaggaaccggaaatataggagagacactaggagaaaaatggaaatcacgtcttaatgctctaggtaaaagtgagttccagatttacaagaaatcaggaatacaggaagtcgatagaaccttggcaaaagaaggaataaaaagaggggaaacagatcatcatgcagtaagtagaggctcagcaaaacttcgttggttcgtggaacgaaacatggttacacctgagggaaaagtcgtagacctaggctgtggaagaggaggttggagttactactgcggtgggcttaaaaatgtacgcgaggttaaagggctaactaaagggggtcccggccacgaggaaccgattcctatgtcaacatatggttggaatctggtcagattacagtcgggcgtcgacgttttctttataccacccgaaaaatgtgatacgctcttgtgtgacattggtgaatcttcaccgaatccaacagtagaggcgggaaggacactcagagttctcaatctagtagagaactggttgaacaacaatacacagttttgtataaaagttttaaacccttatatgccgagtgttatagagaaaatggaagcactgcaaagaaagtacggaggagcactggttagaaatcccctgagtcgaaattctacacacgaaatgtactgggtatctaacgcatctggaaatatagtatcatctgtaaacatgatttctagaatgcttatcaaccggtttacaatgcgccacaagaaagcaacttatgaaccagatgtggacctaggatcaggaacacggaacatcggtatcgaatctgaaataccaaatcttgatattattggaaaacgcatagagaaaatcaaacaagagcatgaagcatcctggcattacgaccaggaccatccttataaaacgtgggcatatcatggaagttacgaaaccaaacagaccggaagtgccagtagtatggttaacggtgtagttcggcttttaacgaagccatgggacgtactgccgactgtaacgcaaatggctatgacggatactacgccgtttggacaacaaagagtattcaaagaaaaagtcgatacgagaacacaagagccaaaagaaggaaccaagaagttaatgaagataactgcagaatggctctggaaagaactcggcaagaagaaaactcccaggatgtgcacaagagaagagttcactcggaaagtgcgtagtaacgcggcgttaggcgcaatttttacagatgaaaataagtggaaatcagctagagaagcggtagaagatagccgattttgggaactggtagataaagaacgcaaccttcacttggaaggtaaatgtgagacgtgcgtttataatatgatgggtaaacgagagaagaaactaggtgaatttggaaaagcaaaagggagtagagctatatggtacatgtggctaggagcaagatttcttgaatttgaggctttaggttttctaaatgaagaccactggttctcaagggaaaattcactaagtggagtcgaaggtgaaggtttacataaactaggatatatcttaagagatgtctctaaaaaggaaggtggtgcaatgtacgcagacgacacagccggatgggatacccgtatcactttagaagatctaaagaacgaagagatggtaacgaatcacatggaaggggaacataaaaagttagcggaagcaatctttaaacttacataccaaaataaagtagtacgagtacaaagacctacaccacgaggaactgtaatggatatcatatcgaggagagatcagcgcggctcaggccaagtgggaacttatggattgaatacattcaccaatatggaagcgcaactaatccgacaaatggaaggagaaggtgtatttaagaacattcagcaccttacagtaactgaggaagtagcggtgcataattggttagcgagagttgggcgagaacgtcttagtaggatggccatttcaggagatgattgtgttgtgaagcccctggatgatcgatttgcgaacgctctgaccgcgctaaacgatatgggaaagatacgaaaagacatccaacaatgggaaccaagtaaagggtggaatgactggactcaagttccattttgtagtcatcatttccatgaattaattatgaaagatggccgagtcttagtagttccgtgccgaaaccaagatgaactgattgggagggctaggataagtcaaggtgccggatggtccttaagagagacagcatgccttggaaaaagctatgctcagatgtggtcattgatgtattttcataggcgggacctccgcttagcagcaaacgcgatatgctcggccgtaccatcacactgggtgccaacaagtcgaacaacttggtctatacatgcaaagcatgaatggatgacaactgaggacatgttaactgtctggaaccgtgtctggatacgggaaaatccgtggatggaagacaagacaccagtagaatcttgggaagaaataccctacttaggcaaaagagaagatcaatggtgcggctccttgattggactcacgagtcgtgcgacatgggcgaagaacatccaggccgcgatcaatcaggtcaggagcttaataggaaatgaagaatatacagactacatgccatccatgaaaagattccgacgagaagaagaagaagcaggggtactttggtaa

SEQ ID NO: 22740 - RNA, 9876 nt, synthetic construct
  misc_feature 1..9876: note = derived and/or modified CDS sequence (opt6) from DENV-2__EU482658__SS-prME
  source 1..9876: mol_type = other RNA
tctgcggggatgataatcatgttgattcctacggtgatggcatttcatttgacaactcggaatggtgaaccccatatgatcgttggaatacaggaaaaaggaaaaagccttctcttcaaaaccgaagacggagttaatatgtgcacgctaatggccatggatctgggtgaactctgtgaagacacaataacttataaatgtcccctactccggcaaaacgaaccagaagatatagactgttggtgtaactcaacaagcacttgggtaacatatggaacttgcacaacgacaggggaacataggcgagaaaaacgaagtgtagcactggtgccacacgtaggtatggggctagaaaccagaaccgaaacctggatgagttcagaaggggcttggaaacatgcacagagaattgaaacgtggatccttagacacccgggattcacaatcatggcagcaattctcgcatacactattgggacaacacacttccaacgggtattgatatttattctcttaacagcagtcgccccatccatgaccatgagatgcataggaattagcaatagagatttcgtcgaaggggtctctggaggaagttgggttgatatcgtcctagaacatggatcgtgtgtaacgacgatggccaaaaataaaccgactttagatttcgaattaatcaaaaccgaagcaaaacagccagcaactctaaggaaatattgtatcgaggccaaattgaccaatacaacgaccgagtcgcgatgtccaacacaaggcgaaccaagccttaaagaagaacaagacaaacggtttgtgtgtaaacactcaatggtagacagaggatggggtaatggatgtgggttatttggcaaaggaggaatagttacgtgtgcgatgtttacatgtaagaaaaacatggaaggcaaaatcgttcaaccagaaaatttagagtatacaattgttgtaacaccacactctggagaagaacacgcagtaggtaatgatacaggcaaacatggaaaagagataaaagttacaccacaatcttccattacagaggctgaattaactggatacggcactgttacaatggaatgttcacctagaactggtctagatttcaatgaaatggttttactacaaatggagaataaagcatggcttgttcacagacagtggttcttagacttacctttgccctggttgccgggtgcagataaacaagagagcaactggattcaaaaagagaccttagttactttcaaaaaccctcacgcgaagaaacaagacgtaatagtattaggttcacaggaaggagcaatgcatacagcactcacaggtgcaactgagattcaaatgagttcggggaacctattattcactggtcatctaaaatgtagactgaggatggataaactacaactgaaaggtatgtcatacagcatgtgcactggaaaattcaaagtagttaaagaaatagcagaaacacaacatggaacaattgtgattagggttcaatatgaaggcgatggatctccttgcaaaattccgttcgaaattatggatctcgagaaacggtatgtactaggaagactgattacagttaatccaattgtaacagagaaagattctcctgtaaacatagaggcagaaccaccatttggagactcatacattatcatcggagtagaaccaggtcaactaaaattgaattggtttaagaaagggagcagcatcgggcaaatgtttgaaacaacaatgagaggggcaaaaaggatggcgatattgggggatacagcatgggattttggatccctaggtggtgtgtttacctctatcgggaaggctttacatcaagtatttggagcaatctatggggctgcattttcaggagtatcttggacaatgaaaatcctcataggagtgattattacttggattggcatgaactcacgatcgacatcattatcagttagtcttgtcctggtcggcattgtaacgctctatctgggagtaatggtacaagctgactcgggatgcgttgtaagttggaagaataaggaactcaagtgtggaagtggtatatttataactgataatgtacacacctggactgaacaatataaatttcaacctgaatcaccaagtaaattagcatccgccatacaaaaggctcaagaggaagggatctgtggcattcgtagtgtaactagacttgaaaatttgatgtggaaacaaattaccccagaattgaaccatatcctagccgagaatgaggtcaaattaacaataatgaccggagatattaaaggtatcatgcaagcagggaaacggagcctaagaccacagcctacagaactaaaatatagttggaaaacttggggtaaagccaaaatgctgagtaccgaatcatataatcagacgttcttgattgacggacctgaaaccacagagtgtccaaataccaatcgggcatggaactccctcgaagttgaagactatggatttggggtgtttactacaaacatatggctaaaattaaaggaaaaacaggatgcattctgcgattccaaacttatgagcgcagctataaaagataacagggcagtacatgcagacatgggttattggatagagtccgccttaaatgatacatggaaaattgagaaagcatcgtttattgaagtcaaaaactgtcactggccaaagagtcacactctttggtccaacggagtactagaaagtgagatgataatacccaaaaatctggctggtccggtcagtcaacataattacaggccaggataccatacgcaaatagcaggtccatggcacctcggaaaactagagatggatttcgacttttgcgatggaactacagtgatagtcacggaagattgtggaaataggggccctagcttacgtacaactacagcgtcggggaaactaattacagaatggtgttgtaggtcgtgtactttaccacccctaagatatagaggggaagatggttgttggtatgggatggaaatacgaccactcaaagaaaaagaggaaaacctagtcaattctttggttaccgctggtcatggtcaagtagataattttagcctaggagttctaggaatggctttattccttgaagaaatgttgaggactagggttggcacgaaacacgccatattactcgtcacagtaagtttcgttacactcataacaggaaacatgtcatttaaagatctaggcagagtggtagtaatggtaggtgccacaatggcagatgatattgggatgggcgtcacctacttagcattgctagctgcctttaaagtaaggccaacgttcgcagccggattgttattgagaaagttaactagcaaagaactaatgatgacaacaattgggattgttcttttatcccaatccacaattccagaaaccgttctagaacttaccgacgcactcgcactcgggatgatggtccttaaaattgtccgcaatatggaaaagtaccaattagctgttacaattatggctattctatgcgtaccaaacgcagttatacttcaaaacgcttggaaagtatcgtgtacgatactagcagtagtgagtgtgtcgccactattattgacaagctcgcaacaaaagacagactggatacctcttgcactcacgattaaaggtcttaatccaaccgcaatttttcttacaactctctcaagaacgaataagaaacgatcgtggccgctaaatgaagctattatggcagtgggcatggtaagtatcttagcaagctcgttactcaaaaacgatattccaatgacaggaccattagttgctgggggtttactaactgtttgttacgttttgacgggcagatctgctgatttagaactagaacgcgcaacggatgtgaaatgggaagaccaagccgaaattagcggaagctctccaatcctgtcaataacgatctcggaggatgggagcatgtcaattaaaaatgaggaagaagaacaaactttaactatattgattcgaacaggactattagttatttcaggcttgtttcccatttctatcccaattaccgcagctgcgtggtatttgtgggaagttaagaaacaacgtgctggtgttctctgggatgttccctccccaccccctatggggaaggcagagttagaggacggagcatacaggataaagcaaaaaggtatacttgggtatagtcaaattggagcaggggtatataaggaaggtaccttccatacgatgtggcatgttacgcgtggggctgtattaatgcataaggggaaaagaatagagccttcttgggcagatgtcaagaaagatctcatttcttacggaggaggctggaaactagaaggtgaatggaaggagggggaagaagtacaagttttggcgctagaacctgggaaaaatccaagggcggttcagactaaacccggtctttttaaaaccaacaccggtacgattggggccgttagtttggatttttctccaggcacgagtgggtcgcctataattgataagaaaggaaaggtggttggcttgtatggaaatggggttgtaacccggagtggagcatatgtttctgcaattgcacagaccgagaagtcgatagaagataatcctgaaattgaagacgatattttcaggaaaagacgactaaccattatggatctacatccaggcgctggcaaaaccaaaagatacctcccagctatagtgcgagaggcaattaaacgaggactacggacactaatattagctccaaccagagtagttgcggcggaaatggaggaagccttaagaggcttaccaatccgatatcaaacaccagcaatcagagcagagcatactggccgagaaatcgtggatctgatgtgtcatgccacgttcactatgagattattatcgccggtacgcgtgcctaattacaatctcattataatggatgaggcgcatttcacagacccggcgagtatagcagcaagaggatacatatcaaccagagttgaaatgggcgaagccgctggtatattcatgacagcaactccaccaggaagtcgagatcctttcccgcaaagtaatgctccaatcatagatgaggaacgcgaaatacccgaacgttcttggaactctggtcatgagtgggtaactgacttcaaaggaaaaacagtttggtttgtaccatcgatcaaagcaggcaatgacatagcagcatgtttgcgtaagaatggtaagaaagttatacaattgtcaaggaaaacattcgatagtgaatacgtaaagacaagaacaaatgattgggattttgttgttacaacagatatatcagaaatgggcgccaattttaaagcagaacgcgtaattgatccgaggcgttgtatgaagcccgtgatattaacagacggagaagaacgagttatcctcgctggaccaatgcccgtaacacatagtagcgccgcccaacgaagaggacgtataggtaggaatcctaaaaatgaaaacgaccagtatatttacatgggggagcctctagaaaatgatgaggattgcgcccattggaaggaggccaaaatgttgcttgataacataaatacaccagaaggaattattccatctatgttcgaacccgagcgggagaaagttgacgccatagatggggagtacagattaaggggtgaggctcgaaaaacgttcgtcgatctgatgcgccgaggcgacttaccagtatggttggcatacaaagtagctgctgagggcataaactatgctgacaggcgatggtgttttgacggtatcaaaaataatcaaatactggaggagaatgtagaagtagagatttggacaaaagaaggtgaaaggaagaaattgaagccacgttggctcgatgcacgaatatattcggatcccttagccctaaaggagttcaaggaatttgcagccggaagaaaaagcctaacactcaatttaattacggagatgggacgactaccaacatttatgactcaaaagacacgtgatgcactagacaatcttgcagtattgcacacggctgaagctggaggtagagcatataatcacgccctttcagaattaccagaaacccttgaaaccttacttttattaacgttactcgcaacagtaaccggtggcatatttctatttctcatgtcgggccggggcattggaaaaatgacactaggaatgtgttgcatcataacggcatcaattctattatggtacgcacagattcagccacactggatagcagcgtcaataatattagaatttttcttaattgtgttattaataccggaaccagaaaaacaaagaacaccccaagataaccaactaacatatgtagtaatagcgatactcacagttgtcgcggcgaccatggcaaacgagatgggtttcttagaaaagaccaagaaagatcttggacttggatctatcgcaactcagcaaccagaatccaatattcttgacatagacttaaggccggcttcagcatggactctctacgccgtagcaacaacatttgtgacccctatgttgagacatagtattgagaactcaagtgtaaatgtatctctaacagcaatcgcaaaccaggctactgtccttatgggactaggtaaggggtggccactgagcaaaatggatattggagtgccactgctagccattggatgctattctcaggttaatccaataacgctcactgcagcgttattactcttagtcgcacattacgcaataataggtccaggcctgcaagcgaaagctacacgagaagcccagaaaagggcagccgctgggataatgaaaaaccctacggttgacggtatcactgttattgatctagaccccattccatatgaccctaaattcgaaaaacaattagggcaagtgatgttattgatcctttgtgtaactcaagttctcatgatgaggactacatgggcgttatgtgaagcgctaacacttgcgacgggcccaatctccacattatgggaaggaaacccgggaaggttttggaataccactatagctgtatctatggcaaacatatttcgaggatcatacttggcaggcgcaggtcttctcttctcaatcatgaaaaacaccactaacactagaagaggaaccggcaacataggtgagactctcggtgaaaaatggaaaagtcgattaaatgcacttggtaaatccgaatttcaaatatataagaaaagtggaatacaagaggtcgacagaactttggcaaaagaaggtataaaacgaggtgagacagaccatcatgcagtatcccgcggcagtgccaaactaaggtggttcgtagagcgtaatatggtgacacccgaaggtaaagttgtcgacctgggatgtggtcgaggtggatggagctactattgtggagggctaaagaatgttcgagaagtaaaaggtttaacaaagggaggaccaggccacgaggagcccataccgatgagtacgtacgggtggaacctcgtcagactacagtccggagttgatgtattctttatccctccagaaaaatgtgacacattgttatgcgatataggcgagtccagtcctaatcccacagtagaagccgggcgaacgttacgggttttaaatttagttgaaaactggcttaataacaatacgcaattttgcataaaagttttaaacccttacatgccttcggtaatagagaaaatggaggcattacaaagaaaatatggaggtgctcttgtaaggaatcccctatccagaaattcaacacatgaaatgtattgggttagcaatgccagtggaaacattgtgtccagtgtaaatatgataagcaggatgttaattaatagattcacaatgagacataaaaaggccacctacgaacctgacgtagaccttggatctggaactcgaaacataggtattgaaagcgaaattccaaatctagacattattggaaagagaatagagaaaataaaacaagaacatgaaaccagttggcattatgaccaggatcatccatataaaacttgggcttatcacggctcttatgaaactaaacaaacgggcagtgcttcatcgatggtaaacggggtggttagactattaactaaaccttgggatgttttgcctacagtcacacagatggcaatgactgatacaacaccttttggccaacagcgcgtgttcaaagagaaagttgatacgcgaacacaggaaccaaaagagggcactaaaaagttaatgaaaataacagcggaatggttatggaaagagctaggcaagaagaaaacaccacgaatgtgtacacgtgaagagttcacacgaaaagttaggtcaaacgccgcattaggtgcaatatttaccgacgagaacaaatggaaatctgcaagagaagcagttgaagattctaggttctgggagttagtcgataaggaacgcaatctccatctagaaggaaaatgtgaaacatgcgtatacaacatgatgggtaaacgggaaaagaaactaggtgaatttggtaaagcaaaaggatctagagccatttggtacatgtggctcggagcacgctttcttgagttcgaggctttaggatttttaaatgaagaccactggtttagtcgagaaaattcactgtctggggtagaaggagaaggtcttcacaaattgggttatattttgcgcgatgtttctaaaaaggaagggggagcaatgtatgctgatgatacagccggatgggatactcgaataacgctggaagatctcaagaacgaagagatggttacaaaccatatggaaggggaacataagaaactggcagaagcaatttttaaactgacataccaaaataaagtagtaagagtccagagaccaactccacgtggcaccgtgatggatataatctcgaggcgagatcagaggggatctggccaagtaggaacgtatggtttgaatacatttacaaacatggaagcacaattaattcgacaaatggaaggtgagggagtattcaaaaatattcaacacctcactgtaacggaagaagtagcagttcaaaactggcttgcaagagtaggtagagaaagactttctcgaatggctattagcggggacgattgcgtcgtgaaacctctagatgataggtttgcgaatgcactgacggcactaaatgacatggggaaaatccgtaaagatatccaacaatgggaacccagcaaaggatggaatgattggactcaagtaccattttgcagtcaccactttcatgagttgataatgaaagatgggagagttctagtagtcccctgcagaaatcaagatgagcttataggcagggctagaatttcccaaggtgcgggttggtcccttcgagaaacagcctgcctcggtaagtcatatgctcagatgtggtccttaatgtattttcacagacgcgatctacgactagcagccaacgcaatctgctcagcagtcccaagtcactgggtacctacaagcagaacaacgtggagtatacatgccaaacacgaatggatgacaacggaagacatgttaaccgtctggaatcgagtctggattcgagacaatccatggatggaggacaagactccggtggagagctgggaagaaatcccatatttaggcaaaagagaagatcaatggtgcggatcactgataggattgacttcacgtgcaacttgggctaagaatattcaagctgctattaatcaagttcgttcacttattgggaatgaagagtataccgactatatgccttcaatgaaaagatttcgacgagaagaagaggaagccggtgttttatggtga

SEQ ID NO: 22741 - RNA, 9876 nt, synthetic construct
  misc_feature 1..9876: note = derived and/or modified CDS sequence (opt6) from DENV-2__EU482659__SS-prME
  source 1..9876: mol_type = other RNA
tcagcaggtatgataataatgctcatcccaacggtaatggcttttcatctcacaactagaaacggtgaaccacacatgattgttgggatacaagaaaaagggaaatcgctactatttaaaactgaagatggggtaaacatgtgcacgttaatggctatggatctaggtgaattgtgtgaagatactattacatataaatgtccactgctaagacaaaacgaaccagaagatatagactgttggtgcaacagtacttcaacttgggtaacttacggcacatgcacgactacgggggagcatagaagagaaaaacgtagtgtagccttggtcccacatgtaggaatgggattggagacacgaactgaaacgtggatgtcatcagagggggcttggaaacatgctcaacggattgaaacttggatactgcgacacccaggattcacgattatggctgcaatcctagcctacacaataggaacaacacattttcaacgcgtgcttatatttattctattaacagccgttgcaccatcaatgacaatgagatgcataggtatatccaaccgggactttgtagaaggagtaagcggtggttcctgggtagatatagtattggagcatggctcttgcgttacaaccatggccaaaaataaaccaacactcgatttcgaattgataaaaacagaggcaaaacaaccagccaccttacgtaaatattgtatcgaagctaaactgacaaatacaaccacggagagccgatgtcctacccaaggagagccttcattaaaagaggaacaggataaacgcttcgtttgtaaacacagtatggttgaccggggttggggaaacggatgcggactcttcggtaaaggaggaatagttacatgtgcaatgttcacttgtaagaaaaatatggaaggcaaaattgtacaacccgaaaatttagaatacacaattgtcgtgactccgcatagtggagaggagcatgcagtcgggaatgatacaggtaaacacggtaaggagattaaagtcaccccacaaagttccataaccgaggcggaactcacagggtatgggactgtaacgatggagtgttcacctagaactggccttgattttaacgagatggtattattacagatggaaaacaaagcatggttagtgcatcgacaatggtttttggatttaccccttccgtggttacctggagctgataaacaggaatcaaattggattcaaaaagaaacacttgtgacatttaaaaatccacacgccaagaaacaggacgtggtagtcttaggcagccaggaaggtgctatgcacacagcacttacgggggcgacagaaattcaaatgtcaagtggaaatttgctattcacaggacacctaaagtgtagattgcgaatggacaagctgcagctgaaagggatgagttatagtatgtgcaccggtaaatttaaagtcgtcaaggaaatagcggaaacacaacacggcactattgtgatacgagtccaatatgaaggcgatggctcaccctgcaaaattccattcgagattatggacttggagaaaaggtatgtcctcggcagacttataactgtaaatcccatcgtaacagagaaagattcgcccgtgaacatagaagctgagcctcctttcggagactcttatattataatcggagtagagcctggacaactgaaactgaactggtttaagaaagggagtagcataggacaaatgttcgagacaaccatgcggggagctaaaagaatggcgattctaggcgacacggcatgggactttggatcgcttggcggggtattcacctctataggaaaggcactacaccaagttttcggagctatatatggagcagcatttagtggtgtgagttggaccatgaagatacttattggagtaattataacatggataggaatgaactcgaggtcaacttcattaagcgtatcactggtcttagtaggaattgtaacattatacttgggtgtaatggttcaagctgatagtggctgtgttgtaagttggaaaaataaggaacttaaatgtggaagtggcatatttataacagacaatgtccatacttggacggagcaatacaaattccaaccagagagtccaagtaagttggcttcagcaattcagaaagcacaagaagaaggtatatgtggtataagaagcgtgacgcgactcgaaaatctaatgtggaaacaaattacccccgaactaaaccacatattagcagaaaacgaagtaaaactaacaataatgaccggagacataaaaggcataatgcaagcggggaaacggtccttaagaccacaacccacggagcttaaatattcatggaaaacatggggcaaagcaaaaatgctgtcgacggaatcatacaatcaaacattccttatagatggaccagaaacaaccgaatgtccaaacactaaccgtgcttggaacagcttggaagtcgaggactatggattcggagtattcacaactaacatatggttaaagctgaaagaaaagcaggatgctttctgtgatagtaaactaatgtcagcagcaattaaagataacagggctgtgcatgcggacatggggtattggatagaaagtgccctaaacgacacatggaaaatagaaaaggcttcattcattgaggttaagaattgccattggcctaagagtcacacactgtggtcgaatggtgtactcgaaagcgagatgataattccgaaaaatttagcgggtccagttagtcaacataactaccgaccaggataccatacacaaatagcgggaccttggcacctaggaaaacttgaaatggattttgatttctgcgatggaaccacagtaatagtcacagaagattgtggtaacaggggtccgtcacttaggactactactgcatccgggaaactcataacagaatggtgctgtcgcagttgtaccttgcccccacttcgatatagaggcgaagatgggtgttggtacggcatggaaattcggccattaaaagaaaaagaagaaaacttagtgaacagcctagtaaccgcaggccatggtcaagttgataatttctcgctaggagtattaggaatggctttgttcttagaagaaatgctcaggactcgggtaggaacaaaacatgctatcctactcgtcgcagtctcgttcgttacgctcatcacaggaaatatgtcttttaaggatctgggtcgagtagtagttatggtgggggcaacaatggctgacgatatcggaatgggagtaacctacttagcgttactagcagcatttaaggtgagacccactttcgctgcgggcctattactacgaaaactcacttcaaaggagctgatgatgacaactataggaattgtactcctatcccagtccacgatacccgaaacagttctagaactgactgacgcattggcgcttggcatgatggtccttaaaatagtgagaaatatggaaaaatatcaactagcagtaaccataatggcaatcttatgcgtcccaaacgccgtaatacttcaaaatgcatggaaagtgtcttgtacgattttagcggttgtgagtgtatcaccattactactaacatcaagtcagcagaaaactgattggattcctttggcattgacaataaaaggactaaacccaacagcaatattccttactacactatcaagaacaaataagaaaagaagttggcccttaaacgaagctataatggctgttggtatggtatctatactggcatcttcgctattaaagaatgacataccaatgactggcccgctggtagcgggaggcttgttaacagtttgttacgtcttaacagggagaagtgcagatttagaattggaacgagctacagacgtgaaatgggaagatcaagccgaaatatcaggatcttccccgatattaagtatcacaatttcagaggacggcagtatgtctatcaaaaatgaagaagaagaacagacactcacaatcttaattagaacaggacttctagttatatcaggtctattccccatcagcataccgataacagcggccgcctggtatttatgggaagtcaagaaacaaagagcaggagttctatgggacgtgccatcgccacccccgatgggtaaagctgagttggaagacggtgcttatcgaatcaaacaaaaaggaatacttggatattcgcaaataggggcaggagtgtataaggaagggacttttcacacaatgtggcatgtcacacgtggagcggtgttgatgcacaaaggcaagcgtatagaacccagctgggccgacgtaaagaaggatctaatatcgtatggtggagggtggaaattagaaggagaatggaaggaaggcgaagaagtacaagtacttgcactcgaacccgggaaaaatccacgagcggtacaaaccaaaccaggattatttaaaacaaacacgggcaccattggcgcagtctctctagacttctcacccggaacttctggatctccaatcatagacaagaaaggaaaagtcgtaggactttacggcaacggtgtagttacacgaagtggcgcttacgtgtcagcgattgctcaaacagaaaaatcaatcgaagacaatcctgagatagaagatgatatctttcgcaaaagacgccttaccataatggacttgcatcccggagccggaaaaacaaaacgctatttaccagctatagtacgcgaggctataaaaagaggattaagaacacttattttggccccaacacgagtagtggccgcagaaatggaggaggccttaagaggcctcccaattaggtatcagacacccgcgatacgggctgagcacacaggaagagaaatcgtggacttaatgtgtcatgcgacgtttacgatgagactcttaagcccagtaagagtccctaattacaacctcattataatggatgaggcacactttacggatccggcgtctatagcagcaagaggctatatcagcacaagagtagaaatgggcgaagctgctggaatatttatgacagccacaccaccagggagtagagatccatttcctcaatcgaacgcacctataattgatgaagaaagagagattccggaacgatcgtggaacactggtcatgaatgggtcactgattttaaaggtaaaacagtctggtttgtcccgtcgataaaggccggcaatgatattgctgcatgcttaaggaaaaatggaaagaaagtcatacagctgagtaggaaaacttttgactccgaatacgtaaaaactaggacgaatgattgggacttcgtcgttacaacagacataagtgagatgggagctaacttcaaagccgaacgagtcatcgatccgcgaagatgtatgaaaccggtaatactgacagatggtgaagaacgtgtaattttagccggaccgatgccagttactcatagtagcgccgcacaacggagaggcaggataggaagaaaccccaaaaacgagaacgatcaatacatttacatgggagaacccctagaaaacgatgaggattgtgctcactggaaggaagccaaaatgttgctagataacattaacacgccagaaggaataataccgagcatgttcgaaccggaaagagaaaaagttgatgcaatagacggagaataccgattaaggggagaagctagaaaaacctttgtggacctcatgcgcagaggtgatttgcctgtatggctcgcctataaagtggcagccgaaggtattaattacgctgacagacggtggtgtttcgatggcattaaaaataaccaaatacttgaggagaacgtagaagtagaaatatggactaaggaaggcgaaagaaagaagttgaaaccgagatggcttgatgcacgtatttattcggacccattagcactgaaagaatttaaagaatttgccgctggtagaaaatctctaacccttaatctgataactgaaatgggacggttacccactttcatgacgcaaaagacacgtgatgcattagacaacttagctgtattgcacaccgcagaagctgggggtagggcctataaccacgcgctatctgagttaccagaaactttagaaacactacttcttctgactttgctggccactgtaacaggtggaatatttctttttctcatgtctggtagggggataggtaagatgacacttggaatgtgttgcataataactgcatcaatattgctatggtatgcccaaattcaaccacattggattgccgcatctattatactcgagttctttcttattgtattgctcataccagaaccagaaaaacaaagaacaccacaagataaccaattaacttatgtagtaatagccatcctgactgtcgtagctgccactatggctaacgaaatggggtttttagagaaaacgaagaaagatctaggtctagggtccattgccacacaacagcctgagtctaatatattagatatagatttacgacccgcatcagcttggacattatatgctgttgcaaccaccttcgtaactcctatgctacgccactccatcgaaaactctagcgttaatgtatcactaacagcaattgccaatcaggctactgtattaatgggcttggggaaagggtggcccctctctaaaatggatataggggtaccattattagcaatcggttgttacagccaagtaaatcctataactctaacggcagcactattattattagtagcgcattatgccataatcggacctggcctacaagcaaaggcaacaagggaagctcaaaaacgggcagctgcaggtataatgaaaaacccaacagtagacgggataacagtcatagatttggatccaataccatacgatccaaaattcgagaagcaactcggtcaagttatgctattgatcctatgtgttacacaagttttaatgatgaggacgacatgggccttgtgtgaagcgctaactttagcgacagggccaataagcacactgtgggaaggtaatccaggaagattttggaacacaacgatagcggtatcaatggcaaacattttcagaggctcatacttagcgggagctggattattattctcaataatgaaaaataccacaaacacgcgcagaggcacaggaaacattggagaaactctcggtgaaaaatggaaatctagactgaacgctctcgggaaatctgaatttcagatctacaagaaaagcggcatccaagaggtagaccggacattagccaaagagggaataaagcgcggggaaacggaccatcatgctgtctcccgaggaagtgcaaaactccggtggttcgtagaaaggaatatggtcacacctgaaggaaaagtagtcgacttgggctgtggacgtggagggtggagctattactgcggcggcttaaagaacgttcgagaagtaaaaggcttgactaaaggtggtccaggacacgaggaaccgattccaatgagtacttatggatggaaccttgtccgactccagtcaggagttgacgtattctttattccaccagaaaaatgtgacacactactatgtgacatcggggagtcatccccgaatccaacagtggaagcagggagaaccctaagagtcttgaatctagttgaaaactggcttaacaataatacacaattctgtattaaagttctgaatccgtacatgcccagtgtaattgagaaaatggaggctctacagcgtaaacatgggggagctctcgtacgcaatccactatcgcgcaacagtacacatgagatgtattgggtatcaaacgcttctggtaacatagtatcgagcgtaaatatgataagtagaatgctcatcaacagattcacaatgcgacataagaaagcaacctatgaacccgacgtagatctaggttcaggaacaaggaatattggaatagagtcagagatcccgaatctagatataattggcaaaagaatagagaaaataaaacaagagcatgaaacgagttggcattatgatcaagatcatccatacaaaacttgggcgtaccatggctcgtatgaaacgaaacaaacaggatctgcgtcgtctatggtaaatggtgtggtaaggctgcttacaaaaccatgggatgttctacctactgtaacacagatggcaatgacagataccactcctttcggacaacagcgagtatttaaagagaaagttgatacaagaacccaggagccaaaagaaggcaccaagaaacttatgaaaataaccgccgaatggttatggaaagaactggggaagaagaaaacacctcgaatgtgtacgagagaggaatttacacgaaaggtaagaagtaatgcagcattaggggcaattttcactgacgaaaacaagtggaaaagtgctagggaagcagtagaagattcaagattctgggaacttgttgataaggaaagaaaccttcatctggaaggtaagtgtgaaacctgtgtctataatatgatgggaaaacgcgagaagaaactaggcgagtttgggaaagcaaaaggatccagagcaatatggtatatgtggctaggcgcacggtttctagagtttgaagcactaggttttcttaatgaggatcattggtttagccgagaaaattccttgtctggggttgaaggagaaggtctacacaaattgggatacatactacgagatgtgtccaagaaagaaggtggcgcaatgtatgccgacgacacagctggatgggacactcggatcacgctagaagatttaaagaatgaggaaatggtgaccaaccatatggaaggggagcacaagaaactcgcagaagcaattttcaaattgacatatcaaaacaaagtagtcagagtgcaacgtccaacacctcgaggtacagttatggatattataagcaggagagaccaaagaggtagtggtcaagtaggaacctacgggttgaatactttcacaaatatggaagctcaacttataagacaaatggagggcgaaggagtattcaaaaatatccaacatttaaccgtaactgaagaagtagcagtacaaaactggctagcccgagtaggaagagaaagattgtcacggatggcaattagcggagacgattgtgtagtcaaacctctggacgatagatttgcaaatgcattaactgctctaaacgatatgggtaaaattcgaaaagacatacaacagtgggagccctctaagggttggaacgactggacccaggtaccattttgttctcatcacttccatgaattgataatgaaagacggaagagtactggtagtcccatgtaggaaccaagacgagcttattggtagagctcgcatcagccaaggcgcagggtggtcactccgagaaactgcatgcctaggaaaatcctatgcgcaaatgtggagtctaatgtacttccaccgcagagatttacgtcttgcggctaatgctatatgcagtgccgtaccaagtcactgggtaccgacgagtcgtactacctggagtatacacgcaaaacacgagtggatgaccacagaagatatgttaacagtatggaatagggtttggataagagagaacccttggatggaagacaaaactcctgtagaaagctgggaggaaattccctacttagggaagagggaagatcaatggtgcggctctttaataggacttacaagtcgcgcaacgtgggctaaaaacatccaagcagcaattaatcaagtaagaagccttatcggggacgaagaatatacggattacatgccttccatgaagagatttagaagggaggaagaagaagcaggagtgctctggtag

SEQ ID NO: 22742 - RNA, 9876 nt, synthetic construct
  misc_feature 1..9876: note = derived and/or modified CDS sequence (opt6) from DENV-2__EU482661__SS-prME
  source 1..9876: mol_type = other RNA
tcagccggaatgattataatgttaataccaactgttatggcatttcatcttaccacaaggaatggagaaccacatatgatagtaggaatacaggaaaaaggcaaatcactcttattcaaaacagaagatggagtaaacatgtgtacattaatggctatggaccttggcgaattatgtgaagatacaataacatataaatgtccccttctaagacagaatgaaccagaagatatcgactgttggtgtaactcaacctccacctgggttacttatggtacatgtaccactacaggggaacataggagggagaaaaggtccgtggcgttagttcctcatgtaggaatgggcctcgaaacccggaccgaaacatggatgagtagcgaaggggcatggaaacatgctcaacgaatagaaacgtggatattaaggcacccaggatttacgattatggcagcaatacttgcatatactattggaacgactcatttccaacgagtcttgatatttattttattaactgccgtagcgccgagcatgacaatgcggtgtataggaataagcaatagggattttgtcgaaggtgtttcgggcgggagctgggttgacatagttcttgaacatggttcttgtgtcacaactatggctaaaaacaaacctactcttgatttcgaactgatcaaaaccgaagcgaaacagccagctactctgagaaaatactgcattgaagccaaattaacgaacactacaacagaatcaaggtgtccaactcaaggcgaacccagtcttaaagaagaacaggataaaagatttgtatgtaaacactccatggtagatcgaggatggggaaatggctgtggattattcggtaaagggggaatagttacatgcgcaatgtttacatgtaagaaaaatatggaaggaaaaatagtacaaccggaaaacctcgaatataccattgtagttactccacattccggcgaagaacacgcagtcggaaatgacactggcaaacacggcaaagaaataaaagtcacaccacaatctagcataacagaagccgaattgacaggatatgggaccgttactatggaatgctcaccacgaactggattagatttcaatgaaatggtactactacaaatggaaaataaagcatggctcgtacatagacaatggttcctagatttaccattaccttggttgcctggagctgacaaacaagaatccaattggattcaaaaagaaacgctagttacatttaaaaatccacacgctaagaaacaagacgttgtagtactaggatctcaggaaggagctatgcacacagcacttacgggagctacagaaattcagatgagctcgggtaacttattatttaccgggcatttaaaatgtcgactcagaatggataaactgcagttaaaaggaatgtcatatagcatgtgcacaggaaaatttaaggttgttaaagaaattgctgaaacacagcatggaacaatagttatacgagtacaatatgaaggtgatggctcaccatgtaagattccttttgaaataatggatttagaaaagagatatgtcttaggacggttaattacagttaatccgattgttaccgagaaagatagtcctgtgaatatagaagcggaaccgccattcggcgactcatatattattatcggtgtggaaccaggtcaattaaaattgaattggttcaagaaaggtagcagtattggtcaaatgttcgaaacaactatgcgaggagcaaagagaatggccattttgggcgatacagcttgggatttcggctctcttggaggagtttttacttcaattggtaaagccttacaccaagtatttggagcaatatatggagctgcgtttagtggggtgagctggacgatgaagattttgatcggcgtgataataacatggataggtatgaactctcgctcaacaagtttgagtgtaagcctagtcctagttgggatagtaacgttatacctaggggtcatggtccaagccgactcggggtgtgttgttagttggaaaaacaaagagctgaaatgcggctcggggatcttcataacagataacgtacatacatggactgagcaatataaatttcaacctgaaagtccttcaaaacttgcatcagcaatacaaaaagcccaagaggaggggatctgcggaataaggtcagtgacaaggctagaaaatctcatgtggaagcaaataactccagaactgaatcacatcttggctgagaatgaagttaaacttacaatcatgaccggcgatataaagggtataatgcaagcaggaaaacgatctttacgtccacaaccgacagaactgaaatacagttggaaaacatggggcaaggccaaaatgttatcaaccgaaagctacaaccaaacttttctaatagacggtccggaaacggcagaatgcccgaatacaaatcgcgcatggaactcactcgaagttgaagactatgggtttggtgtatttactactaacatctggttaaaacttaaagaaaaacaagatgcattttgtgattcaaaacttatgagcgcagccattaaagataatcgagccgtacatgcagatatgggatattggattgaatctgcacttaacgacacatggaaaattgaaaaagcatcattcatagaggttaaaaattgtcattggcccaaatcacacactttgtggagtaatggagttcttgaaagcgaaatgatcatacccaaaaatttagctggccctgttagtcaacacaactatagacccgggtaccatacgcagatcgcagggccctggcatcttggaaagctagagatggatttcgatttctgcgatggaacgaccgtaatagtaacagaagactgcggtaatagaggaccttcccttcgaaccaccaccgctagtggtaaactcataacggaatggtgctgtaggagctgtacgttgcccccattacggtatcgcggcgaggatgggtgctggtacgggatggaaatcagaccgctgaaggaaaaagaggaaaatctagtaaatagtctagtaacggctggacacggacaggtagataacttttcacttggagttttaggcatggccttatttcttgaagaaatgcttagaacgagagtcggcacaaaacacgcaattctcttagtagcagtgtctttcgtcacgctaatcactggtaacatgtcatttaaggatttaggacgcgtcgtggtaatggtaggcgcaacaatggcggacgacataggtatgggcgtcacgtatctagcacttttagctgcttttaaggtaagaccaacgtttgcggcaggactgctactgaggaaactaacttctaaagaattgatgatgactactataggaatcgtgcttcttagtcaatcaacaatacctgaaacggtattggaactaactgatgctttggcattaggaatgatggttttgaaaattgttcgtaacatggaaaaataccaactagccgtaaccataatggcaattttatgtgttccgaatgcagtcatattacaaaacgcatggaaagtatcgtgtacaatattagctgtggtatccgtcagccctttactattaacgtcatctcaacaaaagacggactggatccctttagcattaacaataaaggggcttaatccaacggctatattccttacaacattaagtaggacgaataagaaacgtagctggccacttaatgaagctattatggccgtaggaatggttagcatcttagcgagtagtcttctaaagaacgatattcctatgaccggcccactcgtagccggaggtctattgacagtgtgttatgtcttaacaggaagatccgctgacttggaactagaaagagcaacggacgttaaatgggaagatcaagcagaaatttccggaagcagcccgatactctctattaccatatctgaagacggatcaatgtctataaagaacgaagaagaagaacaaacattaactatactaatcaggactggactactcgtaatctcagggctttttcctatttctatccctattacagcagcagcttggtatttgtgggaagtgaagaaacaaagggcaggagtcttatgggacgttcccagcccaccacctatgggcaaggctgaattagaagatggagcctatcgtataaagcaaaaaggaatcttgggatacagtcaaataggggcgggtgtatacaaagaggggacatttcatacaatgtggcacgtgaccagaggagcagtcttaatgcataaaggaaagagaatagagccttcctgggctgacgtaaagaaagacctaatatcctatggaggtggctggaagttagaaggagagtggaaagaaggagaggaggtacaagttctggcattagaaccaggaaagaatcctcgagcagtccaaacgaaaccggggctgtttaagactaatactggcacaattggagcagtaagtttggatttttcgcctggaacatctgggtcaccaataattgacaagaaaggtaaagtcgttggattgtatggaaatggcgtcgtcacacggtcaggagcttacgttagcgcgatagcacaaacggaaaaatcgatagaagataaccccgaaatcgagggagatatctttcgcaaaagaagacttaccatcatggacctccatccaggtgccgggaaaacaaaaagatatttacctgctatagttagggaggccatcaaaagggggcttaggacacttatccttgccccgactagagttgtagctgctgagatggaagaagcgttaagaggccttccgattcgttatcaaactcctgcaattagagcagaacacacagggcgagaaatagtagatctcatgtgtcacgcaacttttacaatgagattattatctcctgtccgagtgccaaactacaatctcattatcatggatgaggcccactttactgacccagcatccatagctgcaagaggatatatttcaacaagagtagagatgggagaggcggcagggatattcatgacggcaactccacctggaagccgcgacccctttccacaatcaaatgcaccaattatcgacgaagaacgagaaattccagaaagatcctggaatagtggtcacgaatgggtaacagacttcaaaggtaaaacagtatggtttgtacctagtataaaggcagggaacgacattgctgcatgcttaaggaaaaacgggaagaaagtcatacaattaagccgaaaaacatttgattcggagtacgtaaagacacgaacaaatgattgggactttgtagtaacaacagacatttctgaaatgggggcaaatttcaaagccgaacgcgtgatagatcctagaagatgtatgaaaccagttatattaactgatggagaagaaagggtgatccttgcaggtccgatgcctgttacgcactcgagtgcagcacagagaagaggtagaatagggcgtaatcccaaaaatgaaaacgatcagtatatatatatgggagaaccattagaaaatgatgaagattgtgcacactggaaggaagcaaaaatgctgttagataatataaacacaccagagggaatcatcccgtcaatgtttgaaccggaaagagaaaaggtcgacgctatcgatggagaatacagactcagaggggaagcacggaaaacattcgtagatctaatgcggagaggggacctccctgtatggctggcatacaaagtagccgcagaaggaatcaattatgctgatcgaagatggtgttttgacggaatcaaaaataaccaaatattggaagaaaatgtcgaggtggagatttggacaaaagaaggggaacgaaagaagctaaaaccaaggtggttagatgccagaatatattctgatccgcttgcactgaaggagtttaaagagttcgccgcaggacggaagtcacttacgttaaatttaataaccgaaatgggacgtttacccacatttatgacacagaagactcgagacgctttagacaacctcgcagtacttcacacggcagaggctggtggcagagcgtacaatcatgcgctatcagaactaccagaaaccttagaaacccttctactcctgactttactagcaaccgtaacaggtggaattttcctcttcttaatgagcggtagaggaataggtaaaatgactctgggaatgtgttgcataataacagccagtatacttctttggtatgcacaaattcaaccacattggatagctgcatccatcatattggagttctttctgatagtactattgataccagaacccgaaaaacaaaggactcctcaagataatcaattgacatatgtagtaatagcgatcttgacggttgtagcggccacaatggctaacgaaatggggttcttagagaaaactaagaaagatcttggtctaggaagtattgctactcaacagccagaaagcaacatattagatattgatcttcggccagcatccgcttggactttatatgccgtagcgacaacatttgttaccccaatgttgcgtcattccatagaaaacagttctgtaaacgtttccctcactgccattgctaatcaggccacggtccttatgggactgggaaagggctggccgttaagtaaaatggacatcggagtaccacttttagccataggttgctactcgcaagtaaaccccattaccctcacagccgccctcctattgttagtagctcattatgccataattggaccagggctccaagccaaggcaactagagaagcgcagaaaagggccgcagcgggaataatgaaaaatcccactgtagatggtataaccgtcatcgatttggaccccataccttatgacccaaaattcgagaagcaacttggacaagttatgttactgatcctatgtgtgacccaagtattaatgatgagaacaacttgggccctttgtgaggcccttacgttagctaccggcccgataagcactctttgggagggaaacccaggaagattctggaatacgacaatcgcggtctcgatggctaatatatttcgaggatcgtatctagcgggtgcaggtttattattttcaataatgaagaatacaacaaatacacgccgcggtacaggtaatatcggagaaacattgggagagaaatggaagtcgcgtcttaacgcactcggtaaaagcgagttccaaatttataagaaatccggcattcaagaagtggaccggacattagcaaaagaaggaataaaacgtggggagacagaccaccacgccgtatcacgtggatccgcaaaactaagatggttcgtagaaagaaatatggtaacaccggaaggcaaagtagtcgatctaggttgtggacgtggtggctggtcatattattgcgggggtttaaagaacgtacgagaagtcaaaggactgacaaaagggggacccggtcatgaggaacctattcccatgtcgacatacggttggaaccttgtaagactgcaaagtggcgtagatgtattctttattccaccggaaaagtgcgataccctactatgtgacataggggaatctagcccaaatccaactgtagaagccggtagaacactcagagttctaaatctggtggaaaattggcttaataataatacgcaattctgtataaaagttttaaatccctatatgccaagtgtgattgagaaaatggaggccctccagagaaaatacggaggcgctctcgtgagaaaccctttatcacgaaatagtactcatgagatgtactgggtaagcaatgcctctggtaatatagttagtagtgttaacatgatatctagaatgcttataaatagatttacaatgagacacaagaaagctacatatgaaccagacgttgatctcggatccggaactagaaacattgggattgaaagcgaaatacccaatttggacataattggtaaacgcatagagaaaataaagcaagaacacgaaacgtcttggcattatgatcaagatcacccgtacaaaacttgggcatatcatggcagttatgagacaaaacaaacaggtagcgcaagtagtatggtgaatggagtcgtgagattattaacaaaaccgtgggatgtcttaccgaccgtcacacaaatggcaatgactgacacgacgccatttggccagcaacgagtattcaaagagaaagtagatacgagaactcaggagcccaaagaaggtacaaagaaattgatgaaaataaccgctgaatggctttggaaagaattgggcaaaaagaaaaccccgagaatgtgtacaagagaagagttcacaagaaaagtccgttctaatgctgcgcttggagcaatcttcactgacgaaaataaatggaaatccgctcgcgaagcggttgaagatagcagattctgggaattagtagataaagaaagaaacctacatttggagggaaaatgcgagacgtgtgtttataatatgatgggcaagcgagagaagaaactaggggagttcgggaaagcaaaagggtcacgagctatatggtatatgtggctaggggcaaggttcctagagttcgaggctttaggattcttgaatgaagatcattggttctctagagaaaattcactaagcggggtcgaaggtgaaggattacacaaattggggtacatattacgtgatgtatcgaagaaagaaggcggcgcaatgtatgcagatgatacagcgggatgggatacacggattacccttgaagatctaaagaacgaagaaatggttactaaccatatggaaggagaacataagaaattagcagaagccatcttcaaattaacgtatcaaaataaagttgtaagagtgcagaggccgacacccaggggaaccgtgatggacatcatatcaagacgagatcaaagagggtcaggacaagtaggaacatacggcctaaacacgtttactaacatggaagcgcaattaatacgacaaatggaaggagaaggcgtcttcaaaaacatacaacatctgacagtgacagaggaagttgctgttcaaaattggctagcgcgcgtaggtagagaaagactatcgagaatggcaatatcaggcgacgactgcgtagtaaagcctttagatgatagattcgcaaacgcattgacagctcttaatgatatgggtaaaattaggaaggatatccagcaatgggaaccatcaaagggctggaatgactggactcaggtaccattttgctcacatcacttccatgaactaataatgaaagatggcagagtgctagttgttccatgtagaaaccaggatgagttaatagggcgtgctagaatatcacaaggagctggttggtcactacgagaaacagcttgtttgggaaagagctatgcccaaatgtggtcgctaatgtattttcaccggcgagacttacgtttagccgctaatgctatatgttcagcagtaccgagccactgggtgcctacttctcgtaccacttggtcaatacatgctaaacacgaatggatgactacggaagatatgctaacggtgtggaatagggtatggatccgagaaaatccgtggatggaagacaaaactccagttgaatcctgggaagaaattccctacctagggaagcgagaagaccaatggtgtggaagtctaattggcttgacgtcaagagctacatgggccaaaaatatacaggccgcaattaaccaagtacgaagtctaataggaaatgaagaatatacagattatatgccatcaatgaaacgcttccgcagggaggaagaggaagcaggcgttttatggtaa

SEQ ID NO: 22743 - RNA, 9876 nt, synthetic construct
  misc_feature 1..9876: note = derived and/or modified CDS sequence (opt6) from DENV-2__EU482662__SS-prME
  source 1..9876: mol_type = other RNA
actgcaggggttattataatgcttatacccacagcgatggcatttcaccttacaacaaggaatggagaaccacacatgatcgtaggaagacaagaaaaagggaaatcattattattcaaaacggaagacggagtaaatatgtgcacattgatggctatcgatttaggtgaattgtgcgaagacacaattacctataaatgcccattgctccggcaaaacgaacctgaggacattgattgttggtgtaattcgactagcacgtgggtgacctatggtacatgcactactacaggagaacataggcgagagaaaaggagtgtagcgctggttccgcacgtcggcatgggtttagaaacacgaactgagacatggatgagttcagagggagcatggaaacacgcgcaaagaatagagacctggatattaaggcatcctggattcacgataatggctgcgatactagcgtacacaatcggaactacacactttcaaaaagcgctaatattcatactactaacagcagtagcacccagtatgactatgagatgtataggtatatcaaatcgcgactttgtcgaaggagtctcaggaggatcatgggttgatatcgtattagaacacgggtcatgcgtaaccactatggcgaaaaacaagccaactctggatttcgaactaataaagaccgaagctaagcaacctgctaccttaaggaaatattgcatagaagcaaaactcacaaatacgacaaccgaatctcgatgtcccacccaaggggaaccgtctttaaacgaagaacaagacaagcggtttgtttgcaaacactccatggtagatagggggtggggtaatggatgcggactcttcgggaaagggggaattgtgacatgtgcaatgtttacctgcaagaaaaacatggaaggaaaaatcgtacaaccagaaaacctagaatatacaatcgtaatcacaccgcactcaggagaagaacatgcagtgggtaacgatacgggtaagcatggtaaagaaataaaaataacaccacaatcaagtataactgaagccgaacttacaggttatggaactgtaactatggagtgctctccccgcactggcttagatttcaatgaaatggtattgcttcaaatggaagacaaggcatggctcgtgcataggcaatggtttcttgatttaccactaccatggcttccaggagctgatacacaaggatccaactggattcaaaaagaaacacttgtcacattcaaaaatccgcacgcgaaaaagcaagatgtcgtagtcttaggctctcaagaaggcgcaatgcatacggccctaacgggagcgacggaaatccaaatgtcttcagggaacttacttttcaccggacatcttaaatgcagattaagaatggataaattacagttaaagggaatgtcttatagtatgtgtacaggaaaatttaagattgtaaaagaaattgctgagacacagcacggaacaatcgttattcgcgtacaatacgagggagacgggagcccttgcaaaattccattcgaaattatggatttggagaagagacatgtcttaggacgcctaattacagtaaatcctatcgttacagaaaaggattcaccagtcaatatagaagcagagcccccattcggcgattcatacataataataggagtagaacctggtcaactgaaattgaactggtttaagaaaggaagctcaataggacaaatgttcgaaacaacaatgagaggggctaagcgcatggcgatcctcggagatacagcttgggattttggatcattaggtggggtattcacgtcaatcggcaaagcactacaccaggtatttggagcaatatatggagccgcattttcaggagtgtcctggacgatgaaaatcctcataggagcaattattacatggataggaatgaacagtaggagtacatcactaagtgttagcttagtgctagtaggtgtaataacgctttacctgggagctatggtacaagcagatagtggctgtgtagtaagttggaaaaacaaggaattaaaatgcgggtcaggtattttcataaccgataacgtacacacttggactgaacaatacaaattccaaccagagtctccctctaagttggcctcggctattcaaaaggcacatgaagagggtatatgcggcatacgttctgtaacgcgattggaaaatttgatgtggaagcaaataacaccagaactaaaccatattctgtcagagaatgaggtgaagttaacgatcatgacaggtgatataaagggcataatgcaagcaggaaaaaggagtttacgacctcaacctacggaacttaaatatagctggaagacctggggtaaagcgaaaatgttatccacagaaagtcacaaccagacattcttaattgacgggcccgaaacagctgaatgcccaaataccaacagggcctggaactctctagaagtagaagattatgggtttggtgtatttactactaatatctggttgaaactaagagagaagcaggacgtattctgcgattcaaaattaatgtctgccgctataaaagacaatcgtgcagttcatgcggatatgggttactggatagaaagtgctctgaatgacacatggaaaatggagaaagctagttttatagaagtgaagtcatgccactggcctaagtcacatactttatggtccaatggtgtgctggaaagtgaaatgataataccaaaatcctttgccgggcctgtcagtcaacataactatcgacctggatattacacacagacagcaggaccatggcaccttggtaaactagaaatggattttgatttttgtgaggggacaacggtagttgtaacagaagactgcggaaatagagggccttctttgagaaccaccactgcgtcgggtaaacttatcacggaatggtgttgccgaagttgcacactaccacccctccgatatagaggggaagacggctgttggtatggaatggagatccgtcctctgaaagaaaaagaagaaaatttggtgaatagtctggtaacagcaggtcacggacaaattgataatttctcactaggggtcctaggcatggcgttattcctggaagagatgttaagaacgcgtgtaggcactaaacatgccattttattggtcgcagtgagctttatgacattgattaccggcaatatgtccttcagagacctcgggagagtaatggtaatggtaggagcaaccatgactgatgacataggcatgggggtaacatatttagccttgttggccgcattcaaggtacgtccgacatttgcagctggactgctactcagaaaacttacatccaaagaattaatgatggcaacaattggtatagcattattatcgcagagcacaattccagaaacaatcctggagctaacagacgctttagcgttaggtatgatggtcctaaaaatagtaagaaatatggaaaaataccagctagcagtcactattatggctatatcttgcgtgcccaacgcagtaatcctacaaaatgcatggaaggtcagctgtactattttagctgcagtcagtgtcagtccactacttttaacttcgtctcaacagaaagctgattggataccgctggcactaacaataaaaggcttaaaccctactgccatcttcctaactacattgtctcgtacatctaaaaagaggagttggcctttaaatgaggctataatggccgtagggatggtaagtatactggcgtcaagcctgttgaaaaatgacatacctatgacaggacctctagtagccggtgggctattgaccgtatgttatgtcctaacaggccgtagtgcagaccttgaacttgagcgagcaacggacgtaaaatgggaagatcaagcagaaataagcggaagctcaccgatattgtcaataactatttcggaggatggtagtatgtccatcaaaaatgaagaagaagaacaaacactgacaatattaatacgtacaggcttgctggtgattagcggccttttcccagtaagcataccgatcactgctgccgcctggtatctctgggaggtcaagaaacaacgagcaggagttttatgggatgtgccatccccgccaccggtaggaaaagcagaattggaagatggggcttataggataaaacagaagggcatcttgggttattcgcaaattggagctggcgtctacaaagaaggaacatttcacactatgtggcatgtaactcgaggggcggtgttaatgcatagaggcaaaagaatcgaaccttcctgggccgacgttaagaaagacctgatatcctatggaggcggatggaaactagaaggagaatggaaagaaggagaagaagtgcaagtcctggcgctagaaccaggtaagaatccacgtgccgtacaaacaaaaccaggtctgttcaagacaaatacaggaaccataggggccgtgtcactggatttcagtccaggcaccagtggaagtcccatcgtggataggaaagggaaagttgtaggattatatggtaacggagtcgtcacacgcagtggtgcatacgtgagtgcaatcgcgcagacggaaaaatcaatagaggacaacccagagattgaagacgatattttccgtaagaaacgactgacaattatggatcttcatccaggcgcaggtaaaacaaaaagatacctaccagctattgtgcgggaggctataaaaagaggtttacggacattaatattggcgccaactagggtagttgcagcagaaatggaagaggcactaagaggtttaccaattcgataccaaacaccagctatccgagcagaacataccggaagagaaatcgttgatttaatgtgccacgctacgtttaccatgcgcttgttaagtccagtacgagttccaaattacaacctaataattatggatgaagctcacttcacggacccagcaagcatcgccgctcgaggctatatatctacccgggttgaaatgggagaggcagcgggtatatttatgacagctacaccaccggggagccgcgatccattccctcaatccaatgctccgatcatcgacgaagaacgggaaataccagaaagaagctggaactctgggcatgagtgggtaaccgactttaaagggaagactgtctggttcgtaccttcaataaaagcgggtaatgacattgcagcatgtcttcgcaaaaatggtaaaaaggtgatacaacttagtcgcaaaacatttgacagcgagtacgtaaaaacaagaacgaacgattgggactttgtagttaccactgatataagtgaaatgggggcaaactttaaggctgagcgcgttatagacccaagacgctgcatgaaaccagtaatattaactgatggagaagaacgagtaatattagcagggccaatgccagttacacattcctcagcagctcagagaagaggacgcatcggcagaaatcccaaaaatgagaacgatcaatacatatatatgggagaaccgctcgaaaacgacgaagattgcgcacactggaaagaagccaagatgttactagacaatattaacacacccgagggtatcataccgagtatgtttgagccggagagggagaaagttgatgcaatagatggagagtacagactaagaggtgaagcccgaaaaacattcgttgatcttatgcggagaggagacttaccagtttggttagcctatcgtgtggcagcagagggtataaactatgccgacagaaggtggtgtttcgatggagtgaaaaataatcaaatattagaagaaaatgttgaagtcgaaatttggacaaaagaaggggaaagaaagaaattaaagccaaggtggcttgacgctagaatctactcagacccgcttgcattgaaagaatttaaggagttcgcggcaggacgcaaatctttaaccctgaacttaatcacagagatgggaagactgccaacattcatgacgcaaaaagcgcgggatgccttagacaatcttgctgtgttgcacacagccgaggctggtggaagggcatataaccacgcgctatctgaattacctgaaacactggaaaccttactactgttaactttactcgcgaccgtcacaggtgggatttttctatttctaatgtctgggaagggcgtaggtaagatgacccttggaatgtgctgtattataacagcgtctattttactttggtacgctcagatccaaccacattggattgctgcctccataattctagaatttttcttaatagtactactcataccagaaccagaaaaacaacgaaccccacaagataatcagcttacttacgtagtcatagctatcttgactgtggttgccgcgaccatggctaatgaaatggggtttttagagaagaccaagaaagacctcggtctaggaagcatagcaacccaagaacccgagagcaacatactggatatagatttaaggcccgcaagcgcctggacgctatatgcggtggcaaccaccttcgtaacaccaatgctacgacatagcatcgaaaattccagcgtaaatgtaagcctaaccgcgattgccaaccaggcaacggtactaatgggattagggaagggttggcccttaagcaaaatggatattggagtacctctactggcaataggatgttactcacaagttaatccaattacactcaccgcagcacttctactacttatcgcacactatgccataattggtccagggctacaagctaaagcaacaagagaagcacaaaaacgggcagcagcaggaattatgaaaaatccgactgtcgatggaataacggtaatcgatctagatcccataccatacgacccaaaattcgaaaagcaactcggtcaagtaatgctcttaattctctgcgtaacgcaggttcttatgatgcgtaccacatgggctttgtgtgaggctttaacattagcgacgggaccaatctcaactttatgggaaggtaacccaggaaggttttggaatacgacaattgcggtttccatggcaaatattttcagaggaagttatctcgctggtgcgggtcttctgttttccataatgaaaaatactacaaacacaagaagaggaacgggtaacatcggggaaacactaggtgaaaaatggaaatcacgattgaacgcactaggaaaaagcgagttccaaatttacaagaaatcaggaatacaagaagtggatcgcacgcttgctaaagaaggaatcaaaagaggagaaaccgatcaccatgctgtttcacgaggttcagctaaactgagatggtttgttgagagaaatatggtaacgccagaaggtaaggtcgtagacctcggttgtggtcgtggaggatggtcttattactgtggcgggctaaagaatgtaagagaggtcaaaggcttaactaagggaggaccaggacatgaggaaccaattcctatgtccacgtacggttggaacctcgtaaggctacaaagtggggtcgacgtattcttcaccccaccagaaaaatgcgatactttattgtgcgacataggagaaagttctccaaaccctacgatagaagcggggagaacattacgggtattatccttggttgaaaattggcttaataatgatactcagttctgtattaaggtattaaatccttacatgccaagcgttatagagaagatggaaaccttacagaggaaatacggcggtgccttagttaggaaccccttgagtagaaatagcacacatgaaatgtattgggtcagtaatgcaaccggcaatattgtatcctcagttaatatgataagtcggatgttaataaatagatttacaatgaaacacaaaaaggccacatatgaaccagacgtagatcttgggtccggaacaaggaacataggaatcgaatcagaaatacctaatcttgatataattggtaagagaatagagaaaataaagcaagaacatgaaactagctggcactacgatcaagatcatccatacaaaacttgggcgtaccacggttcctatgagacaaagcagacaggatcagcaagcagcatggtaaacggagtagtcagactattgacaaaaccttgggacgtggtaccaatggttacccagatggccatgacagatacgactccctttggccaacaaagggtattcaaagagaaggtggacacccgtacacaagaacctaaagaagggaccaagaaattgatgaaaatcactgccgaatggctatggaaagaattaggcaagaagaaaacccccagaatgtgtacgagagaagaatttacaaggaaagttcgttcaaacgccgcattgggagcaatatttaccgatgaaaataaatggaaaagtgcgcgagaagctgttgaggacagtcgattttgggagctagtggacaaggaaaggaacctccatctagaaggaaagtgcgaaacgtgtgtatacaatatgatggggaaaagggaaaagaaactaggagaatttggcaaagcgaaaggatcacgagcaatatggtacatgtggttgggggcgagattcttggaatttgaagctctaggattcctaaatgaagatcattggtttagcagagaaaatagtctctcgggagtcgaaggagaaggactacataaattaggatacatattacgagatgtgagcaagaaagaaggcggtgcgatgtacgccgatgatactgccggatgggatactagaataacattggaagacctaaagaatgaagaaatggtgacaaatcatatggagggagaacacaaacggttagcagaggccatattcaaacttacttaccagaataaagttgttcgcgtccaaagacccacacctagaggaaccgtcatggacataattagcagaagggaccagagaggtagtggtcaagttggtacatacgggcttaatacatttacaaacatggaagcacaattaatacggcaaatggagggagaaggaatattcaagtccatacaacatttaaccgtaactgaagaaattgcggtacagaactggctcgcgagggttggaagagagaggttgtcccgtatggcaataagtggtgatgattgtgttgtcaaaccattagacgacagatttgcctcggcactcacagcactaaacgatatgggcaaagtaaggaaagatatacaacaatgggaaccctcaaaaggctggaatgattggacacaagttccattctgtagccatcattttcatgaattgataatgaaagatggtagagtgctagtggtaccctgtagaaaccaagatgaactaattggacgggcaagaatttcccaaggagccggctggtcactaaaagaaactgcatgcttagggaaatcttacgctcagatgtggagtcttatgtattttcatcggcgtgacctcagactggcagccaacgcgatatgcagtgctgtcccaagccactgggtgccaacgtcaagaaccacctggtcaatacatgctaaacacgaatggatgacaactgaggatatgttaacggtgtggaatcgagtttggattcaagaaaatccgtggatggaggataaaactcctgtagaaagttgggaagaagtcccgtatctaggtaaacgcgaagaccagtggtgtggtagtttaataggcctcacaagtagagctacatgggccaaaaatatacaaactgctataaatcaagtaagatcacttataggaaatgaagaatacaccgattatatgccatctatgaaacgatttaggagagaggaagaagaagccggagtattgtggtaa

SEQ ID NO: 22744 - RNA, 9876 nt, synthetic construct
  misc_feature 1..9876: note = derived and/or modified CDS sequence (opt6) from DENV-2__EU482663__SS-prME
  source 1..9876: mol_type = other RNA
tctgcagggatgataattatgttgattcctaccgtcatggccttccatctgactacgcgtaatggggaaccacacatgatagtcggcatacaagaaaaaggaaaaagtctattatttaaaacggaggatggtgtaaatatgtgtactttgatggcgatggatttaggagagttgtgtgaagatacgataacgtataaatgtccacttctaaggcaaaatgaaccggaggatatagactgttggtgtaattcaacatcaacgtgggtgacatatggtacttgcaccacaactggcgaacacagaagggaaaaacgatcagtggcgttggtcccacacgttggaatgggattagaaactcgtacagagacgtggatgagtagtgaaggcgcctggaaacatgcacaacgaattgaaacctggatactgagacatcccggcttcacgatcatggctgccatactggcctatacaatagggactacgcatttccaacgggtcctaatttttatcttattaacagcagtggctccaagtatgacaatgcgttgtatagggattagtaatagagactttgttgagggtgtgtctggggggagttgggtagatatagtcctcgagcatggctcctgcgttacaacaatggccaaaaataagccaacacttgacttcgaactcattaaaacggaggccaagcagcctgccaccttacgaaaatactgcattgaagcaaaactaacgaatacaaccacggaatctaggtgcccgacccaaggcgagccaagtttgaaagaggagcaagataaaagatttgtctgcaagcattctatggtagatcgtggttggggcaatgggtgtggtttatttggaaaaggaggtatagtaacatgcgcaatgttcacttgcaaaaaaaatatggaaggaaaaattgttcaacctgagaatctagagtacacaatagtagtcactccgcatagcggtgaggaacacgcagtcggcaatgatacgggcaaacacggaaaagagataaaagtaaccccgcagtcctcaatcaccgaggcggagttaacagggtatggaacagttaccatggaatgctcgcctcggaccggcttagacttcaatgaaatggttcttttacagatggaaaataaagcctggctagttcatcgtcaatggttcttagatctgcctttaccttggctgccaggtgcggataagcaagaatccaattggattcagaaagagactctggtaacctttaaaaacccacatgctaagaaacaagatgtagtggtgttagggagtcaagagggagcaatgcatacagcgttgacaggagccaccgaaatccaaatgagcagtggtaacttgctgtttactgggcacctaaaatgtcggttgagaatggataagctacaattaaagggcatgtcatactctatgtgtacgggaaagttcaaagtagtaaaagaaatagccgaaactcagcacggcacaatcgtaataagagttcaatatgaaggagatgggagcccttgtaaaatacctttcgaaataatggacctagaaaaaaggtacgtattggggagactaattacagtcaacccaatcgttacagaaaaagatagtcccgtaaacatagaggcagaaccaccgtttggagattcatatataataataggagtcgaaccagggcaactgaaactgaattggtttaaaaagggatctagtatcggacaaatgttcgaaaccacaatgaggggtgcaaaaaggatggctatattgggagatacagcctgggactttggaagtttaggtggtgtatttacgagtataggtaaagcattgcatcaagtctttggagcaatctatggggcggcattttcaggagtttcatggacaatgaagatcttaataggagtaataataacatggatagggatgaacagtcggagcacctcactttcggtttcactagtattagtcggcatagtcacattataccttggagttatggtgcaagctgactctggctgtgttgtgagttggaaaaacaaagaattgaaatgcggaagtggtattttcataacggacaacgtgcatacatggacagaacaatataaatttcaaccagagtctccgagcaagttagcttctgcaatccaaaaagcacaagaggaaggaatatgtggtattagaagcgttactaggctagaaaacttaatgtggaaacaaataacaccggaattaaatcacattctggccgaaaatgaggtcaagctgacaataatgacaggcgatattaagggaataatgcaagcaggaaagcgctctttacgaccacaaccaacggaattaaagtattcgtggaaaacttggggaaaagccaaaatgttatctacggagtcctataatcagaccttccttattgacggccccgaaaccgcagaatgtccaaatacaaaccgagcatggaactcccttgaggtcgaagattacggatttggcgtattcactacaaacatttggctcaaattaaaagaaaagcaggacgtattttgcgacagcaaattaatgtctgcggcaattaaagacaatcgcgctgtgcatgctgatatgggatactggatagaaagtgccttaaatgacacatggaaaatcgaaaaagcatcctttattgaagtaaaaaattgtcattggcctaaaagtcatacactctggtcaaacggcgttcttgaatcagagatgattataccaaaaaacctagcaggacctgtgagtcaacataattaccgaccaggatatcatacgcaaatcgcagggccttggcacctaggtaaactagaaatggattttgacttttgtgatggaacgactgtaatagtaacagaagattgcggaaatagaggcccaagtcttcgcacaacaacagcatctggtaagctaatcaccgaatggtgctgcagaagctgcacattacctccccttcgttatcgaggggaggacggatgctggtatggaatggaaatcagaccattgaaagaaaaagaagaaaacctagttaacagcttagttacagcgggacatgggcaggtagacaacttctctttaggcgtgttgggcatggctctattcttagaggaaatgttaagaacaagagtaggaacaaaacatgctattttacttgtcgcagtatctttcgtaacattaatcacaggtaacatgagtttcaaagatttaggccgagtagtcgtcatggtaggagccactatggctgatgacatcggaatgggcgtaacctacctagcattattggccgcttttaaagtgaggccaacattcgcagctggactcctactgagaaaattaacaagtaaagaactcatgatgacaacgataggtattgttcttttaagccaatccacaatccccgaaacagtgctagagttaacagatgccttggcactaggaatgatggttttgaaaatagttagaaacatggaaaaatatcaactagcagtcaccattatggccattttatgcgtgccgaatgctgtcattctccaaaatgcatggaaggtatcatgtacaatattagcagtagtatcagtatcgccactattgctcacaagctcacaacagaagacagattggataccacttgcattgacaattaaaggtctcaatcccacagcaatttttctcactacattgagtcgaacaaacaaaaaacgctcatggcctctaaacgaagctataatggcggtaggcatggtatcaatattagcctcaagtttgttaaaaaacgacattccgatgactgggcccttagttgcagggggcttgctaactgtttgctatgtcttgacgggaaggagcgcagatctagaattagaacgtgcaactgacgtaaaatgggaagatcaagccgaaatctcaggatcttcgccaattctatctattactatctcagaagatggtagtatgtcaattaaaaacgaagaagaagaacaaaccttgaccatactaattcgaactggacttcttgtaatcagtggattatttccgatctccatccccattacggcagcagcttggtatctttgggaagtgaagaagcaacgagcaggtgtgttatgggatgtacccagtcccccacctatgggcaaggcagaactggaagatggagcatataggattaaacagaaaggaatactaggctacagccaaataggagctggcgtatacaaagaaggaactttccacacgatgtggcatgttacaagaggtgcagtactcatgcataaaggcaaaagaattgaaccatcatgggccgacgtaaagaaagatttaatctcatatggtgggggatggaaactagaaggcgagtggaaagaaggagaggaggttcaggtactagctttagaaccaggaaagaatccaagagcagtacagacaaaaccaggcttatttaaaacaaacacaggcacgattggtgcagtaagtttagacttcagcccagggacctcgggctctccgatcattgataaaaaaggaaaagttgtcggcttgtatggaaatggagtagttacacgatcaggagcatacgtaagcgcaatcgcccagaccgaaaagtcaatcgaggataaccctgaaattgaggacgatatatttaggaaacggcggttaacaatcatggatctacatcctggagcaggcaaaacaaaacgctatctgcccgctattgttagagaggctattaagaggggactccgtacgttaatattagcgcccaccagagtagttgcagccgaaatggaagaagctctacgtgggctcccaattaggtatcaaaccccggcaattagggcggagcacaccggaagggagattgtggaccttatgtgccatgcaacatttacaatgagattattaagtccagtccgcgttcctaactacaatttgataattatggatgaagcccacttcacagatcccgcttcgatagcagcgcgtggatacataagcaccagagttgaaatgggcgaggccgctggaatttttatgactgcgacaccgcccgggagtagagacccttttccacaatcaaacgcacctatcatagatgaagagcgagaaattccagaaaggtcatggaacagcggtcatgaatgggtaacagattttaagggtaagacggtgtggttcgtcccatcaattaaggccggtaacgacatagcagcatgcttaagaaaaaacggtaagaaagtgatccagttaagtcgaaaaacattcgatagcgagtatgtaaagacaaggaccaacgattgggatttcgtagtaacaacggatatatccgaaatgggcgcaaacttcaaggcggaaagagttatagatcctcgaagatgtatgaaaccagtaatactaactgatggagaagaaagagtgatcctagctgggcctatgcctgttactcattctagtgctgctcagcggaggggacgaataggaaggaatccgaagaatgaaaatgatcaatatatctatatgggagaaccattggagaatgatgaagattgtgcgcattggaaagaagcaaaaatgttattggacaatataaacaccccagaaggaattataccaagcatgtttgaaccggagcgtgagaaggtggatgctatagatggagaatacagattacgaggagaagcacgtaagacatttgtagatttaatgaggcgtggtgatctacctgtatggctggcatataaagtcgcagccgaagggataaattacgctgatcgtcgatggtgttttgatggaataaaaaataatcaaatattggaagaaaatgtggaagtcgaaatatggaccaaagaaggtgagcgaaaaaaactaaaaccaaggtggttagatgcaaggatatacagtgacccattagcgctaaaggagttcaaagagtttgcagccggccgaaaaagcctgacgcttaatttaattacagaaatgggtaggttaccaacattcatgacccaaaaaacgagagatgcattagataatctggcagtattgcacacggcagaagctggaggacgagcttacaatcacgcacttagcgaattacccgaaacattggagactctactactgctaacactcttggcgacggtaacaggaggaatattcctatttctaatgtctggacgtggcattggtaaaatgacgttaggcatgtgttgcataattaccgcaagtatattactttggtatgcacaaatccaaccacattggatagcagcttcgattatattggagtttttcctaatcgtcctgctaattcctgaaccggaaaaacaaaggaccccacaagataatcagttgacatatgtcgtaatagcaattctaacagtcgtggcagcaacaatggcaaatgaaatggggtttctagagaagacgaagaaggacttcgggttaggttcaattgccacgcaacaacccgaatctaatattctagacatagaccttagacctgctagcgcttggactttatacgctgtggcaactacatttgtaacaccaatgcttcgtcatagtattgagaattcatcggtaaatgtatcactgacggccatagcgaatcaggccacagtattaatgggtctaggaaaagggtggcctctaagtaaaatggacatcggggtaccgctgctagcgattgggtgttattcacaagtgaacccaataacattgacagccgcattattactacttgtagcacactacgctattattggtcctgggctgcaagcaaaagctactcgcgaggctcagaaacgagcggccgcaggcataatgaaaaacccaaccgtcgacggcattaccgtgatagatcttgacccaataccgtacgatcccaaatttgagaaacagttaggacaagtaatgctattgatcctttgtgtaacacaggtattgatgatgaggacgacatgggcactatgtgaagctctaacgctggcaacaggtccaatcagtactttatgggaaggaaatccgggaaggttctggaacaccacaatagcagtatctatggcaaatatatttcgaggtagctaccttgcgggtgcaggcctattattttcaatcatgaaaaacactacaaatactcgacgtggcacaggcaatattggagaaacgttaggagaaaagtggaagagcaggctaaatgcattaggtaaaagtgagttccagatatacaaaaaatcaggtatacaggaagtggatagaaccttagcaaaggagggcataaagcgaggggagacggaccaccacgctgtctcaagggggtcagcaaaactcagatggtttgtggaacgcaatatggtcactccagagggaaaggtagtagacttaggatgtggtagaggaggatggagttattattgcggcggattgagaaacgtaagggaagtcaaagggctgacaaagggtggcccaggacatgaagaaccaattccaatgtcaacctatggatggaacctcgtaaggcttcaatcaggagtcgatgttttcttcataccgcctgagaaatgtgacaccctcttatgcgacataggagaatcaagcccaaaccccactgtagaggcaggacgtacgctcagagtattaaatctagtggaaaactggctcaacaataatacccaattttgtataaaagtactaaacccatatatgcctagtgttatagaaaaaatggaagccttgcaaagaaaatatggtggcgcactagtccgaaatcccttatcacgaaattcaactcacgaaatgtattgggtctcaaatgcttcaggaaatattgtcagcagcgtaaatatgatttcaagaatgctgataaacaggttcacaatgagacacaaaaaggcaacctatgaacctgatgtagatctagggtcagggacacgaaacataggaattgaatcagaaatcccaaatctggacattatcggtaagcgaattgagaaaataaaacaagagcatgaaacatcctggcactatgaccaagaccatccatacaagacatgggcgtatcacggctcatatgaaacgaaacaaactggttcagcatcatctatggttaacggagtagtaagacttctaactaagccatgggatgtattaccaaccgtaacccaaatggccatgaccgacactactccatttggacaacagagagtgttcaaagaaaaggtagataccaggacacaagaaccgaaggaaggaacaaaaaagctgatgaaaattacagctgaatggttatggaaagaattaggcaaaaaaaaaacaccaaggatgtgcactcgtgaagaatttactaggaaggttagaagtaatgctgcactcggagctatattcacagacgaaaataaatggaaatctgcaagggaagcagtagaagacagtcgattttgggaactagtggataaagaaaggaacttacatcttgaaggaaaatgtgagacgtgcgtatataacatgatgggaaaacgtgaaaaaaaattaggagaatttggaaaagccaaaggatctagggcaatatggtatatgtggttaggagcgagattcctcgaatttgaagcccttggattccttaatgaggatcactggttctcaagagaaaatagtctttccggagttgaaggtgagggacttcacaaacttggatatattttaagagacgtatcaaaaaaggaaggaggtgcgatgtacgctgatgacacggcagggtgggatactaggatcacactggaggatttaaaaaacgaagaaatggtaacgaatcacatggaaggagagcacaagaagctagccgaagcgatctttaaattaacatatcaaaataaagtggtgcgagtacagcgtccgactccccgtggaaccgtaatggatataatatcacgacgagaccagcgcggatctggtcaggtggggacctatggactaaacactttcacaaacatggaagctcaattgatcagacaaatggaaggagaaggagtattcaaaaatatacagcatctgaccgtcactgaagaagtggctgtacaaaactggctagcaagagttggaagagaacggcttagtagaatggccataagcggtgatgattgtgtcgtgaaacctttagatgacaggttcgcaaatgcactcaccgcactaaatgatatgggaaaaatacgaaaggacatacagcaatgggaaccctccaaagggtggaacgactggacacaagttccattttgctcacatcactttcacgaattgataatgaaagatggcagagtattagtagtgccttgccgaaaccaagatgagctgatcgggcgggcaaggatttcccaaggtgctggttggagcttaagagaaacagcatgcttgggaaagtcgtacgcgcaaatgtggagtcttatgtattttcatcgaagggacttgagattagcagcaaatgcaatatgctcggcagttccgtcacactgggtgccaacatccaggacaacatggtcaatccatgctaaacacgaatggatgaccacagaggatatgttgacagtctggaatcgagtatggattagagaaaatccctggatggaagacaaaactccagttgaatcttgggaagagataccatacctaggtaaaagggaagaccaatggtgtggcagcctgatagggttgacatccagggcgacatgggcaaaaaatatacaagcagcaattaatcaggtacgtagtttgatcggaaatgaagaatatatagattatatgccaagcatgaagcgttttagaagagaggaagaagaagccggagtcctgtggtaa

SEQ ID NO: 22745 - RNA, 9876 nt, synthetic construct
  misc_feature 1..9876: note = derived and/or modified CDS sequence (opt6) from DENV-2__EU482664__SS-prME
  source 1..9876: mol_type = other RNA
acggctggagttataattatgttaataccgacagcaatggcgttccatctaacaacaagaaacggtgaaccacatatgatcgtcggtcggcaagaaaaaggaaaatcgctgctttttaaaacagaagatggtgtaaatatgtgtacacttatggcgatagacttaggagagctttgtgaagacacgataacttataaatgcccactactacgtcaaaatgaaccggaggacattgattgttggtgtaattctacttccacttgggtaacatatggaacttgtacaacgacaggagaacatagaagagaaaaacgttcagtagcattagttccgcacgtagggatgggactagagactagaactgaaacttggatgtcaagtgaaggtgcatggaaacacgcacagcgaatagaaacatggatactacgacatcctggtttcactatcatggcagcaatactcgcctacacaatcggaactacgcatttccaacgagcactgatttttatcctactaacagctgtggcaccttcgatgacaatgcggtgtataggcatctccaatcgtgactttgtagaaggagtatcgggcgggtcatgggtagatattgtgctagagcacggttcatgtgtaacgactatggccaaaaataaaccaactttggattttgagttaatcaaaacggaagccaaacaacctgcaacgttacgtaaatactgtatagaagcgaaactaacaaacacaacaacagaaagtcgctgcccgacgcaaggagagccgagtttaaacgaggaacaagataaacggtttgtctgtaaacactctatggtagaccgcggctggggtaatggatgcggactattcggtaaaggaggtatcgttacatgcgcaatgttcacatgcaagaaaaatatggagggtaaaattgttcaaccagaaaatctggaatatactatagttattacgccacatagtggggaagaacatgcagtcggtaacgatactggaaaacacggaaaagagattaaaataacaccccaatcttcaataactgaagctgagttaacaggctacggaaccgtaacaatggaatgtagtccacgtacgggcctagatttcaatgaaatggtactattgcaaatggaagacaaagcctggctcgtccaccgtcaatggtttttagatcttcctctgccttggctacccggagctgatactcaaggttcaaactggattcaaaaagaaaccttggtaacatttaagaacccacatgccaagaaacaagatgttgtggtattgggttcgcaagaaggtgcgatgcacaccgcattaacgggagctactgagatccaaatgtcttccggaaatctactttttacaggacatctaaaatgtagactacggatggataaactacaacttaaaggtatgagttattcaatgtgtactggaaaattcaaaatagtcaaagagattgctgaaacacagcacggtacaattgtaatcagagttcaatacgaaggagacgggtcaccttgtaaaattccatttgaaataatggatctagagaaacgtcatgtactcggcagactaataacagtgaacccaatagtcacagaaaaggattcaccggttaatatagaagcagaaccgccgtttggggattcctacatcataattggagtggaacctgggcaattaaagttaaattggtttaagaaagggtcatcaataggacaaatgttcgaaacgactatgagaggggcaaaaagaatggcgatactaggtgacacagcgtgggattttggctccctaggaggagtatttaccagtatcgggaaagccttacaccaagtatttggtgcaatatacggtgcggcattttcaggtgtaagctggaccatgaaaatcctaattggagcaataatcacttggattggtatgaactcgagatctacaagtttaagtgtctccctcgtcctagtcggagtaatcacattatacctgggagctatggtacaggctgattcgggatgcgtagtaagctggaaaaataaggaacttaaatgtggttctggtatattcatcacagacaacgtccatacttggactgagcagtacaaattccaacctgagtctcccagcaaactagcatcagcgatccaaaaagcccacgaagagggaatctgcgggatacgaagtgtaacacgccttgaaaatttaatgtggaagcaaataacaccggagttgaatcacatactgagcgaaaatgaagtaaagctaactatcatgacaggagatataaaaggaataatgcaagcaggtaaaaggtctttgagaccacaaccaacagaattaaaatattcatggaaaacatgggggaaggccaaaatgctatctactgagagccacaaccagacctttctcattgacggtcctgaaacagcagaatgcccgaatacgaatagagcatggaatagtctcgaagtggaagattatggattcggcgtttttacgaccaatatatggctaaagctacgagaaaaacaagacgtcttttgcgattcaaaactaatgtctgcagcgataaaggataaccgagccgttcatgcagatatgggctattggattgaatcagcactaaacgatacttggaaaatggagaaggcttcattcatagaagtaaaatcatgccactggcccaaaagccacacgttatggtcaaatggagtgttagaatcagaaatgataataccaaaaagttttgccggaccagttagtcagcacaattacagaccaggctactatacacaaacagcaggaccttggcatctgggaaaactagagatggatttcgacttctgtgagggaaccactgttgttgttactgaagattgcggcaatagaggacctagcttaaggaccacgacagctagcggcaagttgataacagaatggtgttgtaggtcgtgcactctaccaccgttacgttatcgaggagaagatggttgctggtatggaatggagatacggccgttaaaggaaaaggaagagaacttagttaactcattagtcaccgcagggcatggacagatagataacttctctcttggggtgctaggcatggctttatttttagaagaaatgttaagaactagagtcggcaccaagcacgcaattctccttgtggctgtatcattcgtaacattaataactggaaatatgtcattcagagatctcggtagagttatggtcatggtcggtgccaccatgaccgatgacataggcatgggtgtaacgtaccttgcattattagcggcatttaaagtccgacctacatttgcagccggtttgttgctacgaaaattaacaagtaaagaactaatgatggctacaatcggtatagcattattaagccagagcaccataccagaaacgatacttgaactcactgacgcgttagccctgggcatgatggtacttaaaattgtaagaaacatggaaaaatatcagctggcggtaacaataatggcaatctcatgcgttccaaatgccgtaattctgcagaatgcgtggaaagttagttgtacaattctagccgcagtctctgtgtcaccattattacttaccagtagtcaacaaaaagctgattggatacccttagcactaactataaagggtttgaatcccacggccatttttcttactaccctctcacgtactagcaagaaacggtcctggcctttaaacgaagctataatggctgttggaatggtctcaatactggcatcttcactgctcaagaatgacatcccgatgacaggtccattagtagcgggagggttattgacagtatgttatgttctaactggtaggtcggccgacttagaattagaaagagccactgatgttaaatgggaagatcaagccgagataagtggtagttcacctattttatctattactataagtgaagacggcagtatgagcataaagaacgaagaagaggagcagacactcacaatactaatcagaacaggattgctcgtcatatcaggtttatttcctgtttccattccaattacagccgctgcctggtatttatgggaagtaaagaaacaaagagcaggcgtcctgtgggacgttccctcgccaccacctgtaggaaaagctgaactagaagacggcgcataccgaataaaacagaaagggatattaggatactcgcaaataggagcaggagtatataaggaaggaactttccacactatgtggcatgtaactcgaggggcagttttaatgcataggggcaaaagaatcgagccttcgtgggcagatgtaaagaaggatcttatatcatacggcggcggctggaaattagagggggaatggaaggagggagaagaagttcaagtactagccttagagccaggcaaaaatccaagagcagtccaaacaaagccgggtcttttcaaaacgaacacaggaacgatcggagctgttagcttggatttcagtccaggcacttcaggcagtccaatcgttgatcgcaaagggaaggttgtcggattgtatggtaatggcgtagtaaccagatcaggtgcttatgtatcagcgattgcacaaactgaaaaatccatagaagacaacccagagatcgaagacgatatcttccgtaagaagagattgactataatggacctacatccaggcgcaggaaaaacgaagagatatctgcccgcgatcgttcgagaagcaataaaaaggggtttacgaaccttaatattagcaccaaccagagtcgtggcggctgaaatggaggaagcgttaagaggtttaccgatacgatatcaaacccctgctataagggcggaacacacaggaagggaaattgtagatctcatgtgtcatgcgaccttcacgatgaggctgctatctccagtgcgggtgccgaattacaatctgataataatggacgaggcgcattttacagacccagcatccatcgcggcaagaggctacatatctacaagagtagaaatgggggaggcagcagggatttttatgacggccactccgcctggctcaagggatccttttccgcaatccaacgcaccaatcattgacgaagaacgggaaattcctgagagatcttggaatagcggacatgaatgggtaacggatttcaaaggtaaaaccgtatggtttgttccatcaatcaaggccggaaacgacatagcagcttgcctcaggaaaaatgggaaaaaggtcatccaactatcacgaaaaaccttcgatagcgaatatgtaaaaaccagaacaaatgattgggactttgttgtgaccacggatataagtgaaatgggcgcaaattttaaagccgaacgagtaattgacccgagacgatgtatgaagcctgtgatactaacagatggtgaagaaagagtaatcttggctggaccaatgcccgttactcatagttctgcagcacagagaagagggaggataggacgtaatccgaaaaatgaaaatgatcaatatatttacatgggagaaccgctagaaaacgatgaagattgtgctcactggaaagaagcaaaaatgcttttagacaatataaacacacctgaagggatcattccttccatgttcgaaccagaaagggaaaaagttgacgcgatagacggcgaataccgtttgagaggcgaagcacgcaaaacattcgtagacctaatgaggagaggagatttgcctgtttggttagcttacagggtagcggctgaaggaattaactatgctgatagacgatggtgttttgacggagtcaaaaacaatcaaatattggaagaaaacgtggaggtagaaatctggactaaagaaggcgaaaggaagaaactaaagcctagatggttagacgcaaggatatacagtgacccactagctctaaaagaatttaaggaatttgcggctggcaggaaatctctcacattaaacttgattaccgaaatgggtcgtttgcccacatttatgactcaaaaagctagagacgctcttgacaacctagcggtactacacacagcagaagccggagggagagcttataaccacgcactctccgaattaccagagacattagagacattattattattaaccctactagcaacagtaaccggaggcatattcttatttttaatgtcgggaaaaggcgtaggaaaaatgacgttaggtatgtgttgcattataacagcttcaatcctactttggtatgcacagatacagccgcactggatagcagcttctatcatattagagttctttttaattgtgttactaatcccggaacctgaaaaacaacgtacaccgcaggataaccaactaacatacgttgtaattgcaatattaacagtcgtagcagcgactatggcgaacgagatgggtttcttagaaaagaccaagaaagatcttggattaggttcagtggcaacccaggagccggaatcaaatatacttgacattgatctaagaccagcaagtgcatggaccctctatgccgttgctacgacgtttgtaacacctatgttgcgacactccattgaaaacagcagtgtcaatgtcagcttaacagctattgccaaccaagccaccgtacttatgggcttaggaaagggatggcctctaagtaaaatggacataggagttcctctattagcaataggatgttacagccaggtaaaccctataacattaactgcggcattactccttttaatagcacattatgcaataattggtcccggattacaagcaaaagcaactcgtgaggctcagaaacgggctgcggcaggcataatgaagaatccaacagtagatggaattacagtaatagacctcgacccaataccgtatgacccaaagttcgagaagcaactaggtcaagttatgctactaatactttgcgttacccaagtgttaatgatgagaactacttgggccttgtgcgaagcactgactctggcaaccggacctatatctaccctttgggaaggtaatcccggtcgcttctggaacactactatcgctgtgtctatggcaaatatttttaggggctcctacctggctggtgctggactactattctcgataatgaaaaacacaacaaatacacgacgtggaactggaaatatcggggaaactttaggtgaaaaatggaaatcgaggttgaacgcgttaggtaaaagcgaatttcaaatatacaagaaatcaggtatccaagaagttgataggacactagcaaaagaaggaatcaagagaggagaaaccgatcatcatgcagtcagtagaggaagcgcgaaattgcgatggtttgtcgaaaggaacatggtaacaccggaagggaaagttgtcgacttaggatgcggccgaggcggttggtcctattattgtggcgggctgaaaaacgtacgagaagtgaagggtctgactaaaggagggcctggtcacgaggagccaattcctatgtcaacatacggctggaacctggtcagactacagagcggcgtggatgtattctttaccccaccggaaaaatgcgacacattattatgtgatataggtgaatctagtccgaatcctacaatagaagctgggcgaactctacgagttctatcgcttgtcgaaaattggctaaacaacgatacgcaattttgcataaaagtgctaaatccctatatgccatctgtgattgaaaagatggaaacccttcaacgtaaatacggaggagcgctggtacgaaatccgttgtcaagaaatagcactcatgaaatgtactgggtgtccaacgcaactggcaatatagtgagctcagttaacatgatttcccgaatgttaataaatagattcacgatgaaacataagaaggcaacgtatgagcctgatgtagatcttggctcggggacaaggaatataggtatagaaagtgagattcccaacctagacatcataggcaagcgtattgagaaaataaagcaagaacacgagacatcctggcattatgaccaagatcatccctacaagacgtgggcatatcatggttcttacgaaactaaacaaacaggatctgcttcatcgatggtaaacggcgtagtgagattactaactaaaccttgggatgtagtccccatggtaacacagatggccatgacagacactacaccatttgggcaacagagagtattcaaggaaaaggtagacacaagaacacaagagcccaaggaaggaaccaagaaattaatgaaaattacagccgaatggctctggaaagaacttggcaaaaagaagacgcctagaatgtgtactagagaggagttcacgagaaaggtgcgaagcaatgccgcactaggagcaatttttacagacgaaaataaatggaaaagtgcaagggaagctgtagaagattcccgattctgggaactggttgacaaagaaaggaacttacatctggagggaaagtgtgaaacgtgtgtatataatatgatgggtaagcgagaaaagaaactgggtgagttcggaaaggcaaagggatctcgagcaatatggtatatgtggttaggagctagatttttagagtttgaagcgttgggatttttaaacgaagaccattggtttagtcgagaaaattccctaagtggtgtcgagggagaaggactacataaacttggttatatcctgagagatgtatcaaagaaagaaggaggtgctatgtacgcggatgatacagctggatgggacactagaataacactggaagatctcaaaaacgaagagatggtcaccaaccacatggaaggtgaacataaaagactagccgaagcaatatttaaacttacttaccaaaacaaggtagtgagggtccaacgcccaacaccacgaggcactgttatggatataatttcccgtcgagatcaaagaggatcgggtcaagtgggtacttatggactgaatacatttaccaacatggaagcccagctaataaggcaaatggagggcgaagggattttcaaaagtatacaacacctaaccgtaacggaggaaatcgcagtacaaaattggctagcaagagttgggcgagaacggctcagccgtatggctatcagcggggatgattgcgtggtaaaaccgctagacgaccgattcgcaagtgccttaacagcattgaacgatatgggaaaagtaaggaaagacattcagcaatgggaacctagtaaaggatggaacgattggacacaagtcccgttctgcagccatcattttcacgaactaattatgaaggatggccgggttctagtagtaccctgtcgaaaccaagacgagttaataggacgagcgaggataagccaaggcgctggctggtccttaaaagaaacggcatgcttaggtaaatcatatgcacaaatgtggtcccttatgtactttcatcgaagagacctccgattagccgctaatgcaatatgttcagccgtcccaagtcattgggtcccaacatcacggacaacatggtccattcacgcaaaacatgagtggatgaccaccgaagacatgcttactgtatggaatcgagtatggattcaggagaacccttggatggaggataaaacaccagtagagtcttgggaagaagtaccatatctcggtaaacgtgaagaccaatggtgcggaagcctaattggactaacatcacgagcgacttgggctaagaacatacagacagctataaaccaagttcgttcactaattggcaacgaagaatatacggattatatgccatcaatgaaaagattccgtagggaagaagaggaagccggagtattatggtag

SEQ ID NO: 22746 - RNA, 9876 nt, synthetic construct
  misc_feature 1..9876: note = derived and/or modified CDS sequence (opt6) from DENV-2__EU482665__SS-prME
  source 1..9876: mol_type = other RNA
tcggcaggaatgattatcatgcttattccaaccgtgatggcattccatctcacaactaggaatggagaaccccacatgatagttgggatacaagaaaaaggaaaatcgttactatttaaaaccgaagatggagttaatatgtgtacactaatggcaatggatttgggagaactttgtgaagatacaattacatataaatgtccactcctcagacagaatgaaccggaagatattgattgttggtgcaatagtacatcaacctgggttacatatggaacctgtacgacaacaggtgaacatagaagggagaaaagaagtgtggcattggtaccgcatgttggaatggggctcgaaacacgtaccgaaacatggatgtcttcagaaggggcgtggaaacatgcgcaaaggatagagacgtggattcttaggcaccctggttttacgataatggctgctatactggcgtatactattggtactacacactttcagcgggttttgattttcattttgttaaccgctgttgcaccatccatgactatgaggtgcattggaattagcaacagagactttgtagaaggagtgagtggaggaagttgggtggatatcgttttagaacatggatcatgtgtaacaacgatggctaaaaacaaaccaaccctagacttcgaattaattaaaaccgaggcaaaacagccggcgacactacggaaatactgtatagaagcaaaattaacaaatacaactaccgaaagtcgctgccctactcaaggtgagccatcattgaaagaggaacaggataaaaggtttgtatgtaaacacagtatggtcgataggggctggggaaatggttgtggattatttggtaaagggggaatcgtgacatgtgctatgttcacgtgtaagaagaatatggaaggaaaaatcgtacaaccagaaaaccttgaatatactatagttgtgacaccacactcaggagaagaacacgcagtcggcaacgatacaggaaagcatggaaaggaaataaaggtcacaccacagtcaagcataactgaagcagaactcacagggtatggaacagttacaatggaatgcagccctcgaacaggattagattttaacgaaatggtactcctgcaaatggaaaacaaggcttggttggtacatagacagtggtttttagacttacctcttccttggctacccggagcagacaaacaggaatcaaactggatccaaaaagaaacgctcgtgacgtttaagaatcctcatgccaagaaacaggatgtcgtggtgttaggtagccaagaaggagcaatgcacacggcccttacaggagcgacagaaattcaaatgtcaagcggaaatcttctattcacagggcacctaaagtgcaggttgcgtatggacaaactccaattgaaaggaatgtcatatagcatgtgtacaggtaaatttaaggttgtaaaagaaatcgcagagacacaacatggcacaatcgtaatcagagtacaatacgaaggggatggaagcccttgtaaaataccctttgagatcatggatttggaaaaacgatacgtattagggcgtcttataacagttaatcctatcgttaccgaaaaagactcaccggtaaacatcgaagccgaaccgccgttcggagacagctacatcataattggagttgaaccgggtcaattgaaattaaactggtttaagaaaggatcttcgattggccaaatgtttgaaacgacaatgcgaggagcgaagcgaatggcaatattaggcgacaccgcatgggatttcggatcacttggaggagtttttacttcgatcggaaaagccttacatcaagtattcggagctatctatggagctgcatttagcggagttagctggacaatgaaaatactaatcggagtaattataacatggataggaatgaactcaaggagcacaagtttgtctgtgtcgttagtgttagtaggaatagttacattatacttaggtgtaatggtacaggctgattcaggttgtgtcgtgtcatggaagaacaaagaattaaagtgtggcagtggtatttttatcacagacaatgtgcacacttggacggaacaatataagtttcagccggaatctcctagtaagttagcttcagccattcaaaaagcgcaagaagagggtatttgcggtattaggtccgtaaccaggctagaaaatttaatgtggaagcaaattactccagagctaaatcacattcttgctgagaatgaagtaaaattaaccattatgacgggtgacatcaaaggtattatgcaagccggtaaaaggagcttgagacctcaaccgaccgaattgaaatatagttggaagacgtggggcaaagctaaaatgctctcgacagaaagttacaaccaaacttttctaatagatggtccagaaacagcagagtgtcctaacaccaaccgagcttggaatagcttagaagtagaagactatggtttcggagttttcacaacaaatatatggctgaagttgaaagaaaaacaagatgcattttgcgatagtaaactcatgtcagcagctattaaagataatcgagccgttcatgctgatatgggatactggattgaaagtgctttgaatgatacatggaagatagaaaaagctagcttcatagaagttaagaattgtcattggccaaagtcacacactctctggtctaacggagttctagaatcggagatgataataccgaaaaatttggcaggaccagtttcacagcataattacagaccaggctatcatacccagattgcgggcccatggcacctcggaaaacttgagatggattttgacttctgtgatggaacgacagtaattgtaacagaagattgtggtaatcgaggaccttctttgaggactacaacggctagtgggaaacttattacagagtggtgctgcaggtcctgcactttaccgcctcttagatatcgaggtgaagacggatgctggtacggaatggaaatccgaccactaaaggaaaaagaagaaaatttagtaaattctttagtcacagcagggcatggacaagtcgacaacttttctctaggagttctaggaatggctttgtttttagaagaaatgttaagaacccgagtaggcacaaagcacgcgatactactcgtggcagtctcgtttgtaactttaataacaggcaacatgagctttaaagacctgggaagagtcgtagttatggtgggggcaaccatggcggatgatataggcatgggggtcacgtacctagctctattggcagcctttaaagtaaggccaacgtttgcagcagggctactattaagaaaattaacatcaaaggaattaatgatgacaactattggtatagttctcttgtctcaaagtacaatccccgaaacagtgcttgaactcactgatgctctagcattaggaatgatggtactaaaaattgtacgtaacatggaaaagtatcaacttgcagttacaattatggcaatcttatgtgtcccaaacgccgtgatattgcaaaatgcgtggaaagtgtcatgcacgatactggcggttgtcagtgtaagcccgttattacttacttcctcacaacaaaagacggattggataccactagcactaacaatcaaaggcttgaacccaacagccatctttttaactacactatcaaggacaaacaagaagcggtcgtggcccttaaacgaggcaataatggcagtcggtatggtctcaattttggcttccagcttgctaaagaacgatatccccatgacagggccacttgtagctggagggcttttaaccgtgtgttatgtattaaccgggagatcagcagaccttgagctagagcgagcaacagacgttaaatgggaagaccaagctgaaatatctgggtcaagcccaatactaagcataacaatatcagaagatggaagcatgagtataaagaatgaggaagaagaacaaactttaacaatattgatacgaacaggacttttggtaatatccggacttttccctatttccatacctataacagctgcagcatggtatttatgggaagtcaagaaacaaagagcaggagttctctgggatgtcccgtcgccacctcccatgggaaaagcagaattagaagacggggcatatagaataaaacaaaaagggattctaggttattctcaaataggagcgggagtctataaagaaggtacattccataccatgtggcacgtcacacgtggtgctgtacttatgcacaagggtaaacgaatcgagccttcatgggcggatgttaagaaagatctaatatcatatggagggggatggaagttagaaggggaatggaaggagggtgaagaagtacaagtactggcattagaaccaggcaaaaatcctagagctgttcaaactaaaccaggtctttttaaaaccaatacaggaactataggagctgtatcattagattttagccccggaacaagtggatcccccataatagacaagaaaggtaaggttgttggattatatgggaacggagtagtcacccgatctggtgcttatgtatcggctattgcccaaacggagaaaagtatagaagacaatccagaaattgaggatgacatatttaggaaacgtagattgacaataatggacttacatccaggcgcgggtaaaactaaaaggtatttacctgcaatagtgagagaagctataaaaagggggctacggactctaatacttgcacctacccgtgttgtcgcggctgaaatggaagaagcattgcggggtttgcccatcaggtatcaaacaccagccattcgggcagagcacacgggtagagaaatagttgatttaatgtgtcatgcaaccttcactatgagactactaagccctgtaagagttcctaattacaatttgatcataatggacgaagcacactttacagatccagcttcaatcgcagcaagaggatacatcagtactagagttgaaatgggtgaagctgccggaatatttatgacagcaaccccacccggcagcagggaccctttcccgcaatcgaatgccccaattatagatgaagaacgtgaaatacctgaacgaagctggaatagtggccatgagtgggtgacggatttcaaaggcaagacagtttggtttgtgccctcaataaaagccggtaatgacatcgcggcttgtttacgtaagaatggcaagaaagtcattcagctatcccgaaaaacgttcgactcggaatatgtaaaaacacgaactaacgattgggattttgtcgttactactgacataagtgaaatgggagctaattttaaagcagaaagagttatagatccacggcgatgcatgaaaccagtaattctaacagatggagaggaaagagtaatactagctggaccaatgccagttacacactcgtcagccgcacagagacgtggacgaataggcagaaatcccaagaacgaaaacgaccaatatatatacatgggagaaccgttagagaacgatgaagattgtgcacactggaaggaagcaaaaatgctactcgacaacattaacacaccagaaggaataattccatctatgtttgaaccagaaagggaaaaagtagacgcaatcgacggtgaataccgattacgaggcgaagcaagaaagacattcgttgacttaatgcgtcggggtgatctaccagtttggctcgcatataaagtggcagcagagggtatcaattatgcagatagacgttggtgttttgatggaattaagaacaaccagatactggaagagaacgtagaagtggaaatatggacaaaagaaggagaacgaaagaaactgaaaccgagatggctagatgcaagaatatacagcgatccgctagcgctaaaagagttcaaagagtttgcagctggtagaaaatcactaacgttaaacctcataacagagatgggaagactaccaactttcatgacacagaaaactagagacgcactagataacctagcagttttgcatacagcggaagccggtggtagagcttataaccacgccctatcagagctccccgaaactctagagactttattgttactcaccttgctagcaacggttactggagggatattcttatttttaatgagcggacgtggaataggaaagatgactcttggaatgtgttgtataataactgccagtatacttctgtggtacgcacaaatacaaccacactggatcgcggcgtccataatacttgagttctttctgatagtcttgcttatacctgaaccagaaaaacagcgcacaccgcaagacaatcaactaacctatgtcgtaatagccattttgacagtcgtggcagcaacgatggccaacgaaatggggttcttggaaaagacaaagaaagactttggcctaggctcaatcgcaacgcaacagccagaatccaatattttagacattgatcttcgaccagcgtctgcatggactctgtacgctgttgctacaactttcgtgacacctatgctaagacattcaatagaaaactccagtgttaacgtaagcctgactgcaatagctaaccaagccacagtattaatgggacttggtaagggatggccattgtctaaaatggacattggagtaccactgctagctataggttgttatagtcaagttaaccctataacattaacagcggcacttcttcttctagtggcacactacgcaataattggaccaggattgcaagccaaagcgacacgagaagctcaaaagagagcagcagcaggcatcatgaaaaatcccacagtagatggcatcactgtaattgaccttgatccaataccgtatgacccaaagtttgagaaacaacttggacaagtaatgcttttaatactgtgcgtaacacaagtattaatgatgagaaccacctgggcattatgtgaggctttaacattggcaacgggccctatttctaccctatgggaaggtaatccaggcagattttggaacacgacaattgcggtttcgatggccaacattttccggggttcttatttggccggtgccggccttctattttctataatgaagaatacgacaaacactagacgaggaacaggcaacattggtgagactctaggtgagaaatggaaaagccgattaaacgccttgggaaaatcagaatttcaaatttataagaaatccggaatacaagaggtagaccggacactagccaaagagggtataaagagaggagaaacagaccatcacgctgtatctcgtggctcagcgaaattgcggtggttcgtagaaagaaatatggtgacccctgaaggaaaagtggtagatttaggttgtggaagaggtggatggtcttattattgcggaggcctaaagaatgtgagagaagtgaagggattgacgaaaggaggacccggtcacgaagaacctatccctatgtcgacttacggatggaatctggtgcggttacaaagtggggtagatgttttctttatccctcctgaaaaatgtgatacacttctttgtgatataggagaaagctcaccaaatcccactgtggaagctggccgtacattaagagtcctgaatttggttgaaaattggctcaataacaatacacaattttgtataaaagtattaaatccatatatgccatccgtaatagagaaaatggaagccctacagcgtaaatacggcggagcccttgtccgcaatcctttatcccggaactcaacacacgaaatgtattgggtttccaacgcgtcaggtaatatagtttcaagcgtaaacatgatatcaagaatgttaataaatcggttcactatgcggcataagaaagcgacgtatgagccagacgtggatctaggttcaggcaccagaaacatcgggattgagtccgaaattccaaatcttgacattatcggtaaacgtatcgagaaaattaagcaagaacatgaaacaagttggcactatgatcaagatcatccatataaaacatgggcctaccatggaagctatgaaacaaagcaaacaggctcagcttcatcaatggtcaacggcgttgtaaggttacttactaaaccatgggatgtactacctaccgttacgcagatggcaatgactgatactacgcctttcggccaacaacgcgtctttaaagagaaagtagatactcgtacacaagaacctaaagaaggcactaagaaacttatgaaaattactgccgaatggctttggaaagaactaggaaagaagaaaaccccaagaatgtgcaccagggaagaatttacacgaaaagtgcgaagtaatgcagctttgggcgccatatttacggatgaaaacaaatggaaatctgctcgtgaggctgtcgaagactcaagattttgggaacttgtcgataaagaaagaaacctccatctcgaaggaaaatgcgaaacatgcgtctacaatatgatgggcaaaagagagaagaaacttggcgaatttggtaaagccaaaggttcacgagctatctggtatatgtggctaggcgctagatttctggagttcgaagcactaggattcctaaatgaagatcactggttctcaagagaaaattcactaagcggcgtagagggtgagggattacacaaattaggttatatcttgcgagatgtttctaagaaagaaggaggcgcaatgtatgcagatgacaccgccgggtgggacacccgcatcacattagaagatcttaaaaacgaagaaatggtgacaaatcacatggaaggagagcacaagaaactggcggaggccattttcaaacttacatatcaaaataaagtggtcagggtacagcgcccgacgcccaggggtaccgttatggacattataagtcgaagagaccaaaggggatcaggtcaagtaggaacttacgggttaaatacattcacaaacatggaagcacaacttattcgccaaatggagggggagggtgtattcaaaaatatacaacatctcaccgtaacagaagaagttgccgtccaaaattggttagcccgagtcggccgcgagcgtttgtcaagaatggcaatatcaggtgatgactgtgtagttaaaccgttagacgatcgttttgcaaatgcattaacagctctaaatgatatgggtaaaatacgaaaagatatacagcaatgggaaccaagtaaaggatggaatgattggactcaggtcccgttttgttcacaccattttcacgaattaataatgaaagatgggagagttctggtcgtgccttgtaggaaccaggacgaattaataggccgagcgaggattagccaaggggcaggttggagtctaagagaaactgcttgtttaggtaaatcctacgcacaaatgtggtcgcttatgtacttccatcgacgagatctgcgcttagcagctaacgcaatttgctccgcagtccccagccattgggtcccaacaagcagaactacgtggagcatacatgcaaaacacgaatggatgactaccgaagatatgctgactgtctggaaccgagtttggataagagaaaatccatggatggaggataaaacaccagtagaatcttgggaagagattccatacttaggaaaaagagaagaccaatggtgcggctcactaataggtcttactagccgagctacttgggcgaaaaacatacaagctgccataaatcaggtccgtagcttaataggtaatgaggaatatactgattatatgccaagcatgaaacgttttagaagagaagaagaagaggctggagtattatggtaa

SEQ ID NO: 22747 - RNA, 9876 nt, synthetic construct
  misc_feature 1..9876: note = derived and/or modified CDS sequence (opt6) from DENV-2__EU482666__SS-prME
  source 1..9876: mol_type = other RNA
actgctggcgtaattataatgttgatacctactgcaatggcttttcacctaactactaggaatggggaaccacatatgatagttgggagacaagaaaaaggtaaaagtctattatttaaaacagaggacggagtcaacatgtgcactttaatggctatagatctcggagaattatgtgaggatacaatcacttataaatgtccacttttaaggcaaaatgaaccagaagatatagattgttggtgtaactccacttccacatgggtaacgtatggaacgtgcacaacgacaggtgaacacaggagggagaaaaggtctgttgccttagtgccacatgttggtatgggactcgaaaccaggactgaaacctggatgtcgtctgaaggcgcatggaaacacgcacaacggatagaaacatggattttacgtcaccccggcttcaccataatggcagcaatcctagcatatacaataggtacaactcattttcaacgagcattaatattcatactccttacggcagtagctccctctatgaccatgcgatgtatcggaatatctaatcgtgacttcgtggagggagtaagcgggggaagttgggtagatattgtactggaacatgggagttgtgtaactaccatggcgaaaaataaaccaacacttgattttgaattaataaaaacggaagcaaaacaacctgcaacgttgagaaaatactgcatagaagctaaattaactaataccacgacagaatctagatgtccaacgcaaggggaaccaagtctgaacgaagaacaagataaacgatttgtatgtaaacattcaatggtggacagaggatggggtaacgggtgcggactatttggcaaaggcggaatagtaacttgcgcaatgttcacatgtaagaaaaatatggaagggaaaattgtacaaccagagaacctagaatatactatcgtcataacgcctcattcaggcgaggaacatgctgtaggtaacgatactggaaaacatggcaaagaaatcaaaataactcctcaatcgtcaatcacagaagctgagctaacaggctacggaactgtaaccatggaatgctcgccacgcacaggcctagactttaacgaaatggttttacttcaaatggaagacaaagcatggttagtacacagacaatggtttttggacttacccctaccttggcttcctggtgcagatacccaaggaagcaactggatacagaaagaaacccttgtaacttttaaaaacccacatgcaaagaagcaagacgttgtagtgctagggagccaagaaggtgcaatgcataccgctcttacaggagcaacggaaatacaaatgtcaagcggaaatttactgttcacaggtcacttgaaatgtcggttaagaatggataaactccaacttaaagggatgtcatactcgatgtgtacaggtaaattcaaaatcgtaaaagaaatcgcggaaacacaacacgggacgattgtcataagggtacagtatgagggggacgggtccccctgtaaaataccatttgaaataatggatttggaaaaacgacatgtgttagggagacttattacagtcaacccaatagtaactgaaaaagactcaccggtaaatatagaagcagaacctcccttcggcgacagctacatcattattggagtagaaccgggtcaattaaaactcaattggtttaagaagggtagcagtattgggcagatgtttgaaacaactatgcgtggagctaagcgaatggcaatcctaggtgatacagcatgggacttcggaagtctaggaggagtattcacatctatcggcaaagcccttcaccaagttttcggggctatatacggagcggcattctcaggcgttagctggaccatgaaaatactgattggcgcgattataacttggataggtatgaactcgcggtccacttcacttagcgtgagtttagtattagttggggttataacactatacctgggcgctatggtccaagccgatagcggatgtgtggtatcctggaaaaataaagaattaaaatgtggaagtggaattttcatcacagacaacgtacacacatggactgaacaatataagtttcaacccgaatcaccgagtaagctagcctcggcaatccaaaaagcacatgaagaagggatatgtggaatccgttccgtaacacgattagagaatttaatgtggaaacaaataacacccgaattgaatcacatcctgagtgaaaatgaagtcaaactaacaataatgacaggcgatattaaagggataatgcaagcaggtaaacgatccttgagaccacaaccaacagagcttaaatacagttggaaaacctggggcaaagcaaaaatgctatcaacagagtcacataaccagacatttttaattgatgggcccgaaactgctgagtgcccaaatacaaatagagcttggaacagcctggaagtggaggactatggatttggagtcttcaccacgaatatctggcttaaactccgggagaagcaagatgtcttctgtgacagtaaactaatgagcgcagctataaaggataatagagctgtacatgcggacatgggatactggattgaaagcgctctgaacgatacatggaagatggaaaaagcctcgtttatcgaagtcaagtcatgccattggcctaaatcacatactttatggagtaacggtgttctcgaatcagaaatgataataccaaagagtttcgcaggtccggtatcacagcataattataggccaggctaccatacacaaacagcgggaccatggcaccttggtaaattggagatggattttgatttctgtgaaggcaccacagttgtggttacagaagattgcggaaaccgaggacccagcttgaggacaacaacagcatcaggtaaattaatcaccgaatggtgttgccggtcatgcaccttaccaccattaaggtataggggcgaagatggttgctggtatggcatggaaataagaccacttaaggagaaagaagaaaatcttgtaaattcattagtcaccgccggacatggacagattgacaacttctctctcggtgtccttggtatggcgctatttctagaagaaatgctaagaactcgggtaggaacaaaacatgctattctacttgttgctgtctcattcatgacgctaataactggaaacatgtcattcagagacttaggtagggtaatggtaatggtaggagcaacgatgacagacgacatcggaatgggggtcacttatctcgcactgttagcggcatttaaagttaggcctacctttgcagcgggactcctattaagaaaattgacatctaaggagttaatgatggcaaccataggtatagccctgttaagtcagagtactatcccagagactatccttgagctcactgatgctcttgccttaggcatgatggttttaaaaataatgagaaatatggaaaaatatcaactcgcggtcacaataatggcgatctcgtgtgtaccaaacgcagtcatattacaaaatgcatggaaagtcagttgtacgatactagccgcagtttccgtatcaccactactgttaacaagttcacaacaaaaagcagactggatacctttagcgctaacaattaaaggcctaaacccaacggcaattttcttaaccactctttcaaggacttcaaagaaaaggtcatggcccttgaatgaagcgattatggcagtaggaatggttagtatactcgcgtcaagtttgctcaaaaacgacatcccaatgacagggcctctagttgctggaggattactaacagtatgttatgtactaactggaagaagtgcagatttggaactggaacgagcaactgacgtaaaatgggaagaccaggcggagatttcgggcagtagtccaatactttccataacaattagtgaagatggatccatgagtatcaaaaatgaagaagaggaacagaccctaactatattgatcagaacgggattactcgtcatttcaggtttatttcccgtaagtatcccgatcacagccgcagcctggtacttatgggaagtcaagaaacaaagagcgggagtgctttgggatgtaccatctccaccacccgtgggcaaagcggagttggaagacggggcatatcgtatcaagcaaaaaggtattctaggatattcacagataggggccggtgtctataaagagggaacctttcacacaatgtggcacgtcactagaggggctgtgctaatgcaccgaggcaaacggatagagccgtcctgggccgacgtaaagaaagatcttatatcttacggcggcggctggaaattggaaggggaatggaaagaaggtgaggaagtccaggtactagctttagaaccagggaaaaaccccagggcggtacaaacaaaaccgggattatttaaaacaaatacaggtacaatcggagcagtgtcattagatttttcgccggggacaagcgggagccctatagttgacagaaaaggtaaagttgtaggactgtatggaaatggagtggtcacaaggagcggcgcttatgtcagcgccattgcgcagactgaaaagtccattgaggacaatccagaaatagaagacgacattttcaggaagaaaaggcttacaattatggatttgcacccaggcgctgggaaaactaaaagatacctccctgctatagtacgtgaagcaattaaacggggactacgaacgttaatcttggcacctacaagagtagtagcagcagaaatggaagaggccttgagaggacttcccattagataccaaactccagcgataagagctgaacacacaggccgagaaattgtagatcttatgtgtcatgcaacatttacaatgagactcctctcacccgttagggtgccgaactataatttaatcataatggacgaagctcactttacggatcctgcaagtatagcagcacgaggctacatatcaacgagagtagaaatgggggaggccgccggaatctttatgacagcgacaccgcccggtagccgagacccgttcccgcaaagtaacgccccgatcatcgatgaggaacgagaaatccctgaaagaagttggaacagtggtcatgaatgggtaaccgattttaaaggaaaaactgtatggtttgtaccatctataaaagctggtaatgatatagctgcgtgtctacggaagaacggaaagaaagtgattcaattatcacgtaaaaccttcgactctgagtacgtaaaaacacgaacaaacgactgggatttcgtcgtgaccacagatatatcagagatgggtgctaattttaaagctgagcgtgtcatagacccgagaagatgcatgaagccagtaatactaaccgatggagaggaaagagtcatattagcaggacctatgcctgttacccattcttcagctgcgcagaggcggggccgaattgggagaaatccaaagaatgaaaacgatcagtatatttacatgggggagccattggaaaacgatgaagattgtgctcactggaaagaagcgaaaatgttgctagataatattaacacaccagaaggcattatcccctccatgtttgagcccgaacgggagaaagtggatgctatcgacggggagtatcgacttcgaggcgaagcaagaaaaacgttcgtagatcttatgagacgcggcgatttacccgtgtggttagcatatagagttgcagcagaaggaataaactatgcagatcgacgctggtgcttcgatggagtcaaaaacaaccagattctcgaagaaaatgtcgaagtagagatctggaccaaagaaggagaacggaagaagctcaagcccagatggcttgatgcacgcatatactcagatcccttagctttaaaagaatttaaggagttcgcagccggaagaaaatccctcacgctgaatttaatcacagaaatgggtcgattaccaacgtttatgacacaaaaagcaagagatgctctagacaatttggcggtcttacacactgccgaggctggagggcgtgcctataatcatgctttaagcgaattacccgaaacgcttgaaaccctattgttattaacattgttagccacagttacaggcggtatttttctgttcctgatgtctggaaaaggcgttggaaaaatgactcttggcatgtgttgcatcataacagcatcgatacttctttggtacgcccaaatacaaccacattggatagctgcaagtataatactagagttctttttaatcgttctcctgatcccggagccagaaaaacaacgcactccacaagacaatcagttgacttatgtagtaattgcaatactaactgtagtcgccgccactatggcaaacgaaatgggtttcctggagaaaactaagaaagatctcggattaggctccatagccacacaagaaccagaaagcaatatcttggatatagatcttagacctgcctctgcttggacgctatatgccgtcgctacaacatttgttacccctatgctaaggcattcgatagaaaactcttcagtaaatgtatccctaacagccatcgcaaaccaagcaacagtactaatgggcctaggaaagggatggcccctatctaaaatggacataggggtacctcttctagctataggatgttattcccaagttaacccaataacactaacggccgcacttttactcttgatcgcacactatgccattataggacccggacttcaggcaaaagcaacgcgagaggcacagaaaagggccgcagcgggaataatgaaaaaccctacagtggatggcatcaccgtcatcgatttagatccgattccatacgatccgaagtttgagaaacaacttggacaagtgatgcttttaattctttgtgtaacacaagtgctaatgatgagaaccacatgggccctttgcgaagcactaacgcttgctacaggaccaatttcaacattgtgggaaggcaacccagggaggttctggaataccactatagcggtctctatggcaaatatttttcgaggatcttacttggccggtgcgggcttattatttagtatcatgaaaaacaccacgaatacacgaagggggacaggtaacataggagaaacactaggagaaaaatggaaaagtagactaaacgcattagggaaaagtgagttccaaatatacaaaaagtcaggtatccaggaggtggacagaacactagccaaggaagggataaaacgaggagagacagaccatcacgcagtctctagaggatcggctaaattaagatggttcgttgaacgaaatatggtgactcccgaaggtaaagttgtggatttaggttgtggcagagggggctggtcctattactgtggaggactcaaaaacgtaagggaggtgaaaggattaactaagggtggtccaggtcatgaagaaccaattccaatgagcacatatggttggaatctcgttagattgcagagcggagtagacgtcttctttacaccaccagaaaaatgtgacactctactatgcgatatcggtgaaagctctcctaatccaacaatcgaagctgggcggactcttcgagtactgtcgttagtggaaaactggctaaataatgacacacaattctgcataaaagtactgaatccatacatgccttctgtcatagagaaaatggagacactccaacggaaatatggcggggctctagttagaaatccgctatcaaggaatagtacacacgaaatgtattgggtttcaaacgctactggtaacatagtttcgtcagtgaatatgatatctaggatgctaataaaccgtttcacaatgaaacataagaaagcaacatatgaaccggatgtagaccttgggtcaggtacaagaaacattggaattgaatcagagataccgaacttagacattattggaaaaagaattgagaaaataaaacaagaacacgagacatcttggcactatgaccaggatcacccatataaaacttgggcctaccatgggagctatgaaaccaagcaaaccggaagtgcatcctctatggttaatggcgtcgtccgtttgttgacgaagccttgggacgtggtaccgatggtcacccaaatggctatgacagatacgactccatttggacaacagagggtgtttaaagaaaaggttgacaccagaacacaagaacctaaagaaggtaccaagaaactaatgaaaataacagctgaatggctatggaaagaattaggcaagaagaaaacaccacgtatgtgtacaagagaagaatttacacgaaaagttaggagtaatgctgcactcggtgcaatattcaccgatgagaacaagtggaaaagtgcaagagaagcagtcgaagattctagattttgggaattagttgacaaagaacggaacctgcatttagaaggaaaatgtgaaacttgtgtatacaacatgatgggtaaaagggagaagaaattaggggagtttggaaaagctaagggatcacgagccatatggtatatgtggttgggggcacgatttctagagtttgaagcactaggtttcctaaacgaagatcattggttttctcgtgaaaattccttgtcgggggtcgaaggagaaggtctccacaagttaggatatattctccgcgatgtttccaagaaagaaggcggagctatgtacgcagatgacaccgcaggttgggacacgagaattacattagaagatttgaaaaatgaagaaatggtaaccaatcacatggagggagagcacaaaagactagcagaagcgatattcaaattaacttaccagaacaaagtcgttagagtccaaagacctacgccgcgaggtactgtaatggatataatcagccgaagagatcagagggggtcaggacaagttggcacttatggtttaaatacatttaccaatatggaagctcaactaattaggcaaatggaaggggaaggcatattcaaaagtatacaacatctaacagtaacggaagaaatagccgtacaaaactggttagcaagggtaggccgggaaagattgtccagaatggcaataagtggcgatgattgtgtagttaaaccacttgacgatcgctttgcttccgcattaacagccctcaacgacatgggaaaagttagaaaagatattcaacagtgggagccaagcaaaggctggaatgactggacgcaagtgccattttgtagtcaccatttccacgaactaatcatgaaagatggtagagttctagtagtaccatgtcgaaatcaggatgagcttatcggtcgcgctaggatctcccaaggagcgggatggagtctcaaagaaacagcgtgcctaggtaaaagctacgcacaaatgtggagccttatgtattttcatcggcgcgatctaaggttagctgcgaatgccatttgctcggcggttccttcacactgggttccaacgtcgagaactacgtggtctatccacgcaaaacatgagtggatgacaactgaagacatgctaaccgtttggaatagagtctggatacaagaaaacccttggatggaagataaaacgccagtcgaatcatgggaagaagtaccatacttgggtaaaagagaagatcaatggtgtggttcgctcattggtttaacttcccgagctacttgggccaaaaatatacaaacagcaattaatcaagttagatcattgataggaaatgaggaatatacagactacatgccatctatgaaaagatttcgtcgtgaagaggaggaggctggagtactatggtag

SEQ ID NO: 22748 - RNA, 9876 nt, synthetic construct
  misc_feature 1..9876: note = derived and/or modified CDS sequence (opt6) from DENV-2__EU482667__SS-prME
  source 1..9876: mol_type = other RNA
tccgcaggaatgataatcatgctcataccgacagttatggcattccatttaaccactaggaatggtgaacctcacatgatagttggaatccaagaaaaaggtaaaagcctgcttttcaaaacagaagacggggtaaacatgtgtactttaatggcaatggatctcggagaactctgcgaagacacaataacctacaaatgtcccttactacggcaaaacgaacctgaagacatagattgttggtgcaatagcacaagtacctgggtgacctacggtacttgtacgacaacaggagaacatcgtcgtgagaaaaggtccgtcgcattggtgccacacgtcggaatgggactagaaacgagaactgaaacgtggatgagctcggagggagcctggaaacatgcgcaaagaatagaaacctggatacttagacaccctggatttacgataatggcggcgatcctagcatacacaataggaacaacacatttccaaagagtcctgatctttattctactaacggcggtggcacccagcatgaccatgcgttgcattggtatctcaaacagagactttgttgagggcgtaagtggtggaagttgggttgatatcgtactcgaacacggatcttgcgtaaccacgatggcgaaaaataaaccaacattggatttcgaactgataaaaacggaagctaaacaaccggcaactctgcgaaaatactgcatagaagctaaactcacaaatactaccacggaatcaagatgtcctactcaaggtgaaccttcccttaaagaggaacaagacaaaagatttgtatgcaaacactcgatggtagatcgagggtggggaaatggatgcggcctgttcggtaaaggagggatcgttacatgtgctatgttcacgtgtaagaaaaatatggaaggaaaaatagttcagcccgagaatttagaatatactatagttgtaacaccgcattctggagaagaacacgcagtggggaacgatacgggaaaacacggcaaagaaataaaagtaacaccacaatcgagcatcaccgaagcagaattgactggatatggtaccgttacgatggaatgctcccctagaactggactggatttcaatgaaatggtattattacaaatggaaaataaagcgtggttggtccatcgacagtggtttctagatctcccactaccgtggttgcctggagccgataaacaagaatccaactggatacagaaagaagcacttgtaactttcaaaaatcctcatgctaagaaacaagacgtcgtagtactaggtagtcaagaaggggcaatgcatacggcgcttacaggagcaacagaaattcaaatgagtagtggcaatttactattcacaggtcatttgaaatgtagattgagaatggacaaactgcagcttaaaggaatgtcatattcaatgtgtactggcaaatttaaagtagtaaaagagatcgccgagacacaacatgggactattgtcatcaaagttcaatatgaaggggacggtagtccatgtaagattccctttgaaatcatggacttagagaagagatacgtattaggacgactaataactgtaaatcctatagtaacagaaaaagacagtcctgtgaacatcgaagcagaaccacctttcggtgattcctatataataataggtgttgagcccggacaattaaaactaaattggtttaagaaaggaagctcaataggtcagatgtttgagacaacaatgaggggcgcaaaaagaatggctatcctaggagatactgcatgggattttgggtcattaggcggagtgtttacttcaataggtaaagcactacatcaagtttttggagcaatatatggggcggctttcagtggcgtaagctggactatgaaaattttgattggagtcataataacatggatcggcatgaactccagatcgacatctctatctgtaagtttagtattggtgggaattgtcacgttgtatttaggagttatggtgcaagcggattctggatgcgtggttagctggaaaaataaggaactaaagtgtggatctggcatatttataactgacaatgtgcatacctggactgaacaatacaagtttcaacctgagtcaccatcgaaattagcttcagcaattcaaaaggcacaggaggaaggtatatgtgggatccgcagtgttacccgcctagaaaatctgatgtggaaacaaattacaccggaacttaatcatatattagctgaaaacgaggtcaaactaacaatcatgacgggagatattaagggtattatgcaagcaggaaaacgttccttgcgccctcaaccaaccgagttaaagtattcttggaagacatgggggaaagccaagatgttgagcacagaaagttataatcaaacgttcttaatagatggtccagaaacagccgaatgtcccaataccaacagagcatggaatagtctagaagtggaagactacgggtttggagtctttacgacaaacatttggctcaaactaaaagaaaaacaagatgtattttgtgattcgaaattgatgtcagctgcaataaaagataatagagcggtgcacgctgatatgggatattggatcgaatccgctctaaatgacacatggaagatagaaaaagcctcatttatagaagtgaaaaactgtcattggccgaaatcacataccctttggagtaatggggtccttgaatcagaaatgattattcccaaaaatctcgcaggccctgtatctcagcacaattatagaccgggctatcatacacaaatagccggaccatggcatctcggtaaattagaaatggattttgacttctgcgatgggactactgtaatagtgaccgaggattgtggaaatcgaggtcctagcctacgcactacaacagcatcgggaaaattaatcacagaatggtgttgcaggagttgcacactaccaccattaagatatagaggggaagatggatgttggtatggaatggaaatacgacccttgaaagaaaaggaagagaatttagtcaacagtttagtaacagcagggcacggacaagttgataacttttccctcggcgtgcttggtatggcactattcttagaagaaatgctaaggacgcgagtaggaacaaaacatgcaattttgttagtggcagttagctttgtcacgttaatcacgggaaatatgtcttttaaagaccttggtcgcgtggtagttatggtcggagcaaccatggctgatgatatcgggatgggcgtaacatatctagcattactagcagcctttaaagttaggccaacttttgcagccggccttctcttgagaaaattgacaagcaaagaactaatgatgacaacaataggcatcgttctacttagtcaatcaactatacctgaaacagtattggaattaacagacgcattagcgttgggcatgatggtgttaaaaatcgtacgaaacatggaaaaatatcaacttgcggtcacaattatggctatcctctgcgtaccaaacgctgtcatcttacaaaacgcatggaaagtttcttgtaccatactcgcggtcgtcagcgtaagccctctgttactaaccagttcacaacaaaagaccgattggatcccgcttgccctaacaatcaaagggctcaatccgaccgcaatttttcttaccactctaagcagaacaaataagaaaagatcttggccacttaatgaagccataatggcggttggtatggtttctatattagcaagtagtctccttaaaaatgatattcccatgacaggtcctctagtagctggcgggttattaacggtctgctatgttttgacaggcaggtcagcagacttggaattagaaagggctaccgatgtgaaatgggaagatcaagccgaaatatcaggatcttcaccaattctctcaataacaatatcagaagacggatcaatgtctatcaagaacgaagaggaagaacaaacactaacgatactgatcagaacaggattattggtaatatctggcctgtttccaatcagtatcccaataacggcggccgcctggtatttatgggaggtgaagaagcaaagagccggggtcctatgggacgttccatcaccgccacccatggggaaagcagaactggaagacggggcatatcgaataaagcaaaaaggaatcctaggttatagtcaaattggagctggagtgtacaaagaaggcacattccatacaatgtggcatgtgacaagaggggcagttctaatgcacaaaggaaaaagaatagagccatcgtgggcagacgtcaagaaagatctcataagttacgggggaggttggaaacttgaaggagaatggaaggagggagaagaagtccaagtattagccctagaaccggggaagaatccaagagccgttcaaactaaacctggattgttcaagacaaatacgggcactataggtgcagtctcattagactttagcccaggaacgagtgggagcccaatcatagacaagaaaggtaaagtcgttggactctacggaaatggtgtagtaaccagaagtggtgcatatgtcagcgctatcgctcagactgaaaagagtattgaagataacccagaaatcgaagatgatatctttcggaagaggcgtctgactataatggatttacatcctggcgctgggaaaactaaacgatatctcccggccatagtaagagaagccattaaaagaggattgcgaacacttattctagcgccgacgcgagtggttgcagccgaaatggaggaggctctaagaggtctaccaatacggtatcagacgcccgctataagagcagaacacaccggaagagagatagttgatctaatgtgtcatgccacgttcaccatgagattattgagccccgtacgagttcccaattataacctgattataatggatgaagcacattttacagatccagcgagtattgcagcaagagggtacatctctacgagagtggaaatgggtgaggcagcaggcatatttatgactgcgactcccccaggctcgagagaccccttcccacaaagcaacgcgccaattatcgacgaggaacgagaaattccggaacgctcatggaatagcggacacgaatgggtcactgacttcaagggaaagaccgtatggttcgtgccatctataaaagctggtaacgatatagcagcatgtttaaggaaaaatggcaagaaagtaatacagttatcgagaaaaacctttgattcagaatatgtaaaaacacgaaccaatgactgggatttcgtagtgacgacggacatttcagaaatgggggcaaatttcaaagcggagagggtcattgaccctagaagatgcatgaagcccgttattttaactgatggagaagaacgtgtaatattagcgggtccaatgccggtaactcacagttcagcggctcaaagaagaggaagaatcggaagaaatcccaaaaatgagaacgatcaatatatatacatgggggaaccactggaaaatgacgaagattgtgctcattggaaagaggcgaaaatgctgttagataacattaatacgcctgaaggcatcataccatccatgttcgagccagagagagaaaaagtagacgcaatcgacggtgaatacaggctacgcggagaagctagaaaaacctttgtggatttaatgcggcgaggtgatcttcccgtatggctggcttacaaggtagccgcagaaggtataaattatgcagatagacgatggtgcttcgacggcataaagaacaaccaaattttagaagaaaatgtggaagttgaaatttggactaaagaaggcgaaaggaaaaagctcaaaccacgttggctggacgcacggatctattcagaccctttagcgctaaaggaatttaaagaatttgcagcaggaagaaagagtttaacattaaacttgattacagaaatgggtagattaccaacctttatgactcagaaaactcgtgatgcattagataatttagcagtattgcatacagctgaagcagggggtcgagcatacaaccacgcactatccgaactaccagaaaccctggaaacgctcttactattaacgttattagctaccgtgactggaggaatctttctatttctaatgagtggtcgaggtatcggaaagatgacacttggcatgtgctgtataataaccgcttccattctactttggtatgctcaaatccagccacattggatagccgcctcgatcatattagagttcttcctgattgtcttattaatacctgaaccggaaaagcaacgaacaccccaagacaatcagctaacatatgtggtaatagcaatcctgaccgtagtggccgcgactatggcgaacgaaatggggtttctggagaaaacgaagaaagatttcggactcggctctattgcaacacagcagcccgagagtaatattctagacattgacttgcggcctgctagcgcatggacattatatgcagtggcaaccacctttgttacaccaatgcttagacactcaatcgagaacagttcagttaacgtgtccttgacggctatagcaaaccaggctactgtactaatggggctaggaaaaggctggccattgtcaaagatggacattggagtcccgctgctggccattgggtgttatagtcaagtaaatccaataactctcactgcagcattactgttgctggttgcacattatgcaataataggaccaggtctacaagccaaagcaacacgtgaagcacaaaagcgagccgcagcaggtataatgaaaaaccctacagtggatggtatcaccgtgatagatttagaccctattccatacgaccctaaatttgaaaagcaactagggcaagtaatgttattgatactctgtgtaacgcaagtcctgatgatgaggacaacatgggctctatgtgaagcactcaccctagccactggaccgatatccaccctatgggaagggaatcccggacgattttggaataccacaatcgctgtttcaatggcaaacatctttcgtggcagttacctagccggtgcagggctactattttccattatgaaaaatactaccaacacgagaagaggcactggaaatatcggggaaacactaggagaaaaatggaagtcccgtttaaatgcgctaggcaagagcgagtttcagatatataagaaaagcggcattcaagaagtagatcgaacgttggcaaaggaaggaatcaagagaggggaaactgatcatcacgctgtctcaagaggatcggcaaaattacgatggtttgtagaaagaaacatggttactccagagggaaaagtagtagacttaggatgtgggagaggaggatggagctattactgcggcggtttaaagaacgtaagagaagtcaaggggcttacaaaagggggaccgggacatgaagaaccaatcccaatgagtacatatggctggaacttggtcagactacaatccggagttgatgtattctttataccacccgaaaaatgtgatactcttctatgcgatataggagaaagctccccaaatccgaccgttgaagccggacggacattgcgagttttaaatctagttgaaaattggttgaacaataacacccaattttgtattaaagtcttaaacccatatatgccgtctgttatagagaaaatggaggctttacaacgcaagtacggcggcgccttggtgagaaacccccttagcagaaatagcacccatgagatgtactgggtatcaaatgcgagtggcaatattgtttcttctgtcaatatgataagcagaatgctcataaatcgattcacaatgcgccataaaaaggcaacatatgaacctgacgtcgatttaggaagtggaactcggaatatagggatcgaatcagaaattcccaacctagatattataggtaaaaggattgaaaagataaaacaagaacatgaaacatcttggcattacgatcaggatcacccatataaaacatgggcataccatggttcatacgaaaccaagcaaacgggttcggcaagctccatggtaaatggagtagtccgcctattaaccaaaccttgggatgttctaccaacggtaacgcagatggcaatgactgatacaacaccatttgggcaacaaagagtatttaaagaaaaagttgatactagaacacaagaacccaaagaggggacaaagaaattaatgaaaatcaccgctgaatggctatggaaagaactcggcaagaagaaaactccaaggatgtgcacgcgagaagaatttaccagaaaagtaaggtcaaatgctgcattaggtgccattttcactgatgagaataagtggaagtcagctcgtgaagccgtcgaagattcccgtttttgggagcttgtggacaaagaaagaaacttgcacctagagggcaaatgtgaaacatgtgtttacaatatgatgggaaagcgagagaagaaactaggtgaatttggcaaggcaaaaggaagcagagccatatggtatatgtggctgggagcaagattcttagagttcgaagcactaggatttctaaatgaggaccattggttctcaagggagaactcgttaagcggcgtcgagggagaaggactccataaacttggatacatacttcgtgacgtgagtaagaaagagggtggggcaatgtatgcagatgacactgcagggtgggacacacgcattactttagaggatctgaaaaatgaagaaatggtgaccaaccacatggagggcgaacacaagaaactagccgaagcaatttttaagttgacatatcagaataaagttgtgcgtgtacaaagaccaactccaaggggcacagtcatggacataataagtagacgtgatcaacggggaagtggacaagtcggaacatacgggttgaacacttttacaaatatggaggcgcaactaatacggcaaatggaaggagaaggcgtttttaaaaatatccaacacttaacagtaaccgaagaagttgcggtgcagaattggttagctcgggtgggaagagagagactgtcgagaatggcgatatctggagatgactgcgtcgtcaaaccgcttgatgatagattcgcaaacgctctgacagctctaaacgatatgggaaagataagaaaggatatccaacagtgggaaccaagcaaaggctggaacgattggacacaggtacccttctgctcacatcattttcacgaacttataatgaaagatggtcgtgttttagtagttccatgcagaaaccaagatgaattgatagggagggcacgcatttcacagggtgccggctggtccttgagagagactgcatgcctaggcaagtcctatgcgcaaatgtggagtctaatgtatttccatagacgagatttgagattggccgcaaacgcaatatgctcggcagtcccttcccattgggtcccaacgagccgtacgacatggagtatccacgcaaaacatgaatggatgacgacagaagacatgctcaccgtctggaatcgggtatggattcgagagaatccctggatggaagataaaaccccagtagaaagttgggaagagataccttacctaggaaagagagaagatcagtggtgtggtagcctgattgggcttacaagtagagcaacatgggcgaagaacatccaggctgcaataaaccaagttaggagtttaatcggaaatgaggagtataccgactacatgccaagcatgaaacgtttccgaagagaagaagaggaagcaggagttctatggtaa

SEQ ID NO: 22749 - RNA, 9876 nt, synthetic construct
  misc_feature 1..9876: note = derived and/or modified CDS sequence (opt6) from DENV-2__EU482668__SS-prME
  source 1..9876: mol_type = other RNA
agtgcaggaatgattataatgctcattcccaccgttatggcattccacttaaccacccgcaatggagaacctcatatgattgttggaatacaagaaaaaggaaaatcacttttatttaaaacggaagatggagtaaatatgtgcactttaatggctatggacctgggagaactatgtgaagacactataacatacaaatgcccactacttagacaaaatgaaccagaagatattgactgttggtgtaacagtacgtctacatgggtgacatacggaacgtgtacaaccacgggggaacatagacgagagaaaaggtcggtagccctcgtaccacatgtagggatgggactcgaaacgcgcacagaaacatggatgagttcggaaggagcttggaaacacgcccagagaattgaaacctggatactaagacatccagggttcacaattatggcggctatcttagcctacacaattggtacaacacactttcaacgagttttaatatttattctgctaaccgccgtcgctccgagtatgacaatgagatgcattggaatatctaatagagattttgttgaaggagtatccgggggatcctgggtggacatagtcttggaacacggtagttgtgtaacgaccatggctaaaaacaaacccaccttggacttcgaattaataaaaactgaagcaaaacaaccggcaacactgagaaaatattgtatcgaagctaaacttactaacacaacaacagaaagtcgttgtccaacccaaggcgaaccatcgctcaaagaagaacaagataaaaggtttgtctgtaaacattctatggtagatagggggtgggggaacggatgtggtctattcgggaaaggtggcatagttacatgcgccatgtttacatgtaagaaaaacatggagggaaaaatcgtgcagccagagaacctagaatataccatagtagtgactcctcatagtggtgaagaacatgcagtgggcaatgatacagggaaacacggcatggaaataaaagtgacacctcaatcgtccataacagaagctgaattgactggctacggcactgtgactatggaatgctcacctagaacaggactcgactttaacgaaatggtgctgctacaaatggagaataaggcttggttagtacatcgtcaatggttcctcgaccttccactaccatggttgccgggagccgacaaacaagaaagtaattggatacagaaagagacccttgtgactttcaaaaatccacatgccaagaaacaagacgtagtagtactaggtagtcaagaaggagcaatgcatacggctcttaccggcgcaacagaaatacaaatgtcatcaggaaatttgttatttaccggtcatttaaaatgcagactcagaatggataaacttcaattaaaaggtatgagttattcaatgtgtaccggtaagttcaaagtagtaaaggagattgcagaaacacagcacgggactatagtaattcgcgtgcagtatgagggagatggcagtccctgtaaaatcccattcgaaatcatggatttagagaaaagatatgttcttggtcgattgataacagtaaaccccatcgtaacagaaaaagattctcctgtgaatatagaagctgaaccaccgttcggtgatagttacattattatcggcgttgaacccggacaactaaaactgaattggttcaaaaagggatcttctatcgggcaaatgttcgagactacaatgagaggagccaaaagaatggcgatattgggagacactgcctgggatttcggttcgctgggaggagtattcacgtcaattggtaaggcattacaccaggtttttggtgccatctatggcgcagctttttccggagtctcatggacgatgaaaatattaataggagtcattatcacttggatcggcatgaatagtagaagtacctcccttagcgttagcctagtacttgtgggaattgttacattatatctgggggtaatggtccaagcagatagcggttgcgttgtgtcgtggaaaaataaagagctaaaatgtggaagtggaatttttattacagataatgtacacacctggacagaacaatacaaatttcaacctgaatctccaagtaaactggcatcagccatccaaaaggctcaggaagagggtatttgtggtattcgaagcgtaacaaggcttgaaaatctgatgtggaagcaaattactcccgaattaaaccatatacttgctgaaaacgaagtaaaactgacgataatgacaggagatatacgcggtataatgcaagcaggaaaaagatccctacgaccgcagccaacagaactcaagtactcatggaaaacatggggtaaagcgaagatgttgtcaacagaaagctacaaccagacatttttaattgacggaccagagacagcggaatgccctaatacgaatcgagcatggaacagcttagaagtagaggactatggattcggtgtattcactacaaatatctggctaaaattaaaagaaaaacaagatgcattttgtgactcgaaactaatgtctgctgcaattaaagataacagagctgtgcatgctgacatgggatactggatagagtcggctctaaacgacacatggaagatagaaaaggcctcatttatagaagtcaagaactgccactggccaaaatcccacacactatggtcgaatggggtactagagtctgaaatgattattccaaagaacttggcaggtccagtaagccaacataattatcgacctggatatcacacacaaatagcaggcccatggcacctcggcaaattagaaatggactttgatttttgcgatggtaccacagtaatagtaacagaagactgtggcaacaggggaccatcattacgaacaacaaccgcaagcggcaaactaatcacagagtggtgttgtcgatcctgcacactacctccattgcgttatagaggagaagatggttgttggtatggaatggagatcaggcctctaaaagaaaaagaagagaatttagttaacagtctggtaacagcagggcacggacaggtagataattttagcctaggggtattggggatggcattgtttctcgaggaaatgctacgaacgagggttggcactaaacacgctatactgttagtcgcagtatcgttcgtcacattaataacaggtaacatgtcattcaaagatctagggagagtagttgtgatggtcggtgcgacaatggctgacgatatcggcatgggtgttacgtaccttgcactactagcagcatttaaagtccgacctacttttgcagcagggctattactacgaaaactaacctctaaagaacttatgatgacaactatcgggatagtcttattaagtcaatcaacaatccctgagacagtcttggagctaaccgatgcgttggcactaggcatgatggtattaaaaattgtaagaaatatggaaaaatatcaactagctgttacgatcatggccatcctgtgtgttccaaacgctgtaatattacagaatgcctggaaagtctcatgtacgatccttgccgtagttagtgtcagtccattacttctaacttcgtctcagcagaaaacggactggatacccctagcacttaccattaaaggattaaatccaaccgcaatattcctcacaacactcagtaggacaaataagaaacgtagttggcctttaaatgaggcaataatggcagtgggtatggtatcaatcctcgcctcatctttgctcaaaaacgacataccaatgacgggcccattagtagccggaggactgctcactgtatgttatgtactaactggacgcagcgcagatctagaactcgaaagagcgaccgacgttaaatgggaagatcaagcggaaatcagtggaagctcacctatactatcgattacaatatcagaggatggaagcatgtcaatcaaaaatgaagaagaagaacaaacattgacgatactaatacgcacgggactactcgtcataagcgggttgttcccgatttcaattccgatcaccgcagctgcttggtatttatgggaagtaaagaaacagagagccggtgtgttatgggacgtaccctctccgccaccaatgggaaaagctgagttagaggacggtgcatatcgtatcaagcaaaagggcatattaggatattcccaaattggcgccggtgtatacaaagaagggacattccatactatgtggcacgttacgcgcggggcagtattaatgcataaaggtaaaaggatagaaccctcatgggcagacgtcaagaaagacctaatttcctatgggggaggatggaaattagagggggaatggaaggagggggaagaagtacaagtattggcattagagccagggaaaaacccaagggcagtgcagaccaaaccaggactatttaaaactaatacaggtacgatcggcgctgtatctttagactttagtccaggaacaagcggttcgccaataatagacaagaaaggtaaggtggtcggtttgtatggaaacggagttgtcacgagatcgggcgcctacgtgagtgcaatcgctcaaacagaaaagtccatagaagacaacccggaaattgaagatgatatatttcgtaagcgacgattgactataatggaccttcacccaggagccggtaaaacaaaaaggtacttaccagcaatagtccgggaggcaataaaaagaggtctaaggaccttgatactagcgccaacccgggttgtcgcagcagaaatggaagaggcattacgtggtcttcctattcgctaccagacaccggcaatcagagcagaacacactggaagggaaatagtagatcttatgtgtcatgcaacgtttacaatgagactattgagcccagtgagagtaccaaattataatctcatcattatggatgaggcacactttacggatccggcatctatagcagcaagagggtatatatcaacccgagttgaaatgggcgaagcggccggaatatttatgaccgcaacacctccaggttccagggacccctttcctcaatcgaacgctcccataatagacgaggaaagagaaatacccgagaggtcttggaactcaggtcatgaatgggtgacagactttaaaggtaaaacagtgtggtttgtaccctcaataaaagcgggtaatgatattgctgcatgtttaaggaaaaacgggaagaaagtaatccaattatcacgtaaaaccttcgacagcgaatacgtaaaaacacgaacaaatgactgggattttgttgttactactgacatatccgaaatgggcgcgaattttaaagcagaaagagtcatagatccaagaaggtgtatgaaaccagtaatactgacggacggcgaagaaagagttatattagccggtccaatgcccgtcactcacagcagcgccgcgcaaaggcgaggaagaatcggaagaaatcctaaaaatgaaaatgatcaatacatttatatgggggaaccactggagaatgatgaagattgtgcgcattggaaagaggcgaagatgttattagataatattaatacacctgaaggaataataccaagcatgtttgagccagaaagagaaaaagtagatgcaatagacggtgaatacagacttcgaggcgaggcacgtaaaacctttgtggaccttatgcgtaggggcgaccttcctgtatggctagcatataaagttgctgccgaaggcataaactatgcagatcgaaggtggtgttttgacgggatcaaaaataatcaaatattggaagaaaacgttgaagttgagatctggaccaaagaaggtgaaaggaagaaattaaaaccacgctggcttgacgccagaatatacagtgatcctttagctttaaaagaatttaaggaatttgctgctggaagaaaatccctcacattaaatttgataactgaaatgggtagattgccaaccttcatgacacaaaagacaagagatgctttagacaacctcgcggttctacacacagctgaggcgggcggacgagcgtataatcacgcgctctcagaattacctgaaactctcgagacacttttattactaactcttttggcgactgtaaccggagggatatttttgtttctcatgtcaggtagggggattggaaaaatgaccttagggatgtgttgcataattactgcttctatattattatggtatgcgcaaatacagccccactggattgctgcatcaattattctagagttctttttaattgtcctcctgattccagaaccagagaagcaaagaacacctcaagataaccaactaacatacgtagtgatcgcaattctgacagtcgtagctgcgaccatggctaatgaaatgggatttttggagaaaacgaagaaagatctgggattaggttcaatagcgacacagcaacctgaaagtaacattttagacattgatttacgtcctgcttcggcgtggacattatatgccgttgcaactacatttgtgacacccatgttgagacattcaatagagaatagctcagtgaacgtttctttaacagcaatagccaatcaagcaacagttctcatgggactagggaagggctggccgttaagcaaaatggatatcggtgttcccctcttagcgattggttgctattcacaagtaaatcctataacacttacagccgcgttgttactcctagtggctcattatgcgataataggcccagggctacaagcaaaggcgacgagagaagcacaaaagcgagctgcagcagggataatgaaaaatccaactgtcgatggcataacagtaatagacctcgatcctataccatacgacccaaaattcgagaaacaacttgggcaagtcatgttgcttatactctgtgtaactcaagtgttaatgatgagaacaacttgggcactatgtgaagccttgacactagctactggccctatatcaacattatgggaaggaaatccaggcaggttctggaacaccacaatagcagtttccatggcaaatatatttcgggggagttatttagcgggggctggactactcttttcgataatgaaaaacacgacgaatactagacgtgggacaggaaacattggtgaaactttaggagagaaatggaagagtaggttgaacgcactaggcaaatcggaatttcaaatatataagaaaagtggaatacaagaggttgacagaactctcgcaaaagaaggaatcaaaagaggcgagactgatcatcatgcagtatcaagaggatctgcgaaactacgttggtttgtggaaaggaatatggtgacacccgaaggcaaagtagttgatctcggatgtggtagaggagggtggagttactattgtggcggtcttaaaaacgtcagagaagtaaaaggtctgaccaaaggagggccagggcacgaagaaccgataccaatgtcaacatacgggtggaacctagtgagacttcaaagcggcgtagacgttttctttataccccctgaaaaatgtgacactctattatgtgatattggtgaaagtagcccaaacccaacagttgaagcgggaagaacactccgtgttttgaatttagttgaaaattggttaaataacaacacgcaattttgcatcaaagttttaaatccgtatatgccatcagtaatcgagaaaatggaggcgcttcaacgaaaatacggaggggcactggtcagaaaccctttgtccagaaactcaacgcatgaaatgtactgggtgtcgaatgcaagtggcaacattgtatcaagtgttaacatgatcagtagaatgcttataaaccgtttcactatgcggcataagaaagcaacatacgaaccagacgtggatttggggagtggaactcgaaacatcggaatcgaatcagaaataccaaacttagatattatcggaaaaagaatcgagaaaataaaacaagagcatgaaacatcttggcattatgatcaagatcatccgtataagacctgggcatatcatgggagttacgagacaaaacaaactggttccgcatcctctatggtcaatggggttgttcggctcctgacaaagccttgggatgtcttgccaactgtcacgcagatggctatgacagacactacaccctttggacaacaaagagtattcaaagagaaggtggataccaggacgcaggaaccaaaggaaggtactaaaaagctgatgaaaattacggcagaatggctctggaaagaacttggtaaaaagaaaactccccgtatgtgcacaagagaagaatttacaagaaaagtacgatctaatgcggctctaggtgccatattcaccgatgaaaacaaatggaaatcagctcgcgaggcagtagaggattcacgattttgggaattggttgataaagaaaggaatttacatcttgaaggaaaatgcgaaacctgcgtttataatatgatggggaaaagagagaagaaattaggagaatttggaaaggccaaaggctcaagagccatatggtacatgtggctaggagcgcgcttcctcgaatttgaggctttaggtttcttaaacgaagatcattggtttagtcgagaaaattctttatctggagtagaaggggaagggcttcataaactaggctacatattacgagatgtatctaagaaggaaggaggtgcaatgtacgcagatgatacagcaggatgggatacacgtatcactctcgaggatctcaagaatgaagaaatggtcactaaccacatggaaggcgaacataagaaacttgctgaagctatcttcaagttaacatatcaaaacaaggtagtgcgtgtccaacgaccaacaccccgtggtactgtaatggatatcataagccgacgggatcaacgcgggtccggacaggtaggtacttacggacttaatacatttactaacatggaagcacagttaataaggcaaatggaaggtgaaggagtattcaaaaatatacaacacttgacagttacggaggaagttgctgtgcacaactggttagcaagggtaggaagggaacgattgtcaagaatggccatctctggagatgactgcgtagtaaaacccctagacgacaggtttgcaaatgcgttaaccgctttaaatgacatgggtaaaatcaggaaggatatacaacaatgggaaccaagtaagggctggaatgactggacacaagtaccattttgctcacatcattttcatgagttaataatgaaagacggccgaattttggttgtgccatgtagaaatcaagatgaactaataggtagagccaggatcagccagggagctggatggtccttaagagagacggcatgcttaggaaagagttatgctcaaatgtggtctctcatgtattttcacaggcgagatttaaggttagccgctaacgcaatctgtagtgccgtcccatcccattgggtaccaacaagtcgaacaacttggtcaatacacgcaaaacatgagtggatgaccactgaagatatgttgaccgtatggaacagagtgtggataagagaaaacccatggatggaagacaaaacacctgtggagtcgtgggaggaaatcccctatctgggaaaacgtgaagatcaatggtgtggatccctaataggattaacttcacgtgccacttgggctaaaaacatacaggccgcaataaatcaagttagatcactaatcggaaatgaagaatataccgattatatgccttcaatgaagagattccgtcgggaagaagaagaagctggggtactatggtaa

SEQ ID NO: 22750 - RNA, 9876 nt, synthetic construct
  misc_feature 1..9876: note = derived and/or modified CDS sequence (opt6) from DENV-2__EU482669__SS-prME
  source 1..9876: mol_type = other RNA
tcagctggcatgataataatgttaattcctacggttatggcttttcatctaaccacaaggaatggagagccacatatgattgtaggcatccaagaaaaaggaaaatctcttctatttaaaacagaggatggagtaaatatgtgtactctaatggcaatggaccttggggaactttgtgaggatacgataacatataaatgccctttattaagacaaaatgaaccggaagatatcgactgctggtgtaatagtacgtcggcttgggtaacatatggaacttgtacaacaactggagaacacagaagggaaaaacgatccgtagctctcgtaccgcatgtgggtatggggttggaaaccagaacagaaacatggatgagcagcgagggcgcatggaaacacgcacaaagaattgaaacatggatccttaggcatcctgggtttaccataatggcagcgattctagcctatacaatcggcacgacacattttcaaagagtgttaatatttattttactcactgccgtagctccatcgatgacaatgcgctgcattggaataagtaacagggatttcgttgagggtgtatcaggtggatcctgggtagacatcgttttggaacatggctcctgtgtcacgacgatggccaaaaataaaccaactttggacttcgaactaataaaaaccgaagctaaacaaccagcaacactgagaaaatattgtatcgaagccaaactaacaaacacaacgacagaatcgcgttgcccaacgcagggggagccttcgttaaaagaggaacaagacaaaagattcgtatgcaaacattccatggtcgaccgtggatggggcaatggatgcggattgtttgggaaaggtggtatcgtcacgtgcgcaatgtttacatgcaagaaaaatatggaaggcaaaatagtccagccagagaacttagaatatactattgtcgttactccacactctggtgaggaacatgctgttggtaacgatacgggaaaacatggaaaagaaataaaagtaaccccacaatcttcaataacagaagttgaattaactggatacgggaccgtaaccatggaatgtagtccgcgtacaggtctggattttaacgaaatggtactattgcaaatggaaaataaagcatggttggtacatagacaatggtttctagatcttcctctaccgtggttaccgggagccgataaacaagagagtaactggatacaaaaggaaaccttagtaacatttaagaatccacatgcaaagaagcaggatgtagtggtactaggatcgcaagaaggagccatgcatacggcgttaactggcgcgacagagatccagatgtcgagcggtaatctactatttactggacatttgaaatgtagactgcgcatggacaagttacagctaaagggaatgtcctatagcatgtgcaccggaaagttcaaagtcgtaaaggaaatcgccgaaacccaacatgggacgatagttatcagagtacaatatgagggtgacggatcaccatgtaaaataccgtttgaaataatggacctggaaaagaggtatgttttaggtagattgataacagtaaacccaatagtaacagagaaagacagtccagtaaacatcgaagcggaaccaccatttggagatagttacatcataatcggagtagaacctggccaactaaaattaaactggtttaagaagggaagttctattggacaaatgtttgaaaccactatgaggggtgcaaagcgtatggctattctaggagacaccgcctgggactttggatcattaggaggagtattcacatccatcggcaaagcacttcaccaagtttttggagccatttacggggctgcatttagtggtgtaagttggacaatgaaaatattaataggagttataatcacttggatcggaatgaactcgaggtcaacatcactgtcagtaagtctagtattggttggtatagtcaccctgtatttaggcgtgatggtacaagccgattcggggtgtgtggtatcgtggaaaaataaagaacttaaatgtggatcaggaatattcataaccgacaatgtccatacgtggaccgagcaatacaaattccaacctgaatcacccagtaaactagctagtgcgatccaaaaggcccaggaagaaggaatctgcggcatacgctcagtgactaggctggaaaatttaatgtggaaacaaattactccagaattgaaccatatacttgcagaaaacgaggtcaaattaacaatcatgaccggtgatataaaaggaatcatgcaagcgggaaaaaggagcttgagacctcaacctaccgaacttaaatactcttggaagacttggggaaaggcaaagatgttatctacagaatcatataaccaaacatttctaattgacggaccagaaactgcagaatgtcctaacacgaatagagcttggaactcgttagaagtagaagactatgggtttggagttttcacaacgaatatatggttgaaattaaaagaaaaacaggatgctttctgcgatagtaaattgatgagtgctgcaattaaagataatagagcagtacatgcagacatgggttattggatagaaagtgcgttgaatgacacttggaaaattgaaaaagccagctttatagaagtcaaaaattgtcattggcccaaaagtcatacactctggagtaatggtgttctcgagagcgaaatgatcattcccaaaaatctagcaggccctgtgagtcaacataattacagaccaggatatcatacgcaaattgcaggaccatggcatcttggaaagttagagatggatttcgatttttgtgacgggacaacagtcattgtcaccgaagattgtggaaacagaggaccgagtcttaggactacaactgcaagtggaaaattaatcacagagtggtgctgtagatcatgtacactacctccattacgttatcgaggagaagatggctgttggtatggaatggaaatccgccctcttaaagagaaggaagaaaatttagttaatagccttgtaactgcaggccatggacaagttgacaatttctccctaggtgtactcggcatggctttattcctggaagaaatgttacgtactcgggtcgggaccaaacatgccattttattagtagctgtaagttttgttactttaatcactggaaacatgtcgtttaaagacttaggcagagtagtcgttatggttggagccacaatggcagatgatattggcatgggtgtgacatatttagcgctactagccgcattcaaagtgagacccacgttcgcagccggtctattgctcaggaaactgacttctaaagaattgatgatgacaacaataggaatcgtgttactctcacaatcaacaatacccgagacagtactggaactaaccgatgctttagcactaggaatgatggttctcaagatagtgaggaatatggaaaagtaccaacttgcagtgacaataatggcaattctatgtgtaccaaatgcggtaatcttacagaatgcatggaaagtatcatgcacaatcctcgcggttgtaagtgtgagccctctgcttttaacgagctctcaacagaaaacggattggatacccctagccttgacaatcaaagggttgaatcctacagcaatatttctaacgacattatcacgaacaaataagaaaaggtcatggccattaaatgaagctataatggcggtagggatggtgtcgatattagcctcgagtctccttaaaaatgacattcccatgacagggcctcttgttgcaggcggcttactaacggtatgttacgttttaaccgggagatctgccgatttagagttggaaagagcaactgatgtaaaatgggaagatcaagctgagatatccggaagcagtcctattttaagtattaccatttcagaagacgggtcaatgtcaataaagaacgaagaagaggaacaaacgctaacgattttaatcaggacagggttattagtaatctcaggactctttcctatatcaataccaataaccgcagcagcatggtacttatgggaagttaagaagcagagagccggagttttgtgggacgtcccatcaccaccaccaatgggaaaggctgaactagaagatggggcgtatcgtattaagcagaaaggaatactcggttactcccaaattggtgcaggagtctacaaggagggtacctttcacaccatgtggcacgtaacacgtggtgctgttctaatgcataaggggaaacgaatagaaccaagttgggccgatgttaagaaagatctaattagttatgggggtggatggaaattagaaggcgagtggaaagaaggagaggaagtacaagtattagcattggaaccgggcaaaaacccacgtgcagtacagacaaaaccagggcttttcaaaacaaatacaggaaccataggtgccgtatccctagatttttctccgggaacttcgggcagtccgataattgataagaaaggaaaagttgtcggtttatatggtaatggtgtagttacgagaagtggggcgtatgtttcggcaatcgcacaaacggaaaagagcattgaagataatccagaaatagaggatgatatatttcgaaagcgaagacttacaattatggacttacatccaggcgctggtaagacaaaaaggtatttgccagcgattgtcagagaagcgattaaacgtggactacgaactctcatactagcgcctacgagagtggttgcagcggaaatggaagaagcacttcgtgggctaccaataagataccaaacccctgcgataaaagcagaacacacgggacgcgaaatagttgatcttatgtgccatgctacctttacaatgaggttactcagtccagtgagagtgccaaactacaaccttataatcatggacgaagctcatttcacagaccctgcgtcaatagcagcacggggctacattagtacaagagttgaaatgggcgaagccgcaggaattttcatgaccgccacaccaccaggatcacgagacccttttccacagtcaaacgcaccaataatagacgaggaacgtgagattccggaacggagctggaactcgggacatgagtgggtcacagactataaaggaaagacagtatggttcgttccaagtatcaaagcgggcaatgatatagcggcatgcctcaggaaaaatgggaagaaagttatccagttaagtagaaaaaccttcgattcagagtatgttaagaccagaacaaacgattgggactttgtagtcacaactgacatttctgaaatgggagcaaatttcaaagcagaacgtgttatagatcctaggcgatgtatgaaaccggtaatactaactgatggagaagaacgtgttatattagccggccccatgccagtaacacatagttcagcagcacaaagacggggtcggatcgggcgtaatccgaaaaatgagaatgatcaatatatctacatgggagagccactggaaaacgacgaagactgtgctcactggaaagaagcaaaaatgcttttggacaacatcaataccccagaaggcataataccatccatgttcgaaccagagagagagaaagtcgacgcaatagacggggaatatcggctaagaggtgaagctcggaaaacgtttgtagacttaatgagacgaggagatcttccagtttggcttgcttataaggtggcagctgagggtataaattatgccgacagaaggtggtgctttgatggaataaagaataatcaaattctagaggagaatgtggaagttgaaatctggacaaaagaaggggagcgaaagaaattaaaaccgagatggctcgacgcacggatatatagtgatcctctagctctaaaagaatttaaagaatttgcagcggggcgcaaaagccttactttgaatcttataactgaaatgggacgattaccgacttttatgacacagaaaacacgtgatgcattggataacctagcggtgttgcacacagctgaagcaggaggacgtgcatataaccacgcgcttagcgagctaccggaaactctagagacattattattactaaccctattagcaacggttactggaggcatctttctgtttctaatgagtggacgtgggattggaaaaatgacccttggaatgtgctgcataattacagcatccatattattatggtacgcacagatacaaccacattggatcgcagcaagtataatattagaatttttcttaatagtattgttgatcccagaaccagaaaaacagagaaccccgcaggacaaccaattaacatacgttgttatcgccatcctaaccgtggttgccgcaacgatggcgaacgaaatggggttccttgaaaagaccaagaaagatctgggtttaggatccatagcaactcaacaaccagagtcaaatattttagatatagatttaagaccggcaagtgcttggacattatacgctgtagcaactacatttgtaactcctatgctacgacactctattgaaaacagttcagtaaatgtaagtctaacagcaatagccaatcaagcgactgtgctgatgggtcttggaaagggatggcctctatcaaaaatggacataggagttcctttattagccattgggtgttacagccaggtgaatccgattacattaacagcagctcttttgcttttagttgcccattatgctattataggaccgggattgcaagcaaaagctaccagagaagcgcagaagagggctgcagcgggcatcatgaagaacccgacagttgacggaataactgtaattgacctcgatccaataccatatgacccgaaattcgaaaagcaattaggtcaggtaatgctgttgattttgtgtgtcacccaggtcttaatgatgagaaccacttgggccttatgtgaagcccttacattagcaacaggtccaatatcgacactttgggaaggaaatcctggaagattttggaacactacaatcgccgtatccatggcaaatatatttcgaggctcctacttagcaggagccgggctgctatttagcataatgaaaaataccacaaatacgagaagaggaacgggtaacatcggtgagactctcggagaaaaatggaaaagtagattaaatgctttaggaaaatctgagttccaaatatataagaaatcaggaatacaagaagtcgatcgaacccttgccaaagaggggattaaaaggggagagacagaccatcacgcagtttcacgcggatccgcaaagttaagatggtttgtagaacgaaatatggtaacaccagaaggaaaagtggtggatcttggttgtggacgagggggctggtcgtactattgcgggggcctcaaaaatgttagggaagtaaaagggctaaccaaaggaggaccagggcatgaggaaccaattccaatgtcaacttacggatggaatctggtacgactccaatcaggcgtagatgtattctttatcccaccagagaaatgtgataccctcttatgtgatataggcgaaagctccccaaatcccactgtggaggcaggaaggaccctaagagttttaaatctggtcgaaaactggttgaacaataacacgcaattctgtataaaagttcttaatccttatatgccatcggtaatcgaaaagatggaagctctgcaacgaaaatacggaggggccctagtacgtaatccattgtcgagaaattccactcatgagatgtactgggtatcaaacgcttcaggcaacatagtaagctccgtaaatatgattagcaggatgcttataaatagatttacaatgaggcacaaaaaggcgacctatgaaccggacgtcgatttaggcagtggtacaagaaatataggtattgagtcggaaatacctaatctagatatcataggcaaacgtattgagaaaataaaacaagaacatgaaacgtcctggcattatgatcaagaccatccgtacaaaacatgggcgtaccatggttcatatgagacaaagcaaactggttcagccagtagtatggttaatggtgttgtgagacttctcaccaagccgtgggacgtgttacccacagttactcagatggctatgacagacacaacccccttcggacagcaacgtgtgtttaaagagaaagtcgatacacgaacccaggagcctaaagagggtaccaaaaagctaatgaaaattactgctgagtggctatggaaagagttaggcaaaaagaagacaccaaggatgtgtacacgagaagaatttacacggaaagtaaggtcaaatgctgcccttggagcaatatttacagacgaaaacaaatggaagtctgcacgagaggcggttgaagactcccgtttctgggaactggtcgacaaggagcgcaatttgcacttggaaggcaaatgtgagacatgcgtttacaatatgatgggcaaaagagagaagaaattaggtgaatttggaaaggcaaaaggatcgcgtgctatatggtatatgtggttaggtgcacgctttttggagtttgaagcgctgggattcttaaacgaggaccactggttctcacgagaaaattcactaagtggagtagagggggaaggactacataaattaggttacatactacgagatgtaagcaagaaagaagggggtgcaatgtacgcagatgacactgccggatgggacaccagaataactctagaagatctgaaaaatgaggaaatggttacgaaccatatggagggtgaacataagaaactagcagaggctatctttaaacttacataccaaaacaaagtagtgcgagttcaacgaccaaccccaagaggaactgtaatggatattataagtagaagggatcagagaggtagcggacaggtgggaacctatggcttaaacacctttacgaatatggaagcacaattaatcagacaaatggaaggcgagggtgtttttaaaaccattcaacacttaacagtgaccgaagaagttgccgtacaaaattggctagcaagagtcgggcgtgaacgactaagccgtatggccatctcgggcgatgattgcgtcgtaaaaccgctagatgatcgattcgctaatgcactaaccgcgttaaacgatatggggaagataaggaaggacattcaacagtgggagccatcaaaagggtggaacgattggacgcaggtaccattttgttctcaccattttcatgaacttatcatgaaagatgggagagtattagtagtaccttgtagaaatcaagatgaattgataggtcgagcgcgtattagccaaggagcaggttggagcttacgggaaacagcatgcctaggtaagagttatgctcaaatgtggagtctcatgtactttcaccgcagggacctgcgcctagctgctaacgcaatctgcagcgcagtaccaagtcactgggtacctacaagccgtacgacgtggtcgatccatgcaaaacacgaatggatgaccactgaggacatgctcacagtctggaacagagtatggatacgagaaaacccttggatggaagacaaaacaccagtagaatcgtgggaagaaataccatacctaggcaaaagagaagaccagtggtgcggtagcttgatcggactaacaagcagagcaacttgggccaaaaatattcaagcagcgattaaccaagtcagatcgctgattggcaatgaagaatatacggattatatgccatcaatgaaaagatttagaagagaagaagaagaagcaggagtactatggtag

SEQ ID NO: 22751 - RNA, 9876 nt, synthetic construct
  misc_feature 1..9876: note = derived and/or modified CDS sequence (opt6) from DENV-2__EU482670__SS-prME
  source 1..9876: mol_type = other RNA
agcgcaggaatgattataatgcttatacccacagtaatggctttccatctgaccacaagaaatggtgaacctcatatgatagtaggaatacaagaaaaaggaaaatctctcttgttcaaaactgaagacggggttaacatgtgtaccctcatggcaatggatcttggagaactgtgcgaagacactatcacgtataaatgcccattgttaagacagaatgaaccagaagatattgactgttggtgcaattcgacctctacatgggtaacatatggaacatgtacaacgacaggagaacacagacgagaaaagagaagcgtggccttagtaccacacgtcggtatggggctagaaacgagaacagaaacttggatgtcatcagaaggagcatggaaacatgctcaaagaatcgaaacatggatattaagacatcctggatttacaataatggctgccatacttgcatatacgataggaacaacgcacttccaaagagttctaatatttatactgctgactgcagtcgcaccatctatgacgatgagatgtattggtatctcaaatagggacttcgttgagggagtatccgggggatcatgggtagacatagtattagagcatggaagttgtgttacaacaatggccaaaaataaacccactcttgatttcgaactaattaaaaccgaagcaaaacaaccggcaactcttagaaaatattgtattgaggcaaagctgaccaacacaacaactgaatctcgatgtccgacacagggagagcctagcttaaaggaggaacaagataagcgattcgtttgtaaacacagtatggtcgaccgaggatggggcaacggatgcggtttattcggtaagggaggtattgtgacctgcgcgatgtttacatgcaaaaagaatatggaaggtaagatagtacagcccgagaatttagaatacactatcgtagttactccacacagtggagaagaacatgctgttgggaatgacacaggcaaacatgggaaagaaataaaagtaactccacaaagctcgataacggaagcggagttaacgggatatgggacagttacgatggaatgctctccacggacaggattagattttaacgagatggtattactacaaatggagaataaagcatggctagttcataggcaatggttccttgatttacccttaccatggctaccaggagctgataaacaggagagtaattggatccaaaaagaaacgcttgtaactttcaaaaaccctcatgccaagaagcaagatgtagtcgtattagggagtcaagaaggcgccatgcatacggctcttacaggagcaacagaaatacaaatgagctccgggaatttactatttaccggacatttaaaatgccgactcaggatggataaactacaactaaaagggatgtcgtatagcatgtgcacgggtaagtttaaagtaatgaaagaaatagcagaaacgcaacatggtactatcgtaatacgtgtccagtatgagggcgacggaagcccatgtaaaataccgttcgaaataatggacttggaaaagcgctacgtattaggaagattaataaccgtaaatcctatcgttacggaaaaagattcacctgtaaacatagaagccgaaccgccctttggagactcgtacatcataattggagtggagcctggacaactcaaactaaattggttcaaaaagggcagcagtataggccaaatgttcgaaacaactatgcgtggtgcaaaaaggatggcaatattaggagacacggcttgggatttcggtagtctaggaggtgtctttacctcaataggcaaggccctacaccaggtatttggggcgatatatggagcagcgttctcaggagtgtcctggacaatgaaaatactaatcggagtaataataacctggattggtatgaactcaaggtcaaccagcttgtccgtgtcattagtactggtgggaatcgtaacactgtacttgggagtaatggtccaagcagattcgggttgtgttgttagttggaaaaataaagagctaaaatgtggaagcggtattttcattactgataatgttcacacttggaccgaacaatacaaatttcaaccagaaagtccaagtaaactagcgtcagcaatccagaaagcacaagaagaaggaatttgcggaatccgaagtgttacacgcctagagaacctgatgtggaaacaaattactcctgagcttaatcatatacttgctgaaaacgaagtaaaattaacaataatgaccggcgacataaagggtattatgcaagcaggtaaacgatctctacgaccccaacctaccgaactcaaatacagttggaaaacttggggtaaggcgaagatgctgagtacagaatctcataatcaaacctttctaattgacggcccagaaaccgcagaatgccctaatacgaacagggcatggaacagcctggaggtcgaggactatggttttggtgtatttactacaaatatctggctcaagctcaaagagaaacaggatgctttttgtgattctaaattgatgtccgcagccataaaggataacagagcagttcatgccgacatgggttactggatcgagtccgctttgaacgatacttggaagattgaaaaggcgagttttatcgaagtcaaaaattgtcattggccaaagtctcatacattatggagcaatggcgtattagaatccgaaatgataatccccaaaaatttagctggaccagtgagccaacacaactaccggccaggttatcacacacaagtagccggtccctggcatttaggcaagctagaaatggatttcgatttctgcgacggaacgaccgtaatagtaacagaggattgtgggaatagaggaccaagtctgagaacaacgacagccagcggcaaactgatcactgaatggtgttgccgtagctgcacgttaccacccctaagatatcggggtgaggatggatgctggtatggtatggagataagacctttgaaagagaaagaagaaaacctggttaattcattagttaccgccggtcacggccaagtggataacttcagtctgggagttttgggaatggcactattcctggaagaaatgttgcgaacacgagtcgggacaaaacacgccatacttctagttgcagtaagtttcgttacactcataacagggaacatgtcgtttaaggacctcggcagagtggtcgtcatggtcggagccactatggcagatgacataggcatgggagtaacttacttagcactactagcagcatttaaggtacgcccaacattcgctgcggggcttttgctacgcaaattaacatcaaaagaactcatgatgactactataggtattgtattgttaagtcaatcaacaatacctgaaacagtactagaattaacagacgctctcgccttaggaatgatggtcctaaaaatcgtacgtaatatggaaaaatatcaactggctgtgacaataatggctatactctgcgtcccaaatgccgtaatattgcaaaacgcttggaaggttagttgtacaatattagcagttgtaagcgtatctcctctattgttaacttcatctcagcaaaagacggattggatacccctagcactaaccatcaaaggattgaaccctacagcaatctttctaacgactctaagtcgaacaaacaaaaagcgcagttggccactaaacgaagcgataatggctgtaggcatggtatctatcttagccagctcactgcttaaaaatgatatacctatgacgggacctctcgttgcgggtggattacttactgtttgctatgtcctaacaggcagatccgcagatttagaactcgaaagggcaaccgatgttaagtgggaagatcaagccgagatttcaggttcttcaccgattttgtctattacaatcagtgaggacggatcgatgtccattaaaaacgaggaagaagaacaaactttaacaatattaattagaacaggactcttagtcataagcggtctttttccgattagcataccaattaccgctgcggcctggtatttgtgggaggtaaagaaacaacgtgctggcgtcctgtgggatgtgccaagcccaccgcctatgggaaaagctgagttggaagacggcgcgtatcgaataaagcagaagggcattctcggatacagccaaatcggagccggagtatacaaagaaggaacatttcatacaatgtggcacgtaacaagaggagctgttttgatgcataagggtaagagaattgaaccatcgtgggccgatgtaaagaaagatctaatctcttatggaggcggatggaaactagaaggtgaatggaaggaaggggaggaagtgcaagtgttagctttggaaccaggcaaaaatccccgtgcggtacaaacaaaacctggactgttcaaaacaaataccggaaccataggtgcagtgtctttggatttttccccgggaacaagcggcagcccaataattgacaagaagggaaaagtcgtcgggttatatggaaatggcgtcgtgacaaggagcggagcgtacgttagtgcgatagcacagacagaaaagtcgatagaagacaacccagagatagaagacgacatattcagaaaaagacgattgacaattatggatttacatccgggagccggaaagacaaaacgatatttaccagccatagtacgcgaagccattaagaggggacttcgcaccttaatacttgcaccgaccagggtggttgccgccgaaatggaggaggcactgagaggattaccgattaggtatcagacacccgcaatccgagcagaacatacaggtagggaaatagttgatctcatgtgtcacgctacatttacgatgcgactgctttcgccggttagagttccaaattataatctcataatcatggacgaagctcattttacagaccccgccagtattgcggctcgagggtacatatcgactcgagtagaaatgggggaagcagctggtatatttatgaccgcaactccaccaggaagcagagaccccttcccgcaaagcaatgctccgataatcgacgaagaaagagaaatacctgagagaagttggaactcggggcatgagtgggtgactgatttcaaaggtaaaactgtatggtttgtaccctcaatcaaagcaggaaatgatattgcagcctgccttcgtaaaaacggtaagaaagttatccagctgtcaagaaagactttcgatagcgaatatgttaaaactaggaccaacgattgggattttgtggttaccaccgatatttccgagatgggtgccaattttaaagccgaaagagttatagatccaagaagatgcatgaaaccagtaatattaacggatggagaagaacgagtgatactagcaggccccatgcccgtgacacacagttctgcagcacaacgacgcggacgaataggaagaaatccgaagaatgaaaacgaccagtatatatatatgggagagcctcttgaaaatgacgaagattgtgcccactggaaagaggctaaaatgttgttggataacataaacacgccagaaggaataattccgtccatgtttgaacctgagcgagaaaaagtggatgcaatagatggtgaatatcggttgcgaggggaggcaaggaaaacattcgtagacttaatgagaagaggtgacctaccagtctggctagcatacaaagttgcagcagaaggcataaactatgctgaccgtcgatggtgttttgacggaatcaaaaataatcaaattcttgaggaaaacgtagaggtcgaaatatggacaaaggaaggagaacgtaaaaagttgaagccaagatggttagatgcacgaatatatagcgatccattagcccttaaggaatttaaagaatttgcggctggacgcaagtcactcactctaaatctgataactgaaatggggaggttacctacttttatgactcagaaaacgcgggacgctcttgacaatctagcagtcttacacacggcagaagccggaggacgcgcctataatcacgcactaagcgaacttccggaaactctagaaacactgttgttgttaacgctacttgcgacagtgaccggaggaatttttctattcctgatgtcaggaagaggaattggtaaaatgacactaggaatgtgttgtataattacagcgagcatcctgttatggtacgctcaaatccaacctcattggattgccgcatccattatcctcgagttcttcttaatagtattgctgatcccagaaccagaaaaacaacggacacctcaagataaccaacttacatacgtcgtaattgcaatacttactgtcgtagcagcgacaatggcgaatgaaatgggtttccttgaaaagaccaagaaagatcttggactcggtagcatagcaacccaacaaccggaatcaaacatattagatattgatttgcggccagcgagcgcgtggacactctacgctgtggcgacaacatttgttacaccaatgttaagacactcgatagagaatagctcagttaacgtctccttaacggcgatagctaatcaagcgacggtacttatgggcctaggaaagggatggccactctctaagatggatataggagttcctttattagcaataggatgttatagccaagtaaatcctataacacttacggccgcactcttattattagtggcgcactatgcaattatcggcccaggattgcaagctaaagcaaccagagaagctcaaaaacgagcagctgctgggatcatgaaaaaccccacggtcgacgggataacggtcatagacttggatccaataccatacgaccctaaattcgaaaagcaacttggacaagttatgctactaatactatgtgtgacacaagtcttaatgatgagaacaacgtgggctctctgtgaggcactcactttagcaacagggcctataagtactttatgggaaggcaatccaggacggttctggaatactactatagccgtttccatggcaaacatcttcagaggcagctatcttgccggagccggactcctattcagtattatgaaaaatacaacaaatacaagaaggggcactggaaatatgggtgagactttaggtgaaaaatggaaaagtaggctaaacgcattgggaaaaagtgaatttcaaatatataagaaatcaggtatacaagaagttgataggacactagccaaagagggtataaaaaggggtgaaaccgatcatcatgcagtatcacgaggttcagcaaaattaagatggtttgtggaaagaaacatggtaactcctgaaggaaaggtggtggatctaggatgcggaaggggagggtggtcgtattactgcggtgggttaaagaacgtacgagaagtaaaagggttaaccaaaggcggtccaggtcacgaggaacccatcccaatgagtacttacggatggaatctggttcgcctccagtcgggagtcgatgtattctttattccaccagaaaagtgtgatacacttctgtgcgacattggggaatcgagcccaaatcctaccgtagaagccggacgaacactacgcgtattaaatctagtagagaactggctaaataacaacacgcaattctgtataaaggtgttaaacccatacatgccgtcggtaatagagaaaatggaagccctgcagagaaaatacggaggagcgctagtaaggaatccactttccagaaatagcacgcacgagatgtactgggtaagcaacgcttcaggaaatatagtaagctcggtaaacatgatatcaagaatgttgattaatcggtttactatgcgtcataagaaggcaacttatgaacctgatgtagatctgggtagtggaaccagaaatatagggatagagtccgaaataccgaatttagacattatcggcaaaagaatagagaaaataaaacaagaacacgaaacaagctggcattatgatcaagaccatccttataagacctgggcataccatggttcgtatgaaactaaacaaacaggtagtgcatcgtcaatggttaatggggtagtaagactattgaccaaaccctgggacgtgttaccaacggtcacgcagatggcaatgaccgatacaacaccatttggtcaacagagggtttttaaagagaaagtagacacaagaacacaggaacccaaagaagggactaaaaagttaatgaaaataacagctgagtggctgtggaaagaactcggcaagaagaaaactcctagaatgtgtacacgagaagaatttacaagaaaagtaagatcaaatgctgcgctaggcgcaatttttaccgatgaaaataaatggaaatcagctcgtgaggctgtagaggactcccgattctgggagctagtcgataaagaacgaaatttacacttggaaggaaaatgcgaaacatgtgtctataatatgatgggaaaaagagagaaaaagctgggagaatttggaaaagctaagggctcacgagcaatttggtatatgtggttgggtgcaagatttttagagttcgaagcgctaggttttctaaacgaggaccattggtttagccgagaaaacagtctgtcgggagtcgaaggagaaggtctgcacaaacttgggtacattttaagagacgtatctaagaaagaagggggagctatgtacgcagacgatacagcgggctgggataccagaataacgcttgaagaccttaaaaacgaggaaatggttaccaatcatatggaaggcgagcacaaaaagctggctgaagcaatttttaaactaacgtaccaaaataaagttgtgagagtccaaagaccaaccccacggggaacagtcatggacataattagccgaagggaccaaagaggatctggtcaagtaggcacctatggcttaaacacctttacaaacatggaagcacaactaatcagacaaatggagggcgaaggagtgtttaaaaacattcaacatttaactgttacagaagaagtagcagttcaaaactggctcgcacgagttggtagagaacgactatcccggatggcaatatctggagatgattgtgtagtaaagccattagatgatagattcgcaaatgcattaacagctctaaatgatatgggtaagataaggaaagatatccagcagtgggaaccatcgaaagggtggaatgattggactcaggtgcctttttgtagtcatcattttcacgagttaattatgaaagatgggcgaatactggtcgtaccatgtcgtaatcaagatgagctcataggcagagctaggatatcccagggagctggctggtcactcagagaaacggcatgtttgggtaaatcatatgcgcaaatgtggagtcttatgtattttcataggagagatctaagattagctgcaaacgcaatatgttctgcggtgccaagccactgggtgcctaccagccgcacgacctggtccatacacgcaaaacatgaatggatgaccaccgaggacatgctcacagtatggaacagagtatggattcgagaaaatccttggatggaagataaaacacctgtcgaatcatgggaagagataccgtacttaggtaagagagaggatcaatggtgcggcagcttaatcggactaacctctagagcgacatgggctaaaaacatacaagcggcaataaatcaagtacgatctcttatcgggaacgaagaatacactgactatatgccgagcatgaagaggtttcgtagagaagaagaagaagccggtgttctttggtag

SEQ ID NO: 22752 - RNA, 9876 nt, synthetic construct
  misc_feature 1..9876: note = derived and/or modified CDS sequence (opt6) from DENV-2__EU482671__SS-prME
  source 1..9876: mol_type = other RNA
tcagctggaatgataatcatgctaatacctactgtgatggcttttcatctaaccactagaaatggtgaaccacacatgatagtaggtatacaagaaaaaggtaaatctctgctatttaaaacggaagatggcgtgaatatgtgtacgttgatggccatggatttaggagaattatgcgaagatactattacatataaatgtccgttgctaagacaaaatgaaccggaagacatagattgttggtgcaattcaacctccacgtgggtaacttacggaacatgtacgacaacgggagaacaccgaagggagaaaagatcagtagcattggtaccacacgttggaatggggttagaaactcgaacagaaacctggatgtcatcagaaggcgcgtggaaacacgcgcaacgaatagaaacttggattttgcgacaccccggattcacgatcatggccgctattttagcatacactattggtaccacacactttcaacgtgtattgatatttatattattaacggcagtcgcaccatcgatgacaatgcgttgtatagggatttcgaatcgagatttcgttgaaggtgtcagcggaggcagttgggtcgacattgtattagaacatggaagttgcgtaacaacaatggccaaaaataaaccgactctagattttgaattaataaaaactgaagcaaaacaaccagctaccctaagaaaatactgcattgaagctaaattaaccaacacgacaacggagtcacgttgcccgacacaaggtgaaccatcacttaaagaagaacaagataaacgatttatatgtaaacactcaatggttgacagaggttggggcaatggatgtggcctatttggaaaaggagggatcgtcacgtgcgccatgttcacatgtaagaaaaacatggagggaaaaatagttcaacccgaaaacttagaatacaccattgttgtaacaccacacagcggagaggaacacgcagtgggaaacgacaccggcaaacacgggaaagagattaaagttacaccacaaagctctataacggaagctgaattaaccggatatggaaccgtaactatggaatgcagtcctcgaactgggttagattttaatgaaatggtattactacaaatggaaaataaagcatggttagtccaccggcaatggttcttggatttacccttgccatggttaccaggggcagacaaacaagaatcgaattggatacaaaaggaaacattagtcactttcaaaaatcctcatgcgaaaaagcaagacgtggttgttctaggcagtcaagaaggtgcgatgcataccgcactaacaggtgcaactgagattcaaatgagctctggtaacctattattcacaggacatcttaaatgcaggttaagaatggataagctacaattaaagggtatgagctactcgatgtgtacaggaaaattcaaggtagtaagagaaattgcagaaacccaacacggaacgatagtcataagagtacaatacgaaggcgatggatcaccatgtaaaatacccttcgaaataatggatttagagaaaaggtacgtccttggacgattaataacggtaaatcctatagtaacggaaaaggacagcccagtaaatatagaagcagaacctccttttggagacagctatataattattggagtagagccagggcaactgaaacttaactggtttaagaaaggttcctctataggtcaaatgttcgaaacaactatgaggggtgcaaaaagaatggctatactaggcgacactgcatgggatttcgggagcctaggtggtgtatttacgagtattgggaaagcattacatcaagtatttggagctatatacggtgcggcattcagtggtgtttcctggacaatgaaaatcttgataggagtgataatcacctggataggtatgaatagcagatctacctctttgagtgtgtccctagtattggttggaatagttacactttatctgggagttatggtccaagcagacagtggttgtgtggtatcctggaaaaataaagaattaaagtgtggatctggaatcttcattactgataacgtccatacatggacagagcaatataagtttcaaccagagtcaccgtcaaaattggcctccgcaatacaaaaggcgcaagaagaaggaatatgcggaatacgaagcgttacgcggctagaaaacttaatgtggaaacaaattactccagagctcaatcacatattagccgagaacgaggtcaagctgaccatcatgacgggcgatataaaaggcatcatgcaagcaggcaaaagaagtctaagaccacagccgaccgaattaaaatatagctggaaaacatggggcaaagctaagatgttaagtaccgaaagctataatcagactttcttgatcgatggacctgagactgcagagtgtcccaatacaaatagagcctggaatagcctagaagtggaagactatggattcggcgtatttactactaatatctggttaaaattaaaggaaaaacaagatgcattctgcgattccaaattgatgagtgccgccatcaaagacaatagagctgtccatgccgatatgggatactggatcgaatccgccttaaacgacacctggaaaattgaaaaagcctcctttatagaagtaaagaattgtcattggccgaaaagtcatacattatggtcaaatggtgttttagaatcggaaatgatcattcccaaaaatctagcaggtcctgtaagtcagcataactatcggccaggttatcacacacagatagctggtccgtggcacttaggtaaattagaaatggacttcgatttttgtgacggaactaccgtaatcgtaacggaagactgcggcaatcgaggaccgagtttgaggactacaactgcatcaggcaaattgatcactgaatggtgttgcagatcttgtacgctacccccgctaagatacagaggtgaagacgggtgttggtatgggatggagatccgaccgttaaaagaaaaggaggaaaacttggtcaattcattagtaacagcaggacatggacaggtcgacaactttagcctgggtgtactgggaatggcattgttcttagaagaaatgcttcggaccagggttggaacaaaacacgcaattctattagttgcagtcagctttgtaacattaataacaggaaatatgtctttcaaggaccttggacgtgtagtagtaatggttggcgcaactatggcagacgacatcggaatgggtgtaacgtatttagctttactcgcggcgtttaaagtaaggcctacctttgcagcgggattgctattaaggaaactgacttcaaaagaacttatgatgacaacaattggaatagtattgttatcacaatcaaccatccctgaaacagtgttagaacttactgacgcgttagcgttgggaatgatggtactaaagattgtaagaaatatggaaaagtatcaactggctgtgactataatggctatcctctgtgttcccaatgcagtcatattacaaaatgcttggaaagtttcctgcacgatactagcagtcgtatccgtctcacctctattgctaacttcatcacagcaaaagaccgactggataccgttagcgttgacaataaaggggttgaatccaacagctattttcttaactacactttcgaggaccaataaaaagagaagttggcctttaaacgaggcaatcatggccgttggtatggtgagcatccttgcttcatcattactcaaaaacgatatacctatgacggggccattggtagccggtggactgctcacagtatgttacgtgttgaccgggagatcagctgacttagagttagaacgggcaacggacgtcaaatgggaagaccaggccgaaatttctgggagttctccgatcctatctattactatcagtgaagacggaagcatgagtataaagaatgaagaggaagaacaaaccctaacaatacttatacgtactggattacttgtaattagcgggttattcccgatatcgatacctattacagcagcagcatggtacctttgggaagtcaagaaacaacgagcgggggtgctatgggacgtgccatcaccgcctccaatgggcaaagcagaattagaagacggggcgtatagaatcaaacagaaaggcatactaggatattcacaaattggtgcaggggtatacaaagagggaacattccatacgatgtggcatgtgactaggggcgctgtattgatgcacaaaggaaaaaggattgaacccagttgggccgacgtgaagaaagatctgatctcctacggaggcggatggaaacttgaaggagaatggaaagaaggtgaagaagtgcaggtacttgccttggaacctggcaaaaacccacgggcagtccaaacaaagcctggactttttaaaactaacactggaactataggggcggtgtcactggacttcagcccgggtacatctggatctccaataattgataagaaaggaaaagtggtaggattatacggcaatggagttgtaactaggagtggagcctatgtaagtgcaatagcacaaactgaaaaatcaatagaagataatcctgaaatcgaagatgatatcttccgaaaaaggagactcacgataatggacttacatccaggagctggaaagactaaacgatatctacctgcaattgtccgagaggcaattaaacgaggacttaggactttaatactagctccaacgagagtcgtggcagcagaaatggaagaagcgctaagaggcctcccgataagatatcagactccagcaattagagcagaacacacggggagagagattgtggatctaatgtgccacgcaacattcacaatgaggctcctgtcgcctgtccgagttccaaattacaatttgataattatggatgaagcacatttcacagacccagctagtatagctgcaagggggtatatcagtacacgtgttgagatgggggaagccgcaggtatatttatgaccgcaacccctcccgggtcaagagatccatttcctcaaagcaatgcgcccataatagatgaagagagagagattcctgagcgcagctggaacagtggtcatgaatgggtaacagatttcaagggtaagacagtctggtttgttccaagcataaaggcgggcaatgatatagcagcatgtttgaggaagaacgggaagaaagttattcaattatcccgaaaaacgtttgactcagaatacgttaaaacccgaacaaacgattgggacttcgtagtgacaacggatatatcggaaatgggcgcaaactttaaagcagaaagggttattgatccacgacgctgtatgaaaccagtaattcttacggacggagaggaaagagtcattctagcgggaccaatgccagtaacccactccagcgcggcacaacgaagaggaagaattggtagaaaccccaaaaacgaaaatgaccaatatatttatatgggcgaaccgctagagaacgatgaagactgtgcgcattggaaagaagcaaaaatgttattagataatatcaacacaccagaaggcattataccctcaatgttcgaaccggaacgagaaaaagtagatgccatagatggagaatatagattacgtggtgaagcgcgtaagacatttgtagatctcatgcgacgtggcgatctgccagtatggttggcttataaggtggcggcagaaggcataaactatgcagatcgtagatggtgcttcgatggaatcaaaaataaccagattttagaagaaaatgttgaggttgaaatatggactaaagaaggagaaaggaagaaattaaaaccccggtggctagatgcacggatttactccgacccactggctttaaaagaatttaaagaatttgcagcaggaaggaagagtttaacgttaaacttaataacagaaatgggtcggctaccaacttttatgacccagaaaactcgtgatgctttagataatttagcggtacttcacacggcggaagctggaggcagagcgtataatcatgccttaagcgaactaccggaaaccttggaaaccctattactactaacgttattagccacagttaccggaggcatatttttgtttttaatgtctggtaggggtattggtaaaatgacattaggcatgtgttgtataataactgcaagcatcctgttgtggtatgcgcaaatccaaccgcattggattgccgcaagtataattttagagttctttctgatagtacttttgataccagaaccagaaaaacagcggacacctcaagataaccaactaacctacgttgtaatcgcaatacttactgtcgtcgccgctacaatggctaatgaaatgggcttcttggagaaaacgaagaaagatctggggctaggttcaatagctacacaacagcctgaaagtaacatcctagacattgatctgcgacctgccagtgcatggacactgtacgcggtagcaactacattcgttacccccatgttacgccattcaattgaaaacagctcagttaatgtgagtttgactgccattgctaaccaagctaccgtgcttatgggattgggaaaaggttggccactaagcaaaatggatataggggtaccgttattggcgatcggatgctatagccaagtcaatcccataacactaacagcagccttactactcttagtagcacattatgcaataataggacccggtctccaagcaaaagccacgagagaagcgcagaaaagagcagcagccggtataatgaaaaatccaactgtcgatgggataacagtcatagatctcgaccctattccctacgatccaaagtttgaaaagcagctagggcaggtaatgcttctgatcctatgtgtgacacaggtattaatgatgcgaacaacatgggcgttatgtgaggctttgacactcgctacgggcccaatatcaactttatgggaaggaaatcccgggagattttggaataccacgatcgccgttagcatggcaaatatattccgaggtagctatttagccggtgcaggcttattattctctatcatgaaaaacactaccaatacccgcagggggactggtaacatgggagaaacgctaggggaaaaatggaaaagccgcctaaatgcattaggaaaaagtgagtttcagatatacaaaagatcaggcatacaggaagtggatcgtacattagctaaagaaggaataaagagaggcgagacggaccaccacgcagtttcacgaggatctgcaaaactcagatggttcgtagaaaggaatatggtaactccagaaggtaaagtagttgatctcgggtgcggacgaggaggatggtcctactactgtggagggctcaaaaacgtacgtgaggttaaaggtttgacgaaaggtggacctggacatgaggaacctattccaatgagtacctatggctggaatctagtacgcctacaatcaggtgtagatgtatttttcataccgcctgaaaaatgcgatactttactatgcgatataggtgaatcaagcccaaatccaaccgtggaagcaggacggacactgcgagtgctaaatttggttgagaattggttaaacaacaatactcaattttgtataaaggtgctaaatccttatatgccgtcggttatagagaaaatggaagcacttcaaagaaaatacggtggagctctagtacgaaatccactatcccgaaattccacccatgaaatgtactgggttagtaacgcttcaggtaacatagtatcatcagtcaatatgataagtaggatgcttattaatcggttcaccatgcgccataagaaagctacttatgagcctgatgtcgatttggggtctggcactcgtaacatagggattgagtcagaaatacccaatcttgacattatagggaagcgtatagagaaaataaaacaagaacatgaaacgagttggcactatgaccaggatcatccctacaaaacttgggcgtatcacggctcgtacgaaaccaaacaaacaggcagcgcgagtagtatggtaaacggagtggtcagattgctgacaaaaccctgggatgtgttaccaacagtcactcaaatggccatgaccgatacaactccatttggacagcaaagagtatttaaagagaaggttgatactagaacacaagaaccaaaggaaggaacgaagaaactcatgaaaataaccgcagaatggctatggaaagaattgggaaagaagaaaacacccagaatgtgcaccagggaggagtttacgcgaaaagtacgcagtaacgccgcacttggagctatttttacagacgaaaataaatggaaatcagcacgagaggcggtagaggatagtcgcttttgggaattagtcgataaagaaagaaacttacacctggaagggaagtgtgaaacatgcgtatataatatgatgggtaagcgcgagaagaaattaggtgagtttggcaaagccaaaggatcaagggcgatatggtatatgtggttaggagcaaggttcttagaatttgaagcacttggatttctaaacgaagaccattggtttagtcgtgaaaacagtcttagcggggtagaaggggaaggtttacacaaacttggttacatcctacgcgacgtaagtaagaaagaagggggagcaatgtacgcagatgataccgctggttgggatactaggataactttagaagaccttaaaaacgaagaaatggtaacaaaccatatggaaggggagcacaagaaactagctgaagctatattcaaattgacatatcagaacaaagtagtcagagtacaacgtccaactccaagaggaacagttatggatattatctcgcgacgggaccagcgtggtagcggacaagtaggtacttatggcctcaatactttcactaacatggaagcacaattaataagacaaatggaaggcgagggtgtatttaaaaatatacaacatctcacagtgaccgaagaagtagccgttcaaaattggctagcacgtgttggccgagagcgactaagtcggatggcaatctcaggagacgactgtgtagtcaaaccgctagatgatagattcgccaacgctcttacagcactaaatgacatgggtaaaataagaaaggatatacagcaatgggaaccgtcgaagggatggaatgattggactcaagtacccttttgctcacatcattttcatgagctaataatgaaggatgggcgagtattagtggtaccctgtaggaatcaggatgaattaatcggccgagcacgaatttcgcaaggagcagggtggtctttacgcgaaacagcttgtttaggtaaatcctacgcacaaatgtggtcacttatgtatttccatagaagggacttgagacttgcagcaaatgcaatctgttcggcggtgccgtcccattgggtaccaacaagtagaactacttggagcatacatgccaagcacgaatggatgactaccgaggatatgttaactgtgtggaatagagtatggattagagaaaacccctggatggaagataaaacacctgttgagtcctgggaagaaataccttatttaggaaagcgagaagatcagtggtgtggctcattgataggattaacaagcagggctacgtgggccaaaaatatacaagcagccataaatcaagtacgcagtttgataggaaacgaggaatatacagattatatgccgtctatgaaacgttttaggagggaggaggaggaggctggggtattatggtag

SEQ ID NO: 22753 - RNA, 9876 nt, synthetic construct
  misc_feature 1..9876: note = derived and/or modified CDS sequence (opt6) from DENV-2__EU482674__SS-prME
  source 1..9876: mol_type = other RNA
agtgcaggtatgataataatgcttataccaactgttatggcatttcatttaacgacaagaaacggagaaccgcacatgatcgtttccatacaagaaaaaggaaaaagtttgttatttaaaacggaagacggtgttaatatgtgtacattaatggcaatggatctcggagaactctgcgaagacacaatcacatacaaatgtcctttgcttagacaaaatgaacccgaagatatagattgctggtgcaactccacaagtacttgggtcacgtatggtacgtgtacgaccactggagaacatagaagagaaaaacgaagcgttgccttagtacctcatgttggaatgggtctagaaacaaggactgaaacgtggatgagtagcgaaggagcttggaaacacgctcaaaggattgaaacatggatactacggcacccaggattcacaattatggcagctatattagcctacacaataggtaccacccattttcaacgtgtattaatatttatactattaaccgcagtagccccatctatgacgatgcgatgcattggtataagcaatcgagatttcgtcgaaggcgtcagcgggggctcatgggtagacatcgtgctggaacatggctcatgtgtaactacgatggccaaaaataaacctacattagattttgaattaataaaaaccgaagcaaaacaacctgcgacactacgaaaatactgtattgaagcaaaattgaccaatactacaacggaatctagatgtccaacacaaggcgaaccttcacttaaagaagaacaagataaacgattcgtctgcaaacacagtatggttgatcgtggatggggaaacggttgcggcttatttggcaaaggtggtatcgtcacttgtgctatgttcacttgtaagaaaaatatggaaggcaaaatagtccaacctgaaaacttagaatacacaatcgttgtaaccccacacagtggagaagaacatgcagttggaaatgacacagggaagcatggaaaggaaatcaaggttacgcctcaaagcagtataacagaagcagaactcacaggctatggaactgtaacaatggaatgtagcccgaggacaggtctagatttcaatgaaatggtattacttcagatggaaaacaaagcatggcttgttcatcgtcaatggtttctcgatttgccattgccgtggttgcccggtgcagacaaacaagaaagtaattggatacaaaaagaaactttagttacgtttaagaatccacacgccaagaaacaagacgtagtagttcttggtagccaagaaggcgcaatgcatacagcactaaccggagccactgaaattcagatgtcctcaggtaacctgctatttacaggacacctgaaatgcagacttaggatggacaaactgcaactgaaaggaatgagttatagtatgtgcactggtaaatttaaagtggttaaggaaattgctgaaactcaacatggaactatagtgataagagttcagtacgaaggagacggttccccgtgcaaaatcccattcgaaattatggacttagagaaaagatatgttttaggaaggttgataacagtaaatcctatagttacggagaaggatagtccagttaatatagaagcggaacctcctttcggagatagttacataatcataggtgtagaaccaggacaactaaaactcaattggtttaagaaagggagcagtattggtcaaatgtttgagacaactatgcgaggagcaaaacgtatggcaatactcggtgatacggcatgggatttcggaagtttaggcggagtattcacatcaattggtaaagcactccaccaggttttcggtgccatctatggcgcagcattcagcggtgtcagttggaccatgaaaatcttaataggagttattattacatggattgggatgaatagccgttcaaccagcttgtcggtgagtctcgttttagtaggcatagtcacactctatctaggtgttatggttcaggcagattcaggttgtgtagtctcatggaaaaataaggaattaaagtgtgggagtggtatcttcataacagataacgtgcacacctggactgaacagtacaaatttcaaccggaaagtccaagcaagctagcaagtgccatacaaaaggcccaagaagaaggaatatgcggtattagatcagtaacccgcctagagaatttaatgtggaaacaaattaccccagagttaaatcatatactcgcagaaaatgaagtaaaattgactattatgacaggagatattcgtggtataatgcaggcaggcaaaaggagcctaaggcctcagccaacagaattaaaatactcttggaagacttgggggaaggcgaaaatgttgtcaacagagtcgtataatcaaacctttctgattgatggccccgagacagctgaatgtcccaacaccaatagggcatggaatagtctagaagtagaagattatggcttcggcgtattcaccacaaatatatggctgaagctaaaagaaaaacaagatgcattctgtgatagcaaattgatgagcgcagctataaaagacaatagagcagttcatgctgatatgggatattggattgagtcagcgttgaacgatacctggaagatagaaaaagcatcgttcatagaagtgaaaaactgtcattggccaaaaagccatactttgtggtcaaatggagtactagagagtgaaatgataataccaaagaacttagcaggtccggtaagccaacataattacagacccgggtatcacacacaaatcgcgggtccgtggcatttaggaaagctagaaatggactttgatttctgtgatggaacgacggtcatagtaaccgaggattgtggcaacagaggcccaagtctaagaaccaccactgcatcaggtaaactcataacggaatggtgctgtcgatcgtgtactttgccacctctgcgttatcgtggcgaagatggatgttggtatggaatggaaattagaccactcaaagagaaagaagagaacttggttaactcattagtgactgcgggacatgggcaagtggataatttttcactaggagtattagggatggctttattccttgaagaaatgctccgaacgagagtcggcacgaaacatgctattctgttagttgccgtgtcgtttgttaccttaattacgggaaatatgagtttcaaagatctgggaagagtcgtagtaatggtaggagcaacaatggctgatgatattggaatgggggtgacctatttggctttgctggcggcgttcaaagtcaggccgacatttgcggctggactcctattaagaaaactaactagcaaagaactgatgatgacgacgatcggtattgttctactatcacaaagtaccatacccgagactgtacttgagctaactgatgcactagctctcggaatgatggtactaaaaatagtcagaaacatggaaaagtatcaattggctgttacaataatggccatactatgtgtgccgaatgctgtaatactacaaaatgcatggaaagtgagttgtaccatccttgcagtggtatctgtgtctccattactactaaccagcagtcaacagaaaactgattggatccctctggcacttacgattaagggactgaatccgaccgcaatctttttaacaacccttagtcgaacaaataaaaagcggagctggccattaaacgaagctataatggcagtcggaatggtgtcaatattagcttctagcctcttgaagaatgatattcctatgactggtccattagtagcaggaggattactgaccgtatgttacgtactcacaggacggagtgctgatctggagttggagagggcgacggatgttaagtgggaagaccaagccgaaatttcgggttcaagccctatattaagtataacgataagcgaagatggcagtatgagtattaagaacgaagaagaagaacaaacgctgactatattaataagaacgggattgctagtaataagtggcttatttccaatatccataccaataacggccgccgcctggtacttgtgggaagtaaagaaacaaagagccggtgtgttatgggatgtaccttcaccaccgccaatgggcaaggccgaattagaggacggtgcctatagaataaaacagaaagggattctaggacattcacaaattggtgcaggagtctataaagaaggaactttccatacaatgtggcacgttaccaggggcgctgtgctaatgcataaagggaagagaatagagccaagttgggcagacgtcaagaaagatttaatctcatatggcggagggtggaaactagaaggagaatggaaagaaggagaagaggttcaagtattggcacttgagccgggcaaaaaccccagagcggtacaaacgaagccaggactatttaaaacgaacaccggcacaataggagctgtgagcttagacttctctccaggaacaagtgggtccccaattatcgacaagaaaggaaaagtcgtgggattgtatggaaatggagtagtaacacgtagtggagcatacgtaagcgcaatcgcccaaacagagaaaaacattgaggacaacccagaaatcgaagatgacatttttagaaaaagacgcctaactataatggatttacacccgggagcaggaaaaactaaaaggtatttgcctgcaatagtaagggaagctattaaaagaggtttacgcactttaattttagcgcctacaagagtagtagctgcagagatggaagaggcattgcggggactacctataagatatcaaacaccagccattagggcagaacatacaggacgggaaatagttgatctcatgtgtcacgcgacctttacaatgagattactgagccccgtaagagtaccaaattacaatctaattataatggacgaagctcactttacggaccccgcttctatagcggctagaggttatatttcaacgcgagtcgaaatgggtgaggcggccggaatattcatgactgccactccacccgggagtcgggatccgtttccacaatccaacgcacccataatagatgaggaacgggaaattccagagcgatcctggaactcaggacacgaatgggtaacagatttcaaaggcaaaaccgtctggttcgtaccaagcataaaagccggtaatgatatagccgcatgcctaaggaaaaatggtaagaaagtaatacaattgtcacggaaaacatttgactcagaatatgttaaaacacgaacaaatgattgggatttcgtcgtaacaacagacatatccgaaatgggagcaaatttcaaagcagagagagtcatcgaccctagaaggtgcatgaaacctgtgattttgaccgatggagaggaaagagtcatactagcgggacccatgccagttacgcattcatcggcagctcagcgcagaggtcgaatcggtcgaaacccaaagaacgaaaacgatcagtacatatatatgggtgagcctttagaaaatgatgaagattgcgcacactggaaagaagcaaaaatgctgttagataacatcaatactccagaagggataatacccagtatgtttgaaccggagagagaaaaggtcgatgcaatagatggtgagtataggttgagaggagaagcacggaaaacctttgtagatctgatgagacgaggcgatttgccagtttggctcgcatataaggtagcagctgaaggtataaactatgcggatagacggtggtgcttcgatggcatcaaaaataaccagatcctcgaagaaaacgttgaagtagagatatggacaaaagagggagaaagaaagaaactcaaacccaggtggttagatgcacggatatactctgatccccttgccttaaaagaatttaaagagttcgctgcaggaaggaaaagcctaactctaaacttgattactgaaatggggcgcttacctacgtttatgactcagaagactcgagacgcattagataatcttgcagtattacatactgcagaagcaggaggcagagcatacaaccatgcgttaagtgaattaccggaaacattggaaacgcttcttctattgaccctactagctaccgtaacaggaggcatcttcttattcttaatgtcaggtagaggaattggaaagatgaccttaggaatgtgttgcataattacagccagcatattactatggtatgcacaaatccaaccgcattggatcgcagcatcaatcattttagaatttttcctaattgtactgttaatcccagagcccgaaaaacaacgcacacctcaagataaccaactcacttacgtcgttatagcgatattaaccgttgtggccgcaacaatggcgaatgagatgggatttcttgagaaaacgaagaaagacttaggacttggatctattgcaacacagcaacctgaatccaatatattagatatagatttgagaccggccagcgcgtggaccttatatgcggtggcaaccacatttgtaacaccaatgctgagacatagcatcgaaaactcaagtgttaatgtgtcccttactgctattgcaaatcaagctacggtattaatgggtctaggcaaaggatggcccctaagcaagatggacattggagtacctcttcttgccatagggtgttatagccaagtaaatccgataactttaactgctgcgttgctactgcttgtagctcactatgctataatagggccaggtttgcaagctaaagcgacgcgtgaagctcagaaaagagcggctgcgggcataatgaaaaatccaacagttgacgggataacggtaattgatttggatcccatcccatatgatccaaaatttgaaaagcagctaggccaagtaatgttactaattctatgcgtgactcaagtgctaatgatgcgtactacgtgggcattatgtgaggcattaacgctggctacaggaccgatttcaactctatgggaaggcaatccggggaggttttggaataccaccatagcggtgagcatggcgaatatatttaggggaagttatctagcgggagctggattattattctcgataatgaaaaatacaaccaatacacgtcgtggaaccggaaacataggcgaaacactaggagaaaaatggaaatctagattaaatgcactaggcaagtctgaatttcaaatttataagaaaagtggtatacaagaagtggacagaacactagctaaagaagggataaaaagaggggaaacagatcatcatgcggtgtcccggggatccgcgaagctaagatggtttgtcgagcgaaacatggtcacaccagaaggtaaggttgtagacctcgggtgcggaaggggaggttggagctactattgtggaggacttaagaatgtaagggaggttaaggggctgacaaaagggggaccaggccatgaagaacctataccaatgagcacatacggttggaatttggtccggctacaatcaggcgtagatgttttctttatacctcctgaaaaatgcgatacactattgtgtgatattggggagtcatcaccaaatccaacggtggaagcagggaggacgttgcgcgtgttgaacttagtagagaactggctcaataacaatacccagttttgtattaaagttttaaatccgtatatgcctagtgttatagagaaaatggaggcgctgcaaagaaaatatggaggtgcactggttagaaatcctctaagtcgcaatagtacacatgagatgtactgggtcagtaacgcgagtggtaatatcgtatcatcagtgaatatgatctctagaatgcttataaacagattcacaatgagacataagaaagcaacatatgagccggatgttgatctgggatcagggactagaaatataggcattgaatccgaaaagcccaatcttgatataattggtaaaaggattgagaaaataaaacaggaacacgaaaccagctggcactatgaccaagatcatccctacaaaacatgggcataccatggttcatatgaaactaagcaaacgggcagtgcatcaagtatggttaatggtgttgtaagactcctaacaaaaccatgggatgtactgccaactgttacacaaatggcgatgaccgatacgacgcccttcggccaacaacgtgtatttaaagaaaaagtagatacacgaactcaagaacctaaagaaggcacaaagaaactcatgaaaattacagcagaatggctgtggaaggagctaggaaagaagaaaacgccaaggatgtgtacaagagaagagttcacaagaaaggttcgatcaaacgctgcgctgggcgctatattcactgatgagaacaagtggaaaagtgcacgtgaagcggttgaagactcacgattttgggaattggtggataaagaaagaaatttacatcttgagggtaaatgcgaaacttgtgtgtataatatgatgggcaaacgtgagaagaaattaggagagttcggaaaagcaaagggttcacgcgcaatttggtatatgtggttaggtgcaagatttcttgaatttgaagccttaggattcttaaacgaagatcactggttttctcgcgaaaactcgttaagtggggtagaaggtgaaggattacacaagttaggatatatacttcgtgacgtctcgaagaaagaaggaggggccatgtatgcagacgacaccgcaggatgggatactaggatcactctcgaggatttaaagaacgaggagatggttaccaaccatatggagggagaacacaagaaattggctgaagctatattcaagctgacataccaaaacaaggtagtaagagtacaacgtcctacgcccagaggcacggtaatggatataatatcaaggagggaccagcgaggaagtgggcaagtcggtacctacgggcttaatacatttacaaacatggaggcacaactaattagacaaatggaaggggaaggtgtctttaaaaatattcaacacctgactgtgaccgaagaagttgcagtacataattggttggcacgtgttggcagagaaagattaagtcgcatggccataagtggtgatgattgcgtcgtaaagccacttgatgatagatttgcgaatgcattaacggcgcttaacgatatggggaagatcagaaaggacatacaacaatgggagccctctaagggatggaatgattggacgcaagtaccattctgttcgcatcactttcacgaactaataatgaaggatggtcgggtgttagttgtaccttgtcgcaatcaagacgagctaataggcagagcacgaatctctcaaggagctgggtggagccttcgagaaacagcctgcctaggcaagtcatacgcacaaatgtggagcttaatgtactttcatagacgagatttaagattggcagccaatgccatctgtagtgcagtaccatctcactgggtacccacgtcgagaaccacatggtcaatacatgccaaacacgagtggatgaccactgaagatatgttaacagtatggaaccgagtgtggattagagaaaatccatggatggaggacaaaacgccagtagaatcatgggaagaaataccttacttgggtaaaagggaggaccaatggtgcggttcgttaataggactcacttctagagcaacttgggcgaaaaatatccaagctgctattaatcaagttcgaagtttaataggtaatgaggagtatacagattacatgccgtctatgaaacgttttcgccgggaggaagaggaagctggagttctctggtaa

SEQ ID NO: 22754 - RNA, 9876 nt, synthetic construct
  misc_feature 1..9876: note = derived and/or modified CDS sequence (opt6) from DENV-2__EU482676__SS-prME
  source 1..9876: mol_type = other RNA
tcggcatctatgataatcatgttaatccctacagttatggcttttcaccttactactagaaatggggaacctcacatgatagttggaatacaggaaaaaggtaaatcgcttttatttaaaacagaagacggggttaacatgtgtacacttatggcgatggacctaggagaactgtgcgaagacacgataacatataaatgtcccttattacgacaaaacgaacctgaagacatagactgttggtgtaacagtacaagtacgtgggtaacatatggaacatgtacaactactggagaacaccgacgcgagaaaagaagcgttgcattggttcctcatgtgggtatgggattggaaacaagaacagaaacctggatgtcatcagaaggagcatggaaacacgcacaaagaatcgaaacgtggatcttaagacatcctggtttcactataatggcagcaatacttgcttatacgataggaactacgcactttcaaagagtactaatatttatactactaaccgctgtagcaccctctatgacaatgcgatgcataggtataagtaatagagacttcgttgaaggtgtctctggagggagttgggtagatattgttctagaacacgggtcatgcgtgacaaccatggccaaaaataaacctacactcgattttgaacttataaaaacggaagcaaaacaaccggcaacactaagaaaatattgcatcaaagcaaaattaacgaacaccacaaccgaatccagatgtcccacccaaggcgaaccctcacttaaagaagaacaggataaaagattcgtatgtaaacattcaatggtcgacaggggttggggtaacggatgtgggctatttggtaaagggggcatagtcacgtgcgcaatgtttacatgtaagaaaaatatggaaggccgaatagttcaaccagaaaatttagaatataccattgtagtcacaccgcatagtggtgaagaacatgcggtaggtaatgacacaggaaaacatggcaaagaaatcaaagttactccccaatcaagcattacagaagcagaattaactggatatggcactgtcactatggaatgcagtccacgcacgggcctagattttaatgaaatggtgttactacagatggaaaataaagcatggttagtacataggcaatggttcttagacttaccgctaccttggttaccgggtgcagataaacaggagtccaactggatacaaaaagaaacgttagtaacgttcaaaaacccacatgccaagaaacaagatgtagtcgttttaggatctcaagaaggtgccatgcatacagctctcaccggtgccacagaaatacaaatgtcctccgggaatctactctttactgggcatctaaaatgtagactaagaatggacaaattacagctcaaaggaatgtcctattcgatgtgtactggcaaatttaaagtggttaaagaaatcgctgagacacagcacggtacaatagtaataagagttcaatatgaaggtgacgggtctccatgtaaaataccattcgaaattatggatctagagaaaagatatgttctaggtagattaattacggttaatccaatagtgacggaaaaagattcgccagtcaatattgaagcagaacccccattcggggatagttacattataattggcgtcgaacctggacagctaaaattaaactggtttaagaaaggatcttccataggccaaatgtttgaaacaacaatgagaggcgcaaaacgtatggcgatattaggagatacagcttgggactttggatcgcttggcggtgtgttcacgtctataggaaaagcacttcatcaagtttttggcgctatctatggcgcagcctttagcggagtttcctggaccatgaaaatattaataggggtaatcataacttggatcgggatgaactcccgctcgacttctctctcagtttctcttgtgttggtgggaatagtaactctatacttaggggttatggtgcaagcggactcaggttgcgtagtaagttggaaaaataaagagctgaaatgcggaagtggtatatttataactgataatgttcacacttggactgaacaatacaaatttcaacctgaatctccatcgaaactagcatcagcgattcaaaaagcacaagaagaaggtatctgtggtatacgatctgtaactaggctagaaaatttaatgtggaaacaaatcacacccgaacttaatcatatattagctgagaatgaagtaaaactcacgattatgacaggagacataaaaggaattatgcaagcgggaaaaaggagcctgagaccacaaccaacagagcttaaatactcatggaaaacatggggtaaagccaaaatgttatcgactgaaagttataaccaaacatttctaatcgatggaccggaaacagccgaatgcccaaataccaatagagcgtggaactctctcgaagtcgaagactatggatttggagtatttacaacaaacatttggctgaaactcaaagaaaaacaagatgtattttgtgatagtaaactgatgtcagccgcaataaaagataatagagctgtacatgcggatatgggatattggattgaaagtgctttaaacgacacctggaaaatagaaagggcctcattcatagaagttaaaaattgtcactggccaaaatctcacacactatggtcaaacggtgttttagagagcgaaatgataatcccgaaaaatctagctggtccagtatcccagcataactatcgtccaggataccatactcagattgcaggtccttggcatctaggtaaactagaaatggactttgatttctgcgacggtacaactgttattgttacagaagactgtggaaacagagggccatcactaagaacaacaaccgcctctggaaaactaatcacagaatggtgttgcagatcgtgtacacttccgcctttgagatatcgcggtgaagacggatgttggtatggtatggaaatacgacccttgaaagagaaggaagagaacttagttaattctctagtaacggccggtcacggtcaagtcgataatttcagcttgggcgtgctgggaatggcgctattcttagaagaaatgttgagaacaagagtaggtacgaaacacgcaattttattagttgcagtatcattcgtcaccctgattaccggaaacatgtcttttaaagatctcggacgagttgtcgtaatggtaggtgcaaccatggctgacgacatagggatgggagtgacttatctagccctactagcggcttttaaagtacgacctacgttcgcggctggactcttattgcgaaagttgacgtcaaaggagttgatgatgactaccataggcatcgtacttcttagtcagtcgacaatccccgaaacggtacttgaacttactgatgccctggcacttggtatgatggttcttaaaatcgtgaggaacatggaaaaatatcaattggcggtcaccataatggctattttatgtgttcctaacgcggtaattcttcagaacgcttggaaagtatcatgtacaatcctggcagttgtgagtgtaagtccactcttactaacgtcatcacaacaaaagacggattggataccgttggccctaaccataaagggactaaatcctactgcaattttcctaactactctcagccgtactaacaaaaagaggtcatggcctctcaatgaagcaataatggccgtaggaatggtttctatcttagcttcatccttactaaagaatgatataccaatgacgggacctttagttgctggtggcttactaaccgtatgctatgtcctcactggcagatctgcagacttagaactggaaagggcaacagatgtaaaatgggaagatcaagcagaaatatccgggtcttcccctatacttagtataacaataagtgaagacggatctatgtctattaaaaacgaggaagaagaacaaactttaacaatcctaataaggacaggtcttttagtaattagcggtttatttccaataagcattccaatcacggcagcagcatggtatctttgggaggtgaagaaacaaagagcaggagtattatgggatgtaccttcgcctccacccatgggtaaagccgaattagaagacggagcatacaggataaagcagaaaggaatactagggtattcgcaaattggtgctggagtatacaaagaaggaacatttcatacgatgtggcacgtaacacggggagcagttctgatgcacaagggaaagcgcatcgaaccatcatgggcagatgtcaagaaagatttgatttcgtacggcggcgggtggaaactagaaggggaatggaaggaaggcgaagaggttcaagtgttggctctagaaccgggcaaaaatccaagagcggtccaaactaagcctggcctatttaagacgaacactggaacaataggtgccgtatctttggatttttcaccgggaacgtccggaagtccaattatcgacaagaaagggaaagtcgtgggattatacggtaatggagtagtaacgagatcaggggcttatgtttccgcgatagcccaaaccgagaaaagcattgaggacaatcccgagattgaagacgatatttttagaaaacgacgacttaccatcatggatttgcatcctggagcggggaagacgaagagatatctacccgctatagtacgagaagctattaaaaggggccttcgtacacttattttagcccccacaagggtggttgccgcagaaatggaagaagccttacgtggattaccaatccgatatcaaactccggctattcgagcagaacatacggggcgagaaatcgtagatttaatgtgtcacgccacttttacaatgcggttactaagcccagtaagagtaccaaattacaacctaataataatggatgaggcccatttcacggacccggccagcattgcagcacgtggctacattagcacaagagttgaaatgggagaagcggctggcatattcatgacagcaacaccacccggcagtagggatccattcccacaatccaacgcgcccattattgatgaagagagagaaatacctgagcggtcgtggaactccggtcacgaatgggttacagatttcaagggtaaaactgtatggtttgttcctagcataaaagctggcaatgatatagcggcctgcctaagaaagaacggcaagaaagtaattcagttaagccgaaagacgttcgacagtgaatatgtgaaaacaagaacaaacgactgggatttcgtcgtaacgaccgacattagtgagatgggagctaattttaaagcggaacgagttattgacccaagacgatgcatgaagcctgttatcttaactgacggagaagaacgagtaattttagccggccccatgccagtgacccactctagtgcagcacaaagaagaggtagaattggacgaaaccccaaaaacgaaaacgatcagtacatatatatgggggagcctctcgaaaacgacgaagattgcgcacactggaaagaagcgaagatgcttttagataacattaatacaccagagggaataatccccagcatgttcgaaccagaaagagagaaagtagatgcaattgacggagaataccgattaagaggggaagccagaaaaacatttgtagatctgatgcgtcgcggagatcttcctgtctggctagcttataaagtcgcagcagagggtataaattatgccgacaggagatggtgttttgacggtattaagaataatcaaattttagaagaaaacgttgaggttgaaatatggactaaagaaggagagaggaagaaacttaaacctcgatggctcgatgcaaggatatactcagacccgctcgccttgaaagagttcaaggaatttgctgcaggtaggaaatcgctaactctgaatctgattacagagatgggacgactaccgacattcatgacacaaaagacacgggatgcattagataatttagcagtattacacacagcagaagcaggaggtagagcatataaccatgcactaagtgaattgccagagaccctagagacactattattattaactctgttagcaactgtaaccggtggtattttcctcttcttaatgagtggcagaggcatagggaaaatgacgttagggatgtgctgtataatcactgcctcgatattattatggtacgcacaaatccagccgcattggatcgccgcaagtattattttggaatttttcctgattgtcttgttgataccagaaccagaaaaacaaagaaccccgcaggataatcaactaacctatgtagtgattgccattttgacggtagtagcagccacaatggctaatgagatgggatttttggagaaaacaaagaaagactttggattaggttccattgctacgcagcaacccgaaagtaatatcttggatattgacctacgtccggcgagtgcttggaccctatatgcggtagcgactaccttcgtaacaccgatgttacgacattctatagaaaattcaagtgtgaacgtatcattaacagccattgctaatcaagcaacagtcttgatgggactaggaaaaggatggccgttatcaaaaatggatattggtgtgcccttattggctattggctgctatagccaagtgaaccctatcaccttaacggctgcattgttgctccttgtcgctcattacgctataattggcccaggtctccaagcaaaagcgacacgggaagcacaaaagagagctgcggccggaataatgaagaatcctacagtagatggcatcactgtaatagatttagaccccataccatatgacccaaagttcgaaaaacaattaggccaagtaatgctgctaattttatgtgtaacgcaagtgcttatgatgcgtactacatgggccctatgtgaagcgctaactctcgcgacaggaccaatatccactttatgggaaggtaatcccggaagattttggaataccactatagctgtatcaatggcaaatatttttcgtggatcatatttggcaggcgcaggtctcttatttagtattatgaaaaatactacaaacacccgacgcggtaccggaaacatcggagaaaccttaggagaaaaatggaaatcaagacttaacgcactcggaaaatcagagttccagatatacaagaaatcgggcatacaagaagtagaccgtacattagccaaagaagggataaaacgtggggaaactgatcatcatgcagtgagtagaggaagcgcaaaactgagatggtttgtagaaaggaacatggtaacccccgagggcaaagtcgttgacttaggctgtggtcgtggaggttggagttactactgcggtggactgagaaacgttagagaagtcaaaggtctaacaaagggagggccaggtcacgaagaacctataccaatgagcacatatggatggaatttagttagattacaaagcggtgttgatgtattctttatacctcctgaaaaatgtgataccttactttgtgatatcggagaatcaagccctaatccaacagttgaggctggacgcaccttaagagtactaaacctggttgaaaactggttaaataacaacacacaattttgcattaaagtattaaacccatacatgcctagtgtgatagagaaaatggaggctttgcaacgcaaatatggaggggcgcttgttagaaatccgttaagcagaaacagtactcacgaaatgtattgggtgtcgaacgcgtctggtaatatagtatcaagtgtgaacatgatctctagaatgctaataaatcgcttcacaatgcgccataagaaagctacatacgaaccagatgtggatctagggtcgggcacacgtaatattggtatcgaatcagaaataccaaatcttgatataatagggaagaggatcgagaaaataaagcaagaacatgaaacgagttggcattatgaccaagatcatccatacaaaacgtgggcgtaccacggtagttacgaaactaaacaaacagggtctgctagttcaatggtcaatggggtagtacgtctactcactaaaccgtgggacgtattaccaacagtaactcaaatggcaatgacggacacgactcccttcggccagcaaagagtcttcaaagagaaagttgatacaagaacccaagaaccaaaggaagggactaagaaattgatgaaaataactgcagagtggctctggaaagaattaggcaagaagaaaacaccaagaatgtgcactcgtgaagagttcactagaaaagtgagaagcaatgccgctttaggggctatatttaccgacgagaacaaatggaaatccgcacgcgaagctgtggaagactcaaggttttgggagctcgtggataaagaaagaaatttacacttagaaggtaaatgtgaaacatgtgtctataacatgatgggcaaaagagagaagaaattgggggagttcggcaaagctaaaggaagtcgtgcgatttggtacatgtggttaggtgctcgattcttagaatttgaagcattagggttcctcaatgaggatcactggttcagcagagaaaattcgttatcgggtgtggaaggggagggtcttcataaactaggatacatcttaagggacgtatccaagaaagaaggaggtgcaatgtacgcggacgacacggcgggatgggataccagaatcacgttggaagacttgaaaaatgaggaaatggtcacaaaccatatggaaggggaacacaagaaattagcagaagcgatctttaaattaacatatcagaacaaagtcgtaagggtacaacggcccacaccgcgaggaacggtaatggatataattagtaggagggatcaacgagggtcaggacaagttggtacctatggcttaaacacatttacaaacatggaagcacaacttatcagacagatggagggggaaggcgtgttcaaaaatattcaacatctcacggtaacagaagaagttgcagtgcaaaattggctagccagagtaggacgtgagcgacttagtaggatggcaatatccggagatgattgtgtagtaaaaccattagatgatcggttcgcaaacgcactaactgccctgaatgatatggggaaaataagaaaagacatacagcaatgggaacctagcaaaggttggaacgattggacacaagtacctttttgcagtcatcattttcatgagctgataatgaaagatggaagagtactggttgtaccctgtcgaaaccaagatgaattgataggtagagcacgaatatcgcaaggggctggatggtcattgagagaaacagcttgtttaggtaagagctacgcgcaaatgtggtcattaatgtacttccatagacgagacctacgactagcggcaaatgccatttgttcggccgtcccatctcattgggtaccaacatcacgaacaacatggagtattcacgctaaacacgagtggatgacgaccgaggacatgcttgctgtttggaacagggtatggatccgtgaaaatccctggatggaggacaaaacgcccgttgaatcgtgggaagaaataccgtatctaggcaaaagagaagatcaatggtgcggaagtcttataggattaacaagtagagccacttgggcaaagaatattcaagcagctatcaatcaagtaagatctttgatagggaacgaagaatatacggactacatgcctagtatgaaacgatttcgcagagaggaagaggaagccggagttttatggtga

SEQ ID NO: 22755 - RNA, 9876 nt, synthetic construct
  misc_feature 1..9876: note = derived and/or modified CDS sequence (opt6) from DENV-2__EU482677__SS-prME
  source 1..9876: mol_type = other RNA
tcggctggaatgataataatgctaataccaacagtaatggcatttcatttaacaacaagaaatggtgaacctcatatgatagttggtattcaggaaaaaggtaaatctcttctttttaaaacagaagacggggtaaacatgtgcacactaatggcaatggatttaggagaactttgtgaagatactattacatacaaatgcccgctactacgtcaaaatgaaccagaagacatagattgttggtgtaattctacgtcgacatgggttacatatggcacttgcacaacgacaggggaacatcgtagagaaaaacgcagtgtagcactcgtcccacatgttggtatgggtttagaaactaggaccgaaacgtggatgtcatctgaaggagcatggaaacatgcccaaagaatagagacctggatactaagacacccaggtttcacaattatggctgcgattcttgcatacactatcggaactacacattttcaaagggtcttaatatttatattactaactgctgtcgcacctagcatgactatgcgctgtattgggattagtaatagagattttgtagaaggagtatcaggcgggtcctgggttgatatcgtactggaacacggctcttgtgttactacgatggctaaaaataaacctactttagattttgaactcattaaaacagaggcaaaacaacccgctacattaagaaaatactgcatagaagctaaactgacaaacacaaccacagaatcaagatgtcccacacagggggaaccaagcctaaaagaagaacaagataaacgatttgtctgtaaacacagtatggtagaccgaggatggggaaatggttgcggtctattcggaaaaggcggtattgttacgtgtgctatgttcacatgtaagaaaaatatggagggcaaaatagtacaacctgaaaatttagaatatacaatagtggtaacgcctcatagtggcgaagaacatgctgttggaaatgacacaggaaaacacggaaaagaaatcaaagtaacaccacagtcaagtattacagaagcggaattaactggatacggcacggtcactatggaatgtagtcccagaacgggactagactttaatgaaatggtgctgctacaaatggagaataaagcgtggttagtgcatagacagtggttcttagatctgccgttaccttggttacctggcgccgacaaacaagagagtaactggattcaaaaagagaccctagtaacttttaaaaatccccatgccaagaaacaagatgtcgtggtattaggatctcaagaaggtgcaatgcatacagcattaacaggtgcgacagaaatacagatgagttccggcaatttactctttactgggcatctgaaatgtcgcttacggatggataaattgcaattaaaaggcatgtcctattcgatgtgtactggaaagttcaaagtagtaaaggagatagcagaaacgcaacatggcactattgttatccgagttcagtacgaaggagacggatcaccttgtaagattccttttgaaatcatggatttagagaaaagatatgtcctgggcagacttattacagtaaacccaattgtcactgaaaaagattcccctgtgaacatagaggcggagccacctttcggcgattcgtatattattataggcgtggaaccaggccaactaaaattgaactggtttaagaaaggtagctcaatcggccagatgtttgaaacaacaatgagaggagccaagcgcatggccatactcggtgatacagcctgggattttggcagtttgggtggagtatttacttcaatcggtaaagcactacaccaagtctttggggcgatctacggcgcggcctttagcggtgtctcttggaccatgaaaattcttattggagtgattattacgtggatcggcatgaatagtcgatcgacaagtctttcagtaagccttgtattagtcggcatagtaaccttatatttaggcgtaatggtacaagcagactcaggatgtgttgtatcctggaaaaataaggaattaaaatgcggcagcggcatttttgtaactgataacgtccatacatggacagaacaatacaaattccaacctgagagtccatcaaagttggctagcgcgatacaaaaagctcaagaagagggcatctgcggtatacgtagtgtcacacgtttagaaaacttaatgtggaagcaaattaccccagagttgaaccacatactagctgagaacgaagtaaaactaactataatgacaggagacatcaagggaatcatgcaagcaggtaagcggtccctaagaccacaacctacagaattaaaatactcctggaagacttggggcaaggcaaaaatgctctctacagaaagttataatcaaacctttttgattgatggccctgaaacagcagaatgtccgaatactaaccgtgcatggaactcactagaagtagaagattatgggtttggagtatttaccacaaatatatggctcaaactgaaagaaaaacaagatgcgttctgcgactcgaaattaatgagtgcggctataaaagataatcgagcggtgcacgcagacatgggatactggatagaaagtgcactcaacgacacgtggaaaatagaaaaagcgtccttcatcgaagtcaaaaattgtcattggcctaaatcacatacgttgtggtcgaatggagttctggaaagcgagatgattatacccaaaaatctagcgggccccgtgtcacagcataattatagacctggatatcatacacaaatagcggggccttggcacctgggtaaactggaaatggatttcgacttttgtgacggtacaactgttatcgtaacagaagattgtggcaatagggggccctcgcttcgaacaacaacagcgtcagggaaactcataactgaatggtgctgtagatcgtgtaccctaccacctctccgatatcgaggagaggatggctgctggtatgggatggaaatacgtccattaaaggaaaaagaagaaaatcttgtgaatagtttagtaacagccggccatgggcaagtggataacttcagtcttggggtattaggtatggccttatttttggaagaaatgctacgaacaagggttggtacaaaacatgcaatactcttggtggcagttagctttgtcactctaattaccggaaacatgagcttcaaagacctaggtagggtcgtggttatggtaggagcaacaatggctgatgacatagggatgggtgttacgtatcttgcacttctggcagcattcaaagtacgaccaacatttgcagcgggattgctacttcgtaaattgacgtccaaagaattaatgatgactactataggaattgtattactcagtcaaagtacaataccagaaactgtcttagaactgacagatgcgcttgcattgggaatgatggtattaaaaatagtcagaaatatggagaaataccaactagctgtcacaatcatggctattctatgcgtacctaatgcggttattctacagaacgcgtggaaagtatcgtgtactatattagcagtcgtgtcagtatcaccactcctattgacaagttcacaacagaaaactgattggattccattagccctgacaataaaaggattaaacccaaccgccatatttctaacgacattatcgcgtacgaacaagaaacggtcctggcctctaaacgaggcgatcatggcagtcggaatggtgtctattcttgcatcatccctcctcaaaaacgacataccaatgacagggccactcgtggcaggaggattactcaccgtatgctatgtactcaccggacgttctgcagatcttgagctcgaacgcgcaacagatgtgaaatgggaagatcaagcggagatctcaggaagttcaccgattttatccataacaatatcagaagatggaagtatgtcaatcaaaaatgaagaagaagaacagaccctaacgatccttatacgaaccgggttactggtcatatcaggcctttttcccatttctataccaattacggctgcagcttggtatctatgggaagtcaagaaacaaagagcaggagtactctgggatgttccatcaccaccacccatgggcaaagcagaattagaagatggtgcttaccgtattaaacagaaggggatattaggatattcacaaattggagcgggagtttataaggaaggaacttttcatacaatgtggcatgtgactagaggagctgttttaatgcacaaaggcaaaagaatcgagcccagttgggcggacgtcaagaaagacttaattagttacggaggtgggtggaaactggaaggcgaatggaaagaaggggaagaagtacaggtattagcactagagcctggcaaaaatccgcgagcagtccaaacaaagcccgggctgttcaaaacctcaactggaacaattggggcggtatcacttgacttttctccaggaacaagtggatcccctataatagacaagaaaggtaaggttgtgggattatatggtaacggagtagtcaccagatcaggtgcttatgtttctgcaatagcacagaccgaaaagagcatagaagataatccagaaatagaagacgacatctttcgcaaacggcgtttaacaataatggatttacatcctggcgcaggaaaaactaagcgttacttacctgcaatcgtacgagaagcaatcaaacgcggattgcgaacattgatattggctccgactagagtggtagctgccgagatggaggaagcactaaggggattgcccatcagatatcaaactccggctattagggctgaacataccggacgtgaaatcgtagatctcatgtgtcacgctacatttacaatgagactattatctcccgtacgcgtacctaattacaacttaataataatggacgaagcccattttacagaccccgcctcaattgccgcgagaggttatatcagcacccgtgtcgaaatgggtgaagcagctggaatatttatgacggctactccaccaggatcccgagacccattcccacagtctaacgcaccaatcatagatgaagaaagggagataccggaaagaagttggaactcgggccatgagtgggtgactgattttaaaggcaagaccgtttggtttgttccatcaatcaaagcaggaaatgatatagccgcttgtcttaggaagaatgggaagaaagtcatacaactttcacgaaagacatttgactccgaatatgtcaaaaccaaaacaaatgattgggactttgtagtcacaacggacataagcgaaatgggagccaatttcaaagcagaaagagtcattgatccacgcagatgtatgaaaccagtgatacttacggatggggaagaaagggtaattctagcaggtcctatgcccgtaacacacagctcggcagctcagcggcggggcaggataggtagaaaccccaaaaatgaaaacgaccaatacatttacatgggtgaacctttggagaatgacgaagattgtgcgcattggaaagaagctaaaatgctgttagataacattaacactcccgaaggtattatcccatcaatgttcgaaccggaacgagaaaaggtcgacgctatagacggagaatatagattgcggggcgaagcaaggaaaacattcgtggaccttatgcgtaggggcgatttaccagtttggttggcatataaggtagcagcagaagggattaattatgctgatagacggtggtgtttcgacggtataaagaataatcagattcttgaggaaaacgttgaagttgaaatctggactaaagaaggagagcgaaagaaacttaaaccacgttggctggatgcccgaatatattctgatccactagcattaaaagaatttaaagagttcgcagctggtagaaaaagtctaactttaaatcttattacggaaatgggtcgattgccgacttttatgacacagaaagctagggatgcattggataatcttgcagttttgcataccgcggaggcaggaggtagggcatacaaccacgcattaagtgaacttcctgagacactcgagacactcttattgctgactttattggctacagttactggaggtatttttctatttttaatgagtggaagggggatagggaaaatgacactcggtatgtgttgcataattaccgcctcaatacttttgtggtacgcacaaatacaacctcattggatcgccgcatctatcatcctcgagtttttcctcatcgtcctactcattccagaaccggaaaaacaacggacgccgcaggacaatcagctaacatatgtcgttatagcaatactaactgtagttgcggcgactatggcgaacgaaatgggctttttggaaaagactaaaaaggatttgggattaggcagcatagcgacacaacaaccagaaagcaacattctggatatagacctgaggccggcgagtgcatggaccctctatgcggtcgctacaactttcgttactcccatgctaagacattctatagagaacagttcagtgaatgtatccttgacagctatcgccaaccaagcaactgttcttatgggtctgggaaaaggctggccactttctaaaatggatatcggagttcctctattagccatcggatgttatagtcaggttaatcccattacattgaccgcagcattactacttttagttgcccattatgcaattataggccctggtcttcaagcaaaggctacaagggaagctcagaaaagagcagcagccggaatcatgaaaaatcccacagtcgatggaataactgttatcgaccttgatcctatcccgtacgacccaaagtttgaaaagcaactaggtcaggtcatgctattaatcctatgcgtcactcaagtcctaatgatgagaacaacatgggcactatgtgaggctttaaccctagcaacaggccctataagtactctttgggaaggaaacccaggaagattctggaatacgaccattgcagtcagcatggcaaacattttccgtggtagctatttagctggagcgggacttctattttcaataatgaagaacactacaaatactagacgtggtacgggaaatataggcgaaacacttggagaaaaatggaagagtcgactcaacgcactaggaaaaagtgaatttcaaacttacaagaaatctggaatccaggaagtcgacagaacattagctaaggaaggaattaaacgaggcgaaactgatcatcatgcagttagcagagggtctgcaaaattacggtggtttgtagaacgaaacatggtaacacctgaaggaaaggtggtagacttaggctgcggaagaggagggtggagttattattgcggagggttaaagaacgtacgagaagttaagggtttaaccaaaggaggccccggacatgaagaaccaataccgatgagcacatatggttggaatcttgtccgactacaatcgggtgtagacgtattcttcatacctccagaaaaatgcgatacactattgtgtgatatcggagaaagcagtccaaatcccacagttgaagccggccgaactcttagggtattaaacctggttgaaaattggttaaataacaatacacaattttgcatcaaagtattgaacccatacatgccttccgttattgagaaaatggaggcactgcaaagaaaatacggcggagcgctcgtccgtaatcctttaagtagaaactccacccatgaaatgtactgggtatctaatgcttcaggaaacatagtaagctcagtcaatatgataagcagaatgctaatcaatagatttactatgcgacacaagaaagcgacatatgagccagatgtagatctgggttcaggaacgagaaacatagggaacgaatccgaaataccaaatctagatataattgggaaaaggatcgagaaaataaaacaggaacatgaaacgagttggcattatgaccaagatcatccgtacaaaacctgggcttatcatggatcatatgaaactaaacaaaccggttcggcatctagcatggtaaatggggttgtcaggctacttactaaaccatgggatgtgctaccgacggtaacacagatggcaatgacagatactacaccatttggtcaacaaagggtattcaaagagaaagtggatacacgaacacaggagccgaaggaagggacaaagaaattaatgaaaataaccgctgaatggttatggaaagaactcggcaagaagaaaaccccaagaatgtgtacaagagaagaatttacacgaaaagtgaggagcaacgcagcactaggagccatctttaccgatgaaaacaagtggaaaagcgccagagaagcggtggaagattcgagattttgggagcttgtagataaagaacgaaacttacatcttgaaggaaaatgcgaaacttgcgtatacaatatgatgggtaaacgtgaaaagaagctgggcgaatttggaaaagcaaagggatctagagcaatatggtatatgtggctcggggctagatttttagagttcgaggctcttggattcttaaacgaggaccactggtttagccgcgaaaattcattatctggtgtcgaaggagaaggtctccataagttgggttatatattaagagatgtctccaagaaagaaggaggggctatgtacgccgatgacacagccggatgggatacaaggataacattggaggacctcaaaaatgaggagatggtaacaaatcacatggagggggaacataagaaattggcagaagcaatattcaaactaacataccagaataaagttgtaagagtccaacggcctacaccaaggggtaccgtaatggacataattagtaggagagaccaaaggggcagcggccaagtaggaacttacgggctaaatacctttacgaatatggaggcacaattgataagacaaatggaaggggaaggagtattcaaaaacattcaacacctaaccgttacagaagaggtagctgtgcagaattggctcgctagagtcggaagggaaaggttatcacgaatggccatttcgggcgatgattgtgtagtaaaaccattggacgacagatttgccaacgcattaacagccttgaatgacatgggaaagataagaaaagatatacagcaatgggaaccttccaaaggatggaatgattggacacaagtaccattctgctcccaccactttcatgaacttataatgaaagacggccgagtattagtcgtcccttgtcgaaatcaagatgagttaataggaagggcaaggatcagccaaggggctggatggagcctaagagaaactgcatgtctaggaaagtcatacgcacaaatgtggtctcttatgtactttcaccgcagagacttgaggttagcagcgaatgcaatctgttccgccgttccatcccattgggtaccaacaagtcgtacaacctggtcaatccatgctaaacacgaatggatgacaaccgaagacatgttaacagtttggaacagggtatggatacgagaaaatccttggatggaagataaaacacccgtagaatcttgggaagaaataccctatttaggaaaaagagaagatcagtggtgcggatcattaatcggccttacatcaagagcaacgtgggctaaaaacatacaggttgccataaaccaagtaagatctttgataggcaacgaggaatacaccgactacatgccctctatgaaaagatttcgtcgagaagaggaagaagccggcgtactatggtag

SEQ ID NO: 22756 - RNA, 9876 nt, synthetic construct
  misc_feature 1..9876: note = derived and/or modified CDS sequence (opt6) from DENV-2__EU482678__SS-prME
  source 1..9876: mol_type = other RNA
tcagcgggcatgataattatgctaattccaacggtaatggcatttcatttaactacaagaaacggggaaccacacatgattgtaggtatccaagaaaaaggtaaaagcctgttattcaaaacggaagatggagtgaatatgtgtactttgatggcaatggacttaggagaactctgtgaagacacaattacatataaatgtcctttattaagacaaaacgaacctgaagacattgactgctggtgtaattcaacctcaacttgggtaacttacggtacctgtactactactggagaacatagacgcgagaaaaggagcgtagccttagttccgcacgtgggaatggggttggaaacgaggacagaaacgtggatgtcgtctgaaggggcatggaaacacgctcaaaggattgaaacatggatattacgacacccgggtttcacaataatggctgctatattggcctatacgattggaacaacacacttccaaagggtgttaatatttatactccttacggcagtggctccaagtatgacgatgagatgcattggaattagcaacagagatttcgtcgaaggagtatcgggaggcagttgggtagatatagtactcgaacatggttcatgtgtaacaaccatggctaaaaataaacctacacttgacttcgaactcataaaaacagaagctaaacaaccagctacattaaggaaatactgcattgaagctaaacttacaaatacgaccacagaaagtcggtgtcccacacagggtgaaccaagtctaaaagaagaacaagataaaagattcgtctgcaaacactcaatggtggatcgtggctggggaaatggatgtgggttatttggaaaaggaggcatcgtcacatgcgcgatgtttacatgcaagaaaaatatggaaggtaaaattgttcaaccggagaatctggaatacacgatagttgtaacgcctcatagcggagaagaacacgcagttggtaacgatacaggtaaacatggaaaagaaatcaaagtaacaccacagtcatcaataactgaagcagaactaacaggttatggcacggttacaatggagtgctctccgcgtactggcctagatttcaacgaaatggtactactacaaatggagaataaagcatggttggtacatagacaatggttcttagacttaccattgccatggctacctggtgctgatgaacaagaaagtaattggatacaaaaagaaactctagtaacatttaaaaatccacacgcaaagaaacaagacgtagtggtattaggttcgcaggaaggagcgatgcacacggctttgacgggtgcaaccgagatacaaatgagctcagggaacctcttatttactggacatttaaaatgtagactacgaatggacaaactacagctcaaagggatgagctattcaatgtgcactgggaaattcaaagtagtaaaagaaattgcagaaactcaacatggcacaattgttataagagttcaatacgaaggggacggaagcccatgtaaaataccgtttgaaataatggacctagagaaaagatacgtattagggcgtttaataacagttaaccccatagttacagaaaaggacagccccgtcaacattgaagcggaacctccctttggagactcatacataatcatcggagtagagcccggtcaattgaaactaaactggtttaagaaaggatcatcaatagggcaaatgtttgaaactactatgcgaggcgcaaaacgcatggctatcttaggtgatacagcgtgggatttcggtagcttgggtggagtatttacatccattggcaaagcattacatcaagtctttggggcaatatacggcgctgcttttagcggtgtatcttggacaatgaaaatattaatcggcgtgattattacatggattggtatgaactcaagaagtacctctttatcagttagtttggtcctagtgggaatagtcactttatatctaggcgtgatggtacaagcagattcaggctgtgttgttagctggaaaaataaggaattaaagtgtggttcgggtatttttataacagataatgtacatacgtggacggaacagtataagtttcaaccagagagcccaagtaaattggccagtgccatccaaaaagcacaagaagagggtatttgtggaataagatctgtaacaaggttagaaaatttgatgtggaaacaaataacgcccgaactgaaccacatattagcagaaaacgaagtcaaattaacaataatgactggggatataaaaggtattatgcaagcaggaaaacgatcattaagaccacagccaactgaacttaaatatagctggaagacgtgggggaaagcaaagatgcttagtactgagagttataatcaaaccttcttaatagatggaccggaaacaacagaatgcccaaacaccaatagagcatggaactctctagaagttgaagactatggattcggagtgttcacgaccaatatctggttaaaacttaaggaaaaacaagatgccttctgtgactccaagctcatgtcagctgccataaaagataatcgcgctgtacatgctgacatgggctactggattgaatcagccttgaacgatacttggaagattgaaaaagcctcatttatagaggttaaaaactgccactggccgaaatcccacactctatggagtaatggagttttagagagtgaaatgattatcccgaaaaatctagccggccctgtgtctcaacacaattatagaccgggttaccacacacaaatagcaggcccatggcatttgggaaagttagaaatggattttgatttttgtgatggtacaaccgttatagtaaccgaggattgcggaaatagaggaccaagtttgagaacaacaactgcatcaggaaagttaattactgaatggtgttgcagatcatgcacacttccccctctgcgttatcgtggagaggacgggtgctggtatggaatggagataagaccacttaaagaaaaagaagaaaatttagtaaattcgttggttacggcagggcatggccaagttgataattttagcctcggtgtattaggtatggccctatttttggaagaaatgctccgaacaagggttggaactaaacacgcgatactactcgtagcggtatcatttgtaacactgattacgggaaacatgagcttcaaagacttgggtagagttgtggtaatggtaggagcaaccatggcggacgacataggaatgggtgtgacatatttagcattgttagcagcgttcaaagtaagacctacttttgcagcggggctcctgttgaggaaattaacatcaaaggaactaatgatgaccactattggaatagtactgcttagccaatccacaatacccgaaactgttctggaattgactgatgcattagctcttgggatgatggttttgaaaatcgtgagaaatatggaaaaatatcaacttgctgttaccattatggcgattttatgtgttccaaatgctgtaatcttacaaaacgcgtggaaagtaagctgtacaatactagctgtcgtaagtgtttcccccttactactgacaagttctcaacagaaaactgattggataccattagcactagcaataaaaggacttaatcctactgcgatatttttaactacactcagtagaactaacaagaaaagatcatggcccttaaatgaggcaataatggcggttgggatggtatcaatattagctagcagcttgttaaagaacgacatcccaatgacaggacccttagttgcgggtggattgctaactgtatgttatgtattaacaggaagatccgctgacttggagctggaacgtgccaccgacgtgaaatgggaggaccaagccgaaatctctgggtcaagtcctatactaagtattactatatcagaagacggttcaatgagtattaaaaatgaagaggaggagcaaactttaacaattcttatacgcaccggactgcttgttatcagtggtcttttcccaatatcaatacctataacagcagcagcctggtatttatgggaagtaaagaaacaaagagcaggggttttatgggatgttccttcaccaccaccaatgggtaaagcagaactagaagatggtgcctatagaataaaacaaaaaggaattttaggatactcacagataggggcaggagtttataaagaggggacttttcatactatgtggcacgttacgcgaggtgctgtgttaatgcacaaaggcaaaagaatagagccatcttgggccgacgttaaaaaggaccttatatcctatggaggtggttggaaactagaaggtgaatggaaggaaggcgaggaagtccaggtcctagcattagagccggggaaaaatccaagagcggttcaaacaaagccaggtctgttcaagacaaacactgggaccattggagcagtctcactcgatttcagccccggaacgtcaggatctccgataatagacaagaaagggaaggtagttggactatacggaaacggagtagtaactcgaagtggggcatatgtaagtgctattgcgcagacagagaaaagcatagaagacaatccggaaattgaggatgacattttcagaaaacggcgactaaccatcatggaccttcatccaggggcaggaaaaaccaaaagatacttaccagccatagtacgagaagctattaaacgtggacttagaacattaatcttagcaccgactcgagttgtagcagctgagatggaggaagcgttacgaggtttgcctatacgataccagaccccggcaattcgagcagaacacactggacgagaaattgtagatctaatgtgccacgccacatttactatgaggttattaagcccagttcgtgtaccaaattataacttaataatcatggacgaagcccatttcactgatccagcttctatagcagctcgtggatacattagtacgagggtagaaatgggagaggcagcgggtattttcatgacagcaactcctcctggaagccgtgatccatttccacaaagtaacgcaccaattatagatgaagaaagagaaattcctgaacgtagttggaatacaggtcatgaatgggtgactgacttcaaaggtaaaacggtttggtttgttccctcaatcaaagctggaaacgacatagcggcttgtttgaggaaaaatggtaagaaagtaatacaactaagtagaaagacttttgattccgaatatgttaagacacgcactaacgattgggacttcgtggtaactacagatatatctgaaatgggggcaaattttaaagcagaacgcgttatagatccccgaaggtgcatgaaacctgtgattctaaccgatggagaagaacgtgttatattagcaggaccaatgcctgtcacacacagcagtgcagcacagcgtcgaggcagaataggacgtaaccccaaaaatgagaacgaccaatatatttacatgggcgagccactcgaaaacgacgaagattgcgcacattggaaggaagccaaaatgttacttgacaatataaatactccagagggtataatcccgtcaatgtttgagcctgagcgtgaaaaggtcgatgctatagacggagaatatagattacgtggtgaagcgagaaaaacgtttgtcgatctaatgcgaaggggagatcttccggtatggcttgcatacaaggtagcagcagaaggtataaactatgccgacagacgatggtgttttgatgggatcaaaaataaccagatattagaagaaaatgtggaagttgagatctggactaaagaaggagaaagaaagaaattaaaacctagatggttggatgctcgaatatactcagatccgctcgcacttaaagaatttaaagagttcgctgccggtagaaagtctttaacgttaaatttaatcactgaaatgggaaggttacccacatttatgacacagaaaactcgagatgcccttgataacctcgctgttctacatacggcagaggccggtggcagagcctacaaccatgctctttcggaactaccagaaaccttagaaacactattattgctaacattacttgccacagtaaccggcggcatattcttgttcctaatgtcaggcagaggtatagggaagatgactttgggaatgtgttgtataatcacagccagtattctattatggtatgctcaaatacaaccacattggatcgctgcaagcataatactggagttctttctaatagtcctacttatacccgagcccgaaaaacaacgaacaccacaagataatcagctaacgtatgtggtaatagcaatattaacggtagtagcagcgaccatggctaacgagatgggcttcctagagaaaaccaagaaagatctaggattgggtagcatcgcaacacaacaaccagaatctaatatcttagatatagatttacgcccagcatcagcatggaccttatatgcagtggccacgacgttcgtaacgcctatgttgcgtcacagtattgaaaattcgagcgtcaacgtgagtttaacggcaattgctaatcaggcaacagtactaatgggattaggaaaggggtggccactctccaaaatggacataggcgttcccttattagcgattggttgttacagccaagtaaaccctataacactaacagcagcactattgctgctggttgctcactatgctattattggaccaggcttgcaagctaaagctacacgcgaggctcagaaaagagccgcagccggaattatgaagaatcctacggtcgacggaataacagtaatagacttagatcccataccgtatgacccaaagtttgaaaaacagttaggtcaggtaatgctacttatattgtgtgtcacacaggtcttaatgatgcgaacgacgtgggcactgtgtgaagcactaaccttggcgactggaccaatatccacattgtgggaaggaaaccctggacgtttctggaatacgacaatagctgttagcatggctaatatattccggggctcatatctagcgggtgcaggattgctgttctcaattatgaaaaatacaacgaataccaggagaggcacaggaaatataggagaaactctaggagaaaagtggaaaagtaggctaaatgcactaggaaaatcggaatttcaaatatacaagaaaagtggcattcaagaggtagatagaactttggcaaaagaaggaataaaacggggagaaactgatcaccatgcagtatctcgaggttctgcaaaactaaggtggtttgtagaacgaaacatggtaacacccgaaggaaaagtagttgacttgggctgcggcagaggtggctggtcctattactgcggaggcttgaaaaacgtccgagaagtaaaaggtttaactaagggaggtccaggacatgaggaaccaatcccaatgtcgacatacggatggaacttagtacgattacagagcggggtagatgtattcttcataccaccggaaaaatgtgacactttattatgtgatatcggagaaagttctccaaatcctacagtagaagcaggacggacactgcgagtattgaatttagtagaaaactggttgaacaacaatacccaattttgtataaaagttctgaatccatatatgccatctgtaattgagaaaatggaggctttgcaaagaaaatacggtggagcattagttcgaaacccactatcaagaaattcaacacatgaaatgtattgggtgtcaaatgcatccggcaatatagtcagctcagtaaatatgatctcacgaatgctaatcaaccgcttcacaatgagacataagaaagcgacctacgaacccgacgttgatttaggatcgggaacacgaaacataggaattgaatcggagatcccaaacttagacatcataggaaaacgcatcgagaaaatcaaacaagaacatgaaacatcgtggcattacgatcaagaccatccatataaaacatgggcatatcatggcagttatgaaacaaaacaaactggtagcgcatcttcaatggttaatggagtagttcggctcttaaccaagccgtgggatgtattgccaacggtgacgcaaatggctatgacggacactactccatttggacaacaacgtgtatttaaagaaaaagtcgacaccagaacacaagagccgaaggaaggaacaaagaagctaatgaagataactgctgagtggctatggaaagaacttggtaagaagaaaacaccacggatgtgtactcgcgaagagtttacacgaaaagtccggtctaacgccgcgctcggtgcgatctttactgatgaaaataaatggaaaagtgccagagaagctgttgaagacagtagattttgggagcttgtggataaagaaagaaatctacacctagaggggaaatgcgaaacttgtgtctacaatatgatgggtaaaagggagaagaaattgggcgagttcggtaaagcgaaaggttcgagagctatctggtacatgtggctgggagctcgattcctagaatttgaagccctgggatttttaaacgaagatcattggtttagtcgagagaactcattatcgggagtagagggtgagggacttcataagctcggttatattcttagggatgtaagcaagaaagaaggaggtgccatgtacgcagatgatactgcgggttgggatacaaggatcacactagaggatctaaagaatgaagaaatggtcactaatcacatgaaaggtgaacataagaaattagcagaagcgatattcaaactcacttatcaaaataaagtagtcagggtccagcgacccaccccgcgtggtacagtcatggacattatcagcaggagggaccaacgagggagtggacaggtcgggacatacggtttaaataccttcactaatatggaagctcaattgattcgccaaatggaaggcgaaggagtgtttaaaaacatacagcatttaactgttaccgaagaagttgctgtacaaaattggctggcacgagttgggagagaacgtttgtcgcggatggcaatttcaggtgacgattgcgtagttaagcctttagatgatagatttgcaaatgccctaactgcgttgaatgacatgggaaagattcgaaaagatattcaacagtgggagccaagcaaaggttggaacgattggacgcaggtccccttctgttctcatcattttcacgagctaatcatgaaagacggacgcgtcctcgtggtgccatgtaggaaccaagacgaattaatcggtagagccaggataagtcagggtgcagggtggagtttacgagaaacggcctgtttgggcaaatcctacgcacaaatgtggagtctaatgtacttccacagaagagatctacgtcttgctgcaaacgccatttgtagtgcagtacccagtcattgggtacctacatctcggacaacttggtcaattcacgcaaaacacgagtggatgaccaccgaggacatgttaactgtatggaatcgcgtatggataagggaaaatccgtggatggaagacaaaacgccggtcgaatcttgggaagaaattccttatctaggaaaacgagaagaccaatggtgcggaagcctaatagggctcacttccagggcaacctgggctaaaaatatacaggctgcaataaatcaagtacgctcactgatagggaatgaagaatatacagactatatgccatcaatgaaaaggttccggcgagaagaagaagaggcgggagtactttggtga

SEQ ID NO: 22757 - RNA, 9876 nt, synthetic construct
  misc_feature 1..9876: note = derived and/or modified CDS sequence (opt6) from DENV-2__EU482679__SS-prME
  source 1..9876: mol_type = other RNA
tcagcagggatgataataatgctaatacctactgtcatggcattccatctaactacgcggaatggtgaaccgcatatgattgttggaatccaagaaaaaggtaaatcactattatttaaaaccgaagatggggtgaatatgtgtacattaatggctatggatttaggagaattgtgcgaagacacgatcacatacaaatgcccacttttaagacaaaatgaaccagaagatattgattgctggtgcaattcaacatctacatgggttacatatggtacatgtaccactacgggggaacaccgtcgtgagaaaagaagcgttgcattagttccacatgtaggtatgggattagaaacacgcactgaaacatggatgtcaagcgaaggtgcatggaaacatgcacaaagaatagaaacttggatactaagacatcccggattcacgataatggccgcaatcttagcctatacaataggaactacacacttccaaagagtcttaatattcatactactaacggcagttgctccaagcatgacgatgagatgcattggaattagtaacagagattttgtagaaggtgtatcaggaggatcgtgggttgatattgttctcgagcacggaagttgcgtgactaccatggccaaaaacaaacccactctggattttgaattgataaaaacagaagcaaaacaaccagcaacactaagaaaatattgtatagaggccaaattgaccaatacaaccacagagtcaagatgtccgacacaaggagaaccttcgttgaaagaagaacaagataaaagatttgtatgcaaacatagtatggtagatagagggtggggtaacggatgtggtctctttggaaaaggaggaatagtaacgtgtgcaatgtttacatgcaagaaaaatatggaaggaaaaattgtacaaccagaaaacttagaatatactattgtcgttacaccgcacagtggtgaagaacatgccgtaggaaacgacactggaaaacacggaaaagaaataaaagtcaccccacaaagcagcataactgaggcagaactcaccggatacggaactgtaactatggagtgttccccaagaaccggtttggactttaatgaaatggttttacttcaaatggaaaacaaagcgtggttagttcatcgacaatggttcttagaccttccattaccctggttacctggagcagacaaacaagaaagtaactggatacaaaaagagacattggtaacgttcaaaaacccacacgccaagaaacaggatgtcgtggtactaggatctcaagagggcgctatgcataccgcgttaactggagcaacagagatacaaatgtcgagcgggaatttgctattcacaggtcatctcaaatgtcgccttcgtatggataaactacagctgaaaggtatgtcatatagtatgtgtacaggcaaatttaaagtagttaaagagatagcggagacacaacatggtactatcgtaatccgagttcaatatgagggtgacgggtcgccatgcaaaattccatttgaaataatggacctcgagaaaagatatgtactcggacgcttaataacagtcaacccaatagtgactgaaaaagatagcccagttaatatcgaagccgaaccaccattcggtgatagctatataattattggtgtagaacccggccaactgaaactcaattggttcaagaaaggttcgtccataggacaaatgttcgaaacaacaatgcgtggtgcaaaacgcatggccatacttggagacacggcatgggattttggatctcttggaggtgtgttcacaagtataggtaaggctttacaccaggtctttggcgcaatttatggtgcagcattctcaggcgtttcgtggaccatgaaaatactcataggagtgattatcacttggattggaatgaatagccgtagcactagcctttcagtcagtctagttctagtgggcatcgtcaccctttatttaggtgttatggtgcaagcggatagtggatgtgttgtttcttggaaaaacaaagaactaaaatgtggatcagggatcttcattacagacaatgtacatacttggacggaacaatacaaattccaaccagagtcacctagtaaattagccagtgccatacaaaaagcccaagaagaaggtatatgtggaataagatctgtaactagactggaaaatctcatgtggaaacagattactccagaattaaatcatattctcgctgaaaacgaggtcaagttaacaattatgaccggagacataaaaggaataatgcaagcgggtaagaggagcttgcgaccgcaaccgacagaactaaagtacagctggaaaacgtggggcaaagcaaagatgttgtcgactgaatcccataatcaaacatttttaatagatggcccagaaacggcagaatgcccaaataccaacagagcttggaactcattggaagtagaagactacggttttggcgtctttaccactaacatatggctaaaacttaaagagaaacaagatgccttttgtgatagcaagctcatgagcgcagcaataaaagataacagagcagtgcatgcggacatgggatattggatagagtcagctctaaacgatacttggaaaatagaaaaagcatcctttatcgaggttaaaaactgccactggccaaaatctcatacactatggtcaaacggtgtcttagaatctgagatgataattcctaaaaatctcgctggcccagtatcacaacacaactatcgacctggctatcacacccaaatagccggaccttggcatttaggaaaattagaaatggattttgatttctgtgatggaaccacggtaatagtgactgaagattgtggaaataggggaccctcattacgtacaacgaccgcctctggtaaactaatcacagagtggtgttgccgaagctgtacccttccgcccctacgatatagaggtgaagacggttgttggtacggaatggaaattaggccattaaaagaaaaagaagaaaacctagttaatagcctggtaacggcgggccatggccaagtagacaatttttctctaggagtattgggaatggcattgttcttagaggagatgctcagaacgcgcgtcggcactaagcacgccattctattagttgcagtctcatttgtaactttgataacaggaaacatgagttttaaagacttaggtagagtggtggttatggtaggagcaactatggcagacgatatcggaatgggagtaacatatttagcattgttagccgcttttaaagtgagaccgacatttgccgccgggctattattaaggaaactgaccagtaaagaattaatgatgacgacaataggtatcgtcctcttatctcaaagcacaatacctgaaactgttctagaattgacagatgcactagcacttggtatgatggtcctcaaaatagttaggaacatggaaaagtatcaactagctgttacaatcatggcaatattatgtgtaccgaacgctgtcattttacaaaacgcttggaaagtttcatgcacaatattggcagtagtatcggtttctcctttactgttaacctcaagccagcaaaagacagactggataccattagccttgacaattaagggtcttaatccaacagctatattcttgacaacgttatcaaggacaaacaagaaaagatcatggccactgaatgaagccattatggcggtagggatggtaagtatactggccagctctcttttgaaaaatgacatacccatgactgggccgctagtagcagggggtttattgactgtttgttatgtcctcactgggagatcggcggatttagagctcgaaagagcaactgatgttaaatgggaagatcaagcagaaattagtggatcaagccccattctatcaataacgatttccgaagatggatctatgtcaatcaaaaacgaggaagaggaacaaaccttaacaattctcataaggacgggtttactcgttatttctgggttatttcctattagtatccctataactgctgctgcatggtatttatgggaggttaagaagcaacgggcaggcgttctatgggacgtcccatcacctccaccaatgggtaaagcagagctagaagacggtgcttacagaataaaacagaagggcatattaggatattctcaaataggagccggtgtttataaagaagggacgttccacacaatgtggcacgtaacacgaggggccgtgttaatgcataaaggtaagagaatcgaaccttcttgggcggatgtcaagaaagacctaatttcttacggagggggatggaagttagaaggtgaatggaaagaaggagaggaagttcaggtactagcacttgaaccaggcaaaaatccacgggccgtacagacaaagccggggctattcaaaaccaatacgggaaccataggagcagtgagtctagattttagccctggaacaagtggaagtccaataattgataagaaaggcaaagttgtcggactgtacggcaatggagtggtcacacgaagcggtgcgtatgtatcggcgatcgcgcaaacggaaaagagcatagaggacaatcccgaaattgaagacgatatctttagaaaaagacgtctgactattatggacctccacccaggggccggaaaaactaaaaggtaccttcctgcaatagtacgagaagcaattaaaaggggattgaggacattaatattagctcctactagagtagtagcggcagagatggaagaagcattaagagggctaccaattagataccaaactccggcaattagggcggaacacacaggaagagagatagtggatctaatgtgtcatgctactttcacaatgcgcttactctcgcccataagagtacctaattacaatcttataataatggacgaagctcattttacagatcctgcaagtatcgcagcgagaggctatataagtactcgagttgaaatgggcgaggctgcgggaatcttcatgacagcaactccgccaggttctcgagaccctttcccgcaaagcaatgccccaatcatagatgaagaacgggagattcctgagagaagttggaacagtggtcacgaatgggtaactgattttaagggaaagactgtttggtttgtaccatctattaaagctggaaacgatatcgctgcgtgcttaaggaaaaacggcaagaaagttatacaattgtccagaaagacattcgactctgagtatgtaaaaacaagaaccaacgattgggattttgttgttacaacagatatatccgaaatgggagcaaattttaaagcagaacgagtcatagatccccgtagatgtatgaaaccggtgatactgacagacggtgaagagagagtgatattagccgggccaatgcctgtgacacactcttccgcggctcaacgaagaggaagaatcggaagaaacccgaaaaacgaaaacgaccaatacatttatatgggcgaaccactggaaaatgacgaggattgtgcccattggaaagaggcgaaaatgcttctagataatattaatactcccgaaggcattattccaagcatgttcgaaccggaacgtgaaaaagtagacgccattgatggggaatatagattaaggggtgaagcgagaaaaacttttgtagatctaatgcgaagaggagatctacccgtgtggctcgcatacaaggttgctgcagaaggaatcaactacgcagatcgacgatggtgcttcgacggaatcaaaaacaatcagatactagaagagaacgttgaggtggaaatttggactaaagaaggggaaagaaagaaactaaaaccgagatggctagacgcaagaatttactctgaccccctagctctaaaagaatttaaagagttcgcagcaggaagaaaatctttgacacttaatttgattactgaaatgggtcgtttgcctaccttcatgacgcagaaaacccgagacgcactagacaatttagctgttctacacaccgcagaggcgggaggcagagcatataaccatgctttaagtgagctcccagaaacactagaaacgttattgctgctaacacttttagccactgtaaccggtggcatttttctttttctgatgtctggacgagggattggcaaaatgacactaggaatgtgctgtattataacagcttccatactgctatggtacgctcagattcaaccgcattggatagctgcatcaattatccttgagttctttctaatagtcttactaataccagagccggagaaacaaagaacaccgcaagataaccaactaacgtatgtagttatagcgatattaacggtcgttgcggcaactatggcaaacgaaatgggatttttagagaagaccaagaaagatctggggcttggaagtattgcgacccaacaacctgaaagtaatatacttgacatcgacttaaggccagccagtgcttggacactatatgccgtagccacgacattcgttaccccaatgctaaggcactcaatagagaacagttctgtcaacgtaagtttaaccgcgattgcaaaccaagccacagtgttaatgggattaggaaaaggatggcctctatccaaaatggatataggcgtcccattgttggcgatcggatgctattcgcaagtcaatccaataacgttgacagcagcactcttacttttagttgcccattatgcgataataggacctgggttacaggccaaggcaacaagagaggctcagaaaagagcagccgctggaatcatgaaaaatcctacggtagacggaattaccgtaatcgacttagacccaattccttatgaccccaaatttgaaaaacagctgggacaagtaatgttgttaatattatgtgtgacgcaagtattaatgatgagaacaacgtgggcattatgcgaagccctaacactggccactggacctatcagcacattatgggagggaaatccaggaaggttttggaatacaacaattgccgtatcaatggctaacatttttagaggcagttacttggccggtgcaggacttttgttcagcataatgaaaaacactacaaatactcggcgtggtacgggcaacatgggtgaaacactgggcgaaaaatggaagagtaggctaaatgcactaggaaaaagtgaatttcagatctacaagaaatcaggcatacaagaagtagaccgcactttagcgaaggaagggattaaacgaggagaaaccgaccaccatgctgtaagtagagggtccgcaaaattacgttggtttgtcgaaaggaatatggtaacacctgaaggaaaagttgtagatctaggttgtggtcgtggcggatggtcgtattactgcgggggcctcaaaaatgttagagaggtaaaagggttaacaaagggtggacctggacatgaagaacctattccgatgtcgacatacggatggaatttagtgaggttacaaagcggggtcgatgtatttttcataccgccagaaaaatgtgataccctcctttgcgatataggcgaatcaagcccaaatcctacagtggaagctggaagaactttgagagttttgaatcttgtggagaattggttgaacaataacacacaattttgtattaaagtgttgaatccatacatgcctagcgtgatagaaaagatggaagcactgcaacgcaagtatgggggagcattagtcagaaatcctctaagtcgaaactcaacacatgaaatgtactgggtatccaatgctagcgggaatattgtctcttcagtaaatatgataagtcgtatgttaatcaaccgatttactatgcgtcataagaaagctacatacgaaccagatgtagatcttggatcaggtacacgtaatatcggcatagagagcgaaataccaaacttggatataatcgggaagcgtatagaaaagattaaacaagaacacgaaacttcttggcattatgatcaggatcatccatacaagacatgggcatatcacggatcatatgaaactaaacaaactggctcagccagcagtatggttaatggagtagttcggcttttaacaaaaccttgggatgttttacccacagtcacccaaatggccatgacagacaccacacctttcggtcaacaaagagttttcaaagaaaaagtggatacaagaacccaagaaccgaaggaaggaactaagaaattaatgaagataaccgcggaatggctctggaaagagttagggaagaagaaaacaccccgcatgggcactagggaggaatttacaaggaaagttcgatccaatgcagctttaggagctatttttacagacgaaaacaaatggaaaagcgcaagagaagcggttgaagattcaagattttgggagttagtagataaagaacgaaatctacacttggaagggaaatgcgaaacatgtgtatataacatgatgggcaaacgcgaaaagaaattgggggaatttgggaaggctaaagggagtagggcaatttggtacatgtggctaggggctagattcttagagttcgaggcgctcggattcttaaatgaagaccattggttttcaagggaaaactctctatctggggtggaaggagagggtcttcacaagttgggctacatcctacgagacgtatcgaagaaagaaggaggtgctatgtatgcagatgatacggcaggctgggacacccgaattacattagaggatctgaaaaacgaggagatggtaacaaaccacatggaaggagaacataagaaactagcggaagcaatattcaagctgacctatcagaataaggtggtacgagtacaaagaccaactccaaggggaactgtaatggatataatttctaggcgtgaccagcgaggaagtggacaagtcggaacttacgggctaaacacttttactaatatggaagcgcagctaatccgacaaatggaaggtgaaggcgtatttaaaaatatacagcatctgaccgtgaccgaggaagtggcagttcaaaattggctggctagggttggtcgagagaggttgtctaggatggcaatttcaggagatgattgcgtagttaaaccactagatgatcgatttgcgaatgctttaactgcacttaacgacatgggaaaaataagaaaagatatccaacaatgggaaccatcaaaaggctggaacgattggacacaagtcccattttgttctcaccattttcacgaattgataatgaaagatgggcgggtgctagtagtaccatgccgcaaccaagacgaattaatcggacgagcgagaatttcgcaaggtgcaggctggagtctaagagaaactgcatgcttaggaaagtcatatgcccaaatgtggagtttaatgtacttccatcggcgggatctcagattagcagccaatgcaatctgttctgcagttccatcccattgggtcccaacaagtcgaacaacatggagtattcatgcaaagcatgaatggatgactacagaagatatgctaacggtatggaatcgagtatggattcgagaaaacccatggatggaagataagactccagtagaatcttgggaggaaataccgtatttgggcaagcgtgaagatcaatggtgtggttctttaattggattgacaagtagagcaacctgggccaaaaacatacaagcagcaataaaccaagtaagatctctgatcggtaacgaggaatatactgattatatgcctagtatgaaacgatttcgtagagaagaagaggaagccggggtattatggtaa

SEQ ID NO: 22758 - RNA, 9876 nt, synthetic construct
  misc_feature 1..9876: note = derived and/or modified CDS sequence (opt6) from DENV-2__EU482774__SS-prME
  source 1..9876: mol_type = other RNA
agcgcagggatgataataatgttgatcccaacggtaatggctttccaccttacaacaagaaacggtgaaccacatatgatcgtagggattcaagaaaaaggaaaaagtcttctatttaaaacagaagacggggttaatatgtgtactctaatggcgatggacttaggggaactttgcgaagatactatcacttacaaatgtcctcttcttaggcaaaatgaaccagaagatatagactgttggtgtaattcaactagcacatgggtaacatatgggacgtgcactactaccggagaacacagacgtgagaaaaggtcggtggcactggtaccacacgtgggtatggggctagaaacacgaacggaaacctggatgtcatccgaaggagcttggaaacatgctcaaagaattgaaacctggatacttcgccatcccggatttacgataatggcagcaatattggcttacaccataggaaccactcatttccaaagggtattaatcttcatattattaaccgcagttgcaccaagtatgacaatgcgctgcattggaattagtaaccgcgatttcgtagaaggcgtttcaggtggtagctgggtagatattgtcctggaacatggcagttgcgtaacgactatggctaaaaataaaccaacgttagactttgaattaattaaaacggaggccaaacaaccggctactctaagaaaatactgtatcgaagcaaaattgacaaataccaccacggaatcaaggtgtccaacgcagggggagccatctttaaaagaggagcaagataaaagatttgtctgtaaacactcaatggtagacagaggttggggtaatggatgcggattattcgggaaaggaggtatagtaacgtgtgccatgtttacatgcaagaaaaatatggaaggaaaaatagtacaaccagaaaatcttgaatacactatagtagtcacgccacactccggtgaggagcatgcggtaggtaatgacaccggtaaacacggaaaggagataaaggttactccacaatcgagcataacagaagcagaattgacaggatatggtacagttaccatggagtgtagtccaagaacaggactagattttaatgaaatggtgttattgcaaatggaaaataaggcttggctagttcatcgacaatggttcttagacctaccactaccctggttacccggtgcagataaacaagaatcaaactggatacagaaagaaacgctagtgacatttaaaaacccgcatgccaagaaacaagacgtcgtagttctaggcagtcaagaaggagcgatgcatactgcactaacaggagcaactgagatacaaatgtcgagcggcaatctactgtttacagggcatctaaaatgcagactaaggatggataagctccaactgaaaggtatgtcatatagtatgtgtacaggtaaatttaaagtagtaaaagaaatagctgaaacacagcatggtactattgtaatacgtgtccaatacgaaggagacggctcaccatgtaagatcccatttgaaatcatggatttagagaaaaggtatgtacttgggcgtttgataacagtcaacccgattgtcacggagaaagattcccctgttaatattgaggcagaaccaccattcggagatagttatattatcattggagtagaaccaggacaacttaaactaaactggtttaagaaagggagttcaattggtcagatgttcgaaacgacaatgagaggagcgaaaaggatggcgatattaggcgatacggcatgggatttcggctctctaggaggggtattcacaagcatcggaaaagcattacaccaggtgtttggtgccatttacggagccgcatttagcggtgtttcctggaccatgaaaatttttattggcgtgataattacatggataggtatgaatagtcgtagtacaagtctctcagtatcactggtcttagtagggatcgttactttgtacttaggagtaatggtacaggcagactccgggtgtgtagtctcttggaaaaacaaggaactgaaatgcgggtcaggcatatttataacagataatgtgcatacatggacagaacagtacaagttccaaccagagtcgccatctaagttagcctccgcgatacaaaaagcccaagaagagggaatatgcggaataaggtccgttacacggttagaaaacctaatgtggaagcaaataacacctgagctgaaccatattttagcagaaaacgaagtcaaactcacgataatgacaggggatataaaagggattatgcaggccggaaagagatcattacgtccgcaaccaaccgaattaaaatattcctggaaaacatgggggaaagcaaaaatgttaagtacagaatcccacaaccagacctttttaatagacgggccagagaccgccgaatgtccaaatactaatcgagcatggaactctctcgaagtcgaagattatggctttggggtatttactacgaatatatggctgaaacttaaggaaaaacaagatgcattttgcgattccaagttgatgagtgctgctataaaagataacagggcggtacatgctgacatgggatattggatagaaagtgccctaaacgacacatggaaaatagaaaaagccagctttattgaagttaaaaactgtcactggccaaaaagccataccctgtggtcaaatggggtactagaaagtgagatgatcattcctaaaaatctagcaggaccagtatcacaacataattatagacctggttaccatacgcagattgccggtccttggcaccttgggaaactggaaatggactttgatttctgcgatggcactacagtaatagtaacggaggactgtggaaacaggggcccatctctaagaacgaccacagcctcaggcaaattaataactgaatggtgctgtcgatcctgcaccctgccgccactgcggtatagaggagaagacggttgttggtatggaatggaaataaggcccttaaaagaaaaagaggaaaacttggtaaattcccttgtcacagccggacacggtcaagttgataatttcagcctcggagtcctggggatggccctatttttggaggaaatgcttaggactcgagtagggacaaaacacgcaatactattagtagctgtaagttttgttacactaatcacaggcaacatgtcatttaaggatctcggacgtgtagtagttatggtaggggcaacaatggcagatgacattggaatgggagtgacctacttagcattattagccgctttcaaagtgcgacctacgtttgctgctggactgctacttcgaaaactaaccagtaaggaattaatgatgacaacgattgggattgtgctactgtcccagtctactatacccgaaacagttttagagttaaccgacgccttggcgttgggtatgatggtattaaaaatagttcgaaacatggagaaataccaacttgcggttacaatcatggcgattctttgcgtgcctaatgcagtcgtattgcagaacgcctggaaggtatcttgtacaattctcgcggtggtcagcgtaagtcctctgctcctaacttcatcacagcagaaaacggactggatacctcttgctttaacaatcaagggactgaaccccactgcaatatttctaaccacactgagcagaacaaataagaaacgttcttggccactaaatgaagcgataatggcagtaggaatggtatccatactcgctagctcattactaaagaacgatatcccgatgacaggaccgctcgtcgcaggcggtttattaacggtttgttatgtacttactgggcggtctgctgaccttgagttagagcgcgctacagatgttaaatgggaagatcaagctgaaatatctggcagttcacctatacttagcatcactatcagtgaggatggatctatgtccatcaaaaacgaggaagaagaacaaaccttaactatactcataagaaccggccttctagtaatctcaggtctcttccctatctcaatcccgattactgcagcggcatggtacctatgggaagtaaagaaacaaagagcaggagtcttatgggatgttccgagtccccctccgatgggaaaagccgaattagaagatggagcttatagaattaaacaaaaaggtattttaggttattcacaaatcggtgctggagtctacaaagaaggtacttttcatacgatgtggcatgtgacgcggggagccgtgctgatgcataagggtaaaagaattgaaccatcatgggcggacgtcaagaaagatctaatttcgtatggaggcggctggaaattagaaggtgaatggaaagagggtgaagaagtacaagtacttgcactagaaccaggtaaaaacccacgggctgtacaaacaaaaccaggcttatttaaaacaaatacagggacgattggcgcggtttcattagatttctcgccaggcaccagcggctcgccaataatagacaagaaaggtaaagtagtcggcttatatggcaatggagtggtcacccggtcgggcgcctatgtaagtgctatagcccaaaccgaaaagtcaatagaggataacccagaaattgaagacgacatatttcgaaaacgcagattaactatcatggatcttcacccaggagcggggaaaacgaaacgttatttgcccgccatcgttagagaggctattaaacgaggcctaagaactctaatcctagcacccactcgtgtagtggcagctgaaatggaggaagcattaagaggtctaccaattcggtatcagacgcctgctataaaagcagaacataccggcagagaaatcgtagatcttatgtgccatgcaactttcacaatgcgcctcttatcaccagtgcgagtccctaattataacttaatcataatggacgaagcacacttcacggatccagcttccatagcagcacgcggatatatatcaacacgagtagaaatgggtgaagcagcaggaatctttatgactgctacaccgccaggttcaagagatccttttccacaatcaaatgcacctatcattgacgaagaaagggaaatacctgagagatcttggaactctggacacgaatgggtaactgactttaaaggaaaaactgtatggtttgtacccagcataaaagcaggaaatgacatagcagcctgcctacgaaagaacggcaagaaagtcatacagctctctcggaaaacatttgatagcgaatacgtcaaaaccaggacaaatgactgggatttcgtggttactactgatattagtgaaatgggtgcaaattttaaagcagaacgagtgatcgacccaagaagatgcatgaaaccagttatattaacagatggagaggaaagagtcatcctcgctggccccatgcccgttacccactccagtgcagcgcaaagaagaggacgtattggacgtaatccgaagaatgaaaatgatcaatatatctatatgggagaaccacttgagaacgatgaagattgtgcgcattggaaagaagcgaaaatgcttttagacaatatcaatacaccagaaggcatcataccttcaatgtttgaaccagaacgggaaaaagttgatgccattgatggagaatatcgactaagaggagaagcacgaaagacatttgtggacctaatgagaagaggggatttaccagtatggctagcatataaagttgcagcagaaggtataaattacgctgatagacgttggtgcttcgacggcatcaaaaataaccaaattttggaggagaatgttgaggttgagatttggactaaggaaggtgaacgcaaaaagctaaaacctcgatggttagacgctagaatctattctgatcccctcgcattaaaagaatttaaagaatttgcggccggacgtaaatcactaaccctcaatctgataaccgagatgggtcggctaccaacttttatgacccagaaaactcgggatgccttagataatttagctgtattacatacagctgaagccggagggcgagcctacaatcatgcactttcagaacttcccgaaacattagaaaccctattattacttacgctcttagccacagttacagggggaatatttttattcttgatgtctggacgtggcattggtaaaatgacactgggaatgtgttgtatcattactgcatcgatccttctatggtatgcacagattcaacctcactggattgcagcatccataatcttagagttctttctgatcgtccttctaattccggagcccgaaaagcagcgaacacctcaggataatcagctaacatatgtggtaatcgcaattttaacggtagtggcagcaacaatggcaaacgaaatgggttttctcgagaaaactaagaaagatctaggcttagggagcatagcaacgcagcaaccagaaagtaatatactcgatatcgacttgagacctgcttcagcatggaccctatatgctgtggcaacaacttttgtgacaccaatgctcaggcatagtattgaaaacagcagtgtaaacgtgtctttaacagctattgcgaaccaagctacagttcttatggggctaggaaaagggtggcccttatccaaaatggacattggtgtaccacttctagccataggatgttatagccaagtaaatccaattacgcttacagcagcactcctccttctggtagcacattatgccattattggtccaggtttacaggctaaagctacacgggaggcacaaaaacgagcagcagcggggattatgaagaatccaaccgtagatggaatcacagtaatagatttagatccgataccttatgaccccaaatttgagaaacaattgggacaagtaatgttattaatcttatgcgtcactcaagtcttaatgatgagaacgacttgggccctgtgcgaagcgctaaccctagcgacaggcccgatatcaacattatgggaaggtaatccaggaaggttttggaacaccacaattgcggtatctatggcaaatatatttagaggatcctacttagctggcgcaggactactattcagtataatgaagaacacaacaaatacaaggaggggaacggggaatataggggaaactttgggagaaaaatggaagtccagattaaacgcgttaggtaaaagtgaatttcaaatatataagaaatccggcatacaggaggttgataggacgcttgccaaagaaggaataaaaagaggagaaacagaccatcatgctgtgtcaagaggctcagcaaaattacgttggttcgttgaacgtaatatggttactcctgaaggaaaagttgtagaccttggctgcggccgaggtggatggagttactactgtggtggtctcaaaaatgtaagggaggtcaaaggacttacaaaaggagggcccggtcatgaggagcctattcccatgtcaacctatggttggaacttggttagattacaaagtggtgtagatgtattctttattcctccagaaaaatgcgatacattactatgcgatattggagaatccagcccaaacccaactgttgaagcgggaaggacattacgagtactaaatctagttgaaaattggcttaataacaacacccaattctgtattaaagtattgaatccatatatgccgagtgttatagagaaaatggaagcacttcaaaggaaatatgggggagcattagtccggaaccctttgtctagaaattcaacgcatgaaatgtattgggtatcaaatgcatctggaaatatcgtaagttcagtaaacatgatctcaaggatgttaataaaccgtttcacgatgagacacaagaaagcaacctatgaaccggatgtcgacctggggagtggaacacgaaatatcggaatagagagcgaaataccaaacctagacataataggaaaacgtattgagaagataaaacaggaacatgagacatcatggcattacgatcaagatcatccatataaaacatgggcttatcacggttcctatgagacaaagcagacggggtcagcctcttcgatggtcaacggcgtggtgcgactacttactaaaccatgggacgtgctcccaacagttacacaaatggcaatgactgacacgactccgtttggacaacaaagagtgtttaaagagaaagttgataccagaacccaagaacccaaagaagggaccaagaaactaatgaaaataaccgcgaagtggctatggaaagaactggggaaaaagaaaacgccaagaatgtgtacccgagaagagtttacaagaaaagtgcgttctaatgccgcattaggagcgatctttacagatgagaataaatggaaaagcgctcgtgaagcggtagaagactctagattttgggaacttgttgataaagaacgtaacttacatttagaaggcaaatgcgaaacatgcgtctataacatgatgggaaagagagagaagaaattaggagaatttggtaaagcgaagggtagtcgagcaatatggtatatgtggttaggtgcacgatttctcgagttcgaggcattgggtttcctaaacgaagatcactggtttagccgggaaaattcattatctggagtagaaggtgaaggactccacaaattaggatatatattgcgggacgtcagcaagaaagaaggaggcgcgatgtacgcggatgacactgctggatgggacactcgcataacattagaagatcttaagaatgaagagatggtaaccaatcacatggaaggagaacacaaaaagttagcggaggcgatttttaaattgacttaccaaaacaaggtggtacgagttcagcggccaactccaaggggtacggttatggatattattagccgacgcgaccaaagaggttccgggcaagtaggcacttatggcctaaatactttcaccaacatggaggcacaattaattagacaaatggaaggcgagggcgtttttaagaacatacaacatttaaccgttaccgaagaagtagcagttcaaaattggttagcaagagtaggacgagagagattgagtcgaatggccatctctggtgatgactgtgtcgttaaaccattagacgatcgtttcgcaaatgcgttgacagctttgaatgatatgggcaaaatacgaaaagacatccaacaatgggaaccgtcgaagggctggaatgactggactcaagtccctttttgttcacaccacttccacgaactcataatgaaagatggacgagttttagtagtcccgtgtcgaaatcaagatgaattaattgggcgagctcgaataagccaaggtgcaggatggtcactacgagaaaccgcctgtttaggtaagtcatatgcacagatgtggtcacttatgtacttccatagacgcgatttaagattagccgctaatgcaatctgcagcgccgtaccgtcacattgggtgcctacaagcagaactacttggtcaatacatgcaaaacacgagtggatgacaacggaggatatgttgactgtttggaatcgtgtttggatacgagaaaatccttggatggaagacaagacaccagtcgaatcgtgggaggaaattccatatctaggcaaaagagaagatcaatggtgcgggagtttgatcggccttactagcagagcaacttgggctaagaatatccaagcggcaataaatcaagtacgatcgttaataggtaatgaggaatacacagattatatgccgagcatgaagaggttcaggcgagaagaagaagaggcgggtgtcctatggtaa

SEQ ID NO: 22759 - RNA, 9876 nt, synthetic construct
  misc_feature 1..9876: note = derived and/or modified CDS sequence (opt6) from DENV-2__EU482775__SS-prME
  source 1..9876: mol_type = other RNA
tctgcgggtatgataatcatgctaataccaacagtcatggcatttcacctaacaacaaggaatggggaaccacatatgatcgttggaatacaagaaaaaggaaaatcactattatttaaaacagaagacggagtaaatatgtgtactctgatggcgatggacttaggagaattatgtgaagacacaataacttataaatgcccactactaagacaaaatgaaccggaagacatagattgctggtgcaattctacttcaacatgggtaacatatggaacctgtacaacaaccggggaacatagaagggaaaaacgatcagtcgcattagtgcctcacgttggtatgggattggaaactcgaacggaaacatggatgagttccgaaggtgcatggaaacacgcgcaacgaatcgaaacctggattctaagacatccaggctttacgataatggctgcgattttagcatataccataggaacaactcattttcaaagagtacttatctttatacttttaactgcagtagcaccttcgatgacgatgcggtgtatcgggatatcaaatagggacttcgtggaaggagtcagtggagggagctgggtagacattgtccttgaacacggtagttgtgttacaacgatggctaaaaataaaccaacattagactttgaattaataaaaactgaagcgaaacaaccagcaactctccgaaaatactgcatagaagcaaaactgaccaatactaccacagaaagccggtgtccaacgcaaggtgaaccatcactcaaagaagaacaagataaaaggtttgtttgtaaacactcaatggttgatcggggatgggggaatggttgcggactatttggtaaaggaggaatagttacctgtgctatgttcacatgtaagaaaaatatggaaggcaaaatagttcaacctgaaaatttagaatatacaattgtggtcactccccactctggcgaagaacatgccgtaggtaatgacaccggcaaacacgggaaagaaattaaagttaccccacaatcgagcataactgaagctgaactgacgggatacggaactgtaactatggaatgctctcctagaactggcttggatttcaatgaaatggtcttacttcaaatggaaaacaaggcttggttggttcacagacaatggttcctagacctccctctcccgtggctccctggagcggacaaacaagaatctaattggattcaaaaagaaactcttgttacttttaaaaatccgcatgccaagaaacaagatgttgtagtattaggttctcaagaaggcgccatgcacacggctcttactggtgctactgaaattcaaatgagtagtggtaatctactctttacaggtcatcttaaatgtcgattaaggatggataaattacagttaaaaggcatgtcatatagcatgtgtacgggtaaatttaaagtagtaaaagaaatagccgaaactcaacatggtacaatagtcattagggtgcaatatgaaggagacgggtccccgtgtaaaattccattcgaaataatggacttagagaaaagatacgtattgggtcgattgataacagtaaatcccattgtaacagaaaaagatagtccagtgaacatagaagcagaacctccattcggagacagctatattattataggagtcgaacctggtcagttaaagctaaactggtttaagaaaggaagttctattgggcaaatgtttgaaacaacaatgcgaggtgcaaagagaatggcaattttaggggatacggcttgggactttgggtcactaggaggagtttttacgagtataggaaaagcacttcaccaagtctttggagctatatatggggccgcattcagcggggtgtcctggacaatgaagatactgatcggcgtaataataacatggattgggatgaactcacgttcaacaagcctctcagtatcattggtgctcgtcggcatcgttacattatatctaggagtgatggttcaggcggattcaggttgtgtcgtaagttggaagaataaagagctgaaatgtggatcgggtatcttcattacagacaatgtacatacatggacagagcaatacaaatttcaaccagaatctccaagtaagctggctagcgccatccaaaaagcacaagaagagggaatctgtggtatccggtcggtaacaagattagagaatttaatgtggaaacaaatcactccggagctgaaccacattttagccgaaaacgaagtaaaactcacgataatgacgggcgatattagaggaatcatgcaagcaggcaaaagatccttacgccctcagccaaccgaactaaagtatagttggaaaacttggggtaaagcgaaaatgttatctacagaaagctataaccagacctttctaattgatggaccagagacagctgagtgtccaaatacaaatagagcatggaacagcctggaggtagaagattatggttttggagtattcacaacgaatatatggttgaaattaaaagagaagcaggacgctttttgcgatagtaaattaatgtccgcagcaataaaagataacagagcagtacacgctgacatgggctactggatagaatcagctcttaacgatacctggaaaatagaaaaggcttcatttatagaggtaaagaattgtcactggccgaaaagtcatacactatggtctaatggagtcctagagtcagagatgataattccaaagaatttggccggtccggtttcacaacacaactacagacctggatatcacactcaaatagcaggcccctggcatctgggcaaactcgagatggactttgacttttgtgatggtacgacagtaatagtcaccgaggactgcggcaaccgcggaccttcattaagaacgacgacagcatcaggaaaactaataacagaatggtgttgtcggagttgcacgttaccaccactgcggtatcgaggagaagatggatgttggtacgggatggaaatacgacctttaaaagaaaaagaagagaatttggtaaatagcttagtgaccgctggacatggacaagttgataacttctcattgggtgtattggggatggcgctatttctggaggagatgctgcgcacaagggtaggaacgaaacatgcaatattattagttgcggtatcatttgtcacgttgatcacaggaaacatgagctttaaagatttaggacgcgtagtcgttatggtcggtgccacaatggctgatgacatagggatgggagttacttacctagcgctccttgctgcattcaaggttcggcctacgttcgcggctggattactgcttcgaaaactaacatcaaaggagttaatgatgacaacaataggtattgtcttgttgtctcagtctacaatccctgaaacagttttagaactaactgatgcattggcacttggcatgatggtgctaaaaatcgtgagaaatatggaaaaataccaactagcagtaactataatggcaattctatgtgttccaaatgcagtaattcttcagaatgcgtggaaagtttcatgtaccatcttagccgtagtctcggtcagtcctctactcctaacaagcagccaacagaaaacggattggattcccttggcattaaccattaaaggactcaaccctactgcaatattcctaacgacactttcgcgcactaataagaaaagaagctggcctctaaatgaagcaataatggctgtaggaatggtcagcattctagcgtcttccttattaaagaatgacatacccatgacaggtccacttgtggcaggaggcctcttaactgtttgttatgtcttaactgggcgtagtgctgacctggagctagaaagagccaccgatgttaaatgggaagaccaggcagaaatcagtggaagcagtcccattctctccattactatatcagaagacggttcaatgagtattaaaaacgaagaagaagaacagacattaacaatcttaatacgaactggactattagtcatcagtggtctattccccataagcatccccattactgcggctgcatggtatctgtgggaagtgaagaagcaaagagcaggcgtactatgggatgtcccatcgcctccacccatgggtaaagcagagctagaagatggagcttacagaataaaacaaaaaggaatcctaggatacagccaaataggggctggtgtctataaagaaggaacattccatactatgtggcatgtgacacggggagcggttctgatgcataaaggcaagaggatagaaccaagttgggccgatgtacgaaaggacctaatatcctacggagggggatggaaactcgaaggagagtggaaagagggcgaagaagtgcaagttttagcgttggagcctgggaagaatcctagagcagttcaaaccaaacctggcctttttaaaactaacacagggacaattggagcggtcagtttagattttagcccaggaacttctggatcacctataatagataaaaagggtaaagttgtaggtttgtacggcaacggagtagtgactaggagcggggcgtacgtaagtgcgatagcacagactgaaaagtccatagaagataatccagaaatagaagacgatatattcagaaagagaagattgacaattatggatttacatccaggcgctggtaaaacgaaaagatatttgccagcaatagtcagagaagctataaagcgcggtcttagaactctaatattggctcccactagggtagtggcagcggaaatggaggaggctttgaggggtctaccaatacgttatcaaacccctgctataagagcggaacacactggtcgagagatagtagatctaatgtgccacgcgacgttcactatgcgactgctctcgcctgtacgagttcccaattataatctaataatcatggatgaggcgcatttcactgatcctgcctcaattgcagcaaggggctacatttcgacgagggtagaaatgggagaggccgccggaatatttatgaccgctaccccgccaggtagcagagacccatttccgcagtccaacgcacctattattgacgaagagagggaaattccagagagaagttggaactccgggcacgaatgggtaacagatttcaagggcaagacagtttggtttgtacctagtataaaggccggcaatgacatcgctgcgtgtctccgcaaaaatgggaagaaagtaatacagttatcgagaaaaacatttgattccgagtatgttaaaacacgtaccaatgattgggacttcgttgtaaccacagacataagtgaaatgggagccaacttcaaggctgaacgagtaatagacccaaggagatgtatgaaaccagtgatcttaactgatggagaggaacgagtcattctcgcaggtcctatgccagtaacacacagtagcgccgcacaaagaagaggacgtataggaagaaatcctaaaaatgaaaatgaccaatatatatacatgggagaaccattagaaaacgatgaagattgtgcacattggaaagaagctaaaatgctgcttgacaatataaatacacctgaaggtataatcccaagtatgtttgaaccagagagagaaaaggtagatgctattgacggagagtatcgcttacgtggagaagctaggaaaacatttgtagaccttatgcgacgtggggatttacctgtatggttagcctacaaagttgcggctgaaggaataaattacgccgaccgccggtggtgctttgacggtatcaagaataatcaaattctagaagaaaatgtcgaggtcgaaatatggactaaggaaggagagcgcaagaaacttaaaccgaggtggctcgatgctcggatctatagtgacccgctagcgcttaaagaatttaaagaatttgctgctggacggaaatcccttactcttaatttgataacagaaatgggaagactgcctactttcatgacacagaaaactagggatgccctagacaatttagctgttctccatactgcagaggccggtggtcgagcatataatcacgctctatcagagcttccagaaacgctagaaacactacttctactaactcttctagctactgtaacgggtggtatttttctcttcctaatgagtggcaggggtattggaaaaatgacattaggaatgtgctgtataattactgcatcaatattattgtggtacgctcaaatacaaccacattggatcgccgcgagcattatattagagttctttttaattgtgttacttataccagagccggaaaagcaaagaaccccacaagacaatcaattaacatatgtagtaatagcaatactaacagtcgtagcggccacaatggctaatgaaatgggattcttagagaaaactaagaaggatctaggtctggggtcgatagcaacgcaacaaccagaatcgaatatattggatatagatctcagaccagcgtcagcttggactttgtatgctgtggctacaacatttgtaaccccaatgctcaggcatagtattgaaaattcatcagtaaatgtgtcgctaaccgctatagcgaatcaggctactgtgttaatgggactaggcaaaggatggccactatccaaaatggatattggagtcccacttttagcaataggttgctattcacaagtgaacccaataacactaacagctgccctactactcctagtagctcactacgcaataataggtcctggtcttcaagccaaggctacgagagaagcacaaaaacgtgcggcagcaggtataatgaaaaatccgaccgtagacggtattactgttatagatttagatcctattccctacgaccctaaattcgaaaaacagctcggtcaagtaatgttattaattttatgtgtcacacaggtactgatgatgcggacgacgtgggcactctgcgaagcactaaccctagcgactggacccatatcaacgctgtgggaaggtaatcccggacggttctggaatacaaccatcgctgtttcaatggcaaatatatttcggggatcgtatctcgcgggagcaggcttactatttagtatcatgaaaaataccactaataccagacgaggaacgggaaatattggggaaacgttaggcgagaaatggaagagtagattaaatgccttgggaaagtcagagttccaaatatataagaaatcgggcattcaagaggtcgatcgtactctagcgaaagaagggatcaaacggggcgagacggatcatcacgcagtttcaaggggctcggctaaattacgatggttcgtagagaggaatatggtaacccctgaagggaaggtggtcgatctaggatgcggaaggggaggatggtcctattactgtgggggactaaagaatgtaagagaagtcaaaggattaaccaaaggtgggcccggacatgaagaacctatcccaatgtcaacatatggctggaatctggttagattacaatcaggtgtcgacgtattctttataccaccggaaaaatgcgatacgctattatgtgatattggtgagtcctctcctaacccgacagtagaagcagggagaacgttacgggtattaaacctcgttgaaaactggctaaataataatacacagttttgtataaaagtattaaatccttatatgccatctgtaatagagaaaatggaagcacttcagaggaagtatggaggtgcacttgtaagaaatccgttgtcaagaaactcgacacacgaaatgtattgggtatcaaatgctagtggaaatatagtaagctccgtcaacatgataagtagaatgttaatcaacagatttaccatgaggcacaaaaaggcgacctacgaacctgatgtcgacttggggagtggcacaagaaatataggtattgaaagcgaaattccgaacctcgatatcattgggaaaagaatcgagaaaattaaacaagagcatgaaacgagttggcactatgaccaagaccatccctataaaacatgggcttatcatggtagctatgaaaccaaacaaacagggtctgcttcttccatggtcaacggcgttgtgcgcctgctgacaaaaccctgggacgttttacccacagtcactcaaatggctatgacagatacgacaccgtttggacaacagagagtattcaaagagaaggttgatactcgaacccaagaaccgaaggaaggaaccaagaaactaatgaaaataacagctgaatggctttggaaagaactcggtaagaagaaaacaccacggatgtgtacacgtgaggagttcactcggaaggtccgctccaacgcagctttaggcgcaatctttactgacgagaacaaatggaaatcagcgcgagaagcagtagaagatagccgtttttgggaattagtagacaaagaaagaaatcttcacttagaaggaaagtgcgaaacatgtgtatacaacatgatgggaaaaagggagaagaaattgggggagtttggaaaagccaaaggaagcagagccatctggtacatgtggttaggcgcgagattcttagagtttgaagcgcttggattcttgaatgaagaccattggttcagtagagagaatagcctaagcggcgtagagggagagggcttacacaagttggggtatattttgagagatgtctctaagaaagagggcggtgcaatgtatgcggatgatacagcgggctgggatactcggatcacgctagaagacctcaaaaatgaagagatggtgactaaccatatggaaggcgaacacaaaaagttagcagaagccatcttcaaactcacttatcaaaacaaggttgtacgcgtgcagagacctactccgagaggaacagttatggacataataagtagacgtgatcaacgggggagcggtcaagttggaacatatggcctcaacacgtttactaacatggaggcccaattaattagacaaatggaaggcgaaggggtttttaaaaatatacaacatcttacagtcactgaagaagtagcagtccacaattggctagctcgagtggggcgtgaaagattatcccgaatggcgatttccggtgacgattgtgttgtaaaaccactagatgatcgatttgcaaacgcactcaccgctttaaacgatatgggaaaaatacgaaaggatattcagcaatgggaaccttccaaagggtggaatgactggacacaggtaccattttgttctcatcacttccatgaactaatcatgaaggacggccgagtgctagttgtaccatgtaggaatcaagacgaactcattgggcgggcgcgaataagccaaggtgcaggttggtctttgagagagactgcctgtcttggaaaatcatatgcccaaatgtggagcttgatgtatttccataggagagatctaagattagcagctaacgcaatttgctcagcagttccaagccactgggttccaaccagccgaacaacatggtcaatacatgcgaaacatgaatggatgacaaccgaagacatgctcacggtatggaatcgtgtttggataagggagaacccttggatggaagacaagacgccggtagaatcatgggaagaaattccttatctaggtaagagggaagatcaatggtgcgggagtctgattggactcacatcaagggcaacatgggccaaaaatatacaagcggcgatcaatcaagttaggtccttaataggaaatgaagaatacacagattatatgcctagcatgaaaagattccggagggaagaagaggaagctggtgtgttatggtaa

SEQ ID NO: 22760 - RNA, 9876 nt, synthetic construct
  misc_feature 1..9876: note = derived and/or modified CDS sequence (opt6) from DENV-2__EU482776__SS-prME
  source 1..9876: mol_type = other RNA
agtgcgggaatgattattatgttaattccaacagtaatggcatttcacttaacaacacgtaacggagaaccacatatgatagttggtattcaagaaaaaggtaaaagtttactatttaaaacagaagatggagtaaacatgtgtacactaatggccatggacttaggagaattatgcgaagataccataacttataaatgtccgttactacgtcaaaatgaaccagaagatatagactgctggtgcaattcaacatccacctgggtaacatacggcacgtgcacgacaacaggagaacatcgcagggagaaaaggtcagttgctctagtaccacacgttgggatgggattggaaactcgaactgaaacatggatgtcctcggaaggggcttggaaacacgcacaaagaatagaaacctggatcttaagacaccctgggttcacaattatggcagcaattttagcttatacaataggaacgacacacttccagagggtactaatattcattctactaacagccgtagcaccaagtatgactatgcgatgcattggtattagcaaccgagactttgtcgaaggtgtttccgggggtagttgggtagatatcgttctagaacacggctcatgtgttactaccatggcgaaaaacaaacctactctagactttgaattgataaaaacagaagctaaacaaccagctactttaagaaaatattgtatagaagcaaaactaaccaatacaacaacagaaagcagatgcccgacacaaggagagccgtcgttaaaagaggaacaagataaaagattcgtctgcaaacattctatggtagatagaggttggggaaacgggtgtggtcttttcggcaaaggaggaatagtgacctgtgccatgtttacatgtaagaaaaatatggaaggtaaaatcgtacagcccgagaatctcgagtatacgatcgttgttacgccacactcaggcgaggaacatgctgtagggaatgataccggaaaacacggaaaagaaattaaagtaacccctcaatcttcgattactgaagcagagctaactggctacggaactgttacaatggaatgcagtcctcggaccgggctagatttcaatgaaatggtgttacttcaaatggaaaataaagcatggctggtccacagacaatggttccttgatttaccattaccctggttgcccggtgcagacaaacaagaatctaattggatacaaaaggagactctggtcactttcaagaacccacacgcaaagaaacaagatgtagtcgttttaggttcccaagaaggagcaatgcatacggcgttaactggagcgacagaaatacagatgagttcaggtaacctactattcaccggacacttaaagtgtagactaaggatggataaattacaacttaagggtatgagctattcaatgtgcactggaaagttcaaggtagtaaaagaaatagcagagacccaacatgggacgatagtgatcagagttcaatacgaaggagatggaagtccttgtaagatcccatttgagatcatggatttagaaaagagatatgtactcggtaggttaataacagtaaatccaatagtcaccgaaaaagactcaccagtaaatatagaagcggaaccaccatttggtgatagctatataataataggcgtagagccaggccagttgaaattaaattggtttaagaaaggctcgtcaataggccaaatgtttgaaacaaccatgagaggagctaaaagaatggccatattgggagacactgcttgggatttcgggagtctcggaggagtatttacaagtattggcaaggcgttacaccaagtattcggtgcaatatacggagcagccttttccggagtatcatggacaatgaagatccttataggtgttattataacgtggattggtatgaactcacgcagtacatccttatcagtatctctagttcttgttggaatagtgacactatacctcggggtaatggtacaagctgacagcggatgcgtagtatcttggaaaaacaaagaacttaagtgtggatcagggatttttataacggacaatgtccatacctggaccgaacaatataaatttcagccagagagtccaagcaagttggcttcagcaattcaaaaggcacaagaagaaggtatttgtggcattcgctcagttacccgtctggaaaatctgatgtggaaacaaataacaccagaactgaaccacatcctcgcagaaaatgaagtaaagttaacaatcatgacaggtgatataaggggtattatgcaggcgggtaaaaggtcattaaggccccagcctactgaactcaaatactcatggaagacatggggaaaagcaaagatgttgtccacagagagttacaaccaaacattcctaattgatggaccggagacagcggagtgccccaatactaatcgagcttggaactccctggaagtagaagattacggatttggagtattcaccactaatatttggttaaaactaaaggaaaaacaagatgcgttctgtgacagtaaactaatgtcagcagcaattaaagataacagagcagtccatgcagatatgggatattggatagagagcgctttaaacgatacttggaaaatagagaaagcatcattcatcgaggtcaaaaactgccactggccgaaaagtcatacattatggtcaaatggagtactcgagtctgaaatgattatacccaaaaatctggcaggaccagtatcacaacataactatcgtccaggttatcacactcaaatagcagggccctggcacctgggaaaacttgaaatggattttgatttctgcgacggtacaacagttatagttaccgaggactgtggtaatagagggccaagtctacgaacgacaactgcctcaggtaaactaatcactgagtggtgctgtcgctcatgtacgttgccgcctctcaggtataggggagaagacggctgctggtacgggatggaaatacgtccactaaaagaaaaagaagaaaatctagttaactctttagttaccgctggacatggacaggtagataatttctctttgggcgtgctaggaatggcattgtttctagaagaaatgcttagaacaagagttggtacaaagcatgcaattcttctcgttgccgtctcattcgtaacattaattacgggaaatatgagctttaaggatctcggtagagtcgtagttatggtgggggctacgatggctgacgatatcggtatgggcgtaacatatctagcattactcgcagcctacaaagtgcgtcctacctttgccgccggtttgttattaagaaaactaaccagtaaagagctcatgatgacaacaatcgggatagtcttgctctcgcaatccacgataccggaaactgtattagaattaacagacgcattagcgttaggtatgatggtgcttaagatagttaggaatatggagaagtatcaactagcggtaactataatggccatcttgtgcgtgccgaatgcggtcatcctccaaaacgcttggaaggcttcctgtacaatactagcagttgtctcggtaagtccgctactattgacatcatctcaacagaaaaccgattggattcccttagcactaacgatcaagggtcttaatcctacggctattttcctcactacactgagtcgcacaaacaagaaacgatcgtggcctctaaacgaagcaattatggccgtaggtatggtgtcaattttggcttcgagtctgctcaaaaatgatattcccatgaccggaccgttggttgctggtggactccttacagtttgttatgtattgacaggcagatctgcagatctcgagttagaacgcgcaacggacgtgaaatgggaagatcaagcagaaatttcgggcagctctccaattctatccataacgatttcggaagatggttcaatgtctatcaaaaatgaagaggaggaacagacattaactatactcattagaacagggctattggttatatcggggctatttcccatttcaatacctatcaccgccgcagcctggtatctatgggaagtcaagaaacaaagggcaggagtattatgggatgtaccatcaccaccaccaatgggaaaggcagaacttgaagatggcgcatacagaattaaacaaaaaggtattctcggatacagtcagataggagcgggagtatataaagaaggcacatttcatactatgtggcacgtaacacgaggggcagtacttatgcacaaagggaagcgtattgaaccgtcttgggcagacgtcaaaaaggacctgatatcatacgggggcggttggaagctagagggagagtggaaggaaggtgaggaagtacaggtacttgcactagagcctggcaagaatccacgagctgtccaaactaaaccgggattgtttaaaactaatactggcactataggggcagtctcgctagacttctcccccggcacatctggttcaccaataattgataagaaagggaaagttgtaggcttatacggaaatggcgtcgtgacaagatcgggagcgtatgtctcagcaattgcacaaactgaaaaatcgatcgaggataatcccgaaatagaagatgacattttccgaaaacgacgtttaactataatggatctgcaccctggcgccggaaaaactaagagatatctccctgcaattgttagggaggcgatcaaaagaggtttaaggactctaatattagcacctactcgggtagttgcagcagaaatggaagaggctttgagaggattacctatacgataccaaaccccggcaataagagcagaacatactggcagagaaatagttgacctgatgtgccacgcaacatttacaatgagattattgtcgccagtgcgtgtaccaaattataatctcataataatggacgaggcgcattttacggatcctgcatcaatagcagccagaggatacatttctactcgagtagagatgggagaagcggcggggatattcatgacagctacacctccaggatctagagacccttttcctcagtccaacgcaccaattatagatgaagaaagagaaatacctgaaagatcctggaacagtggacatgaatgggttacagatttcaaagggaaaaccgtatggttcgttccaagcataaaagccggaaacgacattgcagcctgcttaaggaaaaatggcaagaaagttattcaactctcacgaaaaacctttgattccgaatacgtaaaaaccagaacaaacgactgggactttgttgtaacgactgacatttcagaaatgggagcgaattttaaggcggaaagagttatagatccgcggaggtgcatgaaacctgtgatacttacagatggcgaagaaagagtcatattagccggaccaatgcctgttacacacagttcagcggcacaaagacgaggccggattgggcgaaaccccaaaaatgaaaatgaccaatacatatacatgggggaaccattagaaaatgatgaagactgtgcacattggaaagaggcaaaaatgctacttgataatataaacacaccagaaggcataataccttctatgtttgaacctgaacgtgagaaggtcgacgccattgatggagaatatcgattgcgcggggaggcgcgtaaaacatttgtagatctaatgcgaaggggtgatttgcctgtatggcttgcatataaggtagcggcggagggaattaattacgccgaccgaagatggtgcttcgatggaattaaaaataaccaaatactggaagaaaacatggaagtagaaatttggaccaaagagggcgaaaggaagaaactaaaaccgagatggctcgatgcaagaatttactccgatccattagcgcttaaagagtttaaagaatttgcggcaggacgaaaatcattaactctcaatcttataaccgagatgggcagacttcccacatttatgacgcagaaaacaagggacgcccttgacaatttagctgtcctgcacacggctgaagccgggggtagagcgtacaaccatgcactatctgagctccccgaaacattagaaacactcttacttctcacgctgcttgcaaccgtcacagggggaatatttttattcctcatgtccggaagaggaattggcaaaatgacattaggaatgtgttgtatcataacggcaagtatacttttatggtatgcgcaaattcaaccgcactggattgctgcatcaataattttggagttctttctcatagtattattgattccagaaccggaaaagcagagaacaccgcaagataaccaattgacgtacgtagtgatagccatacttactgttgtagcggccacaatggcaaatgagatgggattcctcgaaaagacaaagaaagatctaggtcttggctctatcgctacgcagcaacccgaaagtaacatactcgatatagacctaaggcccgccagtgcatggactctttacgccgtggcgactacctttgtaacaccaatgctcagacactcaatcgagaacagttccgtaaacgtgagcttgacagctatagcaaaccaggctactgttctaatgggtttaggtaaaggatggcccttaagcaaaatggatataggggtgccacttctagcaataggatgctactcccaagtaaatcctataaccctcaccgcggctctacttttacttgtagcacattacgcaatcattggtcctggtctccaagcaaaagctacccgagaggcacaaaaacgggcagcggcaggtatcatgaagaatccaacagtggacggaattacagttattgatttagatccaatcccttacgatcccaaatttgaaaaacagttgggacaagtaatgttgctcatactctgtgttacacaagtcttaatgatgagaacaacctgggctttgtgcgaggccctaactttggctacaggaccgataagtacgttgtgggaaggtaatcccggcaggttctggaacacaacgatagcggttagcatggcgaatatttttaggggaagttatctcgcaggagctggattactatttagtataatgaagaatactaccaatacacgaagaggtacaggaaacattggagagacattgggcgagaaatggaaatctcgattgaacgcgctcggaaaatccgagttccaaatatacaagaaaagtggtattcaagaagtagatcggacccttgcaaaagaaggtatcaagcgaggtgaaactgatcatcacgctgtgtcaagaggtagtgctaaactgcgatggtttgtagagaggaacatggttacacccgaggggaaagtcgtagaccttggatgcggtcgtggaggttggagctattactgcggaggacttaaaaatgtacgtgaggttaaaggtctaacaaaaggtggaccaggacatgaagaaccgataccgatgtctacttatggatggaatttagtcagattacagtcaggagtagatgtattcttcatacccccagaaaaatgcgatactctgctctgtgatataggagagtcatctcccaatccgacagtcgaagcgggaaggactcttaggatcctaaaccttgtagaaaattggctaaacaacaacacccagttctgtattaaagtacttaacccctacatgccttctgtaatagagaaaatggaagcactgcaacggaagtacggaggcgccttagttcgcaaccccttaagccgaaatagtacacatgagatgtattgggtttcaaacgctagcggtaatatagtctcttcggtgaacatgatatcgcgaatgttaattaatagatttacaatgagacataagaaagcgacatatgaaccagatgtagacctgggttccggaaccagaaatatcggcatagaatccgaaatccccaacttagatataataggaaaaaggatagagaaaataaaacaagaacatgaagcatcgtggcactacgaccaagaccatccctacaagacctgggcataccacggctcttatgagactaaacagacaggaagtgcatcttcaatggtgaatggggttgtcagactccttaccaaaccttgggatgtcctaccgacggttactcaaatggcgatgacggatacgacacctttcggacagcaaagggtattcaaagaaaaagtagatactagaacccaggagccaaaagaagggacaaagaaactaatgaagataacggcagaatggctatggaaagaactgggcaagaagaaaacacctagaatgtgtacaagggaagaatttacccgaaaagtcaggtcaaatgcagcactaggcgctatatttacagacgaaaataaatggaaatcagcaagagaagctgtggaggattcccgattttgggaactggtggacaaagaaagaaatctacatctagagggaaaatgtgaaacgtgcgtatataacatgatggggaagagagagaagaaattaggtgagtttggcaaagccaagggatccagagcaatatggtatatgtggctaggggcacgatttctggaatttgaggcattaggattcctaaatgaagatcattggttttcaagggagaatagtcttagcggagtagaaggagaaggtttacacaaattgggttatatattaagagatgtctcaaagaaggagggcggcgcaatgtatgctgacgacaccgcaggatgggacaccagaattacactagaggatctcaaaaatgaagaaatggtaacgaaccacatggaaggagaacataagaaattagcagaagctatatttaaattgacgtatcagaataaagtcgtacgagttcaaagaccaacgcccagaggaacagttatggatatcattagcagacgagatcaacggggttcaggacaagtaggtacgtacggtctaaatacgttcactaacatggaagcacaattaatcaggcaaatggaaggggaaggcgttttcaagaatatacagcacttaacagtcacagaggaggtagctgtccataactggttggctcgtgttggctgcgaaagactaagtcgaatggcaatatccggagacgactgtgttgttaaaccactagatgatagattcgccaatgcgttaacagcactaaatgatatgggaaagatcagaaaagacatacaacagtgggagccatcaaaaggctggaatgactggacccaagttccattttgtagccatcacttccatgagctaattatgaaagatggaagggtactcgtcgtaccttgcagaaaccaggatgagctaatcggcagagcgcgaatatcacaaggggcgggttggtccctaagagaaacagcgtgtttaggcaaatcgtatgcacaaatgtggagtttaatgtactttcatagacgtgacttacgtttggcagcaaatgcaatatgcagcgctgtgccatcacattgggtacctaccagtcgaacgacatggtcaatccacgctaaacatgaatggatgactaccgaagatatgttaacagtctggaatagagtttggatactagaaaatccctggatggaagataaaaccccagtagaatcgtgggaagaaataccatatttaggaaaaagagaagatcaatggtgtggatcacttatagggttgacaagtagagcaacatgggcgaaaaacatacaggcggctataaaccaagtacgcagtctgataggaaatgaggaatatacagattacatgccaagcatgaagaggttcagaagagaggaagaagaagcgggagtcttatggtaa

SEQ ID NO: 22761 - RNA, 9876 nt, synthetic construct
  misc_feature 1..9876: note = derived and/or modified CDS sequence (opt6) from DENV-2__EU482777__SS-prME
  source 1..9876: mol_type = other RNA
agtgcaggaatgattataatgttgattccaactgtgatggcatttcacttaacaacgagaaatggagaaccacatatgattgtaggaatacaagaaaaaggaaaatcactactatttaaaacggaagacggagtaaatatgtgtacgttaatggcaatggatttaggagaattatgtgaagatactataacatacaaatgcccgcttttacgacaaaatgaaccagaagacatagactgttggtgcaattcaacgtctacatgggtaacatacggaacctgtacgaccacaggggaacatagacgagaaaaacgatcggtcgctctagtgcctcacgtaggtatgggtctagaaacacggactgaaacttggatgagctccgaaggggcatggaaacatgcgcagagaattgaaacttggatcttgagacatccaggattcacaattatggcggcaattctagcatatacgataggaacaacccattttcaaagagtgttaatattcattttattaactgctgttgctcctagtatgacaatgcgctgtattggaatttcaaatagagattttgtggaaggtgtttcgggtggatcatgggtcgatattgtccttgaacatggatcttgcgtgacaactatggctaaaaataaacctacccttgattttgaactaattaaaactgaagcaaaacagccggcaaccctacgaaaatattgtattgaagcaaaattaacgaatactacaaccgaatcacgctgtccgactcagggtgaaccgtccctgaaagaagaacaagataaacgcttcgtttgtaaacattcgatggtcgaccgaggatggggaaacgggtgtggcctatttggaaaaggaggtatagttacatgcgcaatgttcacatgtaagaaaaatatggaaggaaaaatcgtacagccagaaaacttagaatacacaatagtcgtaacaccccactcaggagaagaacatgctgtgggcaatgatacaggaaagcacggaaaagaaataaaggtaacccctcaaagctcaatcaccgaagctgaactaacaggttatggaaccgtaactatggaatgctctccacgtaccgggttagattttaacgagatggtacttttacaaatggaaaataaggcttggttagttcaccgccaatggtttctagatctaccgttgccatggttacctggagctgacaaacaagaaagcaactggattcaaaaggaaactctcgttacattcaaaaatcctcacgccaagaaacaggatgtggtagtcttaggaagccaggagggggcgatgcatacggcattaactggggctacagaaatccaaatgagctccggtaaccttttattcaccggacatctcaagtgcagacttagaatggataaacttcaattgaaaggaatgtcttatagcatgtgtaccggaaaattcaaagttgtcaaagaaatcgcagaaacccaacatggaaccatagttataagagtgcaatacgagggcgacggttccccctgcaaaatcccatttgaaatcatggacttagaaaaacgttatgtcctaggtcgtttaataactgtcaaccctatagttacagagaaagattctcctgtaaatattgaagcagaaccgccattcggtgattcttacataataataggggtcgagcccggacagttaaaactaaactggtttaagaaagggagcagtatcggtcaaatgtttgagactactatgagaggagccaaaagaatggcgatcttgggggacaccgcctgggatttcggatcacttgggggtgtgttcactagcattggaaaggcgttacatcaagttttcggagctatctatggagccgctttctcaggagtttcatggacaatgaagatactaataggagtgataataacatggattgggatgaacagtagaagtacttcactttcggtgagccttgtgcttgtgggaatcgtcactctttatctcggagtcatggtccaagcagactcaggctgtgttgtatcatggaaaaacaaggaattaaagtgcggtagcggcatctttataacagacaacgttcacacatggaccgaacaatacaaatttcaacctgaatccccttcaaaattagctagcgccatccaaaaagcacaggaggaagggatatgtggaatacgctctgtaacacgattggaaaatctaatgtggaaacaaatcaccccagagctaaatcatattctagctgaaaacgaagtaaaattaacaattatgacaggagatataaaagggatcatgcaagcgggcaaaagaagtttaaggccacaacccacagagttaaagtattcgtggaaaacatggggaaaagcgaaaatgttatcaacagaatcttacaaccaaacgttcctaattgatggtccagaaacagcggagtgtccaaacacgaaccgtgcttggaactctttagaagttgaagattatggattcggtgttttcacaacaaacatttggcttaagctaaaagagaaacaagatgcattttgtgatagtaaattgatgtccgcagcaattaaagacaatagagcagtccatgctgacatgggttattggatagaatctgcgctaaatgatacttggaaaatagagaaggcttcattcattgaagtcaaaaattgtcattggcccaagtcgcataccttgtggtcaaatggggttctcgagtcggaaatgattattcccaaaaaccttgctggcccggtatctcagcacaattataggccaggataccacacccagatcgccgggccctggcatctcggtaaattagagatggactttgacttttgcgatgggacaacagtaattgtaacagaagattgcgggaataggggcccatcattaaggactacaacagctagtggtaaactaattacagaatggtgctgcaggtcatgcactcttcccccgcttcgctaccgaggagaagacggctgctggtacggaatggagatcaggccattgaaagaaaaggaagagaatttagtaaacagtctagtaacagccggacatggccaagtggacaacttttcgttaggagttctcggaatggccctgtttctagaagaaatgctaagaactcgcgtcggaacgaaacatgcgatattattagtagcagtaagttttgttacgctaatcacaggaaatatgtcttttaaggatttgggccgtgtagtagtaatggtcggtgcgacaatggcagatgacatcggaatgggggtaacatatttagcgttattagctgcgttcaaagtacgaccgacctttgctgcaggcctattactaaggaaactcacatccaaggaattaatgatgacgacaataggaatcgtactactatcacaaagtacaatccctgaaacagtgcttgaactaacagacgcactagcgttaggaatgatggtcctgaaaatagtaaggaatatggaaaaatatcaactcgccgtcactatcatggcaatattgtgtgttccaaatgcagtcatactacaaaatgcatggaaagtttcatgtaccatattggccgtcgtaagtgtctctccgctattgctaaccagtagtcagcagaaaacggattggataccgctagccttaacaataaaaggattaaatccaactgcaatattccttaccacgttgtcaagaacgaataaaaagagatcttggccactaaacgaagctatcatggcagttggtatggtaagtatattagcttctagccttttgaaaaatgacataccgatgacggggcccttggtcgcaggcggtttactcaccgtttgttatgttttaacaggtcggtcagcagaccttgagttggaacgagcgacagatgttaaatgggaggatcaagcagagatttccggatcgagtcctatattatcaatcacaatttccgaagatgggagcatgagcattaaaaatgaagaagaagaacagacattaactatacttatccgcactggcttgctagttatatcaggtttattccctatatctatacccattacagcagctgcatggtatctttgggaagtcaagaaacaacgagctggggtattatgggacgtcccatctccgccccctatgggtaaagctgagttagaagatggagcgtatagaatcaagcagaagggtatcttaggctacagtcaaataggagccggtgtatataaggaagggactttccacacaatgtggcacgtcacacgtggagctgtgctgatgcacaagggaaaacgaatagaaccgagttgggccgatgttaagaaagatttaatctcatacggcggtggttggaaattagaaggagagtggaaggaaggagaagaagtgcaggtactagcactcgaacctggtaagaatccaagggcagtacagacaaaaccgggactatttaagacaaacactggaacaatcggggcagtatcacttgatttttctccaggtacatcaggttcaccgataattgacaaaaagggaaaagtagtaggactgtatggcaatggtgtagtaacaagatcaggagcatatgttagtgctatagctcagacagagaagagtatagaggataatccagaaattgaggatgatatattccgaaagaggcgtcttactataatggatctacaccctggagctggtaaaacaaaacgatatctacctgcaatcgtacgagaagctattaagaggggcctacgcacattaatattagcaccaacaagggtagttgccgcagagatggaagaagcgctacggggtttaccgatccgatatcaaaccccagcgattagagcagagcacacaggacgtgaaatcgtggaccttatgtgtcatgcaacgttcacaatgagactcctctcaccagtaagagtaccaaattataatttaattatcatggatgaagcccactttactgaccctgcaagcattgcagccagaggttacatctctacaagagtagaaatgggagaggccgcaggtatatttatgacagcaactccaccagggtcgagagaccccttcccacaatcgaatgccccgataattgacgaagagagggaaataccggaaagatcatggaatagcgggcatgagtgggtgacggatttcaaaggcaaaaccgtttggtttgtaccgtctataaaagcgggaaacgatatagctgcatgtctgaggaaaaatggcaagaaagttattcagttaagtcgaaagacgtttgacagtgaatatgtaaaaacccgaaccaatgattgggatttcgtagtaacaaccgacataagcgaaatgggagctaactttaaggcagaacgagtaattgatccaaggagatgtatgaaaccagtaatcctgaccgatggagaagagagggttatactagcgggtccaatgccagtcactcatagtagcgccgcccagcgtagaggaagaataggaagaaacccgaaaaatgagaacgatcagtatatatatatgggcgaaccgttagagaatgacgaagattgtgcgcattggaaagaagccaaaatgcttctagataacatcaatactcctgaagggattataccaagtatgttcgaaccagaaagggagaaagtcgatgccatagacggagaatatagattgagaggggaagcacgtaaaacttttgtcgacctcatgaggagaggtgatctccccgtttggctagcttataaagttgcagctgaagggataaattacgctgatagaagatggtgtttcgacggtatcaaaaacaatcagattctagaagaaaatgtcgaggtagaaatttggacgaaagaaggagaacgtaagaaattgaaacctcggtggttagatgcaaggatatattcagatcctcttgcattgaaagaatttaaagaatttgcagcaggcagaaaatctttaactttaaatttaattacggaaatgggtagactaccaaccttcatgacacagaaaacaagggatgcattagacaacttagcagtcctccatacagcagaggcaggcggtagagcatataatcatgcattatcagaacttcctgaaaccttagaaactctattgttattaacactccttgctacagtgaccggaggaatcttcttatttttgatgagtggcaggggaataggcaagatgacactaggaatgtgctgcataataacagcgagcatattgctttggtacgcccagattcaacctcactggatagcagcctctataattctcgaatttttcttaatagtactactgataccggaacctgaaaaacagaggactccacaagataatcaactaacatatgtcgtcatagctatattaactgtagtagcagcaactatggcaaatgaaatggggttcttagagaaaactaaaaaggacttgggattaggctcaattgcgacacagcaaccggaaagcaatattcttgacatagacctgcgaccggcgtcagcatggactctctatgcagtagcaaccacctttgtgacacccatgttacgacactcaatagagaacagttcagtaaacgtaagtctaacagctatcgcaaatcaagccacggttttgatgggcttgggaaaaggatggcctttgtcgaaaatggatatcggggtaccactgttagcaataggctgttatagccaagtaaatcccataactctgacagcagcactattactgcttgtagcccattacgctattatcggacccggtttgcaagcgaaggcaacgagagaggcgcagaaacgagcagccgcaggaatcatgaagaacccaaccgtagatggcataacggttatagatttagatcccataccatacgaccccaagtttgagaaacaattaggacaggtaatgcttttaatattgtgcgtcacgcaggtactcatgatgcgtactacatgggcactatgcgaggcattaacactcgctactggacccatctctaccctctgggaaggtaacccaggcagattttggaatacgacaatagcagtttccatggccaatatcttccgcggttcctacctagccggggcgggactgttatttagcataatgaaaaatacaacaaatacaaggagaggaacggggaatatgggtgagacactaggagaaaaatggaaaagtaggctcaacgctctaggcaaaagcgagttccaaatatacaagaaaagtgggattcaagaggtcgatcgaacgcttgctaaagaaggaattaagcgaggggaaacggatcaccacgcggtatcgcgcggttcagctaagctccgatggttcgtcgaaagaaacatggttacaccggaaggtaaagttgttgatttaggctgtgggaggggaggttggtcatattattgcggtggtctcaaaaacgtaagggaagtaaaaggacttactaaaggtggacctggacatgaagaacctatacccatgtcaacatatggatggaatctggtcagattacaatctggggtagacgtcttctttataccaccagagaaatgcgatactctcctatgtgatatcggtgaatcctcccccaatccaacggttgaagcgggacgaacactgcgcgtattaaatttggtagagaactggttaaacaacaacactcaattttgtataaaagttctgaatccatatatgccatcagtcatagagaagatggaagcactacaaagaaaatatgggggagccctagtaagaaacccgctctcacgcaacagtacacacgaaatgtattgggtcagcaacgcctctggaaacatcgtatcatctgttaatatgatatcaaggatgttaatcaaccgattcacaatgagacacaagaaagcaacatatgaaccagatgtagacctaggatcaggcacaagaaatatagggatagaaagtgaaattccaaatctagacatcatcggaaaacgaatagagaaaattaagcaagaacatgaaacttcgtggcactatgaccaagaccacccatataaaacgtgggcttatcacggaagctatgaaaccaaacaaactgggagcgcctcaagcatggttaacggtgtcgttaggctattaacaaaaccttgggatgtactaccgaccgttactcaaatggccatgacggacactacaccgttcggtcaacaaagggtttttaaggaaaaagtagatactagaactcaagagccaaaggaaggaacaaagaaattaatgaaaataacagctgaatggttgtggaaagaattgggtaaaaagaaaactccaaggatgtgtacaagagaggagtttaccagaaaagtaaggtcaaatgccgcattaggagcaatattcactgatgagaataaatggaaatcggcaagggaggctgttgaagattcgcgattctgggaactcgtggataaagaaagaaacttgcacctagaaggtaaatgcgagacttgcgtctacaacatgatgggtaaaagggagaagaaactaggggaatttgggaaagcaaaaggtagtagagctatatggtatatgtggttaggagcaagatttctggagttcgaagctcttggcttcctaaatgaagatcattggtttagtcgtgaaaattccctatctggtgttgaaggtgaggggctacacaagttaggttacatactaagggacgtgtctaagaaagaaggcggagcgatgtatgccgacgatacagcgggatgggatacacggataacgctcgaagatctcaagaatgaggagatggtcaccaaccacatggaaggagagcataagaaactggctgaagctatcttcaaactcacctatcagaataaagtagtgagagtccaaagaccaactccgcgtggaacggtaatggatatcatatctcgaagagatcaaagaggttcaggacaagtaggcacatacggtttaaatacatttaccaacatggaagctcaactcataaggcaaatggaaggagaaggagtttttaaaaatattcaacatctgactgtaaccgaggaagttgcggtgcagaattggctcgctagggttggaagagagcgattgagcagaatggcaatctcaggggacgactgtgtagtcaaaccgctagatgatagattcgctaatgccttaacagcgttgaatgatatgggcaaaatacgaaaagatattcagcaatgggaaccgagcaaaggttggaacgattggactcaagtaccattttgtagtcatcatttccacgaattaataatgaaagatggtagagtcttagtagtaccatgtaggaaccaggacgaattaatagggcgtgcccgcatcagccaaggagctggatggtcactacgcgaaacagcgtgccttggtaaaagctatgcgcaaatgtggtctcttatgtattttcatagaagagacttaaggttagcagcaaatgccatatgtagtgcagttcctagtcattgggttcctacatcacgcaccacgtggagcatacacgcaaaacacgagtggatgacaacggaagatatgcttacagtatggaatcgagtttggataagagagaacccatggatggaagacaaaacgcctgtcgagtcttgggaggaaattccatatttaggcaaacgagaagatcagtggtgtggatcattaatcggtttaacttcccgagcgacatgggctaaaaacatccaagccgccattaaccaagttcgcagtctaatcggcaacgaggaatatacagattatatgccaagcatgaaaagatttcggagagaagaagaagaggcaggagttctatggtaa

SEQ ID NO: 22762 - RNA, 9876 nt, synthetic construct
  misc_feature 1..9876: note = derived and/or modified CDS sequence (opt6) from DENV-2__EU482778__SS-prME
  source 1..9876: mol_type = other RNA
acggccggtgtaatcatcatgctaataccgactgcaatggcattccatctcaccacgcggaatggtgaacctcatatgattgtgggaagacaggaaaaaggaaaaagtttgcttttcaaaacagaagatggagtaaatatgtgcacattgatggcaatagacttaggagaattatgcgaagatacaataacgtacaaatgccctctactcagacaaaatgaacccgaagatatagattgctggtgtaactctacttcaacttgggtgacgtatggaacatgtaccacaacaggagaacaccgtcgcgagaaaagatctgttgcacttgttccccatgtgggaatgggattagaaaccagaacagaaacgtggatgtcctccgagggtgcatggaaacacgctcaaagaatcgaaacttggatccttcgccaccctggatttacgataatggcagcgatccttgcatatacagtaggaacaacacactttcagagggcacttatttttatacttctggccgccgtcgcaccatcaatgacaatgcgatgtataggtatttcgaacagagactttgtcgaaggagtatcaggaggtagctgggttgacatcgttttagagcatggtagttgtgtaactactatggcgaaaaacaaacccacactagattttgaacttattaaaaccgaagcaaaacaaccggcaaccttgcggaaatattgcatagaagcaaagctaacaaatactaccacagaaagccgatgcccaacacaaggagagccaagtttgaacgaggagcaagataagcgatttgtatgtaaacatagtatggttgatagaggatggggcaacggatgtggtctctttggaaaaggcggaatagtaacatgtgctatgttcacatgtaagaaaaacatggaagggaaaatagtccaaccagagaatctcgagtatacaatagtaataactccacattcaggcgaagaacatgcagtaggaaatgatacaggtaaacatggaaaagaaatcaaaattacaccacaaagcccaattacagaggcagaactaacagggtatggaacagttacgatggaatgcagtcctcgaaccggccttgattttaatgagatggttctactacaaatggaagacaaagcgtggttagtgcacagacaatggttcctagacttgcccttgccatggctgccaggagcagacactcaaggatcgaattggatacaaaaagaaacgttggtaacattcaagaacccgcatgctaagaaacaagacgttgtcgtcttaggaagccaagagggcgcaatgcatacagcgttaacgggggcaacagaaattcaaatgtcaagcggaaacctattgtttacaggccacttaaagtgcaggttgagaatggacaaactgcagttaaagggaatgagttattctatgtgtaccggaaaattcaaaatcgtaaaagagatcgctgaaacacaacatggtacgatagtcattagagtacaatacgaaggagacggaagcccctgtaagattccctttgaaataatggacttagagaaacgccacgtccttggacgattaataaccgttaacccaatagtaaccgagaaagatagtccggtgaacatagaggcagaaccaccttttggagacagttacataattattggagttgaacctggacagttaaaactgaactggtttaagaaaggaagcagtattggacaaatgtttgaaacaacaatgaggggagcgaagaggatggcgatactaggcgacactgcttgggacttcggcagtcttggtggggtattcacaagtattggcaaagcacttcatcaagtatttggtgcaatatacggcgcagcattttctggagtttcttggaccatgaagatcctaataggagttatcatcacttggattggtatgaatagccgatcgacaagtttaagtgtgtcccttgtactggtcggtgtaataacactatacctaggtgcaatggttcaggctgatagcggatgtgtcgtgagttggaaaaacaaagaattaaagtgtggcagtggaatattcatcaccgataacgtgcacacttggacagaacaatataagtttcaacctgaaagtccatccaagttggccagcgcgatacaaaaggctcatgaggaaggaatatgcggcataagaagcgtaacgcgattagaaaacttaatgtggaagcagataactccagaattgaaccatatactctctgaaaacgaagtcaaactcacgattatgaccggggatattaaagggatcatgcaggcaggaaaacgatctttgcgaccccaacccacagagctcaaatatagctggaaaacatgggggaaagcaaaaatgctatcaacagaaagccacaatcaaacctttctcattgacggccctgaaacagccgaatgtccaaacactaatcgagcatggaatagtctagaagtggaagattatggatttggcgtttttacaacaaacatatggttgaaacttagagaaaaacaagacgtgttttgtgattccaaattaatgtctgcagcaataaaagacaacagagctgtgcatgctgatatgggttattggattgagtccgcactcaatgatacttggaaaatggaaaaggcatcatttattgaggtcaaaaattgtcattggccaaaaagccatacactctggtcaaatggagtgttagagagtgaaatgatcatcccaaaatcatttgcgggaccagtgtcccaacataactaccgtcctgggtattatacccaaactgcaggaccctggcacttgggaaaactcgaaatggattttgacttttgtgaaggcactacggtggtagttaccgaagattgtggtaatcgaggtccgagtcttagaacaactacagcctcagggaaattaatcaccgagtggtgctgtagatcttgtacactaccaccactccggtatagaggtgaagatggatgttggtatgggatggaaatacggccgttaaaggagaaagaggaaaatttggtcaactcgttagtcactgcagggcatgggcaaatagataatttttcattaggcgtgttggggatggcactgttcctagaggagatgttacgtacccgtgttggcaccaaacacgcgatcttattggtcgcagtttcatttgtaacgctgataacgggaaatatgagtttccgagatctgggacgagttatggtaatggtcggtgcagctatgacggacgacatagggatcggcgtaacgtacctagctctattagcagcattcaaggttcgaccaactttcgctgcaggattattattgcgaaagttaacatcgaaggagctgatgatggctacaattggaatagctctattatcacagagcaccattccagaaacaatactagaactgaccgatgcattggcgctaggcatgatggtgttaaagatcgttcggaacatggaaaagtatcaattggcggtaactataatggctataagctgcgttccgaacgccgtaatcttgcaaaatgcgtggaaagtttcctgtacgatattagcaaccgtatcggttagccccttacttctaacaagttcccaacaaaaagccgactggatccctttggcattgacgattaaggggttgaatcctaccgcaatcttccttaccactcttagccgaacctccaagaaaagatcctggccacttaatgaagctataatggctgtcggcatggtatctatacttgcatctagtcttctaaagaatgatataccaatgactgggccattggtagcagggggacttcttaccgtttgttatgtactaacaggtcggtccgctgacttagaattagaacgagccactgatgtgaaatgggaggaccaagcggaaatttcaggttcaagtccaatattaagcattacaatagcagaagatggatcgatgagcattaaaaatgaagaggaagaacagaccttgacaatcctcatacgtactgggcttttagttataagtggtctatttccagtctcaataccaatcaccgctgcagcatggtatttatgggaggtaaagaaacaaagagccggtgttctgtgggacgttccaagtcccccaccagtgggaaaggctgaactagaagatggcgcgtatagaataaaacagaaaggtatattaggatatagccaaataggtgccggggtatacaaagagggtacttttcataccatgtggcatgtgacgagaggcgcagtgcttatgcataggggaaagagaatagaaccaagctgggctgatgtcaagaaagacctaatatcatacggtggagggtggaaacttgagggagaatggaaagaaggggaagaagtgcaagtgttggccctggaaccaggcaaaaacccacgagcagtgcaaacaaagccaggcttattcaaaacgaatactgggactatcggagcagtctcactcgattttagtccaggcacatcaggatcaccaatcgtcgataagaaagggaaagtagtaggattgtatggtaacggtgttgttactagaagtggagcatatgtaagcgcaatagctcaaacggagaaaagcattgaagataaccctgagatagaagatgatatatttaggaagaaacgattaacaattatggacttacaccctggagcaggcaaaactaaaagatatctccctgcaattgtgcgtgaagcaataaagagaggacttagaacgctcatattagcaccgacacgtgtagtagcagcagagatggaggaagcacttaggggactaccaatccggtaccagaccccagccataagagcagaacatactggtagagaaattgttgaccttatgtgccatgccaccttcacaatgagacttttgtcgccagttagagtacccaattataacctcattattatggatgaggcgcactttacggatccagcaagtatagctgctcgaggatacatttcaacccgagtagaaatgggcgaagcggctggcatctttatgaccgctactccacctggatcgcgagatccttttccgcagtctaatgcacctattatggacgaggaacgagaaatacccgaacgatcctggaactcaggacatgaatgggtaactgactttaaaggaaaaactgtatggtttgtgccgagtataaaggcaggtaatgatatcgctgcatgtttgaggaaaaacggcaagaaagtcattcaactctctagaaaaacatttgatagtgaatatgtaaaaacaaggacaaacgattgggatttcgtggttacgacggacatatctgaaatgggagctaattttaaagccgaacgggtaatagatccaagaagatgcatgaaaccagtgatactcacggatggcgaagagagggtcatattagccgggccaatgccagtaacacattcgtctgccgctcaaaggcgcggtcgtattggtagaaaccccaaaaacgaaaatgatcaatatatttatatgggtgaaccgcttgaaaatgatgaagactgcgcacattggaaagaagctaaaatgctactagacaatatcaacactcctgagggaattatacccagcatgtttgagccagagcgtgagaaagtagacgcaatagacggggaataccgcctacgcggcgaagctcgcaaaacgtttgttgacctcatgagaaggggtgatttaccagtctggctggcatacagagtggcagcggaaggcataaattatgctgatagaagatggtgcttcgatggagtaaagaataaccaaatcctagaagagaacgtagaagttgaaatatggactaaagaaggagaaagaaagaaattaaagcctaggtggctagacgcaaggatatacagcgatcccctagctctcaaagaatttaaagagttcgcggcaggtagaaaaagccttacgctaaatctgatcacggaaatgggaagattaccaacctttatgacccaaaaagcaagagatgctttggacaacctagctgtcctacatacggcggaagccggtgggagagcttataaccatgctctaagtgagcttccagaaacattggaaaccttactactcttaacactcttagcaacggtaaccggaggtatatttctatttttaatgtcaggaaaaggggtcggaaaaatgaccctaggaatgtgttgcataattactgcaagtatcttattatggcacgctcaaatacaacctcactggatagccgcttcaataatattagagttctttttaattgtactcctcatacccgaaccagaaaaacaaaggactccccaagataaccagcttacttatgtagtcatagctatactaactgtggttgctgcaacgatggccaacgaaatgggttttctagagaaaaccaagaaagaccttggactgggaagtatagcaacacaggaaccagaatctaacattttagatatagatctacgaccggcaagcgcttggacattatacgccgttgccacgacgttcgtaacacctatgttgcgacatagcattgaaaactcgtcagtgaatgtttcacttacagctattgctaatcaagcaactgttctcatgggcctaggaaaggggtggcctctaagcaagatggatattggtgtcccactcctcgctatcgggtgctattcgcaagtcaatccaataacattaacagccgcattgctcctactcgtggctcattacgctataataggccctggcttacaagctaaggcaacgcgcgaagcgcaaaaacgtgcagcggcaggaataatgaaaaatcctacagtagatggaataacggttatcgacttagatcccataccgtatgatccaaagttcgaaaaacagcttggacaggttatgttactgatactctgtgtgacccaagtattaatgatgagaactacttgggctctttgtgaagctctcaccctggcaacgggaccaattagcacgttgtgggaagggaatccaggtcgattctggaatacaactatcgcagtatcaatggccaatatatttaggggtagctacctagcgggagcagggctgttgttctctatcatgaaaaatacaacgaatacaagacggggaacgggaaacattggagaaacacttggcgaaaagtggaaaagccgacttaacgccttgggtaaatcagagttccaaatctataagaagagtggtatacaagaagttgatcgaactcttgcaaaagaaggaatcaaacgaggagaaacagatcaccatgcagtgagccgaggtagtgcaaaattacgttggtttgttgaaagaaatatggtaaccccagaaggtaaagtagtagacctagggtgcggacgtggaggctggagctattattgtggcggattaaagaacgtcagggaagtaaaaggtttaacgaaaggaggaccaggtcacgaagaaccagtgcccatgtctacttatggttggaatctagtgaggcttcaatctggagttgatgtattcttcacaccccctgaaaaatgcgatacacttttgtgcgacatcggggaatcgtcacccaatccaacaatcgaagccggaagaactttaagagtactcagtttagtagaaaactggttaaataacgatacccaattctgcataaaagtactaaatccatatatgcctagtgtcatagagaaaatggaaacgttgcaaagaaaatatggcggagccctagtacggaatccattgtcgagaaacagcacacacgagatgtattgggtatcaaatgcaactgggaatatcgtaagcagtgtaaacatgatatccagaatgctcataaatagatttacaatgaaacataagaaggccacttatgaaccggacgttgatctaggctccggcaccaggaacatcggaattgaaagcgaaattcccaatttggacataataggtaagagaattgagaagatcaagcaagagcatgagacaagttggcactatgaccaggaccatccttataaaacatgggcttaccatggaagctatgaaacaaaacaaacaggatctgccagttcgatggtcaatggggttgtgcgtcttcttacaaaaccttgggacgtcgtccctatggtaacccaaatggctatgacagatactacaccatttggacaacaacgagttttcaaagaaaaggtagatacaagaacccaggaaccaaaagagggaaccaagaaactaatgaaaataacagcagagtggctgtggaaggagctcggcaagaagaaaacgccacgtatgtgtacgagagaagaatttacccgtaaggttagaagtaatgcagcactaggagcgatatttactgatgaaaataagtggaaatctgctagagaagcggttgaagacagcagattttgggaattagtagataaagaaagaaaccttcatttagaaggaaaatgtgaaacatgcgtgtacaatatgatggggaaacgagagaagaaactaggggaatttggtaaagcgaaaggaagcagggcgatatggtatatgtggcttggagccagattcttagagttcgaagctctggggtttcttaacgaggatcattggttttcaagagaaaactctctatcaggtgttgaaggagaggggctacacaaacttggttacattttgagagatgtatcaaagaaagaaggtggtgctatgtacgccgatgatacagctggctgggatactcggattactctggaagatttgaaaaacgaggagatggtaactaatcacatggaaggtgaacacaagaaattagccgaggcaattttcaaacttacgtatcaaaataaagtagtccgagtccaacgacccacaccacgaggcactgttatggatatcatttcacgacgcgaccaaaggggatctggccaagttgggacgtatggattgaacacattcaccaacatggaagcacaattaataagacaaatggagggggaaggtatttttaaatcgatacaacacctgacagtaacagaggagattgcagtacaaaattggttagctcgtgttggtcgagaaagactttctagaatggctatcagcggagatgattgtgttgtcaagcccctcgatgatcgtttcgcgagcgcattgacggcactgaatgatatggggaaagtcagaaaggacatacaacaatgggaacccagtagaggatggaatgactggacgcaagtaccattttgctctcaccattttcatgagctaataatgaaagacggccgtgttctagtagttccctgcagaaatcaagatgaactgataggcagagcaagaatttcgcaaggagctggttggagtctcaaagagactgcatgtctaggtaaaagttatgcccagatgtggtcgctaatgtattttcatagaagagatctccgtcttgcagctaatgctatatgttctgccgtgccatcacattgggtcccaacctccaggacaacgtggagcatacacgcaaaacacgaatggatgaccacagaagatatgcttacagtctggaacagggtttggatacaagaaaatccttggatggaggataaaacaccggtagaatcatgggaagaagttccctatctgggaaaaagagaggatcaatggtgtggaagtcttatagggctcaccagccgtgctacatgggccaaaaatatacagacggcaataaatcaagtaagatctttaataggaaatgaggaatacaccgattatatgccgtcgatgaagagattcagacgcgaagaagaagaagctggcgttctgtggtaa

SEQ ID NO: 22763 - RNA, 9876 nt, synthetic construct
  misc_feature 1..9876: note = derived and/or modified CDS sequence (opt6) from DENV-2__EU482779__SS-prME
  source 1..9876: mol_type = other RNA
actgccggtgtaataataatgttaattccaacagcgatggcttttcatttgaccacgagaaacggagaaccacatatgatagtaggaagacaagaaaaaggtaaatcactactatttaaaaccgaagacggagttaatatgtgtaccttaatggcaattgatttaggagaattatgtgaagataccataacgtataaatgtccgttgctacgtcaaaatgaaccagaagatattgattgttggtgcaactctacttcaacttgggttacgtacggtacctgtaccactactggagaacacagaagagaaaaacgaagcgtagctttagtaccacatgttggaatgggattggaaaccagaacagaaacttggatgtctagcgaaggagcatggaaacatgcccagaggatagaaacgtggatattacgtcatccaggatttacgattatggcagcgattcttgcatatactgttggaacaacacattttcaacgcgctttgatatttattttgctggcggctgttgctccatccatgacaatgaggtgcataggaataagcaaccgcgacttcgtagaaggggtcagcggaggaagttgggtagacattgtcttagaacatggatcgtgcgtaactacaatggctaaaaataaacctacgcttgactttgaattaataaaaaccgaagcaaaacagccagcaactctgagaaaatattgtatagaggcaaaactgacgaatacgaccacggagtcgagatgtccaactcagggtgaaccatcgctgaacgaagaacaggacaaacgattcgtatgtaaacattctatggtcgatagaggatgggggaatggatgtggtctgttcggaaaaggaggaatagtaacttgtgcaatgttcacgtgtaagaaaaatatggaagggaaaattgtgcagcccgaaaaccttgaatatacaattgtaataacaccacacagtggtgaagaacatgcagtgggaaatgacactggaaaacacggaaaagaaatcaaaattacacctcaatcaccgatcacagaggccgaacttacaggatatggcactgtgaccatggaatgttcacccagaactggcctagatttcaatgaaatggttttactacaaatggaagacaaggcctggttagtacacagacagtggtttttagatttaccattaccctggcttccgggtgcagatacacaaggaagtaactggatacaaaaggaaacattagtcacatttaaaaacccccatgccaagaaacaagacgttgtggtgttaggctcacaagaaggtgctatgcatacagctctcacgggtgctacagagatacagatgtcatccggtaatttgctgtttaccggacacttgaagtgcaggctcagaatggataaacttcaattaaagggcatgtcgtattccatgtgtaccggaaaattcaaaatagtaaaggagatagccgaaactcaacacggaaccatagttattagagttcagtacgaaggcgatggtagtccctgtaaaataccatttgaaattatggatctcgagaaaagacacgtcttaggaagactgattactgttaaccccatagtgacagaaaaagacagtccggtcaatattgaagcggaaccaccattcggagatagttatataatcatcggtgtcgaaccaggacagttgaaattaaattggttcaagaagggttcgtcgattggacaaatgttcgaaaccacaatgagaggcgccaaacgtatggctatcttaggggatacagcctgggacttcggatctctaggcggtgttttcacaagtattggcaaggcacttcatcaagtatttggggcgatttacggggcagcattttccggagtatcgtggaccatgaaaattttgataggagtaataatcacctggattggaatgaatagccgatcaacaagcctaagtgttagcttagtactcgtgggcgtgataacgttgtacttaggagctatggtgcaagcagactcgggctgcgtcgtatcttggaaaaacaaggagcttaaatgtggatcaggaatctttatcacagataacgttcacacatggacagaacagtacaaattccagcctgagtctccatcaaaattagcctctgctatacagaaggcccacgaagaaggaatttgtggaataagaagtgtaacgagattagaaaacttaatgtggaaacagataacaccggaattaaatcacatcctaagtgagaatgaagtaaaacttaccataatgacaggagatataaagggtattatgcaagctggcaaacgaagtctgagaccacaacccacagaattgaaatattcttggaaaacatggggaaaagcaaaaatgttaagtaccgaaagtcataaccaaacctttttgatcgatggaccagaaacggcagaatgtccgaatacgaatagggcttggaatagcctagaggttgaagattatggattcggtgttttcacaacaaacatctggttaaaacttcgtgagaaacaagatgtattctgcgactctaaattaatgtctgcagctattaaagataacagagcggtccatgctgatatgggttattggattgaaagtgccctgaacgatacatggaaaatggaaaaagcatcctttatagaagtgaaatcctgtcattggccgaaatcgcacactttatggagtaacggcgtgcttgaatctgaaatgataatacctaaatcatttgcaggacccgtgtcacaacataactacagacccggctactacacgcaaacagcggggccatggcatttaggaaagctcgaaatggacttcgacttttgtgaaggaaccacagtagtggtcacagaagattgcggcaatcgtgggccgtctcttagaaccaccacggcctcaggaaaacttataacagagtggtgctgccgtagttgtacattgccacccttgcgctaccgtggtgaggacggttgctggtatggaatggaaatccgtccattgaaagagaaagaggagaacctcgtaaactcattagtaacagcagggcacggtcaaatcgacaacttcagtttgggagtcttaggcatggcattgtttctggaagaaatgctgagaactagagtcggaactaaacacgcaatcctgttagtcacggtaagttttgtcactttaataactggaaatatgtcattcagggaccttggcagagttatggtaatggttggtgctgcaatgacagatgatatcgggatgggagttacctatttagcacttcttgctgcatttaaagtgaggcctacgtttgcagcaggattactgctccgaaaactgaccagtaaggaattgatgatggcaacaataggcattgcactcctatcacaatcaacaatccctgagactattttagaactaacagatgcattagcgttgggtatgatggtactaaagatagtgaggaatatggaaaagtaccaactagcagtcactataatggccatcagctgtgtaccgaatgctgtgattttacaaaacgcatggaaggtatcctgtactattctagcagcggtatccgtctcaccgttattactaacttcaagtcaacaaaaagcagattggatacccctggccctcactataaaggggttgaatcctacagctatatttcttactacactttcgcgcacttctaagaaaagatcatggcccctcaatgaggcaataatggccgttgggatggtttccatactagcatcttcgctactcaaaaacgacattccaatgaccggccctttagtagccgggggattattaacagtatgctacgtactaactggtcgaagcgcggatctagagctagaacgtgcgaccgatgtgaaatgggaagatcaagcagaaatttctggatcatcccccattttaagtataaccatagcggaggacggtagtatgagtatcaaaaatgaagaagaagaacagacgctaacaatcctaattcgaacaggattattagtaatatcgggcctcttcccagtcagcataccaatcacagcagcagcatggtatctatgggaagtgaaaaagcaaagagcaggcgttttatgggatgttccctctccgcctccagtaggaaaagctgaactggaagacggtgcctataggataaagcaaaaaggaatattagggtattctcagataggggcaggagtgtacaaagaaggaacctttcataccatgtggcatgtcactcgcggagccgttctaatgcatagagggaagagaattgaaccatcgtgggcagatgtcaagaaagacctaatctcgtatggtggaggttggaagctcgaaggggaatggaaagaaggggaagaagtacaggttctagccctagagcctggcaaaaatccaagggcagtccagacgaaaccgggcctctttaaaacaaatactggaactatcggagctgtaagtttggacttctctccgggaacaagtggaagcccaatagtagatcgaaagggaaaggtcgtcggattatacgggaatggcgttgttactagatcaggagcctatgtttcggctattgcccagacagaaaagagcatagaagataacccagaaattgaagacgacattttcaggaagaaaagactaaccataatggatctccaccccggtgcaggtaaaacaaaaaggtacctccctgctatagtaagagaagcaattaaaagggggctaagaactttaatcttagcacctacacgagtagtagcggcagaaatggaagaagcgctcagaggattaccaattagatatcaaactcctgccataagagcagaacatacaggtagagaaatagtagatcttatgtgtcatgcaactttcactatgcgtttactgagtcccgttcgcgttcctaattacaaccttataattatggatgaagcacattttacagatccggcaagtatagcggcccgtggatatatttcgactagagtagaaatgggagaagctgccggtatatttatgacagcaactccaccaggttcacgagacccatttccccaaagcaatgccccgataatggacgaagaacgagaaattccagaaagatcatggaactcaggacacgaatgggtaaccgattttaaggggaagacggtgtggtttgtacccagcataaaagcggggaatgatatagcggcatgtctaagaaagaatggcaagaaagtaattcaactgagtcgaaaaacctttgatagtgaatacgtaaaaactagaacaaacgactgggacttcgttgtaaccactgatattagtgaaatgggagcaaactttaaagcagaaagagtaatagacccgaggcgatgtatgaaacctgtcattttaacggatggtgaggagcgagtgatactggccggtccgatgcctgtcactcacagctctgcggcacaaagaaggggtcgtattgggcggaaccctaagaatgaaaatgatcagtatatatatatgggagaaccgctagaaaatgatgaggattgcgcgcattggaaagaggcaaaaatgctattagacaatattaatacacctgaaggaataataccatcgatgtttgagccggaaagggaaaaagtagacgctatagacggcgaatatagattacgtggcgaagcgagaaaaacgttcgtcgacctcatgcgaagaggagacctacctgtttggctggcctatcgagtggctgctgaaggaatcaactacgccgacagaagatggtgctttgatggggtcaaaaataatcaaattttagaagaaaatgtcgaagtggagatatggacaaaagaaggcgaaagaaagaaattaaaaccacgatggctagatgctcgaatttattcagacccgcttgcactaaaagaatttaaagagttcgcagccggacgcaaatctttaacccttaatctaattacagaaatgggccgattacccacctttatgacccagaaagcacgggatgccttagataatctggcagtcttgcatacagctgaagcgggaggcagagcctacaaccacgcgctgtcagaactaccggaaactctagaaactttactacttctaactcttctcgctacagtaacaggaggaatattcctgtttcttatgagcggaaaaggtgtagggaaaatgacactcggaatgtgctgtattataacagcgtcaatcttgttgtggtatgcacaaatacaacctcattggatagctgcatcaataatactggagttctttctaatcgtgctattgattccggaacccgagaaacagagaactccgcaagataaccaactaacatacgtcgtaatcgctatcttgaccgtagtagcagcaacaatggcaaacgaaatgggctttctagagaaaactaagaaagatctgggcctaggcagtatcgcaacccaagaaccggagagtaatatattagacattgacttacgtccggctagcgcatggaccttatatgctgtggcgactactttcgtcactccaatgttaaggcattccattgaaaatagctcggtgaacgtatcactgactgcgatcgcaaaccaagctaccgttctgatgggtttaggtaaaggatggcccttgtcaaaaatggatataggagtcccattactagctattgggtgctatagtcaagttaaccccattaccctaactgcagccctacttttgcttgttgcgcattatgccataataggacctggactacaagcaaaagcaactagagaagcacaaaaacgggcagctgccgggataatgaaaaaccccactgttgacggtgtcacagtcattgatttagaccccattccctacgatccgaaatttgaaaaacagctgggacaagttatgttgttaatattgtgtgtaacccaagtattgatgatgagaacgacttgggcactgtgcgaagcattgactttagcgacaggccccataagcacactatgggaaggtaacccgggcagattctggaataccacgatagctgtgagtatggcaaacatttttagggggtcatatctagcaggggccgggttattgttcagtatcatgaaaaacactacaaatacaagaagaggtactggaaatataggagaaactttgggagagaagtggaaaagccgtctcaacgccttaggaaaatcagaatttcaaatatacaagaagtctggaatacaagaagtagataggacactcgcaaaagaggggattaaacgtggcgaaacagatcatcacgccgtgtcaaggggttccgccaagttaagatggtttgttgaacgcaatatggtaactccagaaggaaaagtcgtggacctaggatgcggtcgaggaggatggtcgtattattgcggagggcttaaagacgtcagagaggtaaagggattaacaaaaggtggccccgggcatgaagaacctataccaatgtcaacgtatggctggaatttggttcgtctgcagagcggtgtcgatgtcttctttactcctcctgagaaatgtgatacactgctttgcgacatcggagagtctagccccaatccaacgatagaggcagggaggactctaagagtcctttctctcgtagaaaattggctaaataatgatacgcaattttgcattaaggtattaaacccatatatgcccagcgttatagagaagatggaaacactacagcgaaagtacgggggtgctctagtgcgaaatcctctaagtagaaattccacgcacgaaatgtattgggtaagcaatgcaacagggaacatcgtatcatcagtaaatatgattagcagaatgctgattaacaggtttacaatgaaacataagaaagctacttatgaacctgatgtagatttgggctcaggaactcggaatattggaatcgagtccgagattccaaatttagatataattggtaaaagaatagagaaaataaaacaagagcatgaaaccagctggcattacgatcaggaccatccgtataagacttgggcatatcatgggagctacgaaacaaagcaaaccggcagtgcaagctcaatggtcaatggcgtggttcgtttactcacaaaaccctgggatgttgtaccgatggttacccaaatggctatgacagacacaacaccatttggacagcaacgtgtgttcaaagaaaaagttgacactcgcactcaagaaccgaaagagggcaccaagaagttaatgaaaatcacagctgagtggctatggaaggaattagggaagaagaaaaccccacgaatgtgtacaagagaggagtttactagaaaagtgaggtcaaatgctgcgctaggagccatatttactgacgaaaataaatggaaatcagcaagggaagcggtggaagatagcagattttgggaactcgtagacaaagagagaaatctacacttagagggaaaatgtgaaacgtgtgtttataatatgatgggaaaacgtgagaaaaagttaggagagttcggcaaggcaaaaggttcaagagcaatatggtatatgtggttaggcgctagatttcttgagttcgaagctctagggtttttgaacgaagatcattggttcagccgtgaaaatagtttgagtggagtagagggagaaggtctacacaaattaggttatatactgcgtgacgtctctaagaaagaaggaggcgcaatgtatgcagacgataccgcaggttgggatacaagaataacgttagaagaccttaagaacgaagaaatggtaacgaatcacatggaaggtgagcataaaaagttagcagaagcaatatttaaattgacataccaaaataaagtggtccgagttcaaaggcccaccccgagaggaacggttatggatattatttctcgtagggatcaacgaggctctggccaagtcggtacatatggcctaaacacatttactaacatggaggcccaattaatccgacagatggaaggggaaggagttttcaagtcaatacaaaggttaacagtaacagaagaaattgccgtacaaaattggctagcacgagtagggagagagcgattatccaggatggcaatcagcggagatgactgtgtagttaaaccattagatgaccgatttgctagtgctcttaccgcacttaatgatatgggaaaagttcgcaaagatatacaacagtgggagccatccagaggatggaacgactggacacaggtcccattttgctctcatcactttcatgaactgatcatgaaggatggacgagttctagtcgtcccatgccgtaatcaggacgagctaataggtagagctcgaataagtcaaggggcaggctggagtcttaaggaaacggcgtgtttgggcaaaagttatgcacagatgtggagtctgatgtatttccatcgacgagacttaagactcgctgcaaacgcaatctgttctgctgtaccatcacactgggtacctactagcagaaccacatggagtattcatgcaaaacacgaatggatgacaacagaagacatgttaactgtatggaatcgagtatggatacaagaaaatccctggatggaggataaaactccggtcgagagctgggaagaagtgccatacctggggaaaagggaagatcaatggtgtggcagccttataggactgacctcaagggctacttgggccaagaatatacaaactgccataaatcaagtgcgaagtttgattggaaatgaggaatatacagattatatgcctagcatgaagcgctttagaagagaagaagaagaagcaggggtattgtggtaa

SEQ ID NO: 22764 - RNA, 9876 nt, synthetic construct
  misc_feature 1..9876: note = derived and/or modified CDS sequence (opt6) from DENV-2__EU482780__SS-prME
  source 1..9876: mol_type = other RNA
acagctggggtgattataatgttgatacctacagcaatggcgtttcatcttaccacgagaaatggagaacctcacatgattgtgggaaggcaagaaaaaggaaaaagtcttttgtttaaaactgaagacggtgtaaatatgtgcaccttaatggcgatagacctcggagaattatgcgaagatacaattacttacaaatgccctttgctacgacaaaatgaaccggaggatattgactgctggtgcaatagtacaagtacatgggttacatatggtacatgtaccactacgggagaacatagacgggagaaaagatcagtagcactggtacctcacgttggaatgggattagaaactagaacagaaacttggatgagcagcgaaggagcgtggaaacatgctcaaaggatagagacgtggatactacgccatccaggattcactataatggcagcaatattagcgtatacggtaggaacaactcactttcagagggcactaatcttcatccttttagcagctgtagccccatctatgactatgcgatgtattggaattagcaatagagatttcgtagaaggggtatcagggggctcatgggtagatatagtgcttgaacacggttcctgtgtaactacaatggctaaaaataaaccgacacttgattttgaactcataaaaacagaagcaaaacaaccagctaccctaagaaaatattgcatcgaagctaaactaacaaatactacaacagaatcgagatgtccaactcaaggagagccatcactaaatgaagaacaagacaaacgctttgtttgtaaacattccatggtggataggggttggggtaatgggtgtggactatttggtaaaggagggatagtgacttgtgccatgttcacatgcaagaaaaatatggaagggaaaatagtccaaccggaaaatttagaatatactatcgttattacgccccattcaggtgaagaacatgcagtggggaatgacacaggaaaacacgggaaagagattaaaataacccctcaaagcccaatcactgaggcagaattaacaggatacggtactgtaaccatggaatgttcaccacgaactggcttagattttaatgaaatggtactactccagatggaagataaagcctggctagtacataggcaatggtttttagatcttccacttccctggctacctggagctgatacccaaggatctaactggatacaaaaagaaaccttagtaacttttaaaaacccacatgcaaagaaacaagatgtagtagtattaggaagtcaagaaggagcgatgcatacagctcttacaggcgcaaccgaaatacaaatgagttctggcaatctattatttacaggacatttaaaatgccgcctgcgaatggataaactacaactaaaaggcatgagctacagtatgtgcacaggaaaatttaaaatagtaaaagaaatcgcagaaactcaacatggaacaatcgttataagagtacaatatgaaggtgatggatcaccttgtaaaataccatttgaaattatggatcttgagaaaagacatgtcctagggcgactcatcacagttaatcctatcgtaaccgaaaaagattcacccgtaaatatagaagctgaaccacctttcggagattcttacatcattatcggtgtggaaccgggccagttaaaattgaactggttcaaaaaggggtcaagtataggacagatgtttgagaccactatgagaggcgctaaacggatggccatactcggggacactgcttgggactttggctcactaggtggagtgtttacatcgatcggtaaggcgcttcaccaagtttttggtgcaatatacggagccgcattctccggagtatcctggacaatgaaaatattaataggcgtcattataacttggataggcatgaactctcgatctacaagtctatctgtgtcattagtcctagtaggcgttatcacattatatctgggagccatggtgcaagcagattcaggttgtgttgttagttggaaaaataaggaacttaaatgcgggtcgggaatattcattacagataacgtgcacacatggacggaacaatacaaattccaaccagaatcaccgtcaaaacttgcctcagcaatccaaaaagcacatgaagagggaatttgcgggatcagatcagtaacgagattagagaatttaatgtggaaacaaatcactccagaactaaaccatatactttcagaaaatgaagtcaagctcactatcatgaccggagatataaaaggcatcatgcaggcaggaaaaagaagcctgcgaccgcaacctacagagctgaaatactcatggaagacgtggggaaaagcaaaaatgctaagtacagaatcgcataaccagacgtttttaatagacggtccggaaacggctgaatgtcccaacaccaacagagcatggaactctttggaagtagaagactatggattcggcgtattcactacgaatatttggctaaaactacgagaaaaacaagatgtattttgtgatagcaaattaatgtcagcagcaataaaagataatagagcagtccatgctgacatgggttattggatagagagtgccctcaatgatacttggaaaatggagaaagcgagctttatagaagtaaagtcatgccattggcctaaatcgcacacactttggagtaacggagttctcgaatccgaaatgatcattcctaagtcatttgcagggcccgtttcccagcataactaccgaccaggatattatacgcaaactgcaggaccttggcatctgggaaaactagagatggactttgatttttgtgaaggtacaacggttgttgtaacggaagattgcggaaaccgaggtccgtccttaagaaccacaacagcatccggaaaattaataacagaatggtgctgtaggtcatgtactcttccacctctaagataccgaggtgaagatggttgctggtacggtatggaaatcagaccattaaaagagaaagaagaaaacctagtaaattctctagttacagccggtcacggccagatagacaatttctctctaggtgtcttaggaatggcactctttctcgaagaaatgctccgaacacgggtgggaactaagcatgccattttacttgtcacagtatcattcgtaaccctgataacaggtaacatgtcatttcgtgatcttggacgggtcatggtgatggtcggagcagcaatgacggatgacatcgggatgggagttacctaccttgccctgttagcagcatttaaagtacgacccactttcgccgcggggttactcttgagaaaactaacttcaaaagaattgatgatggccacaataggaatcgcacttctaagccaatccactataccagagacgatactagaacttactgacgccctggcccttggtatgatggtgcttaagatagtaagaaacatggaaaaatatcagttggcagttactatcatggcgatatcgtgtgtaccgaacgccgtaattttacaaaatgcttggaaagtgtcgtgtacaatattagcggcggtgagcgtaagtccactccttttaacaagttcgcaacaaaaagctgattggattcctttagcactaaccataaaggggctcaacccaacggcgatctttctaacgacactatctagaactagcaagaaacgatcctggccattaaacgaggcaattatggcagtgggaatggtgagcatcctcgctagctcactactaaagaatgacattccaatgacgggacccttagtagccggagggctattgaccgtttgttacgtccttactggaaggtctgccgacctagaactagaacgagcgacagacgttaaatgggaagatcaggctgaaatttcaggatcatcaccaattcttagcataacaatagccgaagatggaagtatgagtattaaaaatgaagaagaagaacaaacacttactatattaataaggaccggattactggttatatccggattgtttcctgtctccatacctattacagcagctgcatggtatttatgggaagtcaagaaacagagagcaggagtgctctgggatgtcccatccccgccgccagttggaaaagctgaattggaagacggtgcatatcgtatcaagcaaaaaggaatattagggtactcccaaataggagccggcgtatacaaagaggggacttttcacacaatgtggcacgtgacaagaggagcggtattaatgcacaggggtaaaagaatagagcctagctgggcggatgtgaagaaagatttaatatcctacggcgggggctggaaattagaaggagagtggaaagagggagaggaagtccaagtactagcactggagccaggcaaaaacccacgcgcagtccagacaaagccgggcttgttcaaaacaaatactggaacaattggagccgtatcattagacttcagtcccgggacaagcggatcaccaatagttgacaggaaaggtaaagtggttggtttatatggaaacggagtcgtaacacgaagtggtgcgtatgtttccgcaatcgcacaaactgaaaaatcaatcgaagataacccggaaatagaagacgacattttcagaaagaaaagattaactattatggatctacatcctggcgctggtaaaacaaagcgatatttaccggcaatagtacgtgaggccattaaacgcggccttagaacactaatactagctccgacacgagtagtagcagcagaaatggaagaggcattaagaggcctgcctataagataccaaactccagccatacgcgcagagcacactgggcgcgaaattgtagatcttatgtgtcatgcaacattcactatgcgattattatcaccagtaagagttccaaattataatctaataattatggacgaagcacatttcacggacccagccagcattgcagcgagaggatatatctcgacaagagtagaaatgggagaagcagctggcattttcatgactgctactccgccaggtagtagagacccgttcccccagagtaatgcacctattatggatgaagagagagagataccagaaaggtcatggaactcaggacacgaatgggtaacagactttaaaggtaaaaccgtatggtttgtaccttcaattaaagccggcaacgacattgccgcatgtttgcgcaagaacggaaagaaagtcattcaattaagtcgcaaaacgtttgactccgaatatgtaaagaccagaacaaacgactgggatttcgtggtcacaactgatatctcagaaatgggggcaaacttcaaagcggagcgagttatagatccgagaagatgtatgaaaccagtaatactgacagacggagaagagagagttatcctcgcgggtcctatgccagtgacccattcaagtgcggctcaacgtaggggccgaatcggtagaaatccaaagaacgaaaatgaccagtacatatacatgggagaacccctggaaaatgatgaagattgtgcccactggaaagaggctaagatgttgcttgacaacatcaatacgccagaaggcataataccttccatgtttgaaccagagcgagaaaaagtagatgcaattgacggagaataccgtctacgaggtgaagctcgcaaaacctttgttgacttaatgcgacgcggcgatctgcctgtgtggcttgcctatcgcgtagccgctgagggaataaactatgcagatagaagatggtgctttgacggagtcaaaaacaaccaaatactagaagagaatgtagaggtagaaatatggacaaaagagggggagaggaagaaattgaaaccacgatggctcgacgctcgcatttacagtgacccattagctttaaaggagtttaaagaatttgcggctggcaggaaatcactaactctgaacttaatcacggaaatgggacggttgccaacattcatgacacagaaggctcgagacgctttagataatttagctgtactacatacggccgaagcaggaggcagagcttacaatcatgcgctcagcgagctgcccgaaacattggaaactcttttgttactaacgttactcgccacagtaactggtggaatatttttatttctcatgtctgggaaaggagtggggaaaatgacactcgggatgtgttgtatcattaccgccagtattttactctggtatgctcagatacaacctcactggattgccgcttcaatcatattagagttctttctgatcgttttattaatacctgaaccagaaaagcaaagaacacctcaagacaatcaattaacatatgtggtgattgctatattgacagtcgtagccgcaaccatggccaacgaaatgggattcttagagaagaccaagaaagatctaggcttaggatcaatagccacacaagaacccgaaagtaatatcctagatatagatctcagacctgcatctgcatggacactatatgcagtggctaccacattcgtaactccgatgttacgacattcgatagaaaacagcagtgtaaacgtgtccttaacagcaatagctaaccaagcaactgttcttatgggactggggaagggctggccgctttcaaaaatggatattggcgtaccgctgctagcaattggatgttatagccaggtaaatccaattacactaacggcagctctcctcttgcttgtcgctcattatgcgataataggaccaggtcttcaggctaaggcaacaagagaagcacagaaaagagctgcagctggcattatgaaaaaccccacggtagatggagtaacggtaatagatttggacccaataccatacgatccaaaattcgagaagcaacttggacaagtcatgttattgatactatgcgtgacgcaagtcttaatgatgagaacaacctgggcgctttgcgaagctctgactttggccacaggacctattagtacgttatgggaaggaaaccctgggagattttggaacactactattgctgtaagtatggccaatatttttagaggttcatatttagcgggagctggactactatttagcataatgaaaaacacaacaaatacacgaagaggaactgggaatatcggcgagacactcggagaaaaatggaagtctcgtttaaacgcactgggtaaaagtgaatttcagatatacaagaaaagtgggattcaagaagtcgaccgaacattagcaaaagaaggaataaaaagaggtgaaacagaccaccacgcggtgtctaggggttcagccaaactcaggtggtttgtagaaagaaacatggtcaccccagaagggaaagtagtagacctaggctgtggtaggggaggatggtcatattactgtggaggtcttaaagacgtcagagaggttaaaggacttacgaaaggaggtccaggccacgaggagccgataccaatgagcacgtacggatggaatcttgtacggctacaaagtggcgttgacgtctttttcacaccaccagaaaaatgtgatacactgctatgtgacataggagagtcatcgcctaacccaaccatagaggcaggaagaactctaagggtactcagtctcgtagaaaattggctaaacaatgatacgcagttttgtatcaaggtgctcaatccgtacatgccctctgtcatagagaagatggaaacattacaaaggaaatacggtggtgccctcgtacggaatccattgagccggaacagcactcatgaaatgtactgggtatctaacgcaacaggcaacatagtaagtagcgttaatatgatatctcgaatgctaataaaccggtttacaatgaaacataagaaagcaacttatgaacctgatgttgacttaggcagcggcacacgtaatattggaattgaaagtgagatacctaacctagacatcataggtaaaagaatcgagaaaatcaaacaagagcacgaaactagctggcattatgatcaagaccatccttacaaaacgtgggcataccatggctcatatgaaactaaacaaactggatcagctagctctatggtgaacggggtagtacgtttactaactaaaccatgggacgtcgtaccaatggtaacacaaatggcaatgaccgacaccacaccgtttggacaacaacgcgtgttcaaagagaaagtagatacaaggacacaagaacctaaagagggaaccaagaaacttatgaaaataactgcggaatggttatggaaagaattaggcaagaagaaaacgcctcgcatgtgtacaagggaggagttcacacgtaaggtaagatctaacgcagcattaggtgcaattttcacagatgaaaataaatggaagtcagcacgggaagccgttgaagactcaagattctgggaattagtagataaagaacgtaatctgcatcttgaaggaaaatgtgaaacatgtgtctacaacatgatgggcaaaagagagaagaaactaggggaatttggaaaagcaaaaggttctagggctatctggtacatgtggttaggtgccagattcctagagtttgaagcgttaggcttcttgaatgaagaccattggtttagcagagaaaactctctcagtggagtggaaggtgaaggattacataaactagggtacatactaagggacgtgtccaagaaagaaggaggggctatgtatgcagacgatactgcgggatgggatactagaataacattggaagatcttaagaacgaagaaatggttacaaatcacatggaaggagaacataagaaactagctgaggcgatctttaaactcacataccaaaataaagtagtcagagtacaacgacctacaccaaggggtacagtaatggatattataagtcgaagagatcagagagggagtggtcaagtcggaacgtatggtctgaatacttttacaaatatggaagctcaactaataagacaaatggaaggggaaggagtttttaaatcaatacagcgcttaactgtgacagaagagatagcagttcaaaattggctagcgagggtagggcgggaacgcctctccaggatggcaataagcggagatgactgcgtcgtaaaaccactcgacgataggttcgcaagtgctttgacggccctgaacgatatgggaaaagtaagaaaagatattcaacaatgggagcccagtagaggatggaacgactggacacaagttccattctgttcgcatcacttccacgaattgatcatgaaagacggtcggatgttagtagtaccatgtcgaaaccaagatgaattaatcggtagagcccgtataagccaaggtgcagggtggtctcttaaagaaacagcatgtctaggcaagtcttacgcccaaatgtggtcgttaatgtattttcatcgcagagacctgagacttgcagccaatgccatttgcagcgcagtacctagccattgggtgccaacatcgcgtacgacttggtctattcatgctaaacatgaatggatgactacagaggacatgctaacagtctggaacagagtatggatacaagaaaatccctggatggaagataaaacaccagtggaatcatgggaagaagtcccataccttggcaaaagggaggatcaatggtgtgggagcttaataggccttacgagtagggcaacgtgggccaaaaatatacaaactgccattaatcaagtaagatcacttataggaaatgaagaatatactgattatatgccttcgatgaagagatttagaagagaagaagaagaagcaggcgtcttatggtag

SEQ ID NO: 22765 - RNA, 9876 nt, synthetic construct
  misc_feature 1..9876: note = derived and/or modified CDS sequence (opt6) from DENV-2__EU482781__SS-prME
  source 1..9876: mol_type = other RNA
actgcaggggtaattattatgctaatccccacggcaatggcattccatcttactacacggaacggtgaaccgcatatgatagtagggagacaagaaaaaggaaaatcactattattcaaaacagaagacggagtgaacatgtgcactctaatggctatagacctaggtgaattatgcgaagacacaatcacatacaaatgcccactactccggcagaacgaaccagaagatatcgattgctggtgtaattctacttcaacatgggtgacatacggaacttgcactaccacgggagaacacagaagagagaaacgatcagtagccctagttcctcatgttggtatgggccttgaaacccgaactgaaacatggatgtcatcagaaggagcatggaaacatgcgcaacgtatagaaacatggatacttcgacatcccggttttacaataatggcagcaattctcgcatatacagtaggtacaacgcatttccaacgcgcacttattttcatattgctagcggccgtagcaccctcaatgacgatgagatgtattggcataagcaatagagactttgttgaaggagtatccggaggttcttgggttgatatcgtacttgaacatggttcttgcgtaacgactatggccaaaaataaacccactctagactttgaactaattaaaactgaagcaaaacaaccagcaaccttgcgaaaatactgcatcgaagctaaactaacgaacacaacaacagaatcaagatgccccacacaaggcgagccttcactcaacgaagaacaagataaaagattcgtttgcaaacactctatggtagacaggggatggggaaacggatgcgggcttttcggaaaaggagggatcgtaacctgtgcaatgttcacatgtaaaaagaatatggagggcaaaatagtacagccagagaatctggaatacacaatagtaatcacgcctcactcaggagaagaacacgcagtagggaatgacacaggaaaacatgggaaagaaattaaaataactccgcaaagccctataacggaggccgagttaactggatatggaaccgtaactatggaatgctctcctcgaactggattagattttaatgaaatggtattattacaaatggaggataaagcatggttagttcaccgtcagtggttcttagatctcccattaccatggcttccgggagcagatactcaagggagtaattggatacaaaaagaaactctggtgactttcaagaacccacatgcaaagaaacaggacgtagtagtgctaggaagccaagaaggggcaatgcacacggcactaaccggtgctacggagatacaaatgtcctctgggaatttgctatttacgggccacttaaagtgtcgcttgcgaatggacaagttacaacttaaagggatgagttatagcatgtgcacaggtaagtttaaaatagtgaaagaaatagcagaaactcaacatggaacaatagtcataagggtccaatatgagggagacggaagtccttgtaaaattccttttgaaattatggacctagagaaaaggcatgtattaggtagactgataacggttaatccaatagtaaccgaaaaagactcgccagtgaacatagaggctgaaccaccatttggtgatagttatataataattggtgttgagccaggtcaattaaagctaaattggtttaagaaaggctcgagtatcggacaaatgtttgaaacaacaatgcgcggcgcaaaacgaatggccattcttggtgatacagcgtgggactttggcagtctgggcggagtatttacaagtattggaaaagcactgcaccaagttttcggtgccatatatggtgcagcgttcagtggggtatcatggacaatgaagattttaataggagtcataataacatggataggaatgaatagccgttcaacatctctaagtgtatccttagttctagtcggagtcatcactctttatctaggggcaatggtacaggcagatagcgggtgtgtggtatcatggaagaacaaagaattaaaatgcggatctggtatttttataacagataacgtacacacgtggacagaacagtacaagtttcaaccagaaagcccttccaagctggcctctgcgattcaaaaagcccacgaagaaggaatatgtggtataagaagcgtgacccggctggaaaacctaatgtggaaacaaattacaccagagttaaatcacattttatcagaaaatgaagttaagttaacgataatgacaggagacattaaaggaataatgcaaccagggaagaggagcttaagaccacagccaacagaattaaagtactcatggaaaacatggggaaaagccaaaatgttatctaccgaaagccacaaccaaacctttttaattgatggaccagaaacagccgaatgtcctaacacaaaccgtgcatggaactcccttgaggtagaggactatgggtttggggtatttacaacaaatatttggttaaaattgagggaaaaacaggacgtcttctgcgattctaaattaatgtcggcagcgataaaagataatcgagctgtgcatgccgacatgggttattggatagaatcagcacttaacgatacatggaagatggaaaaggcatcctttattgaagtcaagtcttgccattggcccaagtcacatacgttatggtctaatggagttcttgaaagtgaaatgatcatacctaagagctttgcagggcccgtcagccaacacaactacagacctggctattatacacaaaccgcaggaccctggcatctaggcaaattagaaatggactttgacttttgcgagggaacaacggtagtagtaaccgaagactgtggcaatcgtggcccaagtcttaggacaacaacggcctccggaaaattaatcaccgagtggtgctgtcgttcttgtacactaccaccactgcgttatagaggggaggacggctgctggtacggtatggaaataaggccgttaaaagaaaaagaggaaaatttagtaaatagcctggtgacagccgggcacggacaaatcgacaacttttcattaggcgttttgggcatggcattattcttagaagaaatgctaaggacacgagtaggaactaaacacgcaatattattagtaacagtatcttttgttactctcataacgggaaatatgtccttcagggacctagggcgtgtcatggtgatggtaggagcagcaatgacagacgatatagggatgggcgtaacctatctagcacttttagctgcatttaaagtcagaccaacctttgcagcgggactactactaaggaaattaacttcgaaagaactaatgatggccaccattggtatcgctcttttatcacaatccactatacccgagacgattctagaactaactgatgcgttagcgttaggcatgatggtactaaagattgtaagaaatatggaaaaataccagcttgcggtaactataatggcgatcagctgcgtaccaaatgcggtaattctacagaacgcatggaaggtctcatgcacaatactcgccgcagtcagcgtctcccccttattgctgacaagtagtcaacaaaaagcagattggattccgctggcgctaacgatcaagggattaaacccgacagccatttttctgacaacactctcacgtacgtccaagaaacgttcatggccactaaacgaagcaataatggcagtagggatggtatcaatattagcctcgtcccttctcaaaaatgatattcctatgacaggaccacttgtcgctggtgggcttcttactgtgtgttacgtgctgacaggaaggtccgcagacctcgagttagagagggcaacagatgtgaaatgggaagaccaagcggaaatatcgggatcaagtccaatattaagcataacaatcgcggaagatggatcaatgtcaatcaaaaatgaggaagaagaacaaacattaacaattctcataaggactggactattggtaatctcaggattatttcctgtaagcataccaattactgcggcggcatggtatctgtgggaggttaagaaacaaagagctggagtactgtgggacgtcccgtcaccacccccagtaggaaaagctgaacttgaagatggtgcctataggataaagcaaaaaggtatactaggatatagccaaataggggcaggagtctacaaagaaggcactttccacacaatgtggcatgtaacacgtggagctgtattaatgcatagaggaaagagaattgaaccatcttgggcagatgtcaagaaagatcttataagctatggcggcggatggaagctggaaggcgaatggaaagagggtgaagaggtacaggttcttgctctggaaccagggaaaaatccgagggccgtacagacaaaaccaggactcttcaagactaacacaggtactataggagcggtctctctcgatttttcacctggtacctctggaagccctatcgttgaccgaaaaggaaaagtagtagggctttatggtaatggagtagttacacgtagcggagcttatgtatccgctattgctcaaaccgaaaaatcgattgaggacaaccccgaaatagaggatgatatattcagaaagaaacggcttactatcatggatctacatccaggcgctggcaaaacaaaaagatatttgccagccatagtgcgagaagctataaaacgaggtctccggacactaattttggccccaacgagagttgtagctgcggaaatggaagaagcacttagaggcctcccaattaggtatcagacacccgccattagagctgagcatacgggtagagaaattgttgatttaatgtgccatgctacgttcaccatgagactgttatccccagtaagggtacctaactataatctgattatcatggacgaggcacatttcacggatcccgcttcaatcgcagctagaggatatatctccactagggtagaaatgggagaagcggcgggcatcttcatgacagccacaccacctggtagtagagacccatttccgcaaagcaatgcgcctataatggatgaggaacgggagataccggaaagaagttggaatagcggacatgagtgggtaactgacttcaaaggaaaaaccgtatggttcgtgccatcgattaaggccggaaacgatatagcagcatgtctacgcaagaatggcaaaaaggtaattcaattatctcgcaaaacattcgactcagaatacgttaaaaccaggactaatgattgggattttgttgtaacaacagacattagtgaaatgggcgcgaattttaaagctgaaagagtgattgacccacgacgatgtatgaagccggtaatacttactgatggagaggagcgagtaatattagccggtcccatgcctgttacacatagctcagcagctcaaagacgcggaagaataggtagaaatccgaagaacgagaacgatcaatatatttacatgggagaacctctcgaaaacgatgaagactgcgcgcattggaaagaggcaaaaatgttgcttgataacataaatacacccgaaggaattatcccatccatgttcgaaccagaacgggaaaaggtagatgctatcgacggagaatacagattacgtggtgaagcacgtaaaacatttgtcgacttaatgaggcgtggcgacttgccggtctggttggcttaccgagtcgccgctgaaggaattaattatgctgaccgaagatggtgtttcgatggtgtcaaaaataaccaaatcttagaagagaatgtggaagttgagatttggacaaaagaaggagaaagaaagaaattaaaaccaagatggctagatgctagaatctattctgatcctttagctttaaaagaatttaaggaatttgctgctggtcggaaatctttgacgttaaacttaataaccgaaatgggacgacttccaacctttatgacccagaaagccagagatgctctagataacttagcggttcttcatacagctgaggccggtggacgggcatacaatcatgctttaagcgaactgccagaaacactggaaacattattactgttgacgcttttagcaacagtcacaggaggcatatttttatttctgatgtcgggcaaaggggtaggaaaaatgactttaggtatgtgttgcataataaccgccagcatattattatggtatgcacaaatacagcctcattggatcgcggcgtcgattatccttgagttctttttaattgtacttttaattcctgaaccggaaaaacagaggacgccacaagataaccaattaacgtatgtagtaatagcgatacttacagttgtcgctgccacgatggcaaatgaaatggggtttttggagaaaactaaaaaggatttgggattaggatctatagctacacaagagccagaaagcaatatattagacattgacttacgacccgcatctgcatggactttgtacgcagtagcaaccacattcgtaacacccatgctaaggcactcgattgaaaacagctcggtgaacgtctcattaacagccatagcaaatcaagcaacagttctaatgggattaggcaaaggatggcctctgtccaaaatggacattggagtgcctctcctggcaataggctgctattcgcaggttaatcctataacattgactgcagcacttcttttgctagttgcacattatgcaattattggacctggactccaagcaaaagcaacacgagaggcccaaaaacgtgcagcggctggcataatgaaaaatcccactgtcgatggcgtaaccgtcatagatttagaccctataccctacgacccaaaatttgagaaacaacttggccaggtcatgttgttaatcctatgcgttactcaggtactaatgatgagaactacttgggcattatgcgaagccctgacactcgcaacagggccaatatccacactgtgggaaggaaatccaggacggttctggaacacaactatagcagtatcaatggcaaacatatttagaggcagttacctcgccggtgccggtctcctgttctcaataatgaaaaatactacaaatacacgccgaggaactggtaacattggtgaaacactcggagagaagtggaagagtcgtttgaatgcgctaggcaagtcggaatttcaaatttataaaaagtccggaatacaagaggtcgacagaactttagccaaagagggtattaaacgaggcgaaactgaccaccatgcagtatcgcggggtagcgcaaaacttagatggtttgtcgaaagaaatatggttacccccgaaggaaaagtggttgatctaggttgtggtagaggtggttggtcatattactgtggagggctaaaagatgttagagaagtgaaaggcttaactaaaggtggccctggacacgaagaaccaataccaatgtctacctatggttggaacctggtgagattacagtcaggcgtagatgtattctttacgcctccagaaaaatgtgacactttgttgtgtgacatcggcgaatctagccctaatcctactatagaagcaggaagaacattaagggtgctgtcgttagttgagaactggttaaataatgatactcaattttgtattaaagtattgaacccttatatgcccagcgtaattgagaaaatggaaacgctacaacgtaaatacggaggggcattggtacgaaatccgctatcacgaaatagtacacatgaaatgtactgggtatcaaacgcaactggaaatatagtatcttcagttaatatgatatctagaatgctcataaatagattcacaatgaaacataagaaagcgacctatgagccggatgtcgatctgggttctgggacaagaaacatagggattgaaagcgaaattcctaacttagatatcataggtaaacgtatagagaaaataaaacaagaacacgaaacctcgtggcattacgaccaagatcatccctacaaaacttgggcatatcatgggtcttatgaaactaaacagactggatctgcctctagtatggttaatggcgtcgtgcggctactcacaaaaccatgggatgtggtcccaatggtaacacaaatggccatgacagatacgacacccttcggccaacaaagggtcttcaaggaaaaagtagataccaggactcaagaacccaaggaaggaacgaagaaacttatgaaaataaccgcagaatggctatggaaggaattgggaaagaagaaaacaccccgaatgtgcacacgtgaagaatttacccgcaaagttcgaagtaatgctgctttaggagcgatcttcacagacgagaacaaatggaaaagtgctcgagaagcagtagaggactctcgcttctggaagctagtagacaaagaaagaaacttacatctagagggtaaatgcgaaacctgtgtatacaatatgatgggcaaacgcgagaagaaattgggcgagtttggaaaagctaaaggttcccgagcaatttggtatatgtggctcggagctaggttcctagaatttgaagctctaggatttttaaacgaggaccactggttttccagggaaaacagtctctcaggagtagagggagaagggttacacaaactaggatacatactacgtgatgtgtctaaaaaggaagggggcgctatgtatgctgatgatacagccgggtgggatactcgtattactcttgaggatcttaagaatgaagagatggtaactaatcatatggagggagaacacaagaaactagccgaggcaatttttaagttaacttatcaaaacaaggtagtaagggtacaacgtccaacgccaagaggtacggtaatggacattatatctagacgagatcagagaggaagcggacaagtgggcacatacggattaaatactttcaccaatatggaagcgcagttaattaggcaaatggaaggagaaggagtgtttaaaagcatccaaaggctaacagtcaccgaagaaatagcagtacaaaattggctagcacgagtgggccgtgaaaggttaagtcgaatggcaatatcaggcgatgattgcgtagtaaaaccattagacgaccgttttgctagcgcgctaacagctttgaatgatatgggaaaagttcgaaaagatatacaacagtgggaaccatctagaggctggaatgattggacacaagtacccttctgtagtcaccacttccatgaactaataatgaaagacgggagggtcctagttgttccgtgccggaatcaggatgagttaatcgggcgagcccgaatatcacaaggcgctgggtggtcccttaaagagacagcctgcttgggaaaaagttacgcgcaaatgtggtcgcttatgtattttcaccgccgagatttacggttagcggcaaacgcaatatgctctgcagttccatcccattgggtgccaacatctcgtacaacgtggagcattcatgcaaagcatgaatggatgacaacggaggatatgctaacagtctggaatagggtatggatacaagagaatccgtggatggaggataaaacaccagtcgagtcttgggaagaagtaccatatttaggcaaaagggaggaccaatggtgtggtagccttataggcctgacctccagagcaacgtgggctaaaaatattcaaacagctataaaccaagtccggagcctaatcggaaacgaagaatacacggattatatgccttctatgaagcgattcaggcgagaggaggaagaggccggagttttatggtaa

SEQ ID NO: 22766 - RNA, 9876 nt, synthetic construct
  misc_feature 1..9876: note = derived and/or modified CDS sequence (opt6) from DENV-2__EU482782__SS-prME
  source 1..9876: mol_type = other RNA
agcgcagggatgataattatgttaataccaaccgttatggcctttcatttgaccactcgaaatggagaaccccacatgatagtaggaatacaagaaaaaggtaaatcactattatttaaaacagaagatggcgtgaacatgtgcacgctcatggcaatggacctaggagaattatgtgaagataccataacttataaatgtccacttctaagacaaaacgaaccggaagatatagattgctggtgcaacagtaccagtacctgggtaacctatggaacatgcaccacgaccggcgaacatagacgagagaaacgttcagtagctttagttccgcatgttgggatgggtctagaaacacgcacagaaacatggatgtcttcagaaggagcgtggaaacacgcacaacgaatagaaacatggatactgagacaccctgggttcactataatggcagccattttagcttatacaatcggaacaacccactttcaacgagtcttaatattcattctcttaacagcagttgcacccagtatgacaatgaggtgtatcggtatatcaaacagggacttcgttgaaggtgttagcggaggaagctgggtggatatagtattggaacatggatcttgtgtaaccacaatggcgaaaaataaaccaacattggactttgaactaattaaaactgaagctaaacaaccagcaaccttaagaaaatactgtattgaagcaaaactaacaaacactacaacagaatcacgatgcccaacacaaggcgaaccgtcactaaaagaagaacaagacaaacgatttgtgtgcaaacactctatggtggatcgagggtgggggaacggatgcgggttgttcgggaaaggcgggatcgttacttgcgctatgttcacatgcaagaaaaatatggaagggaaaatagtacaacccgaaaatttggagtataccattgtcgtaactccgcacagtggtgaagaacacgcagtaggtaatgacacaggcaaacatggaaaagaaatcaaagttacaccccaaagcagtataactgaagcggaattaaccggatatggcactgtaacgatggaatgcagccccagaacgggattggattttaacgaaatggtattactccaaatggaaaataaggcttggttggtacatcggcaatggtttcttgacttaccactaccctggctacccggcgccgataaacaggaatcgaactggattcaaaaagaaaccctcgtaacattcaaaaatccgcacgccaagaagcaggacgtggttgtattaggctcgcaagaaggggcaatgcacactgcgctgacaggagcaactgaaattcaaatgtccagtggaaacctgctctttactggccatctcaaatgtagattgcgtatggataaacttcaactgaaaggaatgtcatattcaatgtgtacaggtaaattcaaggttgtaaaagaaatagcggagacgcaacatggaactatagttattagagtgcaatatgaaggtgatggatctccgtgtaaaattcctttcgagataatggacctagagaaaagatatgtattagggcgcttaatcacggtaaatccaatagtaaccgagaaagacagtcctgtgaatatagaagccgaaccgccgtttggcgatagctacattataataggagtagaaccagggcaattaaagttaaattggtttaagaaaggatcctctattggtcaaatgtttgaaaccactatgagaggcgctaagcgtatggcaatcttaggcgacaccgcctgggattttgggtccttagggggagtctttacaagtattggcaaagctctccatcaagtattcggagctatttatggtgcggcgttctccggtgtttcctggactatgaaaatactaataggtgttataataacatggattggcatgaactctagatctacatcgctttcagtatctttggtcctcgtcggaatagtaaccctatacctcggagttatggtacaagcagattcaggctgtgtagtttcatggaaaaataaagagctaaaatgtggaagcggaatttttataacggacaacgtccacacctggaccgagcaatacaaattccaacctgaaagtccatctaaattagcttctgcaattcaaaaggcccaagaagagggaatatgtgggatacgtagcgtaacgcgtttagaaaatctgatgtggaaacaaataacccctgaactcaaccatatattagcagaaaacgaagtcaaattaacaatcatgaccggagatatacgtggaataatgcaagctggaaaaaggtccttgagaccccaaccaactgaactaaaatatagttggaagacatggggtaaggctaaaatgttgagtacagagagctataatcaaacctttcttattgacggtcccgaaactgcagagtgtccaaacacaaacagagcctggaatagcctagaagtagaagattatgggttcggtgtattcacgacaaatatctggttaaaattaaaggaaaaacaggacgctttctgtgatagtaaactaatgtcagctgcgattaaagacaatagagccgtacatgcagacatgggatactggatcgaatcagcgctaaacgacacatggaaaatagaaaaagccagctttatcgaagtcaaaaattgtcactggcccaaaagccacactctttggagtaatggagtgctagagagtgaaatgataatacctaaaaatttggccggaccggtctctcagcacaactatcgaccaggataccatacacagatagcaggaccatggcatttaggtaaactagagatggactttgacttttgtgatggcacaacagtgatagtcacagaagactgcggaaataggggcccttccctgcgaacgacgacagcgtccggtaaactcatcaccgagtggtgttgtcgttcatgtactttgccacccttacgctaccgaggcgaagacgggtgctggtatggaatggagatcagacctctaaaagaaaaagaagaaaacctcgtaaactccttagtcaccgctggccacggtcaggtagataacttttcgctgggggttcttggcatggctttgtttcttgaagaaatgttaagaaccagagtgggtacgaaacatgcaatcttattggtggcagtcagctttgtaactctaataacgggtaatatgagcttcaaagacctaggaagggtagtagtaatggtaggagctacaatggctgatgacattggaatgggagttacgtatttagcactccttgcggcattcaaagtccgtccgaccttcgtagccggattattgttaagaaaactcacatcaaaagaattgatgatgaccactatcggaatagttcttctgagtcagagtaccatacccgaaactgtactagaactaacggatgcattagcattaggtatgatggtactaaaaattgtccgaaatatggaaaagtaccagctagcagtaacaataatggctattctctgcgtacctaacgcagttattttacaaaatgcatggaaagtgtcatgtacaatacttgcagtagtatcagtaagtccattactcctgacaagctctcaacagaaaacagattggataccattagcgttaacaataaaaggcttaaatcctacagctatatttttaactactttatcaagaacaaataagaaaagatcatggccgcttaatgaagcaatcatggcagtaggtatggtctccattttagcaagcagtctgttaaagaatgatataccaatgaccggacccttagttgccggaggtttactaactgtatgctatgtgctaactggaagaagtgcggatctagagctcgaaagagcgacagatgtgaagtgggaggaccaagcagaaatctccggatcatctcccatcctcagtataactataagtgaggatggaagtatgtcaatcaaaaacgaggaggaagaacaaacactaacgatactaatcagaacagggctgctcgtgatctctggtttatttcccattagcataccgataacagccgcagcttggtacttatgggaggttaagaaacaacgagctggggtattgtgggacgtaccctcaccaccaccgatgggaaaggcagaattagaagacggtgcatacaggattaaacagaagggaatccttggatattcgcaaatcggagcaggggtctataaagaaggcacttttcacactatgtggcatgtaaccaggggtgcagtccttatgcataaaggaaagaggattgaaccaagttgggcagacgttaagaaagatctcattagctacggaggaggttggaagctagaaggtgaatggaaagaaggagaagaggttcaggtacttgccttagagccaggtaaaaatcctcgtgcagtccagacgaaacctggactcttcaaaacaaatacgggaacaataggtgctgtttccttagattttagcccgggtacatcaggttcacctataatagacaagaaagggaaggtcgtgggtttgtacggaaatggagttgtaacacgaagtggcgcatatgtatcggcaatagcacaaactgaaaagtctatagaagataacccggaaatagaagatgacattttcagaaagagaagacttacaataatggacctacatcctggagctggaaaaactaaaaggtatctaccagcaatcgtaagggaagctatcaaaaggggtctacgtaccctgatcctagcacctacacgtgttgtggcagctgaaatggaagaagcgctacgcggacttccgattcgttatcagactcctgctatacgagctgaacacactgggagagaaatcgtagatttaatgtgccatgcaacctttactatgcggttattatcgccagtccgtgttccgaattacaacttaatcattatggacgaagcgcatttcacagaccccgcaagtatagcagccagaggatacataagcacgagggtcgaaatgggcgaagcggcgggtattttcatgaccgcgacaccacccggttctcgggacccttttccccaatcaaatgctcccatcatagatgaagaaagagagattcctgaaaggtcatggaactcgggacacgaatgggtcacagattttaaaggtaaaacagtttggtttgttccttcgataaaagccggtaatgacatagcagcttgtttaaggaaaaatggcaaaaaggttatacaactaagccgaaaaacatttgacagcgaatatgtaaagacccgtacaaatgattgggacttcgtagtaactacagatataagcgaaatgggagcaaatttcaaagccgaaagggtaatagatccgagacgatgtatgaaaccagtaatacttacagatggtgaagaaagagtcatacttgctggaccaatgcccgtaactcacagtagtgcagctcaaagacgaggacggataggccgtaaccctaagaatgagaacgaccaatatatctacatgggggaaccacttgaaaatgatgaggattgcgcacactggaaagaggccaaaatgctacttgataatataaataccccagaaggaataatcccatcaatgttcgaaccggagagggagaaggttgacgccattgacggtgaatatcgcttaaggggcgaagcgaggaaaacgtttgtggacttaatgcgaagaggtgatttacctgtctggttagcatacaaagtagcagctgagggaattaattacgcggacagacgatggtgttttgatggaattaaaaacaatcaaatactggaagaaaatgtagaagttgagatctggaccaaagaaggagagaggaagaaacttaaaccaaggtggttagacgctagaatctattcggacccacttgcactcaaagagttcaaagagtttgctgcaggtaggaagtctctaacacttaatttaattaccgaaatgggtcgactcccgacatttatgacccagaaaactagagacgcactagataacttggcagtattgcatactgcagaggctggaggtagagcatacaatcacgccttgtcggagctacccgaaacattagaaacccttctgttgctaacactacttgcaacagttactggcgggatatttttgtttcttatgtcgggaagagggatagggaagatgaccttagggatgtgctgcatcattactgcctctatcttattgtggtatgcccaaattcaaccccattggatagcggcaagcatcatattggagttctttttgatagtgttattgattccagaaccagaaaaacaaaggacacctcaagacaatcaactaacttatgttgttatagccattctaacagtagtcgcagcaaccatggctaatgaaatgggttttctagaaaagactaagaaagacctaggacttggtagtatagctactcaacaaccagaatctaacatactcgatatagacctaagacctgcttctgcctggaccttatacgctgtcgcaaccacattcgtaacccctatgcttagacattcgatagaaaattcgtccgtcaatgtttctctgacagcgatagctaaccaagcaaccgtgttaatgggattgggtaagggatggcctctatcaaaaatggatattggagtaccattattagctatagggtgctactcgcaagtaaaccccatcaccttaactgccgcattactcttgttagtggcacactatgccataatcggtcccggcttacaagcaaaagctacgagggaagctcaaaaacgagctgctgcaggtataatgaaaaatcctaccgttgatggcatcactgtcattgacctggacccaattccatatgatccgaagtttgagaaacaactaggacaagtgatgcttcttattttatgcgtaacgcaagtactgatgatgcgaacaacttgggcattgtgtgaagcattaacgctcgcaaccggcccaatctcgacgctttgggaaggcaacccgggtcggttttggaatacgacaatagctgtaagcatggcaaacatttttaggggctcatacctagctggggcaggtctattattctccataatgaaaaatacaactaacacaagaagaggaacggggaatataggtgaaacgctaggagagaaatggaaatcgcgattaaatgcattgggcaagagtgaatttcaaatttacaaaaagtctggcatacaagaagttgatcgaacactagcaaaagagggaataaagagaggggaaacagatcaccacgcggtaagtagaggaagcgctaaattacgatggtttgtcgaaaggaacatggtaactccggaaggaaaagtggttgatcttggatgcgggagaggaggttggagctattactgcggtggtttgaaaaatgtccgcgaagtaaaagggctaacaaaaggtgggccaggacacgaggagcccatcccaatgtccacatatggctggaatttggtccggttacagtctggggtagatgtcttcttcatcccaccagagaaatgcgataccctattgtgtgatattggtgagtctagtcctaacccaacagtggaagctggacgaacattaagagttttaaatctagtggaaaattggctaaataataatacacagttttgcataaaagtcttgaatccctatatgccttccgtgattgagaaaatggaagcactccaaagaaagtacggcggagccctagtcagaaatccgctctcacgaaattcgactcatgaaatgtattgggtcagtaatgcctcgggaaatattgtaagctcagtgaacatgatatcgagaatgttaattaacagatttacaatgaggcataagaaagcaacctatgaaccagatgtagatctgggttctgggaccagaaacatcggtatagaatcagaaatcccaaacctagacataatcggaaaaagaattgagaaaataaaacaagaacatgaaacatcatggcattatgatcaggatcatccatataaaacctgggcatatcatggctcatatgagacaaaacagacaggtagtgcatcgagtatggtcaacggggtagtgagactattaacaaagccctgggacgtactccccacagtcactcagatggccatgacagatacaacaccgtttggacaacaacgtgtattcaaggaaaaagtagacactcgcacgcaggagccaaaggaagggacaaagaaactcatgaaaattacagccgaatggctctggaaagagttaggcaagaagaaaacgccaagaatgtgtacgcgagaagaatttacacggaaagtaagatcgaatgctgcgttaggggctatatttacagatgaaaataaatggaaatcagcgcgcgaggcagtggaagactctcgattttgggagttagtagacaaagagcgaaacttacacttagagggaaaatgcgaaacatgtgtgtataatatgatgggaaaaagagaaaagaaactaggagagttcgggaaagcaaaaggttcaagagcaatttggtatatgtggttaggggcgagatttttagagttcgaggctctaggatttttgaacgaagaccattggttttcgagagaaaactctttaagtggggttgaaggtgaaggtctccataagttaggttacatattaagagacgtaagcaagaaagagggaggagcaatgtatgcagatgatacagctggatgggatactaggattacacttgaagaccttaaaaatgaagaaatggtgacaaaccatatggaaggagaacacaagaaactagcagaggctatcttcaaattgacttatcaaaataaagttgtaagagtgcaaaggccgacgcctcgaggtacagtaatggatattatatcacgacgagaccaaagaggcagtggccaagttggcacttacggtctaaatacctttacaaatatggaagcccaattaataagacaaatggagggcgaaggagttttcaagaatatccaacatctaacagtaactgaggaagtggcggtacacaactggctagctagagtaggaagagaacggctgagtagaatggcgatctctggagacgattgtgtagtgaaaccgttggacgatagatttgcaaatgccttgactgcactaaacgacatgggaaagataagaaaagatattcaacaatgggagccatcaaagggatggaacgattggactcaagtcccattttgtagccatcatttccatgaattgattatgaaagatgggagagtccttgttgttccctgcagaaatcaggatgaattgatcggacgagcacgcatttcacagggggcaggatggagcctacgcgaaaccgcatgccttgggaaatcctacgcacaaatgtggtcattaatgtatttccacagaagagacctgcgactcgccgctaatgcaatatgcagtgctgtcccttcacattgggtccctacctcgcgcaccacttggtcgatacatgccaaacacgaatggatgactacagaagatatgctcactgtatggaatagagtttggatacgagaaaatccctggatggaggacaaaacaccagtcgagagttgggaagagataccctatctaggaaaaagagaggatcagtggtgcggatctctaataggacttacgtcaagagccacgtgggctaagaacatacaagcggctataaatcaggttcggagtttaataggcaacgaggaatacacagattacatgccttcaatgaagcgatttcgtcgtgaggaagaggaagctggtgttctgtggtaa

SEQ ID NO: 22767 - RNA, 9876 nt, synthetic construct
  misc_feature 1..9876: note = derived and/or modified CDS sequence (opt6) from DENV-2__EU482783__SS-prME
  source 1..9876: mol_type = other RNA
actgcgggagtaataattatgttgattcccactgcgatggctttccatttaaccactagaaacggagaaccccatatgatagtaggaagacaagaaaaagggaaaagccttttattcaaaactgaagatggagtaaacatgtgtactttaatggctattgatttaggagaattatgcgaagatacgattacgtacaaatgcccgttattacgtcaaaatgaaccggaagacatagactgttggtgcaacagtacctcaacatgggttacatatggaacatgcacaacgacgggcgaacaccgccgtgagaaacggagcgtagcattagtgccacacgtgggaatgggattagaaacaagaaccgaaacctggatgagtagtgaaggtgcgtggaaacatgcacaaaggatcgaaacatggatactaagacaccctggatttacgataatggcagcaattttagcatatactgttggtactacgcattttcaaagagctctgatattcattctacttgcagctgtggctccatcgatgactatgcgttgtatcggtataagtaatagagattttgtagaaggcgtgtcagggggcagttgggtggatatagtactagaacatggaagttgcgttaccactatggcgaaaaataaaccaacactagattttgaattaattaaaacagaagcaaaacaaccagctaccttgcgcaaatactgcatagaagctaaactcactaataccacaacagaaagtagatgtccgacgcaaggtgaaccgtcattaaatgaagaacaagataaaagatttgtctgtaaacatagtatggtagatcgtggatggggcaatggctgtggcttatttggaaaagggggaatagttacgtgcgcaatgtttacctgtaagaaaaacatggagggaaaaattgtccaaccggaaaatttagaatatacgatagtaataaccccgcacagtggcgaggagcacgcagtagggaacgatacaggaaaacatggaaaagaaataaaaataacaccccaatctcccattacagaagcagaactcacgggatacggaacggtaactatggaatgctcgccaaggactggcttagactttaacgaaatggtattattacaaatggaggacaaagcatggctagtacaccgccaatggttccttgatcttccactcccatggctccctggagcagatacgcagggttccaactggattcaaaaagaaacactcgtcacatttaagaatccccatgccaagaaacaggacgtggtcgtattgggatcgcaagaaggtgccatgcatactgctttaactggtgcaacggaaatccagatgtcaagcggaaacttgttattcacaggacacctgaaatgtagactacgaatggataaacttcaactgaaaggaatgtcgtattcgatgtgtacaggaaaatttaaaattgtaaaagaaattgctgaaacccaacacggaacaattgtaattagggttcaatacgaaggtgatggatctccatgtaaaataccgttcgaaattatggatttagaaaagagacatgtactaggtcgattgatcacagttaaccccatcgtaacggaaaaagattcccctgtaaacatagaagcagaaccaccttttggcgacagttacataatcataggagtagaaccaggccagcttaaactaaattggttcaagaaagggtcatcaattggtcaaatgttcgaaacaacgatgcggggagccaaaagaatggcaatactaggggatactgcatgggacttcggcagtctaggaggagttttcacgtcgataggtaaagcattacaccaagtgttcggtgccatatacggggctgctttctcaggcgtctcctggacgatgaaaattctaattggggtaattataacttggattggaatgaacagtcgttccacgagcttgagcgtaagtttagtattagtaggtgtaattacgctttatttaggagcaatggttcaagccgactctgggtgtgtggtctcgtggaaaaacaaagagttaaagtgtggatcaggaatttttattacagataacgtacacacctggacagaacagtacaagttccaacccgaatcaccatcaaaacttgcaagcgcaatacaaaaagcccacgaagaagggatttgtggtatcagaagtgtgacaagattggagaatttaatgtggaaacaaattacacctgaactaaaccatatactaagcgaaaatgaagttaagctgaccatcatgacaggtggcataaaagggataatgcaagctggaaaacgatcacttaggccgcaacccacagaattgaagtattcatggaagacttggggtaaggcgaaaatgctctccacggagagtcacaaccagacatttttgattgacgggcccgagactgcagaatgccccaatactaatcgtgcatggaacagtttagaagttgaagactatggattcggtgttttcaccacgaacatatggcttaaactaagagagaaacaggatgtattttgcgattctaaactaatgagtgctgcgattaaagataaccgtgccgtacacgcagatatgggctactggatagaatcggcattaaacgatacatggaaaatggaaaaggcatcatttatagaagtcaagtcctgtcattggccgaaatctcatactttatggtcgaacggcgtcttggagtcagagatgataataccaaagtcatttgcaggcccagtaagccaacacaactacagaccgggctattatacacaaacagccggtccatggcatttgggaaaacttgaaatggacttcgacttctgtgagggaacaacagttgtagtgacggaagattgcggaaatagaggtccatcattacgtacaacgacagcaagcggtaaattaataactgaatggtgttgtcgatcctgtacactaccgccacttaggtaccgtggcgaagacgggtgttggtacgggatggaaatccgtcccttaaaagaaaaggaagaaaatcttgtaaattccttggtgacggcaggacatggacagatagataattttagcctgggagttcttggcatggccctattcctagaagaaatgctccgcacgagagtaggaacaaaacatgcaatattactggtcacagtgagctttgtaactcttattacaggaaacatgtcatttcgagacctcggtagggtaatggtaatggttggagcagcaatgactgatgatatcggaatgggggttacatacctcgcgctgcttgccgccttcaaagtccggccaacctttgccgcaggccttcttctccgaaagctaacatcaaaagaattaatgatggcaacaataggaattgcactattaagccaaagtacgattccagaaactatacttgaactgacagacgcattggcactaggaatgatggttttaaaaattgttagaaacatggaaaagtaccaattagcagttacaataatggcaatcagttgtgttccgaacgctgtaatactacaaaatgcctggaaagtgtcatgtacaatactcgcagcagtatcggttagtcccctgcttcttacgtcatctcaacagaaagcagactggataccattggcacttacaataaaaggtctaaaccccacagcaatatttttaacaacattaagccggacctctaagaagcgcagctggccactaaatgaagctatcatggcggtcggtatggtatcaatattagcaagttcacttcttaaaaacgatataccaatgacaggacctctagtggcaggcgggcttctcacagtttgttacgtcctaacaggaagaagtgctgacctcgaattagagcgagctacagatgtaaaatgggaggatcaagctgaaataagcggatcaagcccaatcttgagtataactatagccgaagacggatctatgtcaatcaaaaatgaagaagaagaacaaacactaacaatactaataagaactggcttattagtaatttccggattgtttccagtaagtatcccgattaccgccgcagcatggtacctgtgggaagttaaaaagcagagggcgggagttttatgggatgttccgagtccacctcctgtaggaaaagctgaactcgaagacggagcatatcgaatcaaacaaaaggggattcttggatatagtcagattggagctggagtttataaggaaggaacctttcatacgatgtggcatgttacgcggggtgcagtccttatgcatagaggaaaacggattgagcctagctgggcagacgttaaaaaggacttaattagttatggtggaggatggaaactcgagggagagtggaaagagggtgaagaagtccaagtccttgcactggaaccaggaaagaatccaagagctgttcaaaccaaacccggattgttcaagacgaatacagggacaataggagcggtgagtttggacttctcaccaggaacaagtggcagccctatcgtagataggaaaggcaaggtagtaggattatacggcaatggagttgttacaagatcgggagcgtatgtcagtgcaatagcccaaacggaaaagagcatagaggataacccagagatcgaagatgatatctttaggaagaaaagacttacgattatggacctacatccaggagcgggaaaaactaaaagatacttaccggccattgttagggaggctataaaacgaggattacgaacactcatactcgcccctactcgtgttgtggctgccgaaatggaggaagcgcttagaggacttccaatccgctaccaaacccccgcaataagggcagagcatacgggaagagaaatagtagatcttatgtgccacgcaacatttaccatgcgattattatcgcctgtgcgagttcctaattataacctaataattatggacgaggcgcatttcactgaccctgcgagtatagcagcaaggggatacataagtacaagagtagaaatgggagaagcggctgggatattcatgactgcaacaccaccgggctctagagatcccttcccacagtctaatgctcctataatggatgaagaaagagaaatcccagaaagatcatggaactcaggtcacgaatgggtaaccgatttcaaaggtaaaactgtttggttcgtacccagcataaaagctgggaatgatatagcggcttgtttaaggaaaaatgggaaaaaggttattcagctatcacgtaagacttttgactctgaatatgtaaaaacaagaactaatgattgggacttcgtcgttacaaccgacataagtgaaatgggcgctaactttaaagccgaacgagtgattgacccgagacggtgtatgaagcccgtcatactgactgacggggaggaaagagttatattggcggggccgatgccggtaacccattcatcagcagcgcaaaggagaggacgaataggtcgtaatccaaagaacgaaaatgatcagtatatttatatgggtgaacctttagaaaatgatgaagactgtgcgcactggaaagaagctaaaatgctcttggataacataaataccccagagggaattattccatccatgtttgaaccagaacgggagaaagttgatgcaatagacggtgagtataggttacgaggcgaggcgagaaaaacatttgtcgacctcatgcgtaggggtgatctgcccgtttggttagcgtatcgagtggcggctgaggggataaattatgcagatcgtcgctggtgttttgatggggtgaaaaataatcagatcctggaagaaaatgtggaagtagaaatatggacaaaagaaggagagaggaaaaagctcaagccaagatggcttgatgcacggatttacagcgatccattagcattaaaggagtttaaagaatttgcggcgggtagaaaaagcctcaccttaaacctaattactgagatgggaagacttccaacctttatgacacagaaagcccgagatgctcttgataatctagccgtgctacatacggccgaggcaggaggtcgggcttataatcacgcattatcggaactaccagagaccctagaaacattattactacttacgttattagcaactgtaacaggtggaatatttttgtttcttatgtcggggaaaggtgtaggaaaaatgaccctgggcatgtgttgtatcatcacagccagtatcctattatggtatgctcagatacagccacattggattgcagcctccattatattggagttctttctaatcgttttgctgattcccgaacccgaaaaacaaaggactccgcaagataaccaattaacgtacgtagtcatagctattctaacggtcgtggcggcaacaatggcgaacgaaatgggattcttagagaaaactaagaaagatctaggactaggcagcatagcaacacaagaacctgaatctaacatactagatatcgacttacgcccagcatcagcatggacattgtatgcagttgcgaccacgtttgtaactcctatgctaagacatagcattgagaactcatcagttaatgttagcttaacagccatagctaatcaagcaacagtcctcatgggcttaggaaaggggtggcctcttagcaaaatggatataggagttccacttctagccataggttgctacagccaggtgaatccaatcacgctcacagcagcgcttctactattagtagcacattatgctatcattggcccgggattgcaagctaaagcaacaagagaagctcagaaaagagctgcagccggtataatgaagaacccaactgtcgacggaataacagtcatagatttagatccaataccgtatgacccaaaatttgaaaaacaacttggtcaagtcatgctactaatactttgcgtgactcaggtcctaatgatgagaaccacatgggctctctgcgaagcacttactctcgcgacaggcccaatctctactctgtgggaaggaaatccgggcaggttttggaacaccacaatagcagttagcatggcgaacatatttaggggctcgtatttagctggggctggactgctctttagtatcatgaaaaatacaaccaacacgagaagagggaccggtaatattggagaaacactaggagagaaatggaagtcacgacttaacgcattaggtaagagcgaatttcagatttataagaaatcgggtatacaggaggtggatagaacattagccaaagaagggataaaaagaggggaaactgaccaccacgccgtcagtagaggatcagctaaactaaggtggtttgtagaaagaaacatggtcacaccggagggaaaagtagtcgacctagggtgtggaagaggagggtggtcatattattgtggcgggttaaaagatgttagagaggtgaaaggtttaacaaaaggagggccaggtcatgaagaaccaattccaatgtctacgtacggttggaatttagtcagactacaatcaggcgttgacgtctttttcacacctccggaaaagtgtgatacattgttgtgcgatataggagaaagttcaccgaacccaaccatagaagcaggacgaacattaagagtgttaagcctagtagaaaattggttaaataatgatactcagttttgcattaaagtattaaatccatacatgccatcagtaatagaaaagatggaaaccttacagcggaaatatggcggagcactggtccgaaatccactgagtagaaattcgacacacgaaatgtactgggtatcaaatgcaaccggtaacattgtcagcagtgtaaacatgataagcagaatgctaattaataggtttaccatgaagcataagaaagccacttacgaacctgacgtcgacttaggaagcggaacaagaaacatcggaatagaaagtgaaatcccaaaccttgacattattggaaagaggatcgagaagattaaacaggaacacgagacaagttggcattacgaccaagatcacccatacaaaacatgggcgtatcacggttcatacgagacaaagcaaaccggttctgccagtagtatggtgaatggagtggtgaggctgctaacaaaaccttgggatgtcgttcctatggttacacaaatggcaatgacagacaccacaccatttggacaacaaagggtatttaaagagaaagttgacacaaggacccaagaaccaaaagaaggaaccaagaaactaatgaaaattaccgcggaatggttatggaaggaactaggcaagaagaaaactccaaggatgtgcacacgagaagaatttacacgtaaagtcagaagtaacgcggctctgggggccatatttacagatgagaacaaatggaaaagtgctagagaggcagtagaagacagccgtttttgggagttggttgataaggagcgtaacttgcatttagagggtaaatgtgaaacatgtgtctataatatgatgggaaaacgggagaagaaattaggggagttcggtaaagccaagggttcacgagctatatggtacatgtggttgggggccagattcttggaatttgaggccttaggatttttaaacgaggaccattggttcagtcgagaaaactcattaagcggagtagaaggagaaggcctgcataaacttggatatattctacgagatgtaagcaagaaagaaggaggagccatgtacgcagacgatacggcaggttgggacaccagaattacactagaggacttgaaaaacgaagaaatggttacaaaccacatggaaggagaacataagaaactagccgaagcgatatttaaactaacttaccaaaataaagttgttcgagtacaacgtccgacaccccgtggaacggtcatggatattatcagcagaagagatcagagaggatcgggacaggtcgggacgtatggtcttaacacgttcactaatatggaagcacaattaataagacaaatggagggcgaaggagtgtttaaatcaatacaaaggcttacggtgactgaagaaattgcggtacaaaattggctagcgcgagttgggcgggagagactaagtagaatggctatttcgggagacgactgtgtagttaaaccgctagacgatcgtttcgcttcagcactgacagcattaaacgatatggggaaggtaaggaaggacatacagcaatgggaacctagtagaggatggaacgattggacacaagtaccattttgctcgcaccatttccatgaactaataatgaaagatggccgggtattagtagtgccatgtcggaaccaggatgaattgataggtcgggcacgaatttcccaaggggccggatggagtttaaaagagacagcatgcctagggaagtcctacgcacagatgtggagtttaatgtacttccatagaagagatcttcgcttagctgcaaatgccatatgttcggccgtaccctcacattgggttccgacatcacgtactacgtggtccatacacgcaaaacatgaatggatgacaacagaggatatgctgacggtatggaatcgagtttggatacaggaaaatccgtggatggaagataagactcccgtagagtcttgggaagaggtcccctatctcgggaaaagagaggaccaatggtgtggctctttaattggcctaacgtcacgtgctacatgggcgaaaaatattcagacagctataaatcaagtaagatccctaattggaaacgaagaatataccgattatatgccgtcaatgaaaagatttagaagagaagaagaagaagctggagttctctggtaa

SEQ ID NO: 22768 - RNA, 9876 nt, synthetic construct
  misc_feature 1..9876: note = derived and/or modified CDS sequence (opt6) from DENV-2__EU482784__SS-prME
  source 1..9876: mol_type = other RNA
tccgccggtatgataattatgcttattccaacagtaatggcatttcatcttaccacccgaaatggagagccacacatgatagttggaattcaagagaaaggaaagtccctattgttcaaaactgaagatggagttaacatgtgcaccttaatggcaatggacctcggggaattatgcgaggacacaataacctacaaatgccccctactgagacaaaacgaaccagaagatatcgactgctggtgcaatagtacatctacttgggtaacatatggtacatgtacgacaacaggtgagcatagacgagagaaacgaagtgttgctctggtaccacatgtggggatgggtcttgaaacacgcacagaaacctggatgtcatcagaaggagcctggaaacatgcgcagcgaatcgaaacttggatactccgacatcctgggtttactataatggcagcgatattagcttatacaatcggcacaacacacttccaacgagttttgatctttattctattaactgctgtagcgcctagcatgactatgagatgtataggaatctctaatagagactttgtcgaaggagtaagcggcgggagttgggtagatatagtactcgaacatggtagttgcgtcacgacaatggcaaaaaataagccaaccctggatttcgaattgattaaaacagaagctaaacaacctgcaacgttacgaaaatactgcatagaagcaaaactaacaaatacaacgactgaaagcagatgtccaacgcagggggaaccatcattgaaggaggagcaggacaaaagattcgtgtgtaagcatagtatggtagaccgcggatggggtaatggctgtgggttatttgggaaaggaggtatcgtcacctgtgcaatgtttacatgtaaaaagaatatggaaggaaaaatagtccaaccagaaaatttagagtataccattgtagtaacaccgcactccggcgaagagcatgcagtggggaatgacacaggaaagcacggaaaggaaataaaagtcacaccccaatcaagcattaccgaagcagagttgactggatatggaaccgtaacgatggagtgttctccacgaacgggtcttgactttaatgaaatggtgttattacagatggaaaataaggcatggttagttcatcggcagtggttcctagaccttccacttccctggttaccaggagcagataaacaagaaagtaactggatacaaaaagagacattggtaacatttaagaaccctcatgcaaaaaaacaggatgttgtggttttagggagtcaagaaggcgcaatgcacacagccctaactggtgctaccgaaatacaaatgtctagtggtaatcttttattcaccggacatctaaaatgtcgactaagaatggacaaattacagttaaagggaatgtcctattccatgtgcacgggtaaatttaaagtagtgaaggaaatagctgagacgcaacacggtaccatagttattagagttcaatatgagggagacggatcaccttgtaaaattccctttgaaatcatggaccttgaaaaaagatacgtgttgggcagattaattacagtaaatcctattgttactgaaaaagacagcccagtgaatattgaagccgaacctccttttggagatagttacattataattggcgtagaaccgggtcagctgaaattaaactggttcaagaagggttctagtatcggccaaatgtttgaaacaacaatgaggggagccaaacgaatggctattttaggggacacagcttgggattttggatcgttaggcggagtattcacctctataggaaaggctcttcaccaagtgtttggggcaatttatggagctgcgttttctggagtctcttggacaatgaaaatcctaatcggcgtaatcatcacatggattggcatgaatagccgcagcaccagcttaagtgtgagtctggtattagttggtatagtaacactatatcttggagttatggtacaagcagattccggatgtgttgtttcctggaaaaataaagagctaaaatgcggtagtggcatttttatcactgataacgtacacacatggaccgagcaatataagtttcaacctgaatcaccctcgaaactcgcatccgcaattcaaaaggcacaagaggaaggcatatgtggcataagatcggttacgagactggaaaatctaatgtggaaacaaataacacctgagttaaaccacattttagcagaaaacgaagtcaaattaactataatgactggggacataagagggataatgcaagcaggcaagagaagtttaagaccccaaccgaccgaacttaagtactcctggaagacatggggtaaagccaaaatgttgtccacggaaagctacaaccaaacgttcttaatagatggtccagaaaccgccgaatgtcccaatacaaatcgggcttggaattcactcgaagtagaagattatggcttcggcgtatttaccacgaatatatggttgaagttaaaagaaaaacaagacgttttttgcgacagcaaactaatgtcagcagcaataaaggacagtagggcagtacatgcggatatggggtattggatagaatcagctttgaacgatacctggaagattgaaaaagcttcgtttatagaggttaaaagttgccactggccaaaatctcatacgctctggagtaacggcgtattagaatctgaaatgataatcccgaagaactttgcgggccccgtctcacaacataactaccgaccaggataccatactcaaacggccggaccttggcatctggggagattggaaatggatttcgatttctgtgaaggtactaccgtcgtagtaactgaagactgcggaaataggggtccgtcactaagaacaacgacagccagtggaaaactgataactgaatggtgttgcaggtcatgcaccttacccccattaagatacaggggtgaggacggttgttggtacggaatggaaatacgtccattgaaggagaaagaagaaaacctagtaaacagcctcgttaccgcaggtcatggtcaaatagataatttttcgttaggtgtattaggtatggcgctttttttggaggaaatgttacgaacgagaataggaacaaagcacgcaatattattagtcgcagtaagttttgtgacgttaatcacaggcaacatgtcatttcgagacctaggtagagtaatggtcatggtcggtgcaactatgacagatgatataggaatgggggtgacttatctagctttgctcgccgcattcaaagtaagaccaacttttgcagccggacttctcctacgtaaattaacgtccaaagaattgatgatgacaactataggaatagtcttattgagccaatctacaattccagagactgttcttgagctcacagacgcactagctctgggtatgatggtgttaaagattgtaagaaacatggaaaagtatcaattagccgtaaccatcatggccattctttgcgtaccaaacgcagtaatacttcaaaatgcctggaaagtttcatgtactatcttagcggttgtatctgtatcccccttattattaacatcttctcagcaaaagacggactggataccgttagcattaacgattaaagggttaaacccaacggctattttcttgactacgttaagcagaaccaataagaaacgcagttggccgttaaacgaggcaataatggctgtgggaatggttagcattttagcgtctagcctattaaagaatgacataccgatgacaggacccctagtagcagggggactgctaactgtatgttatgttttgaccggaagaagtgctgacttagaattagaacgcgctacagacgtgaaatgggaagatcaagctgaaatttctggctcatcgcctattttatctataacaatatcggaagacgggagcatgtcaatcaaaaacgaagaggaggagcaaacactgactatcctcattagaactggcttgttggtaataagtggcttgtttccgatatcaattccgattacagctgcagcctggtatttatgggaagtcaaaaaacagcgtgcaggagtcctgtgggatgtaccttcaccaccaccgatgggaaaggctgagcttgaagacggagcttatcgaattaaacaaaagggaattctagggtatagtcaaatcggagcaggagtttacaaggaaggtacgttccatacaatgtggcacgtcacaagaggagcggtattaatgcataaaggcaagaggatcgaacctagctgggctgatgttaagaaagatttaatttcatatggtggaggatggaaactagaaggcgaatggaaagaaggagaggaagtgcaagttctcgccctagaaccgggcaaaaatcctagagctgtacaaaccaaacctggtctatttaaaacaaacaccgggacgattggggcggtatcattagatttcagccctgggacatcaggaagccctatcatagacaaaaaaggaaaagtggtaggtctatatggaaacggcgtagttacgaggagcggcgcatacgtatccgcaatagcacaaactgaaaaatctattgaagataatcctgaaatagaagacgatatatttaggaagaggagacttactataatggatctacatcccggggccgggaagactaaacgctacttaccagcaatagttagagaggcaataaagcgaggtcttagaactctaatactcgctccgactagagtagtggctgccgaaatggaagaagctctgaggggattaccaattagatatcaaacacctgctattcgagccgagcatactggaagggaaatagtagacttaatgtgtcatgccacctttacgatgagattattatctcccgtaagagtccctaattacaatttgattatcatggacgaagcacattttacagaccctgcctcaatcgcagctaggggatacatttctacaagagtggagatgggtgaagctgcagggatattcatgacagctacaccgcccggttctagggatccttttccacagtcaaatgcccctataatcgatgaagaacgagaaattcccgaacggtcgtggaactccggccatgaatgggtaacagactttaagggaaaaacagtatggtttgtaccctcaataaaggcaggcaacgacatagcagcgtgtttacgtaaaaatggtaagaaggtaatccaattgtcgagaaaaacttttgattcagaatatgtgaaaacaaggaccaacgactgggattttgtagtgactacagatatatccgaaatgggggcgaattttaaagccgaacgtgtaatcgaccctcgtagatgtatgaagccagtaattttaactgacggtgaagagcgagtcattctggctggaccgatgcctgtgacacattcgagcgcggctcagcgccgcggaagaatcggaagaaatcctaagaatgaaaatgaccaatacatctatatgggagagcctttggaaaatgacgaggactgtgctcattggaaagaagctaagatgttactagataacattaatactccagaagggattatccccagtatgtttgaacctgaacgtgaaaaagttgacgccattgatggagagtaccgtctccggggtgaagctagaaaaacattcgttgatttaatgagaagaggagatttacctgtttggttagcctacaaagtggcagctgaagggataaattacgcagacagaagatggtgttttgatggaataaaaaacaaccaaatacttgaagaaaatgttgaagtggagatatggacaaaggaaggagaaagaaaaaaattaaaaccgcgttggcttgatgcccgaatatattctgacccactagcattaaaagaattcaaagagttcgctgctggacgaaaatcactgacccttaatctcataaccgagatgggcagattgcccacgttcatgactcaaaagaccagagatgcgctagacaatctagctgtcctacacaccgcagaggctggaggaagagcatacaaccatgcgctaagcgagcttccagagaccctagagactttattactgttaacacttttggctacagttacaggcggtatttttttatttctaatgagcggccgaggaattggaaaaatgactttaggaatgtgctgtatcataactgcaagtatattactatggtacgcgcaaatccaaccccattggattgctgcgagcattatccttgaatttttcctaatcgtcttattaattcctgaaccagaaaaacaacgaacaccacaggacaaccaactaacttatgtggtaatagctatattaacagtcgtcgcagccaccatggcgaatgaaatgggatttcttgaaaaaacaaaaaaggacctaggactaggaagtatcgcaacgcagcaaccagaatcaaatatacttgatattgatctaaggccagctagcgcctggacgctatatgctgtagcaacaacatttgtcacacccatgttacgacattccatagaaaattcatcggtcaacgttagcctaacagcaatcgcaaaccaggctacggtattgatgggtctgggaaaaggctggccattaagtaaaatggacattggggttccacttctagctattggatgctatagtcaagtcaaccctattactcttacagcagcattactattattggtcgctcactacgcaatcatcgggcccggccttcaagctaaggcgacacgcgaagctcaaaaacgggccgcggccggaataatgaaaaacccgacggtagatggaattactgtaattgatcttgacccaattccttatgatcctaaatttgaaaagcaattggggcaagtaatgctattgatactatgcgtaactcaggtactaatgatgcggacgacatgggccctatgcgaagcacttacgctggcaacgggaccaatatctacactatgggaagggaacccaggaagattctggaacacaactatagcagtaagtatggccaacatcttcagaggtagctatttagcaggagcaggcttattatttagcataatgaaaaacaccacaaacacgcgtcgtggaactggaaatattggcgaaacactgggtgagaaatggaaaagccggctgaatgcactcggcaagagcgaattccaaatctacaaaaaaagcggaatacaagaagtagatagaacactagcaaaagaaggtataaaacgaggggaaacggaccaccatgcagtatcacgcggatccgctaaattaaggtggtttgtagaacggaatatggttaccccagaaggcaaagttgtagatctagggtgtggacgaggtggctggtcgtactattgtggtggactaaaaaatgttagggaagttaagggactaacaaaaggaggaccaggtcatgaagagccaatacccatgagtacctacggttggaacttagttaggctacaatcgggagtggatgtattctttattccaccagaaaaatgtgacaccttgctgtgtgatataggagaaagcagtcctaaccccacagttgaggcaggaagaactcttcgggttttaaatttagtggaaaattggttaaataataacactcaattctgtataaaagtattgaatccatacatgccaagtgtcattgaaaagatggaagcgctccaaaggaaatatggcggtgcactggtaaggaacccattatctagaaattccactcatgaaatgtactgggttagtaacgcttccggcaatattgtcagttctgtgaatatgataagccgtatgctgattaatcgcttcacaatgagacataaaaaagcaacgtacgaacctgacgtagacttaggatcagggacaagaaatatcggaattgaatctgagatccccaatctagacattattggaaaacgtattgaaaagatcaaacaggaacacgaaacgtcttggcactacgaccaagatcacccctacaaaacatgggcatatcatggtagttacgaaacaaagcaaacgggaagcgcatcatccatggtaaacggagtcgttcgattactaaccaaaccttgggacgtccttccgacggtgactcagatggcaatgacggacacaactccttttggacagcaaagagtttttaaagaaaaggtggatactagaacacaggaacccaaagaaggcacaaaaaaactaatgaaaatcacagccgaatggctgtggaaagagctaggcaagaaaaagacaccacgaatgtgcacccgtgaagagtttacccgtaaagttcggtctaatgcagcgctaggcgcgatattcacagacgaaaataaatggaaatcggccagagaggcagtcgaggattctcggttctgggaactggttgataaagaaaggaatttacatctagagggaaaatgcgaaacatgtgtttataacatgatgggaaaaagagaaaaaaaattaggagaattcggtaaagctaaaggaagcagagctatatggtatatgtggcttggtgcaagattcctggagttcgaagccttagggtttttaaacgaagatcactggttcagccgagaaaacagtctaagtggtgtggaaggtgaaggcctccataaactaggatatatactcagagatgtttccaaaaaagagggtggtgcaatgtatgctgatgatacagcaggctgggatacccgaataacattagaagacttaaaaaacgaagagatggtaaccaatcatatggaaggcgaacataaaaaattagcagaagctatattcaaactcacgtatcagaataaagtagtgagggtacaaaggccaacaccaagaggaacagtaatggatattattagtcgtcgagaccaaagaggttctggccaagtaggaacatatggactaaatacattcacaaatatggaagcacaattaataaggcaaatggaaggggaaggagtttttaaaaacatccagcatttgacagtaacggaggaagttgctgtgcacaattggctagcaagagtgggaagagaaagattatctaggatggctatatcaggtgatgattgtgttgtgaagccgttagatgatagatttgcaaatgcgttaacagcacttaacgacatgggaaaaattcgtaaagatatccaacaatgggaaccgagcaaagggtggaatgactggactcaggtaccattttgttcccaccactttcatgaattgattatgaaagatggacgcgtgttagttgtaccttgtagaaatcaagatgagttaataggtcgcgcaagaatttcgcaaggcgcaggctggagcttacgcgaaacagcttgtttaggcaagagctacgcccagatgtggtctttgatgtattttcaccgtagggatctaagacttgctgccaacgccatttgtagcgcagtgccatcacactgggtaccaacatcgcgcacaacgtggtccatacatgctaagcacgaatggatgactaccgaagacatgttaacagtatggaatcgtgtttggattagagaaaatccatggatggaggacaaaactccggtagagtcctgggaggaaataccatatctcgggaaacgagaagaccaatggtgtggctcgctcattggtctcacgagccgggctacttgggcaaagaatatacaagctgcaattaaccaagtacgttcacttattggaaatgaagagtacactgactacatgccttccatgaaacgatttagaagagaagaagaagaggcaggagtattgtggtga

SEQ ID NO: 22769 - RNA, 9876 nt, synthetic construct
  misc_feature 1..9876: note = derived and/or modified CDS sequence (opt6) from DENV-2__EU482785__SS-prME
  source 1..9876: mol_type = other RNA
accgctggagttataattatgttgatacccacagcgatggcgtttcatcttaccaccagaaatggagaaccacatatgatagttggacgacaagaaaaaggaaaatcgctactatttaaaacggaagacggagtaaatatgtgtacattgatggcgatagatttaggagagctatgcgaagatacaatcacgtataaatgtccattattaagacaaaatgaaccagaagatatagattgttggtgtaacagcaccagtacgtgggtaacctatggaacttgcacgacaacaggagaacacagaagagagaaaagaagcgtggcattagtaccccacgtagggatgggtctcgaaacgcgcacagaaacctggatgtcaagcgaaggggcgtggaaacacgcacaaagaatagaaacctggattctcagacacccaggatttacaattatggcagctattcttgcgtatacagtaggcactacacattttcaaagagctttgatattcatattattagcagcggtagccccatcaatgaccatgagatgtattggcataagtaatcgtgactttgtagaaggagtgagcggcggttcatgggttgatatagtgttggaacacggtagctgtgtgacaacaatggctaaaaataaaccaacactagattttgaattaataaaaactgaggctaaacaaccagctaccttacggaaatattgcatagaagcaaaattgacaaatactacaaccgaatcacgctgtccaacgcaaggagaaccttcactcaacgaagaacaagacaaacgtttcgtgtgtaaacattcaatggttgatagaggatggggtaatggatgcggcttatttggaaaaggagggatagttacgtgcgcaatgtttacatgcaagaaaaatatggaggggaaaattgtacagccggagaatctcgagtatacaattgttattacacctcattcaggagaggaacatgcagttgggaatgacaccgggaaacacggcaaagagattaaaataacaccacaatctcccataaccgaggcagaactgacaggatatggcactgtaacgatggaatgttcgccgcgcaccgggctagactttaatgagatggtattactacaaatggaagataaagcatggttagtacatcgccagtggtttttggatcttccactgccctggttaccaggtgcggatacacaaggatcgaactggattcaaaaagagacattggtcacttttaaaaatccacatgccaagaaacaagatgtcgtagttttagggagtcaagagggtgctatgcataccgcattaactggagctacagaaatacaaatgtcttcagggaatttactctttactggacacttaaaatgccgtttacgcatggacaaattacaactgaaaggaatgtcatactccatgtgcacaggcaaattcaaaatagtaaaagaaatagcggagacccaacacggcacgattgtaataagagtacaatatgaaggcgacggatccccatgcaaaataccgtttgaaataatggatctcgagaagagacatgtactcggacggttaataacagtaaacccaatagttacagaaaaagatagtccagtaaatatagaggccgaaccccctttcggagatagttatattatcattggggtagaaccaggacaacttaaattaaattggttcaagaaagggagcagcattggtcaaatgtttgaaaccacaatgcgtggtgctaagagaatggccatacttggggatactgcttgggatttcggatccttgggcggagtctttacaagcataggcaaagcattgcatcaagtctttggagctatttacggagctgcattttcaggtgtctcctggacaatgaagattctaatcggagtcattataacatggataggcatgaactccagaagtacgtcactatctgtatcgctagtacttgttggagtaatcactctatacctaggtgctatggtccaggctgacagtggatgtgtagtttcttggaagaataaagagttaaaatgtggatccggtatttttatcactgacaatgtccacacatggactgaacaatataaatttcaaccagagagtccctcgaaactagctagcgctatacagaaagcacacgaggagggaatatgcgggattagatctgtaacacggcttgagaatttaatgtggaaacaaataaccccagagctaaatcacatactaagtgaaaacgaagttaaacttaccataatgacgggagatataaagggtatcatgcaggcgggaaagagatctttacgccctcaacccactgaactcaagtacagttggaaaacatggggtaaagcaaaaatgctcagtacagaatcacataatcaaactttcctgatagatggcccagaaacagcggagtgcccgaatacaaatagagcgtggaactccttagaagtcgaagactatgggtttggcgtattcactacgaatatctggttaaaattaagagagaaacaagatgtcttctgcgactctaaactaatgtctgctgctataaaggataaccgagcagtacacgctgacatgggatactggatcgaaagtgccttaaacgatacttggaagatggaaaaggcttcatttattgaggttaaatcatgtcattggccaaagtcacatacattgtggagtaatggagtgctcgaaagcgaaatgataatcccaaaatcctttgccggtcctgtcagccaacacaactatcgccctggatactatacacagaccgcaggcccttggcacctgggaaaacttgaaatggatttcgacttctgcgaggggacaactgtcgtagttacggaagattgtggtaatagaggaccaagcctacgcacaacgacagcaagcggtaaacttatcaccgagtggtgttgcagaagttgcacattaccacctttaagataccgaggtgaagacggttgctggtatggaatggaaataagaccacttaaagaaaaagaggagaatctggtaaattcacttgtaacagcagggcatggtcaaatagataatttctccttgggcgtgctagggatggcgctatttctggaagaaatgttaagaactcgggtcggcacaaaacatgccatactattagtgaccgtatcttttgttacgcttataacgggtaatatgagctttcgggacttagggagagtgatggtcatggtaggtgccgcgatgactgacgatataggtatgggcgtaacatatttagccctactggctgcgtttaaggtaagaccaacgttcgccgctggattgttactgcgtaaactgacatctaaggaactgatgatggcaacgattgggatagcactactctcacaatctacaattccggagactatactagaactaactgatgcattggctttaggtatgatggtcctgaagattgtacgaaatatggagaaatatcaactagctgtgacaatcatggcaataagttgtgtgcctaatgcggtaatactccaaaatgcctggaaagtatcatgcaccatcttagcagcagtatctgtttcacctttactgttaacatcttcccagcagaaagcggactggataccgctggcgctgacaataaagggcctcaacccaaccgcaatatttctcacgaccctaagcaggacaagtaaaaagaggtcatggccactaaatgaagcgatcatggctgtcggtatggtatcgatcctggcatcaagcctactcaaaaacgacattccaatgacaggtccattagttgcagggggattattaacagtttgctatgtgttaacaggtcgatcagctgatctagaacttgagcgagcgaccgacgtcaaatgggaggaccaggcagaaatttcagggtctagcccgattttgagcattacgattgctgaagatggttcaatgtcaatcaaaaatgaagaggaagaacaaacccttaccatccttataagaacaggacttcttgtaattagtggtttattcccagttagcataccaataacagcagctgcatggtacctatgggaagttaaaaagcagagagctggcgtattgtgggacgttcccagcccacctccagttgaaaaagcagaacttgaagatggtgcatacagaataaagcaaaaaggtatactagggtattcgcaaattggagcaggcgtatataaagaaggaacatttcatacaatgtggcacgtaacgcgtggggccgtgctaatgcaccgcggaaaaagaattgagccatcatgggcagatgtcaagaaagatttaataagttatggtgggggatggaaacttgaaggggaatggaaagaaggggaagaggtacaagtgctagcgttagaacccgggaagaatccgcgcgcagtccagactaagccaggtctgttcaaaacaaatactggtacaataggtgctgtatcactggatttctctccaggtacgtcaggctcaccaatagttgacagaaaaggaaaagtggtcggtctatatggaaatggagtggttacaaggagcggggcatatgttagcgcaatcgcccaaacagaaaaatcaatagaagataacccagagatcgaggatgatatattcaggaagaaaagattaaccattatggatttacatcctggcgctggaaagacaaaacgatacctaccggcaatagtaagagaagcgataaagagagggctgagaactttaatcttagcaccaactcgagtagttgcagcggaaatggaggaagcacttcgcggcttacccattaggtatcagacaccagcgataagggcggaacacacgggtagggaaatagtcgacttaatgtgtcatgctacttttacaatgcgtctcttgtcaccggttagagtaccaaattataatctgatcattatggacgaagctcatttcacagatccggcttctattgctgctcgaggatatataagcacaagagtagagatgggtgaagccgcaggtatttttatgacagccacaccgcctgggtcacgagacccatttccccaatccaacgcaccaattatggatgaagaacgtgagataccagagagaagctggaactccggacatgagtgggtaacagattttaaagggaaaacggtatggtttgtaccatctatcaaagcaggtaatgacatcgctgcatgtttacgtaaaaacggcaagaaagttatacaactatctaggaaaacattcgattccgaatatgtaaaaacacgaacaaatgactgggatttcgtagttacaacagacatcagcgaaatgggagcaaactttaaagctgagagggtcatagacccaaggagatgtatgaaacccgtcattctcaccgatggggaggaacgggtaatattagccggaccgatgcctgtaacacattcatcggcagcacagaggaggggcagaattggacggaacccgaagaacgaaaacgatcaatatatatatatgggagagccgcttgaaaacgacgaagactgcgcgcattggaaggaagctaaaatgctactagacaacattaatactcctgaaggcataatccctagtatgttcgagccagagagagagaaggtagatgccatagatggggaatacagactaagaggcgaggcgagaaagacttttgtagacctaatgcggcgaggcgacttacctgtttggctcgcttacagagtagctgctgagggaataaattatgcagatcggcgatggtgcttcgacggagtaaagaataatcaaattctggaggagaacgtggaagtagagatatggacaaaagaaggtgagaggaagaagctgaagccaagatggttagatgcaaggatttactcagatccgttagctctaaaagaatttaaagaatttgcggcaggccgaaagagcctaactttgaatttaattacggagatgggaaggttgccgactttcatgacccaaaaggcaagagatgctttagacaatctggctgtactacacacggcagaggccgggggcagagcctataatcacgcactgagtgaactacctgagactttagaaacattactcctcctgacattattagccactgttacaggcggaatattccttttcctgatgtcaggaaaaggagttggaaaaatgacactaggtatgtgttgcataataacggcgtcgattctactatggtatgcccaaatccagccgcattggatagcggcctcgataatactagagttctttttaatagtccttttaattcctgagcctgaaaagcaacgcacgccacaagacaaccaactaacttacgtcgtaattgctattttaacagtcgtggcagcaacaatggcaaatgagatgggctttctcgaaaagacgaagaaagacttaggactggggtctatcgctacacaggaacctgaatctaatattctggatatagatctacgacccgcatctgcatggaccttatatgcagtcgctactacattcgttacccctatgctaagacacagcatcgaaaatagttcagttaatgtgtcattaacagccatagccaaccaagcaacggtactaatgggcctagggaaaggatggccactatcgaaaatggatatcggagtgcccttactggctataggttgttattcacaggtaaacccaattacactaactgctgctctgctattattagtggcccattacgctataatcggccccggattgcaagcaaaagccacaagggaagcacagaaaagagcagcagcaggaattatgaagaatcctacagtggacggagtgactgtgatagaccttgatccaataccctatgacccgaaatttgaaaaacaactcggtcaagtgatgctactaatactttgtgtaactcaagtactaatgatgagaacaacttgggctttgtgtgaagcattaacactcgcaacgggcccgattagtacactatgggaaggaaatcctggtagattttggaataccacaattgcggtgtctatggcaaacatatttagagggagttatctagctggagcggggcttctcttcagtattatgaaaaatacaacaaacactagacgaggaaccggaaatattggcgaaaccttaggagaaaagtggaaatccagactaaacgcgttaggcaaaagtgaatttcaaatttataagaaaagtggaatccaagaagtagatagaacattggcgaaggagggaataaaacgcggagaaactgatcatcacgcagtctcacgcggatcagctaaactgcgatggtttgtcgaaagaaacatggtcacaccggaaggaaaagtggtcgaccttggatgtggaagaggaggatggagctattattgcggcggcctaaaagacgtgcgtgaagtgaaaggactaactaaaggtggacctgggcatgaggaacccatcccaatgagtacatacgggtggaatctagtccgattgcaatcaggggttgacgtattctttacaccaccggaaaaatgtgatactctattatgtgatattggagagtcttcacccaacccaacaatagaagcaggaagaacattacgcgtattaagtctagtcgaaaattggctaaataacgacacacaattttgcataaaagtattaaacccatatatgccttcagtcatcgagaaaatggaaacgttacagcgtaaatatgggggagccttagttagaaacccccttagtagaaatagcacacatgaaatgtattgggttagtaacgcaactggcaatatagtcagctcagtcaacatgattagtcgtatgcttataaatcggtttacaatgaaacataagaaagccacttatgaaccagatgttgatttgggttctggaacgaggaatatcggaatagaatctgaaattccaaatctggatatcataggcaaaaggatagaaaagataaaacaagagcatgaaacatcatggcactacgaccaagatcatccttacaaaacatgggcgtatcacggttcgtatgaaacaaagcaaaccgggtcagcatcatcaatggtgaatggagtagtacgtctactaacgaaaccttgggacgtagtaccgatggtaacacaaatggcaatgactgacacaacgccctttggtcaacaacgcgtcttcaaagaaaaagttgacactcgaacacaagaacctaaagaaggaaccaagaaactcatgaagattacagcagaatggttatggaaagaattaggtaagaagaaaactcctcgaatgtgtacaagggaagaatttacacgtaaagtgcgctcaaatgcagcactaggggccattttcacagatgaaaataaatggaaaagcgctagagaagcagtagaagactcaagattttgggagctagtggataaggaaagaaatttacatttagaagggaaatgcgaaacgtgcgtctacaacatgatgggtaaacgagagaagaaactgggcgaatttgggaaagcgaaaggatcgcgcgctatatggtatatgtggctcggggcacggtttcttgaatttgaggccctagggttcttaaatgaagaccactggttttcgcgtgaaaatagtttaagtggagtagaaggagagggattgcacaagttagggtacatcctaagagatgtgagtaagaaagagggaggagcgatgtatgccgacgatacagccggctgggacacacgaatcacattggaggacctcaaaaacgaagaaatggtgaccaatcacatggaaggggaacataagaaattagcagaggctattttcaagctaacttatcaaaataaagtagtcagagttcagcgcccgaccccaaggggaacggtaatggacataatatcgcggcgtgaccagcgtggcagtgggcaggttggaacatacgggcttaacacctttacaaatatggaagcgcaactaattcggcagatggagggtgagggtgtattcaagagcattcaaaggttaacggttactgaagaaatagcagtacagaactggttagcaagagtaggcagagaacgtttatcgcgaatggcaatttcaggggatgattgtgtcgtgaaacctttggacgatcgatttgcttcagccttgacagcacttaacgacatggggaaagtaagaaaggacatacagcaatgggaaccaagtcggggttggaacgattggacacaggtaccattctgttcgcatcactttcacgagttaataatgaaagacgggcgagtactggtcgtgccatgcaggaaccaagatgagcttatagggagagctaggattagccaaggtgccggttggagcttaaaagaaacagcctgtctaggaaaaagctatgcacaaatgtggtcattgatgtattttcatcgacgtgacttaagattagcagcgaatgcaatatgctccgccgtccctagtcattgggtaccaacatcaaggacaacgtggagcattcacgccaagcatgagtggatgacaacagaagatatgttaaccgtatggaatagggtatggatccaagagaacccatggatggaggataaaacgccagtggaatcatgggaagaagtaccctatctgggtaaaagggaagaccaatggtgcggatctttaatcggtctaacaagtcgtgctacatgggccaaaaatattcaaacggcaatcaatcaagtaagatcgctaataggaaatgaagaatatacagattacatgccctcgatgaaacgcttccggcgggaagaagaggaggcgggcgtgctatggtaa

SEQ ID NO: 22770 - RNA, 9876 nt, synthetic construct
  misc_feature 1..9876: note = derived and/or modified CDS sequence (opt6) from DENV-2__EU482786__SS-prME
  source 1..9876: mol_type = other RNA
tctgcaggaatgataatcatgctgatacctaccgttatggcatttcatctaacaacaagaaatggggaaccacatatgattgtaggcattcaagaaaaaggcaaatcattgctatttaaaacggaagatggagttaatatgtgtacgctgatggcaatggacttgggggaactttgcgaagacacaattacgtataaatgcccactcttacggcaaaatgaaccagaagacattgattgctggtgcaactctacttcaacttgggtgacttatggaacgtgcacaactaccggcgagcatagaagagagaaaagatcagttgctctagttcctcatgtgggcatgggtttagaaaccagaacagaaacatggatgtcatcggaaggagcatggaaacacgcacaacggatagaaacatggatactacgacacccgggttttaccattatggcagccattttagcatatactataggtactactcactttcaaagagtcttgatcttcattttacttacagcagttgcaccttcaatgactatgcgatgtataggcatttctaatagagatttcgtagaaggggttagcggcggatcgtgggtagacattgttctagaacatggctcatgcgtcacgactatggccaaaaataaaccaacccttgactttgaattgataaaaaccgaagccaaacaaccagcaaccctgagaaaatattgtatagaagccaaactaacaaatactacgacagaaagtaggtgtccaacgcaaggagaaccttccttgaaagaagaacaagataaaagatttgtatgtaaacacagcatggttgacagaggatggggaaatggatgtggcttgttcggaaaaggtgggatagtaacatgtgcaatgttcacgtgcaagaaaaatatggaagggaaaattgtccaacctgaaaacttagaatataccatagttgtgacacctcattccggagaagaacacgctgtagggaatgatactggaaaacacggaaaagaaataaaagtaacaccacaatcaagcataacagaagcagaacttacaggatacggtacagtcacaatggaatgcagtcctaggaccggattggattttaatgaaatggtactactacaaatggaaaataaagcgtggttagtgcatcgacaatggtttcttgatttacccctgccctggctgccgggcgccgacaaacaagaaagtaattggatacaaaaagagacattagtaacctttaaaaatccacatgctaagaaacaagatgtagtagtactaggaagtcaagaaggagcgatgcatacagccctaacgggggcaacagaaatacaaatgagtagtggaaatttattattcaccggacatttaaaatgtcgtttgagaatggacaaacttcaacttaaaggaatgtcctactcaatgtgtacaggcaaattcaaagtggttaaagaaatcgcggaaacccaacacggcacaatagtaatacgtgtacagtatgaaggggacggtagcccatgcaaaatcccgttcgagattatggacctagagaaaaggtatgttcttggtcgcctaattacggtaaaccctatagtaacagggaaagacagccccgtgaacatagaagctgaacctcctttcggcgattcttatatcataattggggtggagcctggtcaactaaaactcaattggtttaagaaagggtcatcaataggacaaatgtttgaaaccacaatgcgtggagctaaaagaatggccattctaggcgacacagcgtgggacttcggatcactaggaggagtgtttacgtcaatcgggaaagcattacatcaggtattcggagcgatatacggagcggctttctccggagtatcgtggaccatgaaaattcttataggagtaattataacttggatcggaatgaactctaggagtacatcattaagtgtttctctagtcttagtaggaattgttaccttatatctaggggtcatggtgcaagcagacagcgggtgcgtagtatcatggaagaacaaagagctaaaatgcggaagcgggattttcattaccgacaatgttcacacttggacggaacaatataaattccaacccgaatcaccttcgaaacttgcatcagcgatacaaaaggctcaagaagaaggaatttgtggaattaggagcgtaacaaggctggaaaacctaatgtggaaacaaataactccagagcttaaccacattttagctgaaaacgaagtaaaactaacgataatgacgggcgatataaaaggcataatgcaagctggaaaacgatctcttcgtccccagcctaccgagctcaaatactcttggaaaacctggggaaaagcaaaaatgctctcgaccgaatcttacaaccagacgttcttgatagacgggcctgaaactgcagaatgtccgaatacaaatagagcatggaacagcttggaagtagaagactatggtttcggtgtgtttactacaaatatttggctaaagttaaaagaaaaacaagatgctttctgtgacagcaaacttatgtcagctgcaatcaaggataatagggccgttcatgccgatatgggatattggatcgaatcagcacttaatgatacttggaagatagaaaaggcaagtttcatcgaggttaaaaattgtcactggcctaaatcacacacgttatggtcaaatggagtattagagagtgagatgataatccccaaaaatctagctggaccggttagccaacataattatcgacctggataccacacacaaatcgccgggccatggcatttagggaaactggaaatggattttgacttttgcgacggcactacagtcattgtgacagaggattgtggaaatagagggccatctcttagaaccactactgctagcggcaaactaataacggaatggtgctgtaggtcttgtactctccctcctctacgatatagaggtgaagacgggtgctggtatggtatggaaatcagaccattaaaggaaaaagaggaaaacctagtcaatagcctagtaacggcgggacatggtcaagtcgacaatttttctttaggtgtcctggggatggcactctttttagaggaaatgctaagaaccagagtaggtacgaaacatgcgatactactcgtcgcagtttctttcgttacattgataacgggtaatatgtcttttaaagatttgggaagggtagtcgtaatggtaggggcgacaatggctgacgacattggtatgggggttacttatcttgctctactggctgcattcaaagtgagacccacgtttgcggcaggactacttctccgaaaattgacatccaaagaactcatgatgacaacaattggcatagtcctcttaagccaatctaccataccagagacagttctagaactgacagatgcactagcactaggaatgatggttctaaaaatcgttaggaatatggaaaaataccagctcgctgtaactattatggcaatattatgcgtcccgaacgcagtcgtactacagaacgcatggaaagttagctgcacaattctcgcagtcgtctcagtatcacccctattactaacaagtagtcaacagaaaactgactggataccattagcccttacaataaaaggtttaaaccctaccgcaatctttcttaccaccctgagtcgaacgaacaagaaaagatcgtggccactaaatgaagcgataatggcagtcggcatggttagcatccttgcttcttcactgctgaaaaacgacattccaatgacaggaccgttagttgctggaggccttttaactgtctgttacgttcttactggtagatcggccgacctagaattagagcgagcaaccgatgtcaaatgggaagatcaagcagaaatttctggatcgtcgccaatcctctccattacaatctctgaagatggatcaatgagtatcaagaatgaagaagaagaacagaccctcactattttaattaggactggattactcgtgatcagcggattatttccaatcagtatacctattactgcagcagcatggtatctgtgggaagtcaagaaacaaagggcaggcgttctatgggatgtaccgagccctccaccgatgggaaaggcggagttagaggatggagcatatcgaattaaacagaaaggaatccttggttacagccaaatcggcgctggagtctataaagagggaacgtttcacactatgtggcacgtcacacgaggagcagtattaatgcataagggaaaacgaatagaaccatcatgggccgatgttaagaaagacctgattagctacggcggtggttggaaactagagggtgaatggaaagaaggagaagaagttcaagtattagccctagaaccgggcaaaaacccacgagcagtacaaactaaaccaggactattcaaaacaaatacagggacaatcggagcggtttcactggacttcagtccaggaacgagtggaagtccaataattgacaagaaaggtaaggttgtgggactttatggtaatggcgtcgtaacgcgaagcggagcttacgtttcagccattgcgcaaactgagaaatccatcgaagacaaccctgaaatagaagatgatatcttcaggaaaagaagattgactattatggacttgcatccaggcgcgggtaaaactaagaggtatttgccggccatagttcgagaggctatcaaacgaggtttgagaacattaatcctagcaccaactagggtagtagccgcggagatggaagaagcactgagagggctcccaatccggtatcaaacaccagcgattaaagctgaacatacaggtcgagaaattgtcgatttaatgtgtcacgcaacattcactatgaggctcctatcgcccgtaagggtacccaactataacctaattataatggatgaagcacacttcacagaccccgcgagcatagcagccagaggttacataagtactcgggtcgagatgggggaggcagcgggtatttttatgactgccacacccccaggaagcagggatccttttccacagtctaacgctccaattatagacgaggagagagaaattccagaacggtcctggaacagtgggcatgaatgggtaaccgactttaaaggcaaaacagtttggttcgttccgtccatcaaagctggtaacgacatagcagcttgcctaaggaaaaatggaaagaaagttatacagctctcccgcaaaacatttgactcagaatatgtgaaaacccgaactaacgactgggattttgtagtgacaaccgacataagtgaaatgggcgccaatttcaaagcagaaagagttatcgatccaagaaggtgtatgaaaccagttattctaacggacggagaagagagagtaattctagcaggtcctatgccagttacacatagtagtgcagcacaaaggagaggcagaattggaaggaaccccaaaaatgaaaatgaccaatacatatacatgggagagccgcttgagaatgacggagattgtgctcactggaaagaagcaaaaatgcttcttgataacataaacacacctgaaggtattataccttctatgtttgaacctgagcgcgaaaaggtagatgctattgatggagaatacaggttacgcggtgaagcaaggaagacattcgtagatttaatgcgtcgaggagacttacctgtatggttagcatacaaagtcgccgccgaaggaattaattatgcagacagacgttggtgtttcgatggcataaagaacaaccaaattctggaagaaaatgtcgaagtagaaatttggacaaaagaaggagagcgtaagaaactaaaaccccgctggttggacgccagaatttattccgaccctttagccctgaaggagttcaaggagttcgctgcgggaaggaagtctttgacgttgaacttaattactgaaatgggtcggttaccaacttttatgacacagaaaacaagggatgcacttgacaatctcgccgttttacataccgcggaagcaggaggcagggcatacaatcatgcactctcagaactaccagagaccttggaaacattactattacttacgctcctggcaaccgtaacaggtggcattttcttgtttctcatgagcgggaggggtattggaaagatgacactgggtatgtgttgtatcataacagcctctatcctactatggtatgcacagattcagccacactggatcgcagccagtataattttggagttctttctgatagtactgcttatacctgaacctgagaaacaaagaacgccgcaggataatcagttaacatatgttgtaattgcaatactcacggttgtcgctgctacgatggcaaatgaaatggggttcctcgagaaaactaagaaagatttaggattgggttctatagcaacacaacaacctgaatcgaatatcttagacattgatctacgcccagcatcagcatggactctttatgcagtcgccacaacctttgttacaccaatgcttagacacagcatcgaaaatagtagcgtgaacgtaagtttgactgcgatagctaaccaagcaactgtactaatggggttaggcaaaggctggcccctaagtaaaatggatatcggtgtccctctccttgcaataggatgctattctcaagtaaacccgattaccctaactgccgctttactgttgctcgtggcgcattacgcgataataggacctggattacaagcgaaggcgactcgagaggcgcagaaaagggcggcggccggaataatgaaaaaccctacagttgatgggataaccgtaatcgatcttgatccaataccttacgatccgaaattcgaaaaacaattgggccaagtaatgcttctaattctatgtgtgacacaggtattgatgatgaggactacgtgggcattgtgtgaggcccttaccttagcaacaggtccaattagtacactgtgggaaggaaacccaggaaggttttggaatacaactatcgcagtatctatggctaatattttcagaggtagttatcttgctggagcaggattacttttctcaattatgaaaaacacaacaaatactagaagaggtaccggaaacataggagagactctaggagaaaaatggaaaagccgacttaatgctcttgggaaatccgagtttcaaatatataagaaatccggtattcaagaggtggatcgaacccttgcaaaagaaggcataaaacgtggagagacagatcatcatgcagtaagtagaggttctgcgaaattaagatggtttgtggaaaggaacatggttacgccagagggcaaagtcgtagaccttggatgcggtagaggtggatggagttattattgcggcggcttaaagaatgttagagaggtaaaaggtttgactaaaggaggccctggtcatgaagaacccatccctatgagtacatacggctggaaccttgttcgcctccagtcaggagtagatgttttctttatacctccagagaaatgtgatacattactctgtgacatcggtgaatcatcacctaatccaaccgtagaagcaggaagaaccttgcgggtattaaaccttgtcgaaaactggttgaataacaatacacaattttgtattaaggtgctaaatccttacatgccatccgtaattgagaagatggaagcattacaacgaaagtacggaggcgctttagtacgcaatccactatcaagaaacagtacccacgaaatgtactgggtaagtaatgcatccggaaatatcgtatcatcagtcaacatgatatcgcgaatgttaataaatcgtttcactatgcgtcataaaaaggcaacatacgaacccgacgtggacctaggatcaggaaccaggaacataggtatagaatctgaaataccaaacctagatatcatcggaaaacgtatagagaaaatcaagcaggaacatgaaacatcgtggcattacgaccaagatcatccctacaagacatgggcgtatcatggatcttacgaaactaaacaaacgggcagcgcttcaagcatggtaaatggggttgtgaggttacttacaaaaccctgggatgtcctacctacagttacacaaatggcgatgacggatacgacaccattcggacagcagagggtattcaaagaaaaagtcgatactagaacccaagaacccaaagaagggacgaagaaacttatgaaaataactgcaaagtggttgtggaaggaactagggaagaagaaaactccgaggatgtgtacaagagaagagtttaccagaaaagttaggtctaacgcagcactcggggcaatttttactgacgaaaataaatggaaatcagcgcgtgaagcagtagaggactcaagattttgggaactggtcgacaaagagcgtaacttacatcttgagggaaaatgcgaaacttgtgtttacaatatgatgggaaaaagagagaagaaattaggagagtttggcaaagccaaagggagtcgggcgatatggtatatgtggctcggtgctagatttttagaatttgaagcattaggtttcttgaatgaagatcattggttctcacgagaaaatagtttatcgggagttgaaggtgaaggactacataaattaggctatattctccgagatgtatctaaaaaggaaggaggtgctatgtacgctgacgacacggccgggtgggatacaaggataacacttgaagatttgaaaaacgaagaaatggttacgaatcatatggaaggagaacataaaaagttggccgaagcgatattcaaactaacataccaaaacaaagttgtaagagtccagagaccaacccccagagggacggttatggacattataagtagaagagatcagagaggatccggacaagtggggacttacggtctaaacacttttacgaacatggaagcccaactcatcagacaaatggaaggagaaggagtatttaaaaatattcaacacttaaccgttacggaagaagtggcagtccagaattggttagcgcgggtgggaagggaacgcttatcgagaatggctatctcaggcgatgactgcgtcgttaaaccactcgatgacagatttgctaatgcactaactgcactgaacgacatgggaaaaataagaaaagacatacagcaatgggaaccttcaaagggatggaatgactggacacaagtgccattttgtagtcaccattttcacgaactcattatgaaagatgggcgcgtcctagtggtaccctgtcgcaaccaagacgaattaattggaagggcccgcatatctcaaggggcaggatggtccctaagggagaccgcgtgtttaggaaaatcatacgctcaaatgtggtcgttaatgtattttcatcgccgagatctaagactagcagcaaatgccatatgttccgctgtaccgagtcattgggtccctacaagccgtaccacatggtcaattcatgcgaagcacgaatggatgacgacagaagatatgttaactgtatggaacagagtctggatacgagagaatccatggatggaagataaaacaccagtagaatcatgggaagaaattccatacttaggaaagagagaagatcaatggtgcggaagtttaatagggttgacatctcgagctacctgggctaaaaatatacaagccgcaataaatcaagttcgatccctaataggcaacgaagaatatactgattatatgcctagtatgaagagattcagacgtgaagaagaagaggcaggggttctttggtga

SEQ ID NO: 22771 - RNA, 9876 nt, synthetic construct
  misc_feature 1..9876: note = derived and/or modified CDS sequence (opt6) from DENV-2__EU482787__SS-prME
  source 1..9876: mol_type = other RNA
accgctggggttatcatcatgctaatacccactgcaatggcattccatctgacaactagaaacggtgaacctcatatgattgttggaagacaagagaaagggaaatcattgttatttaaaacagaagacggagttaatatgtgtacgttaatggcaatcgacttaggtgaactctgtgaggatacgatcacatacaagtgtcctttacttcgccaaaatgagccggaagacatagattgttggtgcaattcgacatcaacttgggttacatacggtacctgcactacaacgggggaacaccgacgagaaaaacgaagcgtcgcacttgttccacatgtggggatgggcttggaaacacgtaccgagacttggatgagcagcgaaggagcctggaaacacgcacaaagaattgaaacgtggatattgcggcatcccggcttcacaattatggctgcaatattggcatacacagtagggacaacacatttccaacgagctttgatattcatactcctggctgcagtggccccttctatgacaatgcgatgtattggaatatctaatcgtgatttcgtggaaggtgttagcggcggaagctgggtggacatcgttttggagcacggctcatgtgtgactaccatggccaagaataaaccaaccttagacttcgaactaataaagacagaagctaaacaaccagccacccttagaaagtattgtatagaagcgaaactaaccaacaccacaacggaatcgcgatgccccacacagggagaaccatccttgaatgaagaacaagataagagattcgtatgcaaacattccatggtagatcgaggatggggcaatgggtgtggactcttcggaaaaggtggtatcgtcacttgtgccatgtttacatgcaaaaaaaatatggaagggaaaattgttcaaccagaaaatttggaatatacaattgtcataactcctcactcaggcgaggaacatgccgtaggaaatgacactggcaaacatggaaaagagattaagattacacctcagtctccaattacagaagctgaacttacaggatatggaacagttacaatggaatgtagtccacgcacagggctagacttcaacgaaatggtattgctccagatggaagataaagcatggcttgtacatagacaatggtttttagatctaccactaccctggttaccgggagccgatacacaaggttcaaactggattcagaaagaaactttagtaacgttcaaaaacccacacgcaaagaaacaggacgttgtcgtattagggtcacaagaaggggcaatgcacactgctttaaccggggctacagaaatacaaatgtcgtccggtaatctattatttacaggacacttaaaatgcagactaagaatggacaaactccagctgaaaggcatgagctatagtatgtgcaccggcaaatttaaaatcgtcaaagaaatagctgagacccaacatggaaccatcgtaatccgtgtgcagtacgaaggagacggctcaccatgtaaaataccattcgaaataatggaccttgagaaaaggcatgtactagggaggttaatcactgtaaacccaatagtaacagaaaaagacagccctgtcaatattgaagcagaaccccccttcggggatagttatataataataggagtggaaccaggacagcttaagctaaactggtttaaaaagggatctagcataggtcaaatgtttgaaactacaatgcggggagctaaaagaatggcaatcttaggcgacactgcctgggactttggaagtttgggaggagtttttacctctatcggcaaggcgctccatcaagtttttggagcaatctacggcgcagctttctccggagtgagctggacaatgaagatattaataggagttataattacttggatcggaatgaatagccgatccaccagtctaagtgtaagcctagtactcgttggcgtcattactctctatctaggagcaatggtgcaagcagacagtgggtgtgtcgtgtcgtggaagaacaaagaactaaaatgcgggtcagggatcttcataacagacaatgtacacacatggacggagcagtacaaattccaaccagaaagtccatcgaaactagcaagcgcaattcaaaaagcacacgaggaaggaatatgtggaattcgcagtgtgacacggcttgagaacctgatgtggaagcaaataactccagaattgaatcatattttaagtgaaaatgaggtaaagctcacaataatgacaggagatattaagggcataatgcaagcaggaaaacgctctctaagacctcaacccaccgaactgaaatattcttggaaaacttggggaaaagcaaaaatgctaagtacggaatcgcacaaccagacatttctaattgacgggcccgaaactgcagaatgcccaaacactaacagggcatggaactcattagaggtagaagactacggatttggtgtatttacaactaacatctggctaaagttacgtgaaaaacaggatgtgttctgtgactccaaactaatgtctgcagcaattaaagataatagggccgtgcacgcagatatgggatattggattgagtcagctttgaatgacacttggaaaatggaaaaagcgagttttattgaggtaaaatcatgccattggcctaaatcgcatacgctatggtctaacggcgttctagaatctgaaatgataataccaaaatcattcgccggaccagttagtcagcacaattatcgacccggatattatacacaaacggcgggtccgtggcacttgggcaagctagagatggattttgatttttgcgaaggaacaactgttgtagtaacagaagattgtggcaatagaggcccctcactacgcacaacaacagcgtctggaaaattaataaccgagtggtgttgtcgatcatgtactctcccaccattaaggtatagaggagaagatggatgttggtatggaatggagattagaccgcttaaggagaaagaggagaatcttgtaaacagtctagttacagccgggcatggccaaatagataacttttcactaggagtattaggcatggcactttttttagaagaaatgttaagaacacgagtaggtacaaagcacgccatactactagtcaccgtatcctttgtaacattaataaccggaaacatgtcatttcgtgatttaggaagggtaatggttatggttggtgctgccatgacagacgatataggaatgggagttacttatctagcgttactggccgcattcaaggtacgaccgacattcgcagcaggtttactgctccgcaaattaacttctaaagaattaatgatggccacgattgggatagcattactttcacaatcaacgattcccgagactatcctagaactaactgacgcacttgcgctaggaatgatggtattaaaaattgtaagaaatatggaaaaataccaattggcggtaacaatcatggcaatttcatgcgtcccaaatgctgtaatacttcaaaacgcctggaaagtatcttgtactatactggcagctgtttcagtctcaccactcttacttacaagctctcaacagaaagccgattggattccactcgcacttacaatcaaaggtctaaatccaacagccatatttctaactacattgtccaggacgtcaaaaaaacgttcatggcctctaaatgaggccatcatggcggtgggaatggtatcaattcttgcctcttctctacttaagaacgatataccaatgacggggcctctagtagcagggggcttattaaccgtttgctatgtgttgactgggagatcagcggatttagaacttgaacgtgctactgacgtaaagtgggaggaccaggccgaaataagtggatcttcccctatactatctatcaccatagcagaagatggatctatgagtataaagaacgaagaagaagaacaaacgcttactattttaattcgaacagggcttctagtaataagcggtttatttccagtttccataccaattactgcagcggcatggtatttatgggaagtcaagaaacaaagagctggtgtcttatgggacgtaccaagtcctcctcccgtcggaaaagctgaactagaagatggagcttatcggatcaaacaaaaaggaatactaggatatagccaaattggagccggcgtctataaagagggtacattccatacaatgtggcacgttacaagaggtgctgttttgatgcatcgaggaaaacgaatcgagcccagttgggcagacgtcaagaaagatttaatatcttacggaggtggatggaaactagaaggagaatggaaagagggcgaagaagtacaagtgcttgcactcgaaccgggcaaaaatcctcgagcagtccagacaaaaccaggtttatttaaaactagtacaggcaccataggggctgtgtcactagacttttcaccaggaacgtctggttcgccgatagtggacagaaagggaaaggtagttggattgtatggtaatggagttgtaactagaagtggggcgtacgtttcagccatcgcacagacagaaaaaagcatagaagataatccagagattgaagatgatatatttaggaaaaaaagacttacaattatggatctacaccccggcgcgggtaaaacaaagagatacttaccggcaatagtcagagaagccataaaaagaggcttaagaacgcttatacttgcccctactcgagttgtagcagcggagatggaagaagccctaagagggctgccgatacgatatcaaacgcctgcgatcagagcggaacatacaggacgagaaattgtagacttaatgtgtcatgctacatttacgatgcgtctgctttcgcctgtaagagtcccgaattacaatctcataataatggatgaagcacattttacagatccggcgagtatagcagcccggggttatatctctacgagagtcgagatgggagaggcagcaggaatcttcatgacagctacacccccaggaagtagggatccatttccgcaatcaaacgctcctataatggatgaggaacgagagataccggaacgaagttggaattctggtcacgaatgggtcacagactttaaaggcaaaacagtctggtttgtgccttccattaaagccggtaatgacatagcggcatgcctccgcaaaaacggtaaaaaagtcatccagttatctagaaaaacgttcgattcggaatacgtaaaaacgcgaaccaacgattgggatttcgtagttacaaccgatatatcggaaatgggagcaaattttaaggccgaacgtgtgatagacccaagaaggtgcatgaaaccggtaattcttacagacggcgaagaaagagtgatattagcgggaccaatgcccgtaacacattcaagtgctgctcaaagaaggggtcgaatcggaaggaatcctaaaaatgaaaacgaccaatatatatacatgggggaaccactcgaaaatgatgaagactgcgcccattggaaggaagccaagatgctactagataatattaatactcccgaaggaattattccatctatgttcgagcctgaaagagaaaaagtagatgcaatagatggggaatacagactaaggggtgaggccaggaagactttcgtagatctaatgcgaagaggagacttacctgtatggctagcatatagggtggcagcagagggaattaattatgccgaccgccgatggtgtttcgatggagtaaagaacaaccaaatactagaagaaaatgtagaagtggagatctggacaaaggagggagaaaggaaaaaattaaaaccgagatggctagatgcgagaatttatagtgaccccctagcactgaaggaattcaaagaatttgctgcaggacgaaaaagtctaacgttaaacctcatcactgagatgggtagactaccaacatttatgactcaaaaagcccgggacgcactagataatttggctgttttacatacagcagaagctggtggcagggcctataatcatgctttaagcgagttaccggaaactcttgaaacgttattgttattaacattgctcgcaacggtgacaggcggaatctttctctttttgatgtctggcaagggggttggaaaaatgacactaggaatgtgttgcataataacagcatccatcctactctggtacgcccagattcaacctcattggattgcagcatcgatcattcttgaattttttttaatagtattacttatacccgagccggaaaaacaaagaactccacaagacaatcaattgacttatgttgtcatcgcaattttaacagtcgtagcagcaacaatggcaaatgagatgggattccttgaaaaaaccaagaaagatttaggtctcggttccattgcaacgcaggaacctgagagcaacatactcgatattgatctcagacctgcgtccgcttggaccctgtatgcggttgccaccacatttgtcacaccgatgcttagacatagtattgaaaatagcagcgtcaatgtctccctaacggccattgcgaatcaagccacagtacttatgggattaggaaagggatggcctttatcgaaaatggacattggtgtacccctactggcaatcggatgttattcccaagtcaatcccataacattaactgccgcactacttctattagttgctcactacgcaataataggacccggcttacaggccaaagccactagagaagcacagaaacgtgcagcagctggtattatgaaaaatccaactgtcgatggggtaacagttatagacttagacccgatcccgtatgatccaaaattcgaaaagcagctaggacaggtgatgttactaatcttgtgcgtcacccaagtcctgatgatgagaaccacgtgggctctatgtgaggcacttacattggctacaggtcccataagtacactgtgggaaggaaatccaggtagattttggaacacaacaattgcggtatcaatggcgaatatatttcgagggtcatatctagccggtgccggtttacttttctcaatcatgaaaaacacaactaatacacgacgaggtacgggcaacattggagaaactctaggagaaaaatggaaaagtagactaaacgctttgggcaaatcggaatttcagatatacaaaaagagtggcatccaagaggttgatcgaacacttgcgaaagagggcataaagcgaggggaaacagaccatcacgcggtttctagggggagtgctaagttaagatggtttgttgaacggaatatggtaacaccagagggtaaagtggtagatttaggatgcggacgcggtggatggtcatactattgtggtggattaaaggatgttagagaagtaaaaggactaacaaagggtggaccaggacacgaggaaccgataccaatgagcacatatggatggaatttggttcgtcttcagtctggagtagacgtattcttcacaccccccgaaaaatgcgatacattattgtgtgacattggcgagtcatcgccgaatcccaccatagaggccggacgtactcttcgtgtcctttctcttgtggagaactggctaaacaatgatacacaattttgcatcaaagttttaaacccctatatgcctagtgtaattgaaaaaatggagaccctgcaaagaaaatatgggggagctttggttcgtaaccctctaagccggaacagtactcacgaaatgtattgggtaagtaatgctacgggtaacatcgtgagctcagtaaatatgatatctcgaatgctaattaatagattcacaatgaagcataagaaagcaacctacgaaccggacgtcgacctcggatctggaactcggaacataggtatagaatcagaaataccaaatttagacataataggaaaaagaatagaaaagataaaacaggagcatgaaacctcttggcactacgatcaagatcacccgtacaaaacttgggcatatcacgggagttatgagactaaacaaacaggctcagcatcatcgatggtcaatggtgttgtaagactactaactaaaccgtgggacgtagtcccgatggtcacgcaaatggcaatgacggataccacaccatttggtcaacagagggtatttaaagaaaaggtcgacacacgtacgcaagaacccaaagaaggaacaaaaaagcttatgaaaataacagcagaatggttatggaaagaacttgggaaaaagaaaactccaagaatgtgcacgcgtgaggaattcacaaggaaggttaggagtaacgcagcattaggagcaatttttacagatgagaacaagtggaagagtgctcgcgaagcagtggaagatagtaggttctgggagctagtcgacaaggagcgcaatctacatttagaaggaaaatgtgagacctgtgtatacaacatgatgggcaaacgggaaaaaaagttgggagaattcggtaaagcaaaaggatctcgggccatttggtacatgtggttaggggcacgttttttagagtttgaagctctaggattcctcaatgaagaccactggttcagtcgagaaaattccctttccggtgtagaaggagagggcctgcacaaactaggctacatactgagagatgtgagcaagaaggagggaggcgcgatgtacgctgatgatacagccggctgggatacgagaattactcttgaagacttaaaaaatgaagaaatggttaccaatcatatggaaggggaacataagaaactagcagaggcaatattcaagctaacttatcaaaacaaggtagtcagagtacaaaggccaaccccacgagggactgtaatggacataataagtagaagagaccaacgtggaagtggacaggtaggcacatacggcttaaatacatttacgaatatggaagcacagttgatcagacaaatggagggagaaggtgtctttaaaagtattcaacgattaactgtgacagaggaaatagctgtccaaaactggttagcgagagtagggcgtgagaggttatctagaatggcgataagtggcgatgattgcgttgtaaaaccattagatgacagatttgcatcagcgctcactgcactcaacgacatgggcaaagttagaaaagatatacaacagtgggaaccctcacgcggttggaacgattggacacaagtaccattctgttctcaccattttcatgaactcataatgaaagatggtagagttttagtagtaccatgtaggaaccaagatgaattaattggtagagctcgtatatcgcaaggagcgggatggagccttaaagaaacagcatgcttgggtaagagttacgcacaaatgtggtccttaatgtattttcatcgccgagatttgagactggccgcaaatgccatatgttccgcagtcccatctcattgggtacccacttctaggaccacatggagtattcatgccaaacacgaatggatgacaacagaagatatgttgacagtctggaaccgtgtatggatacaagaaaatccttggatggaggataaaactcctgttgaatcatgggaagaagtcccataccttggcaaaagggaagatcaatggtgtggttcgttaataggccttacctctcgagccacctgggccaaaaacatccaaacagccataaatcaagtcagatctctaattggcaacgaagaatatacagattatatgccatcgatgaagagatttagacgggaggaagaagaagccggtgtactatggtga

SEQ ID NO: 22772 - RNA, 9876 nt, synthetic construct
  misc_feature 1..9876: note = derived and/or modified CDS sequence (opt6) from DENV-2__EU482788__SS-prME
  source 1..9876: mol_type = other RNA
actgccggtgttatcatcatgttaattccgaccgcaatggcatttcatctaaccacaagaaatggtgaaccgcacatgatagttggtcgccaagaaaaaggtaaaagtttactcttcaaaactgaagatggtgttaatatgtgtaccctaatggcaatagacttaggagaactatgtgaagatacaattacgtataaatgccccttgcttcgacaaaatgaaccagaagatattgattgttggtgtaatagtacatcaacatgggtgacgtatggaacatgtaccaccaccggagaacaccgtagggagaaaagatccgtagcattagtccctcacgttggaatggggcttgaaactagaaccgaaacgtggatgtcatcagaaggagcatggaaacatgcacaacgaattgaaacatggatcctgagacatccaggttttacaataatggccgctatcctcgcatatacagttggaacaacacactttcaaagggccctcatttttatattactcgccgcagtggctccatcaatgacaatgcgttgtatagggatatcaaatagagacttcgtggaaggtgtaagcggtggctcctgggtagacatcgtactagaacatggaagttgcgtcacgaccatggctaaaaataaaccaacattggattttgaacttattaaaacagaagcaaaacagcctgcgacgctaaggaaatattgtatagaagcaaaactaactaacactacaacagaatcaagatgtccaactcaaggtgaaccttcacttaatgaagaacaggataaaagatttgtttgcaaacatagtatggtagatagaggatggggaaatggatgtggactgttcggaaaaggaggaattgtaacgtgtgccatgttcacttgtaagaaaaacatggaaggaaaaatagtacaaccggaaaacttagaatacacgatagtcattacgccacactcaggagaagaacacgcagtcggaaatgacacgggcaaacatggaaaagaaataaaaatcacacctcaatcacctataacagaagctgaattaactggatacggaacagtaactatggaatgttcaccccgaacaggcctggactttaatgaaatggtattattacaaatggaagacaaggcttggctagtacatcgacaatggttcttagatctaccccttccatggttaccgggggccgatacccaaggttcaaactggatacaaaaagaaacactcgttacgtttaaaaatccgcatgccaagaaacaagatgtagttgtacttggctcacaagaaggagcaatgcacactgcgttaaccggcgctacagaaatacaaatgtcgtcaggcaacttgttgttcacaggacaccttaaatgccgattaagaatggataaactgcaactgaaagggatgtcatatagtatgtgtaccggcaaattcaaaattgtcaaagagattgcagagacccaacacggcacaatcgtaatcagagtgcaatatgagggtgatggctcgccgtgtaaaatcccttttgaaataatggatttggaaaagcgccatgtgttagggcgtttgataaccgttaaccctattgttaccgagaaagatagcccagtaaatattgaagcggaaccgccgttcggagacagctatataataataggggttgagcctggacaacttaaactgaattggtttaaaaagggttcaagtataggtcaaatgttcgaaaccactatgagaggcgcaaagcgaatggcaatcttgggggacaccgcctgggactttggttccttagggggagtatttacatcgataggaaaggctttacaccaagtatttggcgcaatatacggcgctgcattcagcggtgtaagttggactatgaaaatccttattggcgttatcataacatggattggaatgaactccagaagcacttccctaagcgtcagtctcgtactcgtaggtgtaattacgctttacttgggagccatggtacaggccgactctggctgcgtagtaagttggaagaataaagaactcaaatgtggttcggggatttttataacggacaacgtacacacctggactgaacagtataagtttcaaccagagagccccagcaagttagcaagtgccattcaaaaagcccacgaagaggggatttgcggcattaggtccgtcactagactagaaaaccttatgtggaaacaaataactccggaacttaaccacattctatcggaaaatgaggtgaaacttacaataatgacaggagacatcaaaggaataatgcaagcaggaaagagatcacttagacctcaaccaacagaactaaaatacagctggaaaacatggggcaaagcaaaaatgcttagtaccgaaagccacaaccaaacatttctaatagacggtcctgaaacagctgagtgtcctaacaccaacagagcatggaactctttagaagtagaagattatggttttggcgtttttacaactaacatatggttaaagctacgagaaaaacaagatgtattttgtgattccaaactcatgtcagctgcaattaaagacaaccgtgctgttcatgcggatatgggctattggatcgagtcagccttaaatgatacgtggaaaatggaaaaagcatcattcatagaagtaaagagttgccactggccaaaatcacatacactttggtctaatggcgttctcgaatcagaaatgatcatccccaaatcatttgcgggcccagtctcacagcacaactataggcccggatactacacgcagacagctggaccttggcatctgggaaagttagaaatggattttgacttttgcgaagggactacagtagtagtcaccgaggattgtgggaacagagggcctagtttaagaacaaccacagcctcaggaaaacttataactgaatggtgctgtcgaagttgcaccctcccgccgcttagatatcgaggagaggatgggtgttggtatggaatggaaattcgaccgctcaaagaaaaagaagagaatttagtcaacagtcttgttacagcaggacatggtcaaattgataatttttcactcggagtactgggtatggcgttatttctggaagaaatgttacggacaagggtaggaacgaaacacgctattttgctagtcactgtatcatttgtaacgctgatcaccggtaatatgtcgtttcgcgacctcggacgggtaatggttatggtgggcgcagcgatgactgacgacataggcatgggcgtgacgtacctcgcgctactagcggcatttaaagttcggcccacatttgccgccggcttattgctcagaaaactcacatccaaagaactcatgatggcaacaattggaatagcattgttaagtcaaagtactattcccgaaacaattttagaactaaccgacgcacttgcactcggaatgatggtactcaagattgttaggaatatggaaaaatatcaactcgcagttaccataatggcgattagttgtgttccaaacgcagtaattctacaaaacgcatggaaggtaagttgtaccatccttgctgctgtaagtgtgtcaccactactactaacttcatctcaacagaaagcggattggatacctttagccttgacgattaaaggtctcaatcctaccgcgatatttctaactacactgtccagaacttctaagaaaagatcatggcctcttaatgaagcaatcatggctgtaggcatggtgtctatactagctagcagcctattaaagaatgacattcccatgactgggccactggttgcgggcggacttctcacagtttgctacgttctaacaggaagatctgccgatctagaattagaaagagcaacagatgttaaatgggaggatcaggcagaaatatcaggttcctcacccatattaagcattaccatagccgaggatggatcaatgtcgatcaaaaatgaagaagaagaacagactctaaccatactgatacgtaccggactccttgtaatatctggattatttccggtcagtataccgataaccgcggctgcctggtacctttgggaagtcaagaaacaaagggcaggagtcctttgggatgtacctagtcctcccccagtcggaaaggcggaactagaagatggagcttaccgaatcaaacaaaaaggaatactaggctattctcaaatcggggcaggagtgtataaagaaggaacattccatactatgtggcacgttacgaggggagctgtgctgatgcatcgcggtaaaaggatagaaccatcatgggccgatgtaaagaaagacctaatatcgtatggcggtggctggaaattagaaggggagtggaaagaaggagaagaggtgcaagtactcgccctagaaccaggcaagaatcctcgtgctgtccaaacaaaaccaggattattcaaaaccaacaccggcactataggcgcagtatcactggattttagtccggggacatccggaagccccatagtagataggaagggtaaagttgtgggactctatggtaatggggtagttactcgatctggagcgtatgtctcggccattgcacagacagagaaaagtattgaagataaccccgaaatagaagatgacatatttagaaagaaacgacttactattatggatttgcacccaggcgccgggaagacaaaaagatatctacctgcaatagtaagagaggcaattaaaagaggcctacgaactttaattttagcaccaactcgggtagtggcagcagaaatggaggaagcactaagaggattacctatccgatatcaaacgccagcgattagggcggaacatacaggccgagaaattgtagatctaatgtgtcatgcaactttcacaatgaggcttttgagtccagtaagagtgccaaattataatttaattataatggatgaagcacatttcaccgaccctgcttctatagcagcccgaggttatataagtactcgcgtcgagatgggcgaggcagcaggtatttttatgacggcgacacctcctggatcgcgcgatccgttcccacagagtaatgcaccaatcatggatgaagaacgagaaataccagaaaggtcttggaactctggtcatgaatgggttacagacttcaaagggaaaacagtttggttcgtaccgtccattaaagctggaaatgatatcgcggcatgcctgcgaaagaatggcaagaaagtcattcagttatcacgtaaaacctttgacagcgaatacgtcaaaactaggacaaatgattgggactttgttgttactacagatatatcggagatgggcgcaaactttaaagcagagagagtaatcgaccctagaagatgtatgaagccagtaattttgacggatggagaagaaagagtaatccttgctggtcctatgcctgttacacactcatcagcagcacagaggcggggtagaataggaagaaatcctaagaatgaaaacgatcaatatatatacatgggcgaacctttagaaaatgacgaggactgcgcacattggaaagaagcaaagatgttattggacaatataaatacacctgaaggaatcataccaagtatgtttgaaccagagagagaaaaagtagatgccatagacggggaataccgtttaagaggggaagcacgaaaaacctttgttgatttaatgaggagaggcgacttacccgtatggttggcatatagggttgcggccgaaggaataaactacgccgataggagatggtgtttcgatggggtcaaaaacaaccagatattagaagaaaatgtagaggtagaaatatggacgaaagaaggggaacgtaagaaattaaaaccacggtggctagatgcgcgtatatactctgatcctcttgcattgaaagagttcaaagagttcgcagcagggcgaaaaagtctgaccctgaatttgataactgaaatgggtcgtcttccaacatttatgacgcaaaaggcacgcaacgcattggataacctcgcagttttacatacagcagaggccgggggacgagcatataaccacgcattaagcgaactaccggaaaccttggaaacattattactactaaccttactagccaccgtgactgggggaatattcttatttttaatgtcaggaaaaggagtgggaaaaatgactctcggtatgtgttgtataatcaccgcatcaatattactatggtatgcccaaatccagccgcactggatagcggctagcattattcttgagtttttcttgatcgttttgttaataccagagccggaaaaacaaaggacaccgcaggataaccaactgacatatgttgtgattgctatactaacagtcgtggcagctaccatggcgaatgaaatgggattcctagaaaagactaagaaagatctcggactcggaagcatagcaactcaagagcccgaaagcaacatcctagacatagatcttcgtccagcaagtgcgtggacactttatgctgtagctaccacatttgtaacacctatgctgcgacatagcatagaaaattcctcagtgaatgtatccttaacagctatcgcaaatcaagccactgtgctcatgggcctaggcaaaggatggccattaagcaaaatggacataggagtgccactattagctataggatgctactcgcaagtcaatcccatcactctaactgcagcgttactccttcttgttgcacattacgcaataataggtccaggtctacaggctaaggcgacacgagaagcgcagaaaagggcagctgcaggcataatgaagaatccaactgtcgacggaataaccgtgatagacttagacccaataccttatgatcccaagttcgagaaacaattaggccaagtgatgttactaatcttatgcgttacacaagtattaatgatgagaacgacatgggctctatgcgaagcattaactttagcaacgggacctatatcaactctctgggaagggaatccgggacgcttttggaacacaacaatcgctgttagcatggcaaacatattcagaggtagttaccttgcaggagcaggtttattgtttagcattatgaaaaataccacaaatacaaggaggggaacaggaaacataggagaaacgttaggagagaagtggaaatcacgattgaatgctcttggcaaaagtgagttccaaatatacaagaaatcaggaatacaagaagttgaccggacactggctaaagaagggataaaaagaggtgaaacagaccatcatgcagtaagcagaggtagtgccaaactacgttggtttgtagagagaaacatggtcacgccagaaggtaaggttgtcgatttgggctgcggaaggggcggttggagctactactgtggaggcctaaaagacgtaagagaagtaaagggactcacaaaaggtggtccgggtcatgaagaaccaataccaatgtctacgtacgggtggaatctagtaagactacaatcgggagtcgatgtattctttactcccccagagaagtgtgacacccttctatgtgatattggagaatcaagcccaaacccaacaattgaggcaggaaggacgcttagggtcttaagtttagtggaaaattggcttaataacgacactcagttttgcataaaagtcctaaatccctatatgccgagcgtcatagagaaaatggaaactctacaaagaaaatatggcggagctctagtaagaaatcccctgagcaggaacagcacacatgaaatgtactgggtatcaaatgccacaggaaatatagtcagcagcgttaatatgattagtagaatgttaataaatagatttactatgaagcataagaaagccacttacgaaccagatgtagatttagggagcggtacgaggaatataggcattgagagcgaaatccctaatctagatataattggcaaacgtattgaaaagattaagcaggaacatgaaacttcgtggcactatgatcaggatcatccatataaaacgtgggcttaccacggaagctatgaaacaaagcaaacgggcagtgctagcagtatggtaaacggagttgttaggctcttgactaaaccttgggacgtcgtaccaatggtcacacagatggctatgacggacaccaccccttttggacaacaaagagtcttcaaagagaaagtagatacccgaacccaagagcccaaagaaggaactaaaaagttgatgaaaattaccgcagaatggttgtggaaagaactgggcaagaagaaaacaccccgtatgtgtacacgtgaagagttcacaagaaaagtaaggtcaaatgcagcactaggagctatttttacggacgagaataaatggaaaagtgcacgagaagctgtcgaagactcaaggttttgggagctagtagataaggaaagaaacctacatttggaaggaaaatgtgagacgtgtgtctataacatgatgggaaagcgtgaaaagaaactaggagagttcgggaaagctaaaggtagtcgcgcaatatggtacatgtggctgggagcaagatttctcgagtttgaagcccttggatttttgaatgaagatcactggttcagtcgagaaaattcattatcgggtgtagaaggagagggactacataagttagggtacatactgagagatgttagcaagaaagagggaggagccatgtacgctgatgacacggctggatgggatacaagaataacattggaagatctgaaaaatgaggaaatggttacaaatcacatggagggagaacacaagaaactagcagaagctatatttaaactgacgtaccagaataaagttgttcgggttcaaagaccaacgcccagaggcacagtaatggatatcataagtcgtcgtgatcaaagaggatcaggtcaagttggcacatatggtctaaatacatttactaacatggaagcccaattaattagacaaatggaaggagaaggggtgttcaagtctattcaaagattgacagttacagaagaaattgccgtccaaaattggctggccagagttggcagggaaagattatcaaggatggctatatcaggcgatgactgtgtagtaaagccgctagatgatagattcgcatcggctttgacggcgctaaatgacatgggtaaagtacgaaaagacatccaacaatgggaaccctctaggggttggaatgactggactcaagtgcctttctgctctcaccattttcatgaactaattatgaaagatggaagggtgctagttgtaccttgtagaaatcaagatgagttgatcgggagggcgcgcatcagccaaggtgctggttggtccttgaaggaaacagcatgcctggggaaatcatatgcgcaaatgtggtctctaatgtatttccatagacgagacttacggttagctgcaaacgcaatttgctcagcagtcccatcccattgggttcctacttcgagaacaacttggtcaattcacgcaaagcacgaatggatgaccacagaagatatgttaacagtgtggaatagagtatggattcaagaaaatccatggatggaagataaaacaccagtagagtcttgggaagaagtaccctacttaggcaagagggaggaccaatggtgtggttccctaataggtctaactagcagagctacgtgggccaaaaatattcagactgcgattaatcaagtccgatcactgatcggtaacgaagagtacacagactatatgccttcaatgaaaagattcagacgcgaggaagaagaagcaggagtactatggtaa

SEQ ID NO: 22773 - RNA, 9876 nt, synthetic construct
  misc_feature 1..9876: note = derived and/or modified CDS sequence (opt6) from DENV-2__EU482697__SS-prME
  source 1..9876: mol_type = other RNA
tcggcaggcatgataattatgttaataccaacagtaatggcctttcatttaaccacccgtaacggtgaaccacatatgattgtagggatacaggaaaaagggaaatcgcttttgtttaaaaccgaagacggggtaaacatgtgcacattgatggctatggatctaggtgagctatgtgaggatacaattacctacaaatgcccattgctacgtcaaaatgaaccagaggatatagattgttggtgtaactctacgagtacttgggtaacttacggaacctgcactactactggcgaacatagacgtgagaaacgatcagtagcccttgtcccacatgtcggtatgggattagagacgagaacggagacatggatgagctccgagggagcatggaaacatgcccaacgtatagagacgtggatattgagacatccagggttcacaataatggcagctatactggcctatacaataggaacaacccacttccaacgggtcctaatatttattcttttaacagcggtagcgccaagtatgacgatgcgatgcattggaatatcaaatagggactttgtagaaggcgtttcaggaggcagttgggtagatattgtactagaacacggatcatgcgttacaacaatggccaaaaataaaccgactttagactttgaattaattaaaacagaagctaaacaaccggcaactctccgaaaatattgtatagaagcaaaattaaccaatacaactactgagagccgctgtcccacacaaggcgagcccagccttaaagaagaacaagacaaaaggtttgtatgtaaacatagtatggtagatcgtggatggggaaacggctgtggtttattcgggaaaggaggcatagtcacttgcgcaatgtttacgtgcaagaaaaacatggaaggtaaaatcgttcaaccggaaaatctggaatataccattgtggtaacacctcattcaggggaggagcatgctgtagggaatgacactggcaaacacggccaagaaattaaagtcacaccacaatcatctataaccgaagctgagttaacaggctacggaactgttactatggagtgcagcccgcgaacaggcctagattttaacgagatggtcttactccaaatggaaaataaagcatggctcgtacatcgacagtggtttctcgacttacccttaccatggctcccaggagccgacaaacaagaatctaattggatacaaaaagaaactctggtgactttcaaaaatccgcatgccaagaaacaagacgttgtagtgcttggaagccaagagggtgcaatgcacacagctctgacaggagccacagaaatacaaatgagtagcggcaatctattattcacaggacatttaaaatgtagattaaggatggataaattacaattgaaaggaatgagttacagtatgtgtacaggaaaatttaaagtagtgaaagaaattgccgaaacacaacatgggaccatagtcattagagttcaatatgaaggtgacggtagtccttgtaagatacccttcgaaataatggatttagaaaaacgatatgtcttaggacgcttaattactgtaaaccctattgtcacagaaaaggattcaccggtaaacatcgaagcggaaccgccctttggagacagctatataataataggagtcgagcctggtcaactgaaattaaactggtttaagaaaggatccagtattggacaaatgtttgaaactacaatgagaggggcaaaaagaatggcaatactaggggatacagcgtgggactttggctctttaggtggggtttttaccagcataggaaaagcattacaccaagtctttggggcaatctacggtgctgcgtttagtggggtatcttggactatgaaaatattaatcggtgttataattacatggatcggcatgaatagccgatcaacctcgctttcagtaagcctcgtattggtaggaatagtaacactatatttaggggtaatggtacaagctgattcaggatgtgtggtttcctggaaaaacaaagaactcaaatgtggatcaggtatctttattacagataatgtacatacgtggacagagcagtataaatttcagccagaatcaccttcaaaattagcaagtgcaatacaaaaagctcaagaggagggaatttgtgggataagaagcgttacacgtttagaaaatcttatgtggaagcaaataacaccagaactcaatcacatacttgccgaaaatgaagttaaactcacaataatgactggcgatataaagggaattatgcaagcaggtaaaagatcattacggccacaacctactgaacttaaatattcatggaaaacctggggcaaggcaaaaatgttatccacggaatcatataatcaaacgttcttaattgatggaccagaaacagcggaatgtccaaatactaacagagcatggaatagcttggaagtggaggactacggatttggagtcttcacaacaaacatctggttgaagttaaaggagaagcaagatgccttttgcgatagcaaacttatgtcagccgcaatcaaggacaacagagcagtacatgcagatatgggatactggatcgaatcagcattaaatgacacttggaaaattgagaaagccagcttcatagaggtgaaaaattgtcattggcccaagagtcatacactttggtctaatggagtgttggagtcggagatgataatacccaaaaacctagccggaccggtgtcgcaacataactatcgtcctggctatcatacgcagatagcaggaccctggcatttgggaaaattagaaatggacttcgacttctgtgatggaacgaccgttatagtaacagaagactgcggaaatagaggtccgtctcttcgtacgactacggcgtcgggtaagctcatcacagaatggtgttgtcgaagctgtactttaccgccgttacggtaccgtggcgaagatggctgttggtacggcatggaaattaggcctcttaaagagaaagaggaaaacctggtaaatagtcttgtaacggcggggcatggccaggttgacaatttctcattaggtgtacttggcatggctttatttttagaagaaatgctaagaacaagagtcggcacaaaacatgccattctccttgtcgcagtatcgttcgtaactctcattaccggaaatatgtcatttaaagatctaggtcgcgttgtcgtgatggtaggtgcgacgatgaccgacgatataggaatgggagttacttatttagcactattagctgctttcaaagtaagaccgacattcgccgctggattgttgctcagaaaattaacgtcaaaagagctcatgatgactaccatcggaatagtgctcctctcacaatcaactattcccgaaaccgttttggaactgactgatgccctggcacttggaatgatggttctcaagatcgtaagaaatatggaaaaataccagttagctgtgacgattatggcaattttatgtgtcccaaatgcagtaatactccagaatgcctggaaggttagctgtacaatactagcggttgtaagcgtctcaccattactattaacatcatcgcaacagaaaacagattggatacctttggcactaaccataaaaggtttaaatccaaccgctatatttttgaccacattaagtcgaactaataagaaacggtcgtggccattgaacgaggcaataatggctgtgggtatggtttccatcttggcttctagccttttgaaaaacgatatacctatgactgggccattagtagcagggggtctattgacagtatgttatgtattaacaggaaggtctgcggacttagagctcgaaagagccaccgatgtaaaatgggaggaccaagctgaaatttctggatcatccccaatattaagcatcacaatctcagaagacgggagtatgtcaatcaaaaatgaagaggaggagcaaaccttaacaatactcatacgaacaggactattagtcataagtggtcttttcccgatatcgatccccattactgcagcagcttggtacctatgggaagttaagaaacaacgagctggtgtgttatgggatgtcccaagtccgccacctatgggaaaagccgaactcgaagatggagcataccgaataaaacaaaagggaatactaggttattcacaaataggtgccggtgtctatcgggaaggaacattccatacgatgtggcacgtaacacggggtgctgttctaatgcataaaggaaagcgtatcgagcctagttgggcggacgtaaagaaagacttaatcagttatggaggaggatggaaattggaaggcgaatggaaagaaggagaggaggtacaggtattagcgctcgaacccggcaaaaaccctagagccgtccagactaaaccaggactcttcaaaaccaatacaggcacaataggagccgttagtttagacttcagtcctggcaccagtggctccccaataatagataagaaaggaaaagtggtgggtctttacggaaatggcgttgtcactcgctccggagcttacgtaagcgccatagctcagactgagaaaagcattgaagacaacccggaaattgaggatgatatattccgtaaaagaagattaacgattatggacctacatccgggggcagggaaaactaaacgatacttgccggcgatcgtcagggaagcaattaaaagaggcctgcggacgctaatactggcacccacgcgggtagtggccgcagaaatggaagaagccttgcgaggattgcctatacggtaccaaaccccggccatacgagctgaacatactggaagagaaatagtagatctgatgtgtcatgcaacttttacgatgcggcttctatcgccagtaagagtaccgaattataacttaataataatggatgaagcacatttcacagatccggctagcatcgcagcgagaggttatataagtacccgtgtagaaatgggtgaggccgccggcatttttatgaccgctactcctcctggatccagagacccatttccacaatctaacgctccaataatagatgaagaaagagagattccagaaaggtcatggaactcggggcatgaatgggtcacggattttaaaggtaaaacagtctggttcgtaccctcaataaaggcaggaaatgatatagcggcctgcctaagaaagaacggcaagaaagtaatacaattgtcgagaaagacatttgatagtgagtatgttaaaacaagaacaaatgactgggactttgttgttactacagacataagcgaaatgggtgccaattttaaagctgagagagtaatagaccctcgtaggtgcatgaaaccggttatattgaccgacggagaagaaagagttatattggccgggcctatgcccgttacacattctagtgccgcgcagagaagaggacgtattggaagaaatccaaagaatgaaaatgatcaatatatctacatgggagaaccattggagaacgacgaagattgtgcacactggaaagaggccaaaatgttacttgataacataaatacgccagagggaattattccaagcatgttcgagcccgaaagagaaaaggtggacgccatcgatggagaatatcgactacggggagaggcacgaaagacattcgttgatcttatgcgacgtggagatttaccagtatggctcgcgtataaggtcgctgcggaaggaataaactacgcggacaggaggtggtgttttgatggtatcaaaaacaatcaaattctagaagaaaatgtggaagttgaaatctggacaaaagaaggcgaaaggaagaaacttaaaccaaggtggttagatgcccgcatatattcagatccacttgccctaaaggaatttaaagagtttgccgctggtcgaaaatcgttaacattaaacttgattactgaaatgggaaggttaccgactttcatgactcagaaaacccgagacgcattagataatctagctgtcctccacactgcggaagcagggggtcgggcttataaccacgcattgtcagaactacctgaaactctagaaaccttactattactcacactacttgctacggtaacgggaggcatctttttgttcctaatgagtgggaggggaattgggaaaatgacactggggatgtgctgtataattacggcatcgattctcttatggtatgcgcaaatacaaccacactggatcgctgcttctattatacttgagttctttctaattgtactgctgataccggaacctgaaaaacagcggacacctcaggataatcagttaacatacgtcgttatagcgatacttacagtagtagccgcaacaatggcaaacgaaatgggatttttagaaaagacaaagaaagatttaggtttaggttctatagcaacacagcagcctgagagtaatatcctagatatagatcttagaccagctagtgcctggactctatatgccgtagctaccacgttcgttacaccaatgttaagacattctatcgaaaattcctcagttaatgtcagcttaaccgccatagcaaaccaagctacagtacttatggggcttgggaagggatggccattaagcaaaatggacattggggtccccttactagcaatcggttgttattctcaagtgaatcctattacattaacagcagcactcctattgctggtagctcactatgcaataattgggccaggccttcaagctaaagcaaccagggaagcccagaaacgagcggcggcaggtataatgaaaaatccgactgtagatggaataacagtaattgacctagacccgataccatatgatccaaaattcgaaaagcagctaggacaagtcatgttactaatactatgtgtgacacaagtccttatgatgaggacaacatgggccttatgtgaagcactgaccctcgcaacaggacctataagcacattatgggaaggcaatcctggccgtttctggaacaccaccattgccgttagtatggccaatatctttagggggtcgtatttagcaggagctggattactattttcaataatgaaaaataccactaacaccagaagaggaacagggaacatgggagaaacattaggtgagaaatggaagtctcgtttgaatgccttaggaaaatcagaatttcaaatatacaaaaagtctggaatacaggaagttgaccggacactcgccaaagaagggataaaaaggggcgaaacagatcatcacgcagtttctcgtggatctgcaaaactacgatggttcgtagaacgtaatatggtaacaccagaaggaaaggtagttgacttagggtgtggtcgaggcggttggagctattattgcgggggattgaagaacgttagagaagtgaaaggattaactaagggagggccaggtcacgaggaaccaatccctatgtcaacatacgggtggaacttagtgaggctacaaagcggagtagacgtgttctttatacccccggagaaatgtgatacacttctttgtgacataggtgagagctctcccaaccctacagtagaagcaggccgaacattgcgagtgttaaatttggtagaaaactggttaaacaataacactcagttttgtatcaaagttttgaatccatacatgcccagtgtgatagagaaaatggaagccctccaaagaaaatacggaggcgccttagtcagaaatcctcttagtcgaaattcaactcatgaaatgtattgggtgtcaaatgcctctggaaatatagttagttctgtgaatatgatatccagaatgcttattaataggtttaccatgcggcataagaaagcaacctacgaacctgacgtagatttgggaagcgggactcgcaatattggcacagagtccgaaattccaaacctagacattataggtaaaagaattgaaaagataaaacaagaacatgaaacaagttggcattatgaccaggatcacccttataagacatgggcataccatggttcttacgagacaaaacagactggatctgcatcgtcaatggtaaacggggtagtacgactcctcacaaaaccttgggacgtactgccgatggttactcaaatggcaatgacagatactacgccgttcggccaacagagagtgtttaaagaaaaagtggatacacgaacgcaggaacctaaagagggcactaaaaagctaatgaagatcacagccgagtggttgtggaaagaacttggcaaaaagaagacaccgcgaatgtgcacaagagaagagttcacgcgaaaagttagaagtaatgcagcactaggtgcaattttcaccgatgaaaataaatggaaatccgctagggaagcagtagaagacagcagattttgggaattagtcgataaggagagaaatttccacctagaagggaaatgtgagacttgcgtatataatatgatgggcaaacgagagaagaaattaggggaatttggaaaagcaaaaggatcacgggctatatggtatatgtggttaggggccagatttttagagttcgaagcgctgggatttttaaacgaagaccattggttttcaagagaaaatagtttgtccggagtggaaggcgaaggtttacacaaactagggtatattttaagagacgtgagcaagaaggagggaggcgcaatgtacgctgatgatacagcaggttgggacacacgaataacattggaagatttaaagaatgaggaaatggttactaatcacatggaaggggagcacaaaaagctggcagaggctatatttaaattaacttaccaaaacaaagtggtgcgagtacaaagaccaacccctagaggaactgtgatggatataatatctagacgtgatcagaggggatcaggacaagtaggcacctatgggctgaatacattcaccaatatggaggctcaacttataagacaaatggaaggtgagggtgtatttaaaaatatccagcaccttacagttacagaagaagttgctgttaaaaattggttggcacgtgtggggagagaacggcttagtcgtatggccatcagcggggacgattgcgtggtaaaacccttggatgacagattcgctaatgcattgacagctctcaacgatatgggaaagattcgaaaggatatccaacaatgggaacctagcaaaggatggaatgactggacacaagtaccattctgttctcatcactttcatgagctcataatgaaggacggacgagtcctagttgttccatgtcgaaatcaagatgaactaattgggcgagcaagaatcagtcaaggcgcgggctggtctctccgtgagactgcatgtttaggaaagagctacgctcagatgtggagtcttatgtactttcatagaagagaccttagactagcagcgaatgctatatgttctgccgtgccgtcacactgggttccgacttctcgcacaacatggagtattcatgcaaagcacgagtggatgaccactgaagatatgttgacggtatggaatcgagtctggatcagagagaatccttggatggaagataaaacgccagtagagtcttgggaagagatcccatatctaggaaaacgagaggatcaatggtgcggaagcctaataggactcacatcacgagcgacttgggctaagaatatacaggcggctataaatcaggtaagaagtttaattggaaatgaagagtacactgattatatgccaagcatgaaaagattccggagagaagaagaagaagctggagtattatggtag

SEQ ID NO: 22774 - RNA, 9876 nt, synthetic construct
  misc_feature 1..9876: note = derived and/or modified CDS sequence (opt6) from DENV-2__EU482699__SS-prME
  source 1..9876: mol_type = other RNA
agcgcaggcatgataataatgttaataccaacagtaatggcttttcatttaacgacaagaaatggggaacctcatatgatagttggaatccaagaaaaaggaaaatccctcctatttaaaacggaagacggagttaatatgtgcacgttaatggcaatggatctgggagaattatgcgaagacacaattacgtacaaatgcccgttacttagacaaaatgagccagaagatatcgattgttggtgcaactcaacatcaacatgggttacctatggcacatgcaccacaacaggagaacatcgaagagagaaaagatccgtagcattagtaccacacgtaggcatgggattagaaacaagaacagaaacatggatgagtagtgaaggagcttggaaacacgcacaaaggattgaaacatggatactgcgccacccggggtttacaataatggccgccattcttgcttatacaattggaacaacacactttcaaagagttcttatatttatattacttacggcagtagctccaagtatgactatgcgatgcataggaatatcaaacagagatttcgtggaaggagtaagtgggggtagctgggtagatatagttctagaacatggcagctgtgtaacaactatggcgaaaaataaacccacattggatttcgagcttatcaaaacagaagcaaaacaacccgctactctaagaaaatactgtatcgaggcaaaattgacgaatactaccactgaaagccgatgtcctacccagggcgagccctctctgaaagaagaacaggataaaagattcgtgtgcaaacattcaatggtagatagaggatgggggaatggctgcggtttatttggtaaaggaggaatcgttacttgtgcaatgttcacatgcaagaaaaatatggaagggaaaattgtacaacccgaaaatcttgaatatacaatcgtagtaacacctcactcgggagaagaacacgctgtcggaaatgatacaggaaaacatggaaaagagattaaagtaacaccacagtcatcaattacagaagctgaactcactggctatggaacggttaccatggaatgtagtccgaggacaggcttagattttaatgaaatggtactactgcaaatggaaaataaagcatggttggtccatagacagtggttcctcgaccttcctctaccatggttaccaggcgccgacaaacaagaatctaattggattcagaaagagacattggttacattcaaaaatccacatgcaaagaaacaagatgtagtagtattaggttcacaagagggtgcaatgcataccgcattaacaggagctacggaaattcagatgtcatcaggaaatttactttttacaggccacctaaaatgtagattacgtatggacaaactacagctcaaaggtatgagctatagcatgtgtactggcaaattcaaagtggtgaaagaaatagccgaaacacaacatggaacaatagtgatacgagtacaatatgaaggcgacggcagcccttgcaaaataccttttgagattatggaccttgaaaagagatacgtactaggtcggttaataacagtcaaccctattgtaactgagaaagactctccagtaaacatagaggcagaaccgccgtttggtgactcatatataataataggggtagaaccaggtcagttgaaattgaattggtttaagaaaggttcaagcataggccagatgttcgaaacaacaatgcgaggagcaaagagaatggcaatcttaggagacactgcgtgggattttggttctttgggaggggttttcacaagcatcggtaaagcgctgcaccaagtctttggagcaatttatggagcagcatttagtggagttagctggacaatgaaaatcttgataggcgtaataataacatggataggaatgaactcaagatcaaccagcctttcggttagtctagtattagttggcatagtaactttatatctcggagtgatggtacaagcagattctggttgtgtagtaagttggaaaaataaagaactaaaatgtggcagcggaatatttataacagataacgtgcatacctggactgaacaatataagtttcagccagaatccccttctaaacttgcgtcggcaatccaaaaagcacaagaggaaggcatctgtggaatccggtcagttacgcgacttgagaatctaatgtggaaacaaatcaccccagagcttaaccatatactagctgagaacgaggtcaaacttacaattatgaccggcgacataaagggcataatgcaggcgggtaaacggtcactaagaccacagccgaccgagcttaagtactcgtggaaaacgtggggaaaagcgaagatgctctctacggaatctcataaccagacctttctcatagacggtcctgaaaccgccgaatgtcctaatacaaatcgtgcatggaacagcttagaagtcgaagattacggttttggcgttttcacaacaaacatttggttaaggttaaaggaaaaacaggatgcgttttgtgattcgaaattaatgtcggcggctataaaagacaatagggccgttcatgcagacatgggctattggatagaaagcgcattaaatgacacatggaaaatagaaaaagccagcttcatcgaagtgaaaaactgtcactggcctaaatcacacacgctatggtcaaatggggtgctagaatctgagatgataattcccaagaatttagcgggacccgtttctcaacacaattatcgaccaggataccacacccaaattgcgggaccctggcacctaggtaagctagaaatggactttgatttttgtgatggcacaactgttatagtaactgaagactgtggtaatcgaggcccatcgctccgtacgacgactgcgtctgggaaattgataaccgagtggtgttgtcgaagttgcacactaccacccctaagatatcgaggggaagatggttgctggtacggaatggaaataaggcccctgaaagaaaaagaagaaaacttagtaaattcgctcgtcaccgcaggtcacggccaagttgacaatttttcattaggcattttgggaatggccttatttctggaggaaatgctacgcaccagagtaggtacaaagcatgcgatcctattagcagctgtttcattcgttacactaattacagggaatatgtcttttaaagatttaggccgagtaatggtaatggtcggagctactatggcagatgacataggtatgggagtcacttatttagctttacttgcggcgtttaaggtaagaccgacttttgctgccgggttattactgaggagactaacatcaaaagaactcatgatgacaactataggcatcgtcttattaagccagagtacaatcccagaaaccgtactagaattgactgatgcactcgctttgggaatgatggtcttaaaaatagtacgaaaaatggaaaaataccaattagccgtgaccataatggcgatcctatgtgtaccaaacgctgtaatacttcaaaatgcatggaaagtaagttgtaccatcctggctgttgtaagtgtatcgcccctattactaacaagctcgcaacagaaaacagattggattcctctagcactaaccatcaaaggtttaaatccaactgcaatcttcttaactacactatcccgtaccaataagaaacgatcctggccacttaacgaggctattatggcagtaggcatggtttcaattttggcgtcatcacttttgaaaaatgatattcctatgacggggcctctagttgccggaggattattaacagtttgctatgtcttgacaggaagatcagcagaccttgaactagaaagagctacggatgtgaaatgggaagatcaagcggaaatatcaggcagttccccaatccttagtatcacaatatccgaagatgggagtatgtctatcaaaaatgaggaagaggagcaaacgttgactattttaatcagaacaggtttactggtaataagtggtctattccccatctctataccgatcacagctgctgcttggtacctgtgggaagttaaaaagcaaagagcgggagtactttgggacgtgccgtccccaccacctgtaggtaaagcagaactggaggacggagcctaccgtataaaacagaaaggaattttaggatattcccaaatcggtgcaggggtatataaggaaggaacattccatactatgtggcacgtcacaagaggtgcggtattaatgcataaagggaaacgtattgaaccctcctgggcagatgtcaagaaagatctaatatcatatggcggaggctggaaactagaaggagaatggaaagaaggagaagaagtccaggtactagcattggaacccgggaaaaatccaagggcggttcagaccaaaccaggtttattcaaaacaaatactggcacgatcggagctgtgtccctggacttttcgccaggaacgtcaggttccccgataatagataagaaaggaaaagttgttggtttatacgggaatggtgttgtgactagaagtggtgcctatgtaagcgccattgcccaaacagaaaaatcaatagaagacaatcctgagattgaagatgacatatttaggaaaagacgattaacaattatggatttacacccgggggctggaaaaactaaaagatatttgccggcaatcgtacgtgaagcaataaaaagaggactaagaactttaattttagccccaacaagagtagttgctgctgaaatggaggaggcacttaggggtctacccatccgctatcaaacgccagcaatacgagcagaacacacgggacgtgagatagttgacttaatgtgtcatgctacctttaccatgagacttctttctccggttcgagtgccaaattacaatctaataatcatggatgaagcacattttacggaccccgcctctattgcggctagaggatatatatccactcgagttgaaatgggcgaagcggctggaatatttatgactgcgactcctccaggatccagagatccatttccgcagagtaacgctccaataatagacgaagaacgagagatcccagagcgaagctggaactcaggccatgaatgggttacagatttcaaaggaaaaacagtgtggttcgtacccagtatcaaagcaggcaatgatatagccgcatgtttaagaaagaacggaaagaaggtcatacagttaagtaggaaaaccttcgactcggaatatgttaagaccaggacaaacgattgggactttgttgtgacgacggatataagtgaaatgggcgcaaattttaaagcggagagagtgatagacccacgaaggtgtatgaagcccgtcatactaaccgatggagaagaaagagtcattttagcaggtccaatgcccgtcacgcattcatcagctgcccagagaagagggcgaattggtagaaatcccaaaaacgaaaatgatcagtatatttacatgggtgaaccgcttgagaatgatgaagattgcgctcactggaaagaagcgaaaatgttattggacaatatcaatacaccagagggaataataccatcaatgtttgaaccggaaagagaaaaagtcgacgcgattgatggcgaataccggcttaggggagaagctagaaaaaccttcgttgatcttatgcgacgcggtgatttaccagtttggctggcttataaagttgctgcagaaggaattaactacgcagatcgaaggtggtgttttgacggtattaaaaataatcaaatattagaagaaaacgtcgaagtcgaaatatggacgaaaggaggagagaagaagaaactgaaacctcgttggctagatgctagaatttattcagaccccctggcattgaaagaatttaaagaatttgctgctggacgtaaaagtttaaccctgaatttaattacggagatggggcgtctaccgactttcatgacacagaaaacccgcgatgcattggataacttagctgtattacacacggccgaagctggtggcagagcttacaatcatgccctatctgaactacccgagactttagaaacattactactcctaacgttactagcaacagtaacagggggaatattcctttttctgatgagtggccggggcatcggaaaaatgacgctcgggatgtgttgtataattactgctagcattttattgtggtatgcacaaatacaacctcattggattgcagcctctataatattagagtttttcctgatagtcttactcataccggaaccagaaaagcaaagaactccacaagataatcaattaacatatgtagttatagcaattctaactgttgtggcagctacaatggctaacgaaatggggtttttagagaaaacgaagaaagatctaggtttaggttccatagcaacacaacagcctgaatcaaacattcttgatatagatctaagaccggcatctgcctggacgttatatgcagttgcaacgacgtttgttactccgatgctacgtcacagcatagaaaactccagtgtgaatgtcagcttgactgctattgccaatcaagcaacagttttaatgggtttaggaaaaggctggcccctgagcaaaatggacataggcgtaccgttactcgcaataggatgttacagtcaggtaaatcccattacactaaccgccgctttattactacttgtcgcacattacgctataataggccctggcctgcaggctaaagcaacccgtgaagcgcagaaacgggccgccgcaggtatcatgaaaaatcctacagttgacggaataacagtaattgacttagaccccataccctacgaccctaaattcgaaaaacaattagggcaagtaatgctactaatcttgtgtgtcacgcaagttctgatgatgagaactacttgggcgctctgtgaggccctcactctcgcaacgggtccaatatcaacactctgggaagggaatccgggtagattttggaacaccacaattgctgtaagcatggcaaatatatttagaggtagttatctggcaggggcaggactcttgtttagtataatgaaaaataccacaaacacacggagaggtacgggtaacatgggcgaaacattaggagaaaaatggaaaagccgattaaacgcactaggaaaatcagaatttcaaatctacaagaaatctggtattcaggaagtagatcgcacgttggcgaaagaagggattaagaggggcgaaaccgaccatcatgctgtatctcgaggttcagcaaagctaagatggtttgtcgaacggaacatggtaactcccgaaggaaaagtggtagatttagggtgtggtcgaggtggatggagctattactgcggagggttgaaaaatgttagagaagtcaaggggctaacaaagggtggaccagggcacgaagaaccaattcctatgagcacatacggatggaatttggttcgactacaatcaggcgttgacgtattctttatcccgccagagaaatgtgacaccctattatgtgatataggtgaaagttcaccgaatcctactgttgaagcaggcaggacactgcgggttttaaatttagtagaaaattggttaaataataatacacaattctgcataaaagtattaaacccatatatgccttctgttatcgaaaagatggaagcgttgcaacgcaaatacggaggagcgctagtacgtaatccactaagtagaaattctacccatgaaatgtactgggtgtcaaatgcatccggaaacattgtgagttctgtaaacatgatctctagaatgttaataaatcgcttcacgatgcgccacaaaaaggctacatacgaacccgacgtggatcttggctctggcacaagaaacatagggattgaatcagagatcccaaacttagatataataggaaagagaatcgagaagatcaaacaggaacacgaaacaagctggcattatgatcaagatcatccgtataagacatgggcttatcacggctcgtatgaaactaagcagacaggctcagcaagcagtatggtgaatggtgtagtaagactattaacaaaaccatgggatgttttgcccacagttacgcaaatggcgatgacagatactacaccatttggtcaacagagagttttcaaggaaaaagtggatactagaacgcaagagcctaaagaggggacaaagaaactgatgaaaattacggcagagtggctatggaaagaattggggaaaaagaaaactccacggatgtgtacaagagaagagtttacacgaaaagttaggagtaatgcagccctaggagccatttttactgatgagaataaatggaaaagcgctagggaagccgtcgaagatagtagattttgggaattagtggacaaagagcgcaacttacatttggaaggaaaatgtgagacatgtgtttataacatgatgggaaaacgcgagaagaaattaggtgaatttggaaaagcaaaaggtagccgtgccatttggtatatgtggcttggggcacggtttctagagttcgaggctctaggattccttaacgaagatcattggttctcaagagagaacagcttatcaggcgtagaaggcgagggtctacataaactaggttatatactgagagatgtttcgaagaaagaaggaggggctatgtacgctgatgataccgcaggttgggataccagaataactctagaagatctcaaaaatgaagagatggtaactaatcacatggaaggagaacacaagaaactagcagaggccatctttaaactgacataccaaaacaaagtagtacgcgtacaacgacccactcctcgtggtacagttatggacataattagccgtcgcgatcaacgcgggagtggtcaagtagggacttatggtttaaatacttttaccaatatggaagcccagttaatacggcagatggaaggtgagggcgtatttaaaaacatacagcatctaacagtcactgaagaggtagcagtccaaaactggctagcaagagtcggaagagaaagactatccagaatggccataagcggggacgattgtgttgtcaagccactagacgacagatttgcgaacgccctgactgccttaaacgacatgggaaaaatacgtaaagacattcaacaatgggaaccaagtaaaggttggaacgattggacacaggttcccttctgtagtcatcatttccatgaactaattatgaaggatggacgtgtcttagtagtgccctgccgcaatcaagatgagttgataggtcgagcccgaatatcacaaggtgccgggtggagtctacgagaaacggcgtgtttaggaaaatcttatgcacagatgtggtctctaatgtattttcatcgccgcgatctccggttggccgcaaatgcaatatgctcggccgttccgtcccactgggtaccaacaagcagaaccacatggtccatccatgcaaaacatgaatggatgacaacagaagacatgctaactgtttggaatagggtatggataagagaaaacccttggatggaagataaaaccccagtagaaagttgggaggaaataccttatctaggaaagagagaagaccaatggtgcggatcacttataggactcacctccagagcaacctgggctaagaatatccaggctgcaattaatcaagtccgttcacttataggaaacgaagagtatacggactacatgccatctatgaaaagattcagacgtgaggaggaagaggccggtgttctatggtaa

SEQ ID NO: 22775 - RNA, 9876 nt, synthetic construct
  misc_feature 1..9876: note = derived and/or modified CDS sequence (opt6) from DENV-2__EU482701__SS-prME
  source 1..9876: mol_type = other RNA
agtgcaggaatgattatcatgttaatcccaactgttatggcatttcacctaacaacaagaaacggagagccccatatgatcgtcggcatacaggaaaagggtaaaagtctactctttaaaacggaggacggagtaaacatgtgcacactaatggctatggatttgggggagctctgcgaggacactataacgtataagtgcccacttcttaaacaaaacgaaccggaagatatagattgttggtgtaacagtacttcgacatgggtcacctacggcacatgcacaactaccggggaacatcgacgagaaaaaaggtcagtcgctttagtcccgcacgtaggaatggggttagaaacccgtactgaaacatggatgtcatcagagggagcctggaaacacgctcagaggatagagacctggattcttagacaccccggtttcactataatggccgcaatactagcttatacaatcggcacaacccattttcagcgagtcctaatttttattttactgacagccgtcgcaccatctatgacgatgcggtgcataggaatctcaaatagagactttgtggagggcgtatctggtggtagttgggtcgacatagttctagaacatggctcatgtgtcacaacaatggcgaagaataaacccactcttgactttgaactcataaaaactgaagcgaaacaacccgctaccttaagaaagtactgtattgaagcaaaactaacgaacacgactacggagtcccgttgtccaacacaaggtgagccatcacttaaagaggaacaagacaaacgctttgtttgtaagcactcaatggtcgatcgaggatggggaaatggctgtggcttattcggaaaaggcggaattgtaacttgcgcgatgttcacttgcaaaaaaaacatggaggggaaaattgtgcaaccagagaatttggaatacacaatcgtagtgacaccacattcgggagaagaacatgctgtaggcaatgatacaggaaagcatggaaaggaaataaaagtgactccccaatcgagcatcacagaagctgaattaacaggttatggaacggttacaatggaatgctcacccaggacagggctggatttcaatgaaatggttcttctgcaaatggagaacaaagcatggttagtacatagacagtggtttctagatctaccgctaccctggctcccaggcgctgataagcaagaatcaaactggatccaaaaagagactttagttactttcaaaaatccacatgcaaagaaacaagatgtcgttgtgctaggcagccaggaaggtgcgatgcatgctgccttaacaggggcgacagaaatacaaatgtcaagcggtaacctactcttcacaggacatctaaaatgtcgattgcggatggataaacttcaacttaagggaatgtcctacagcatgtgtactggaaaattcaaagttgtaaaggagattgccgaaacacaacatggaaccatagtcattcgagttcaatatgaaggcgatggcagtccatgcaaaataccctttgaaataatggatcttgagaaacgatacgtgttagggagactcataaccgtgaatcctattgtcacggaaaaagattctccagtgaatatagaagctgaaccaccgtttggtgattcttatatcataataggggtagaaccgggacaattaaaattgaactggtttaaaaaaggatcaagtatcggccaaatgtttgaaacaacaatgcgaggtgcaaaaagaatggcaatactaggtgatactgcctgggatttcggaagtctcggcggggtatttacaagtattggaaaggcactccatcaggtattcggagcgatttacggtgctgctttctcaggagtgagctggacaatgaaaattcttattggagtaattatcacatggataggaatgaattctagaagcacatcactctcggttagtttagttctagttggtatagtaacattatacttaggcgttatggttcaagccgatagtggatgcgtggtttcatggaagaataaagagttaaaatgcggaagcggaatttttattaccgacaatgtacacacatggactgaacaatataagtttcaacccgaatctccatcaaaattagcaagtgcaatacaaaaagcacaagaagaaggtatatgcggtattagaagtgtcactaggctcgagaacttaatgtggaaacaaataacgcctgaattaaaccatatccttgctgaaaatgaggtaaagctaacgataatgacgggggacataaaaggtataatgcaagcaggtaaacgttccttacgaccacaaccgaccgaacttaaatattcatggaaaacttggggtaaagctaaaatgttgagtacagaaagtcataatcaaacgtttttaatcgacggcccagaaacagccgaatgtcccaacacaaaccgagcatggaattccttagaagtagaagattatgggtttggagtgttcacaaccaacatctggcttaggttaaaggagaaacaagatgcattttgtgatagcaagctaatgagcgctgcggttaaagataatcgtgccgtacacgcagatatgggatattggatagagtcagcactaaatgatacatggaagattgaaaaagcaagcttcatagaagtaaaaaactgtcattggccgaagagccacacactctggtcaaatggagtacttgaaagcgaaatggtcattcctaaaaaccttgcgggacctgttagtcaacataattatagaccaggataccacacacaaatcgcgggaccatggcacttaggaaaacttgagatggacttcgatttttgtgacggaacgactgtgattgttaccgaagattgcggcaaccgaggaccctcactacgaacaactacagcatcgggaaaattaataacagaatggtgctgcaggtcttgcacgcttccccctctcaggtataggggtgaagatggttgttggtatggcatggaaataaggccattaaaagaaaaagaggagaatcttgtaaattcacttgtcacagccggtcatgggcaagttgataatttctcacttggaatcttgggtatggccttatttctggaagaaatgcttcgaacaagagtgggaacaaaacatgcaatactattggtagctgtaagcttcgtaaccttaataacagggaacatgtcatttaaggacttaggaagggtagttgttatggttggtgctacaatggcggacgatattggtatgggagtaacatatcttgcactattggcagcgttcaaagttagaccgacgttcgcagccggtttgcttctgcgaaagctaacgtcaaaagagctgatgatgaccacaattggtgtggtattattatcccaaagtactattccagatacggtcttggaattaacggacgccctagcattagggatgatggtgctgaaaatagtccgtaacatggaaaaatatcaactagcggtaacaataatggcaatactatgcgtgcccaatgctgtgatattgcagaacgcttggaaagtatcatgcacaattttggctgtggtctcggtctcaccgcttctattaacaagcagtcaacagaagacagattggatacctttagcattaacaattaaaggactgaacccaacagcaatattcttgactacactaagtcgaacaaataaaaagaggtcatggcctcttaacgaggcaatcatggcggtgggtatggtctcgatactagctagctcattactaaaaaacgacatccccatgacaggacccttagtcgcgggaggattactaacagtgtgctatgtccttacgggtcgctcagccgacttagaactagaaagggcaacggacgtaaaatgggaagatcaagctgagatctctggttcgtctccgatactatcaatcaccatttctgaagatggcagtatgagtataaaaaatgaagaggaagagcagacattgacaattcttattagaactggactgctggtcatatcaggcctctttcccataagcataccaattacagccgcagcttggtacttgtgggaagtaaagaagcaaagagcaggagtactgtgggatgtaccaagtccaccaccaatggggaaagcagaactcgaagacggagcttatcgaataaagcaaaagggaattctaggttatagtcaaattggcgcaggggtatataaagaaggtacatttcatacaatgtggcatgtaacacgaggggcagtactaatgcacaaaggtaaacgaattgaaccaagttgggcagatgtaaaaaaagatctaatatcatacggagggggttggaaactagaaggcgaatggaaagaaggggaagaagtccaggtcttggccttagaacccggtaaaaatcctagggcagtccaaacaaagcctggcttgtttaaaacgaacaccggtacaatcggcgctgtcagcctagattttagcccaggaacttcaggatctccaatcatagacaaaaaaggtaaagtggtaggactctacggaaatggagtggtcacaagaagtggggcgtatgtctcagccatcgctcaaacagagaaaagtatagaggataatccggaaatcgaagatgacatatttagaaaacgaagactaacgattatggacctgcatcctggggcaggaaagacgaaaaggtatcttcctgcaatagttagagaggcaataaaacgcggactgcgcaccttaatcttagccccgactagggtagtcgcagcagaaatggaggaagcgctacggggcttacctatcaggtatcaaactcctgcgatcagagcagaacatacaggacgagagattgtagatttaatgtgtcatgcaaccttcacaatgcgactattatctcccgtaagagtacctaactacaatctcataataatggatgaggcacatttcacagacccagcatcaatagcagctcgtggatacatctctacgcgagttgaaatgggcgaagctgctggaatattcatgacggcgacgcctccaggatccagagatcctttcccccaatctaacgctcctattattgatgaggaaagagaaataccagagcgaagttggaactctggccatgaatgggtaactgacttcaaaggaaaaactgtatggttcgtccctagtataaaggcgggtaacgacatagcagcttgtttacgaaaaaacggtaaaaaagttatacagctatcccgaaaaacattcgattctgaatacgtaaagacccgaacaaatgactgggattttgtagtaactactgatatatcagaaatgggagcaaatttcaaggcggaaagggttattgatccccggagatgtatgaagcccgttatattaacagatggtgaggaacgagtaatactagctggtccaatgccagtcacgcattcaagtgcagcacagcgtagagggagaattgggagaaaccctaagaatgaaaatgaccaatatatatatatgggagaacctttggaaaacgacgaggattgtgcacactggaaagaagcgaaaatgttattagataacataaatacacctgaaggaatcattccatcgatgtttgagccagagcgcgaaaaagtagacgctatagatggagagtataggttacggggggaagcacgaaagactttcgtggatttaatgagaagaggagacctgccagtatggctggcttacaaagtagcagcagaaggtataaattatgccgaccgacgatggtgctttgatggtataaagaacaatcaaatacttgaggaaaacgttgaggttgaaatctggaccaaggaaggagagcggaaaaaacttaaaccaagatggttggacgctcgaatatattccgatccactagcattaaaagaattcaaagaattcgcggctggtcgaaaatctttgacactaaatcttataactgaaatgggacggttaccaacctttatgactcaaaaaacacgagacgcattggataacttagccgtccttcacacggcagaagcaggcggtcgtgcctacaaccatgcattgagtgaattgccagaaacacttgaaactttgctcttgctcactttattagccacggtgacaggaggtatttttctgtttctcatgagtggtagaggtataggtaaaatgacgttaggaatgtgctgcataattactgcctcaatactattgtggtatgcccaaatacaaccacattggatcgcagcatcaattatattggagttttttctgatagttctcttgattccagagcccgaaaaacaacggacgccacaggataatcaactcacatatgtagttattgcaatcctaacagtcgtagccgctacaatggcaaatgaaatgggctttcttgaaaaaacaaaaaaggatttgggcttaggctcaatagcgacacaacaaccagagagcaacatattagacatagacctacggccggctagtgcatggacattatacgcagtcgcgacaacgtttgtgacgcctatgctaagacatagtatagaaaattcatccgtaaacgtttcattgaccgctattgcaaatcaagcaacagttctcatgggactaggaaaaggctggccgctaagtaagatggatataggagttccattgctagcgattggatgttattcacaggtaaatcctattaccctaacggcagcattattgttactggtagcacactacgctataataggtcctgggttacaagcgaaagctacccgagaagcgcagaaacgagcagcagcaggaataatgaaaaacccaacggttgacggtataaccgtgatagatttggatcccattccatatgatccaaaatttgaaaaacaactcggtcaggtaatgctattaatcttatgtgttacacaagttttgatgatgagaactacgtgggctctatgcgaagctctaactcttgcaacaggacccatttctacgttgtgggagggaaatcctggtcgcttttggaatactacaattgccgtatctatggcaaacatattccggggaagctatcttgctggcgcgggactattattttctataatgaaaaacacaacaaatacacgaagaggcacgggcaacatgggcgaaaccctaggagaaaaatggaaatccagactaaacgctctaggaaaaagtgaatttcaaatttacaaaaagagtggcatccaagaggtagacaggacattagctaaagagggtataaagcgtggagagacggaccaccatgcagtctcacgcggcagtgccaagctacggtggttcgtggagaggaatatggtaacccctgaaggtaaggtggtagacttaggatgtggtcgtggtggatggtcttattattgcggaggattgaaaaacgtcagagaagtaaagggattgacgaaaggtggccctggtcacgaagaaccaataccaatgagcacgtacggatggaatttagtgcgtttacaaagtggtgtcgatgtgttcttcatccctccagaaaaatgtgacactctattgtgtgatattggcgaatcatcccctaatcccactgtagaagcagggaggacgttgagggtattaaacttagttgaaaattggttgaacaataacactcaattttgcattaaagtcctaaacccatacatgccgtcagtcatcgaaaaaatggaggctctgcaacgcaagtacggtggcgcactagtacgcaacccgttatctagaaacagtactcacgaaatgtattgggtctcaaacgctagcgggaatatagtatcgtcagtaaacatgatatctagaatgttaataaatcgttttacaatgcgacacaagaaagctacctatgagccagacgtcgacctgggttctggaaccagaaatattggtatagaatcagaaatccccaatctggatataataggcaaacgcatagaaaaaataaaacaagaacacgaaacgagttggcattatgatcaagaccatccctacaaaacttgggcctaccacgggtcatatgagacaaagcaaacaggatcagcatcttcgatggttaatggtgtagtaaggttactaacgaaaccatgggacgtgttgcccacagtcacccaaatggctatgaccgatactactccattcgggcaacaaagagtgtttaaggagaaagtcgatacaagaacacaagaaccgaaggagggaactaaaaaattgatgaaaattaccgccgaatggctatggaaggaattgggcaaaaagaaaacgccgagaatgtgtacaagagaagagtttacgagaaaggtaagaagtaatgcagcgctaggcgccatatttacagacgaaaataaatggaaatcagcaagggaagcagtagaagacagtaggttctgggagttagtagataaggaacggaatttacacttagaaggtaagtgcgaaacctgtgtgtacaatatgatgggtaagagagaaaaaaaattaggggaatttggaaaagcgaaaggatctcgggcaatatggtacatgtggctaggggctaggtttttagaatttgaagcgctaggattcctgaatgaagatcactggttctcgcgggaaaacagcctctcaggagtagaaggggaagggttacacaagctggggtatatattacgtgatgtatcaaaaaaagagggtggggccatgtatgctgacgacactgctggatgggacacaagaataacactggaagacctaaaaaatgaggaaatggtaacaaatcatatggaaggggagcataaaaagttagcagaagccatatttaaattgacctatcagaataaagtagtccgagttcagaggcctacaccaaggggaacagtgatggacataataagcagacgagatcagcgggggagtggacaagtaggaacgtacggtctgaacacattcactaatatggaagcacaactaataagacagatggaaggagaaggagtgtttaaaaatattcaacatttaacggtaactgaagaagtcgcagtacaaaactggttggcgcgtgtggggcgtgaacgtctgtcacggatggccatttccggggatgactgcgtcgtgaagcccctagacgatagatttgcaaacgcgttgacagcacttaatgatatgggaaagatcagaaaagacatacaacaatgggaaccaagcaaaggatggaatgattggacgcaagtgcccttctgttctcatcactttcatgaacttataatgaaagacggccgtgttttagtggtgccctgtcggaatcaggatgaactaatcggtagggcgcggatctcacaaggtgcaggctggtccttgcgggaaacagcatgcctaggcaaaagttatgcacagatgtggagtcttatgtactttcatagacgagaccttcgtttagcagctaacgctatttgttcagctgtaccatcacactgggtaccaacaagccgtactacatggtcgatacacgctaaacatgagtggatgactaccgaggatatgttaacagtatggaatcgtgtatggatacgtgaaaatccatggatggaggacaagacacctgtagaaagttgggaagaaatcccctatttaggtaaacgagaagatcaatggtgcggttcattaatcggtcttacaagtcgagctacttgggcgaagaatattcaggccgcaataaaccaggtacgttctttaataggcaacgaagaatatactgattacatgccaagtatgaaaagatttcgaagagaagaagaagaggctggcgtactctggtaa

SEQ ID NO: 22776 - RNA, 9876 nt, synthetic construct
  misc_feature 1..9876: note = derived and/or modified CDS sequence (opt6) from DENV-2__EU482703__SS-prME
  source 1..9876: mol_type = other RNA
tcggcgggaatgataattatgctaataccaaccgtaatggcgtttcatttgactacgcggaacggagaaccacacatgatagtaggtatccaagaaaaagggaaaagtctattatttaaaacagaagacggcgttaatatgtgtacacttatggcaatggacttaggagaactttgtgaggacacgataacttataaatgtccgttattaagacaaaatgaaccagaagacatcgattgttggtgtaactctacttcaacctgggtaacatatggaacatgcacaacgactggtgaacacaggcgagaaaaacgctctgtcgcacttgtaccacatgtaggaatgggtttagaaacgagaacggaaacatggatgtcaagtgagggtgcttggaaacatgcgcaacgcattgaaacatggattctgagacacccaggctttaccataatggcagctattctcgcatatactatagggacaacacattttcaaagagtattgatcttcattttattaacggcagttgctcccagcatgacaatgcgttgcataggtatctcaaacagggatttcgttgagggtgtgtccggaggctcttgggtagatatagtactagaacatggtagttgtgtaaccactatggccaaaaataaaccgacactggattttgaactaattaaaaccgaggcaaaacaaccagcaactttacgaaaatattgcatagaggcaaaactaacgaatacaactacagaaagccgctgcccgacacaaggagaaccttcactaaaagaagaacaggacaaaaggtttgtgtgcaaacacagtatggtagacagaggttggggcaacggctgtggtctgtttggaaaaggcggtatcgttacttgtgcaatgtttacctgtaaaaagaacatggaaggaaagattgtacaaccagaaaacttagagtacactatagtcgtaacgccacattcaggagaagaacatgcagttggaaacgatacaggtaaacatgggaaagaaattaaagttaccccacaaagtagtataaccgaagctgagttgactggctatggaacggttacaatggaatgcagcccacggactggactcgattttaatgagatggtgctcttacagatggaaaacaaagcgtggcttgtacacagacaatggtttttggatttgccattaccgtggttaccgggggcagataagcaggaaagtaactggattcaaaaagaaacgttagtaacatttaaaaaccctcacgcgaagaaacaagatgttgtagtattggggagtcaagaaggggcgatgcacacagcactcacaggcgcaaccgagattcaaatgagctcgggtaaccttctttttacgggtcatctgaaatgtagattacgaatggataaattgcagcttaagggaatgtcatacagtatgtgtacaggtaagtttaaagtagttaaagaaatagctgaaacccaacacggtacaattgtaataagggtgcaatatgaaggtgatgggtccccttgtaaaatacctttcgaaataatggatttagaaaaacgctatgtcttaggtcgattaataacagttaacccaatagtaactgaaaaagacagccctgtaaacatcgaggctgaacctcccttcggagactcttacattataataggcgtagaacctggacaacttaaactaaattggtttaaaaagggcagttctataggacaaatgttcgaaactactatgagaggggctaagcggatggctatactcggtgacacagcatgggacttcgggagtctagggggcgtatttacaagtataggtaaagctctgcaccaagtatttggcgcaatttacggagcagccttttctggcgtaagttggacaatgaaaatattaattggcgttatcataacctggataggcatgaatagcagaagtacatcgctaagtgtaagcctagtgttggttggcatagttaccctttacttgggagtaatggtacaggccgactccggctgtgtcgtctcttggaaaaataaagagttaaagtgtggctctggaatatttattacagataacgttcatacttggacggaacaatacaaatttcaaccagagtctccgtctaaactggctagtgccattcaaaaggcccaagaggagggaatatgtgggataagaagtgtgacaagattagaaaatctaatgtggaagcaaattacacctgagttaaatcacatactagctgaaaatgaagtgaagttaaccataatgactggagatataaagggtataatgcaagcaggtaagagaagccttagaccacaacctacagaacttaaatattcatggaaaacatggggtaaagccaaaatgttgagcaccgaatcatataatcaaactttcttaatagacggtcccgaaaccgcagaatgtcccaatacaaatcgcgcctggaacagtctagaagtagaggactatggttttggcgtattcactacgaacatttggctaaaattgaaagaaaagcaagatgctttttgtgacagtaaattaatgagtgcagccataaaagataacagagccgtacatgccgatatgggctattggatagaatcagcattaaatgacacttggaagatagaaaaggcgagctttatcgaagttaaaaactgccattggccaaaatctcacacactatggagtaatggtgtcctagaaagcgaaatgattattcccaaaaatctagctggtccagtatcacaacacaattacagacccggatatcacactcaaattgcgggaccatggcaccttggcaaattagaaatggactttgacttctgtgacggtacgacagtaatagtaacggaggattgtgggaacagaggccctagtctaagaacaactaccgcaagcgggaaattaataacagaatggtgttgtcgaagctgcactttaccccctctacgatatcgtggagaagacggttgttggtacgggatggagataagaccactaaaagaaaaagaagagaatctagttaactccctagtcactgccggtcacggtcaagtagacaattttagtcttggggtgctgggcatggctttattcctggaagagatgctacgaacgagagttggaacaaagcacgctattttacttgtcgcagtcagcttcgtcactctaattaccggtaatatgagcttcaaggatctcggtagagtagtagttatggtgggggcgacaatggctgacgatattggcatgggtgtgacttacctagcacttttagcggcatttaaggtaaggccaacctttgctgccggacttttattaaggaaactaacaagcaaagagctcatgatgactacaatcggtattgttctattatctcagtcaacgataccagaaacggtgttagaattaacagacgcgctggcgctgggtatgatggtgcttaaaattgtcagaaatatggaaaagtaccagctcgccgtcactatcatggctattctttgcgtcccaaacgcagtcatattacagaacgcttggaaagtggggtgcactatcctagcagtagtatctgtttcccctttactactaacatcttctcagcagaaaaccgactggatcccgttggcattaacgataaaaggtttaaaccctactgccatattcttaacaaccttaagtcgaacaaataagaaaaggtcttggccattaaacgaggcaataatggcagttggaatggtctcaattctagcaagcagtctacttaaaaatgatatacctatgacagggccgctagttgctggaggtttacttactgtatgttacgttttaactggaagatctgctgatctagaactggagagagcgacagacgtcaaatgggaagatcaagcagaaatatcaggatcctctccgatcctaagcataacaatttcggaagatggaagcatgtcaattaagaacgaggaagaggaacaaactctgacaatactaataaggacaggtctattagttatttccggactctttccgattagcattccgattaccgcggctgcttggtatctttgggaagtcaagaaacagcgagcgggcgtactatgggatgtcccaagtccgccacctatgggtaaagcagaattggaagatggtgcatatagaattaaacagaaaggtattctgggatatagtcagataggagcgggcgtatataaagaaggtacatttcatactatgtggcatgtgaccagaggtgcagttctaatgcacaaaggcaaacgaatcgaaccttcctgggcagatgtcaagaaagatctaattagctatggaggagggtggaagctagaaggagaatggaaggagggagaagaagtacaggttttggctcttgaacctggtaaaaatccaagagctgtgcagacaaaacctggactattcaaaacaaatacgggaaccatcggagcagtttctttagacttttcgccgggaacaagtggatcaccaattattgataagaaagggaaggtagtaggcctgtatggtaatggcgttgtaacaagatcaggtgcgtatgtgtcagcgatagcacaaacagaaaaatcaatagaagacaatcctgaaatagaagatgatatattcagaaaaagacgccttactataatggatctacatccaggtgctggcaaaacgaagcgctaccttcctgcaatcgtgcgtgaggcaattaaacgagggttacgaaccctaatacttgcacctacacgggttgtagctgcggaaatggaagaggcccttagaggattgcccatccgttatcagacaccagcaatcagagctgaacacacgggccgagagatagtggacctaatgtgtcacgcaacttttacaatgagattactatcacccgtaagggttccaaactacaacctgattataatggacgaagcacattttactgatcctgcaagtatcgctgcacgtggttacatctcaacgagagtagaaatgggggaagccgcaggaatctttatgacggcaacaccacccggcagtcgagatcctttcccacaatccaatgcaccaatcattgatgaagaacgagagatccccgagagatcatggaacagtggtcacgaatgggtaaccgattttaaaggaaaaaccgtatggttcgtcccgagtataaaggcaggtaatgacattgctgcctgcctaaggaaaaacgggaaaaaggtgattcagctatctagaaaaacgttcgactctgagtacgttaagacaagaactaacgattgggatttcgtggtgactaccgatattagtgagatgggagcgaactttaaagctgaacgggtaatagatccaagacgctgtatgaaaccagttatcctaacggacggagaagaaagagtcattctggcaggtcctatgccagtaactcattcctcggcagcccaaagacgaggcagaataggcagaaaccccaaaaatgaaaacgatcaatacatatacatgggagagcctctagaaaacgatgaagattgcgcacactggaaagaagctaaaatgctgttggacaatattaacactcctgaaggtataataccttcaatgtttgagccagaacgcgaaaaagtagacgctattgatggtgaatatcgcttgcgaggagaagcacgtaaaactttcgtagatttaatgagacggggagatttacctgtttggttggcatataaggtagcagccgaaggaatcaactacgctgacaggagatggtgcttcgacggaattaaaaacaatcagatactagaagaaaacgtggaggtagagatatggaccaaggaaggcgagaggaagaaattaaaaccacgttggttagatgcacgaatatactccgaccctctagctctaaaagaatttaaagaatttgcagccggtcgaaaatccttaaccctcaatttaatcacagagatgggcagattaccaactttcatgactcagaaaaccagagatgcgctggacaatttggcggtgttgcataccgctgaagctggaggtagagcatacaatcatgctttatcggaactcccagaaacactggagactttactgttacttacgctattagctaccgtaacaggtggaatatttttatttttaatgtccggaaggggcattggaaaaatgactttgggtatgtgttgcataattacagcaagcatcctactatggtatgcccaaatacaaccccattggattgcggctagtattattttagaatttttccttatagtattacttatcccggaaccagaaaaacaaagaacaccccaggataatcagttgacttatgttgtcatagccatactaactgttgttgcagccacaatggcgaacgaaatgggttttctggagaaaactaagaaagacctcggtcttggttccatcgcaactcaacaaccagaaagtaatatattagatatagacctaagaccagcaagcgcctggactttatacgcagtagctactacttttgtgacacctatgcttaggcattccattgaaaattcaagcgtaaatgtatcattgaccgctatcgctaaccaagcaaccgtactaatgggcctaggcaaaggttggcccctgtccaaaatggacataggtgtgccactcctcgctatcggatgttatagtcaagtaaatcctattactctaacagccgccttactactattagttgcccattatgcgatcatcggcccgggactacaagccaaggcaacacgagaagcgcagaagagagctgcggcaggtattatgaaaaatccgacggtagacggaattaccgtaatagacttagatccaatcccctacgatccgaaatttgaaaaacaattaggccaagtaatgcttctaattctgtgcgtcacacaagttctcatgatgcgcactacatgggctctttgtgaagcgcttacactcgcaacgggaccaataagcaccttatgggagggtaatcctggacgcttttggaataccaccatagcagtctcgatggccaatatattccgtggaagttacttagcgggcgcaggcttactctttagtatcatgaagaacacaacaaatacgagacgaggaactggcaatatgggtgaaacactaggagagaaatggaaatctagattaaacgcattaggcaagagtgaatttcaaatatacaagagatccggaatacaggaagtggatagaactttagcgaaagaaggaataaaaagaggagagacggatcaccatgcagtctcaaggggatctgcgaaattgagatggttcgttgaaagaaacatggttacaccagaaggtaaggtagtcgacttgggctgtggaagaggcggctggtcatactattgtggtggattgaaaaatgttcgggaagtaaagggcctaactaaaggcggacccggtcatgaagaacctattccaatgtcaacctatggatggaatttggtgagattacagagtggagttgatgtattctttataccgccggagaaatgcgacacattactatgcgatattggagagtcgtctcctaatccaactgtcgaagcaggccgaactctaagagtcttaaatctggtcgaaaattggttaaataataatacacagttttgtataaaagttctgaatccgtatatgcccagtgtaatagaaaagatggaagcactgcagagaaaatatgggggagctttggttagaaatccgctttcaagaaattctacacatgagatgtactgggtatcaaacgcatcaggtaacatcgtatcgtcagttaacatgatttcgcgcatgctaataaatcggtttacaatgagacacaagaaagccacatatgagcccgatgtggacttgggtagcggaactcgtaacatcggcatagagagtgagattccgaacttggacataataggaaaaaggatagagaaaataaaacaagaacacgaaacgagttggcattacgaccaagatcacccctataagacttgggcttatcatgggagctatgagacaaagcaaacaggttcagcatcatcaatggtaaacggtgttgtccgtctgttaaccaaaccatgggacgtattgccaacggttactcaaatggctatgaccgatacgactccctttgggcaacaaagagtattcaaagaaaaagtagacactagaacacaagaacctaaagaaggtacgaagaaactaatgaaaattacagcggaatggttatggaaagaactaggaaagaagaaaaccccgagaatgtgcacaagagaggagtttactaagaaggtgagatcgaatgctgccctaggagcaattttcacggacgaaaataagtggaaatccgctagagaagcagttgaagattcaagattttgggagctagtagataaggagagaaacctacacttggagggaaaatgcgagacatgtgtatataatatgatgggaaaaagagaaaagaagctaggtgagtttggtaaggccaaagggagtagagcaatatggtacatgtggttaggagcgcggtttttagagttcgaagcactggggtttttgaatgaagaccattggttctctcgcgagaacagcctaagcggagtagaaggagaaggccttcacaaactcggatacatattacgcgatgtaagcaagaaagaaggaggagcgatgtacgcagatgacactgccgggtgggatacgcgtataaccttagaagatttgaaaaacgaagaaatggtaacaaaccatatgaaaggagaacataagaaattagcagaagcaatattcaagttaacatatcagaacaaagtcgtccgagtccaacggccgacacctagggggactgtaatggatatcatttctagacgtgaccagcgaggatctgggcaagtgggaacgtatggactaaatacgtttactaacatggaagctcagcttatcaggcagatggaaggagagggcgtatttaaaaacattcaacacctaaccgttactgaagaagtcgcagttcagaattggcttgccagagttggcagagagcggttaagtaggatggctataagtggagatgactgtgtggtaaagccgttagacgacaggttcgccaacgcccttactgcattaaatgacatgggcaaaataagaaaagacatccagcaatgggagccttccaaaggatggaacgattggacccaagtacctttctgcagccatcatttccacgaattaattatgaaagatggaagagttcttgtagttccatgccgaaaccaagacgaattgattggccgggccagaatatctcaaggagcaggatggtccctcagagagacagcatgcctaggaaaaagttacgctcagatgtggtctctgatgtattttcatcgtagagatttaagacttgccgcaaacgctatatgtagcgctgtgccaagtcattgggtgccaacaagtagaactacttggtcaatacacgccaagcacgaatggatgactactgaagacatgcttaccgtatggaatcgagtctggatacgggaaaatccatggatggaagacaaaactcctgtggaaagttgggaagaaatcccatacttaggtaagcgtgaagatcaatggtgtggaagcctaattggactcaccagtcgagcgacttgggctaaaaacattcaagcggccatcaaccaagtacgctcactgataggtaacgaagaatatacagattatatgcctagcatgaagcggttcaggagagaagaagaagaggccggtgtattatggtaa

SEQ ID NO: 22777 - RNA, 9876 nt, synthetic construct
  misc_feature 1..9876: note = derived and/or modified CDS sequence (opt6) from DENV-2__EU482705__SS-prME
  source 1..9876: mol_type = other RNA
agcgcagggatgattataatgctaataccaacagttatggcgttccacctgacgacgcgaaatggggaaccacatatgattgtaggaatacaagaaaaaggcaaaagcctactttttaaaacagaagatggagtcaatatgtgcacattaatggcgatggacctgggagaactgtgtgaagatacaataacatacaaatgccccctcctacgccaaaatgaacccgaggatatagattgttggtgtaattcaacgtcaacttgggtcacctacggcacctgtacaacgaccggggaacatcgtcgtgagaaaagatcggtggcgttagtgccgcacgtagggatggggctggagactcgcactgaaacgtggatgtcttcagaaggagcttggaaacatgcccaacgaatcgaaacatggatattaagacatcccggatttacaataatggccgcaattttagcctatacaataggaacaactcatttccaacgagtcttgatctttatactacttacagcagttgctccatcaatgactatgcgatgtattggtatcagcaatcgagacttcgtagagggagtgtctggtgggagttgggtagatatagtactagaacatggctcttgtgtaacaacaatggccaaaaataaaccaacgctcgactttgagttgatcaaaactgaagcaaaacaaccagccacattacgaaaatactgcatagaggcaaaacttacaaatacaactacagaatcccgttgtccaacacagggcgaacccagcctgaaagaagaacaagacaaaagatttgtgtgcaaacattcgatggtagacagaggttggggtaatggctgtggactctttggcaaaggtggaattgtaacgtgtgctatgtttacatgcaaaaagaatatggagggcaaaatagtacagcccgagaaccttgagtacacaattgtagtgacaccacactcaggagaggagcatgcagttggaaacgacacgggcaaacatggcaaagaaataaaagtcacaccacaatcgagcataacagaagccgaactaacaggctatgggacagtaacgatggaatgcagcccccgaacgggcttagatttcaacgagatggtcctactacagatggaaaacaaagcctggcttgtccatagacaatggtttctcgaccttcccttaccctggctaccaggtgcggataaacaggaatccaattggattcaaaaagaaacattagtaacattcaaaaacccacacgcaaagaaacaagatgtagtagtactaggcagtcaagaaggagccatgcatacagcactaactggtgccaccgaaatacaaatgtcatctgggaatctgctgtttactggacatctaaaatgccgattacgaatggataaactacaactaaagggaatgtcttactctatgtgcacaggcaaatttaaagtagttaaagaaattgcagagacacagcacggtaccatagtaattagagttcaatacgagggagatggttctccatgcaaaataccgttcgaaatcatggatctggagaagaggtacgtactgggacgcctaataacggtcaatccaatagttactgagaaggactcaccagttaacattgaagccgaacccccatttggtgacagttatatcataattggagtagaaccgggccaactaaaattaaattggttcaagaaaggtagcagtattggtcaaatgtttgaaacaactatgagaggtgccaaaaggatggcaatattaggagatacagcgtgggatttcggatctctcggaggcgtgttcacatccataggaaaagccttgcaccaggtttttggagctatatatggcgcagctttttctggagttagctggacaatgaaaatactaataggagttattattacttggatcggcatgaactcgcggagcacttcactttcagtaagtctcgtacttgttggtattgtaactttatacctcggagtaatggtacaagcggacagtgggtgcgtcgtaagttggaagaacaaagaactaaagtgcggaagcggaatctttataacagacaatgttcatacctggactgaacaatacaaatttcaaccggagagtccatcgaaactagcgtccgctatacaaaaagcccaagaagaaggaatctgcggcatcagaagtgtgacacgcttagagaatctaatgtggaagcagataactccagaattaaatcatattcttgcagaaaacgaagtaaaattaacaattatgactggagacattaaaggtataatgcaggccggcaaaagatctctgaggccacaacctaccgaattaaaatacagttggaagacatggggcaaagctaaaatgctatctacagaaagttacaatcaaactttcttaatagacggaccagagacaactgaatgtccaaacaccaatagagcatggaactccttagaagttgaggattacggatttggagtattcacaaccaacatatggctcaaactaaaagaaaaacaagacgcattctgcgattctaaattaatgagtgcagctatcaaagataatagagcagtgcatgccgatatgggatactggatagaatctgcacttaacgacacgtggaaaatagaaaaagcgagttttatagaagtaaagaactgtcattggccaaaatcacacacactatggagtaacggtgtccttgaaagcgaaatgatcattccgaaaaacttggcaggacctgtatcccagcataactatagaccgggatatcatacgcagattgcaggaccctggcatctaggtaagttggaaatggactttgatttttgcgacggtacaacagttattgttactgaggactgtggaaatcggggaccatccttaagaacaacaacagcgtccggaaaacttataacagagtggtgttgccgttcttgcacactacctccactccgatatagaggtgaagatgggtgttggtatggaatggaaatacgtcctcttaaggaaaaggaagagaatttagttaatagtttagtcactgcaggtcatgggcaagttgacaatttttctctaggtgttcttggtatggcattattcctagaagaaatgttaagaacaagagtaggtacaaaacacgctatactattagtcgcagtaagttttgtgacactgataactggaaatatgtctttcaaagatctcggacgagtagtagtaatggttggagctacgatggcggacaatatcggaatgggtgtaacatatctagcgctattggcagcattcaaggtaagacccaccttcgcagcaggtctactattacgaagactcacaagtaaggagctaatgatgactaccataggaattgttttgttatcccaatcgacgataccggagacagtattagaattaacagatgccttagctctcggaatgatggtgctaaaaatagttagaaatatggagaagtaccaattagcagtgactataatggctatattatgtgttcccaatgctgtaatattacagaacgcctggaaagtctcatgcaccatcctcgcggtagtctcagtttcacccttactacttacttcaagtcaacagaaaacagattggattccactggcactaacaattaaagggcttaatcccactgccatcttcttaacaacgctgtcgagaacaaataagaaaagatcgtggccactaaacgaagccataatggccgtcggaatggtctcaattttagcatcttctctgttaaagaatgatataccaatgacaggtcctcttgtggcgggaggactattaactgtatgctatgtattaacaggaaggagcgccgacctggaactcgagcgggcaaccgatgtaaaatgggaagatcaggcagaaatcagcggatcctcaccaatcctttcaataacgatatcagaagatggtagcatgagtattaaaaatgaggaagaagaacaaactttgaccatactaatccgcactggcctattagtcatttcaggtttgtttccaatttcaattccaattactgcggcagcctggtacctttgggaggtcaaaaagcagcgagctggggttttatgggacgttccatcaccccctccaatgggaaaagcagaactcgaagatggtgcttatagaataaagcagaaagggatcttaggatattctcaaataggcgctggtgtgtataaggaagggacatttcataccatgtggcatgttaccagaggagccgtattgatgcacaaaggaaaacgaatcgaaccaagctgggctgatgttaagaaagatctgatatcctatggaggcggatggaagctagaaggggaatggaaggagggtgaggaagtgcaagtattggccctagagccaggcaaaaacccccgggctgtacaaacaaaacccggattattcaaaacaaacactggtactatcggtgcagtttcactagacttttcgcccggaacgagtggcagtccgataatagacaagaaaggaaaggtagttggactatatggtaacggcgtggtaacccgttccggagcgtatgtaagtgcaattgcgcaaacggaaaaatcaatagaagacaatccagagatagaggacgacatatttaggaaacgcagactaaccataatggatttgcatcctggagcaggtaaaacaaagagatatttaccagctattgtgagagaagcaattaaaagaggtctaagaacactaatcttggcacctacacgagtagtggctgcggaaatggaagaagcactcaggggactacccatcaggtatcagaccccagcaatacgagctgaacacacaggaagagaaattgttgacctcatgtgtcatgcaaccttcacaatgcgtttgttatctccggttcgggtacccaactataatcttataattatggacgaagcacactttacagacccagctagtatcgcagctcgaggatatattagtacaagagtcgaaatgggagaagctgcaggcatatttatgacagccacacctcccggatcccgggatccgtttcctcaatcgaatgcgccgataattgatgaggaaagagaaataccagaacggtcctggaacagtgggcatgagtgggtaacggacttcaaaggaaagactgtctggttcgtaccatcaataaaggcaggaaatgacattgcggcatgtctaaggaaaaatggtaagaaagtcatccaactatcaagaaaaacttttgattcagagtatgtaaaaacaagaactaatgactgggactttgtagtcacaacagacatcagcgagatgggggcgaattttaaagctgagagagtgatagatccacgtaggtgcatgaaaccagtgatattaaccgacggagaagaaagagtcatacttgcagggccaatgcctgtaacccattcaagcgcagcgcagcgacgagggagaataggaagaaatcctaaaaacgagaatgaccaatatatttatatgggagagccattggagaacgatgaagattgtgcacattggaaagaggcaaaaatgctcttggacaacataaataccccagaagggatcattccctcaatgtttgaaccggaaagagaaaaagtagacgccatcgatggtgaatataggttgcgaggagaagcacgtaaaacctttgtagacttaatgagacgcggggaccttccagtatggcttgcctacaaggtggcagcagaaggaataaattatgctgataggagatggtgctttgacggaatcaagaataatcaaatattagaagagaatgtagaagttgagatctggactaaggagggagaaaggaagaaactcaagcctagatggctggatgcacgaatttacagtgatccccttgccctgaaagagttcaaagagtttgctgcaggtagaaaatccttaacattaaatttaataacggaaatgggaagacttccgactttcatgactcagaaaactcgtgatgctttagacaacctggcggtccttcacacggctgaagcaggagggcgggcttacaatcatgcgttatcagaattacctgaaactttagagaccttacttctgcttacattgctagcaacagtaacgggcggaatatttttatttcttatgtcgggtcgtggaattggcaaaatgactctaggaatgtgttgtattataactgcatctatattattgtggtatgcccaaatacagccacactggatagccgcctctataatacttgagttcttccttatcgtactattaatccctgagccggagaaacagcgtactccgcaagacaatcaactgacctacgttgtcatagcaatcttaactgttgtggccgccacaatggcaaatgagatgggatttttagagaaaaccaagaaagacctcggccttggaagtattgcgacccaacagcctgaatctaacattctcgacattgatttaagaccagcatctgcctggaccctttacgcagtggctaccacattcgtcacacctatgttaagacactcaatagagaacagttccgtgaatgtaagtcttaccgcaatagctaatcaggcaaccgtacttatgggactgggcaaaggctggccattgagtaagatggatattggagtgccgcttctagccataggatgctattcacaagtgaatcccattacgttaacagctgctttacttttgttagttgcacactatgcaataattggtcccggcctacaagccaaagctacaagagaagcgcagaaaagagcggcagcgggcattatgaaaaatccaactgtagatggaataaccgtaatagatttagatccaataccatacgacccaaaattcgaaaaacaactaggacaagtaatgctcttgatactatgcgttacacaagttttaatgatgcgaacaacatgggctctttgtgaagcgttaacattagctacaggacctatttctacactatgggagggaaatcctggcaggttttggaatacgacaattgctgtctcgatggcgaatatatttagaggtagttatttagcgggagctgggctactgttcagcattatgaaaaatacaacaaatacgcgcaggggaactgggaatataggggagaccctaggcgagaaatggaaaagcagattgaacgcactaggaaaatccgaatttcaaatttataagaaaagtgggattcaagaagtcgacaggacactggcgaaggagggaattaaaagaggggaaacagaccaccacgcagtttccaggggttcagccaaacttcgttggtttgtagaaaggaatatggtgacccctgaaggtaaagtcgtagacttaggctgtggtagaggaggatggagctattactgtggtggactgaaaaatgttcgagaggtaaaggggctaactaagggcggtcccgggcatgaagaacctataccaatgtcaacctacggctggaatctagtgcgtctccaatctggcgtggacgtcttcttcataccacctgaaaaatgtgatacattattgtgtgacataggcgaatcgtctccaaatccgaccgtggaggccggacgcacactccgcgtcttaaatctagttgaaaattggttgaataacaacacacaattctgtattaaagtattaaatccgtacatgccgtcggtaattgaaaagatggaagcacttcagcggaaatatggcggtgcgctagtgagaaacccattatctaggaatagcacacatgaaatgtattgggtatcaaatgctagcggtaacatagtatcatccgttaacatgatcagcaggatgctaataaacagattcactatgagacacaagaaagcaacctatgaaccggatgtagatttaggctctggaacaaggaatattggaatagagtcagaaataccgaacttggatattataggaaaaagaatagagaaaattaaacaagaacacgaaaccagctggcattatgatcaggaccacccctataaaacctgggcgtatcacggtagttacgaaactaagcaaactggctctgcaagttcgatggtgaatggggtagtaagactattaacaaaaccctgggatgtactaccaacggtaactcaaatggcgatgacagacacgaccccctttggacagcaaagggtctttaaagagaaggtagatacccgaactcaagagccgaaagaaggaactaagaaattaatgaaaattacggccgaatggctctggaaggaattaggcaagaagaaaacacctcgtatgtgtacaagagaagaatttacaagaaaagtccgaagcaatgcagcgttaggggccatattcacagatgagaacaaatggaaatccgcgagagaagcagtcgaagacagtagattttgggagctagttgataaagaacgtaacttgcatttggaagggaagtgtgaaacatgtgtatacaatatgatgggaaagcgagagaagaaactaggggagtttggaaaggcaaaaggcagtagagcaatctggtatatgtggctaggtgcacgtttcttagaatttgaggcattagggtttctaaacgaagatcactggtttagtagagaaaactcactatccggggtagaaggtgaaggcctacataaattaggttatatcttgcgtgacgtctccaaaaaggaaggtggagctatgtatgcagatgacactgcagggtgggacactcgtattacattagaagatctgaagaatgaagaaatggtaactaatcatatggaaggcgaacataaaagactagctgaggccatatttaaactaacatatcaaaacaaagtagttagagttcaaagacctactccacgaggtacggtcatggacataatctctaggagggaccaacgcggcagcggccaagttgggacttacggactaaatacatttacaaatatggaagcgcaactaataagacaaatggaaggcgaaggagtatttaaaaatatccaacatcttacagtaactgaggaagtagcagtacagaactggctagcacgggtagggcgtgaaagactgagccgaatggctatctcaggagatgactgtgtagttaaaccactagatgacaggtttgccaatgcactaacggcactaaatgatatgggtaaaattcgaaaagacatccagcagtgggaaccgtccaaaggttggaatgactggacacaagttcccttttgttctcaccattttcacgaactgattatgaaagacggtcgagtgcttgtagttccgtgccgcaaccaagacgaacttataggcagagctaggattagtcagggagcgggatggagcctcagagaaacggcgtgccttggtaaaagttacgcacagatgtggagtttaatgtattttcacagacgagatttacgactcgcagcgaatgcaatatgctctgcagtaccttcccattgggtacctacatcccgaacgacgtggtcgattcatgctaaacacgaatggatgactaccgaagatatgctgacggtctggaacagagtatggataagagaaaatccatggatggaagataaaacaccggtcgagagctgggaagaaatcccttatttaggaaagagagaggatcaatggtgcggctcgttaataggattgacaagtagggctacgtgggctaaaaatatccaagccgcgattaaccaggtaaggtctttgataggaaatgaggaatatacagactatatgccctcgatgaagagatttagaagagaagaagaagaagcaggggtcctatggtaa

SEQ ID NO: 22778 - RNA, 9876 nt, synthetic construct
  misc_feature 1..9876: note = derived and/or modified CDS sequence (opt6) from DENV-2__EU482463__SS-prME
  source 1..9876: mol_type = other RNA
agtgcagggatgataatcatgcttattcctacagttatggcatttcacttgactacaagaaatggagaaccccatatgatagtatcaatacaggaaaaaggtaaatctctactattcaaaaccgaagatggggtaaacatgtgcactcttatggcgatggatcttggcgagctgtgtgaagacacaatcacctataaatgtccccttttacgtcaaaatgagcccgaagatatagactgctggtgcaactctacaagcacttgggtaacttacggaacttgtacaacaactggcgaacatagacgggagaaaagaagcgtggcacttgttccccatgtgggaatgggcctcgaaacaagaacagaaacttggatgtcatctgaaggagcttggaaacacgcacagcgtattgaaacttggatattgagacaccctggatttacaatcatggcagctatcttggcctacaccataggtaccacacacttccaaagagtattaatttttatattacttaccgctgttgcgccatcgatgacaatgcgttgtatcggcataagtaatcgtgacttcgtggaaggggtctccgggggatcttgggttgacatagtattagaacacgggtcctgcgttacgacaatggctaaaaacaaaccaacacttgatttcgaattgataaaaactgaagcgaaacaacccgcgacgcttcggaaatactgcatcgaagcgaaacttactaacacaacgactgagtcccgctgtcccacacaaggagagccaagtcttaaagaagaacaagataaaaggttcgtatgcaaacatagtatggtggataggggatggggtaacggatgtggcctcttcggtaaaggagggattgttacgtgcgctatgtttacatgcaagaaaaacatggaaggaaaaatcgtacaaccggagaatctagaatatacgatcgtggtaactccccattcgggggaagaacatgcagtaggcaacgataccggcaaacacggtaaagaaataaaagtaacaccacaaagtagtatcaccgaagcagaacttacagggtatgggactgtaacaatggaatgttcaccacgcacagggctagatttcaatgaaatggttcttctccaaatggaaaataaagcatggttagtccatagacaatggttcctagatttgccgctaccatggctaccaggagcagacaaacaggaaagcaactggatacagaaagaaacgttagtcactttcaaaaacccacatgccaagaaacaagatgtagtagtactcggctcccaggaaggtgccatgcatacagcattgaccggagctacagaaatccaaatgtcgtccgggaaccttctattcacaggacatttaaaatgcagattgagaatggataaattacaattaaaagggatgtcttattctatgtgtaccggtaagtttaaggtggtaaaagaaatagcagaaacccaacacggaacgatcgtcattagggtgcaatatgaaggagacggttccccttgtaagattccatttgaaataatggatcttgaaaaacgctatgtactaggaagacttataacagtaaaccccatagtaaccgaaaaagactcccctgtaaatatagaggccgagcctcccttcggagactcttatattattattggcgtggaacctggacaacttaaattgaactggttcaagaaaggatcaagcattggccaaatgtttgagactaccatgaggggtgcgaaacggatggcgatacttggtgacactgcatgggacttcggttcactaggaggggtctttacatcgatcggaaaagcactacatcaggtatttggggccatatacggcgccgctttcagtggtgtctcttggacaatgaaaatactcattggagtcattatcacttggatcggtatgaatagccgatccacgtcgctgtcggtctcgctagtattagttggtatcgttaccttatatctgggcgtaatggtacaagcagattcaggctgtgtcgtaagctggaaaaacaaagaactgaaatgtggttcgggcatttttattacagacaatgttcatacgtggactgaacaatacaagtttcaaccagaaagcccaagtaaattagcttcggctattcaaaaggcacaagaagaaggtatctgtgggattcgctcagtaacaagattagaaaatttaatgtggaaacaaataacaccggaattaaatcacatattggcagaaaatgaggtcaaactaactataatgactggagatataagaggaatcatgcaggcgggtaaaagatcgttgcgtccccaacctacagaactaaaatactcctggaagacgtggggcaaagcaaagatgttaagcaccgagtcttacaatcaaacgttcttgattgatggccccgaaacagcagagtgcccaaatactaatagagcatggaatagtttggaagtagaagattatggtttcggtgtttttaccacaaacatttggctcaagctaaaggagaaacaagacgctttttgtgattcaaaactaatgtcagcagctatcaaagacaacagagctgtacacgcagatatggggtactggatcgaatctgcgctaaatgacacatggaaaatagaaaaggcgagtttcatagaagttaaaaattgtcattggccaaaaagtcatacgctatggtcaaacggggtactggaatcagaaatgataatacccaaaaatttagcagggccagtatcacaacacaattatcgaccaggatatcacactcaaatcgcggggccttggcatcttggtaaattagaaatggactttgacttttgcgatggcactactgtaattgtcactgaagactgcggaaatcgcggtccttctcttagaactacaactgcaagtggaaaattaataactgaatggtgctgtaggagctgcacattaccaccactaaggtacagaggggaagatggatgttggtatggtatggaaatacgaccgctaaaagaaaaagaagaaaacctcgtgaatagcttggtcacggcaggacacggacaagtagataactttagtttaggtgtattgggaatggccctttttcttgaggaaatgcttaggacgagggttggaacgaaacatgctattctcctagtagccgtttcatttgtcactcttattacagggaacatgagttttaaggatctgggacgggttgtggttatggtaggagccacgatggcagatgacattggtatgggcgtaacctatttggccctactcgcagcctttaaagtaagacctacgtttgcggcaggactgttactaagaaaattaacctcaaaagaacttatgatgacgaccataggaatagtactgctatcacaatcaaccatccctgaaaccgtgttagagctaacagacgcactagcattgggaatgatggtattaaaaatagttagaaacatggaaaaatatcaactagccgtcacaattatggctattttatgtgtaccaaatgcagtaattctccaaaatgcatggaaggtgtcatgcacaatcctggcagtggtttcagtgtcaccgttattactcacatcatcccaacaaaagactgactggataccactggccctaacaataaaaggcctaaacccaacagctatctttttaacaaccttatccagaacaaataagaaacgatcttggcctttaaatgaagcaataatggcagtaggaatggtatcaatcttagcaagcagtctgctgaaaaacgatattcctatgaccggacctctagttgcaggcggattactaaccgtctgttatgttttaacaggacgatccgcagatctagagctggaaagagcaacggatgttaaatgggaagaccaagccgaaattagtgggtcatccccaatactctctattaccatctccgaagatgggagtatgtcaattaaaaatgaagaagaagaacaaacactaacgatactcatcagaaccggattattagttataagtgggctatttcctatttcaataccaataactgctgctgcatggtacctgtgggaggtaaagaaacaacgcgcaggagttctgtgggatgttccaagcccgccacccatgggaaaagctgaacttgaggacggagcttatagaataaaacagaaaggaatattgggatatagccagataggtgcaggagtttataaagaaggcacatttcatacaatgtggcatgtcactcggggagccgtattaatgcacaaaggtaaacgtatcgagccaagctgggcagatgtgaagaaggatctcatttcctatggcggcggatggaagttagaaggagaatggaaagaaggagaggaagtccaagtccttgccttggaaccgggaaagaatccgagagcagttcaaacaaaaccaggcttgttcaagacaaacactggtaccataggtgctgtctccctcgacttcagtccagggaccagcgggagtccgattattgacaagaaaggaaaagttgttggtttgtatggcaacggggttgtcactcgttcaggtgcctatgtatcagcaatcgctcaaactgaaaaatcaatagaagataatccagaaatagaagatgacattttccgtaaaagacgactaacaatcatggacttacatccgggagcaggcaaaactaaacgatatttacccgcgatcgtccgcgaggctattaaacgcggattgagaacactcattcttgctcctacacgtgtcgtggctgcagaaatggaagaggcattacgtgggttaccgattcggtaccagacccctgcaataagagctgaacatactggacgtgaaatagtagatctgatgtgtcatgctacattcacaatgaggctactatcgcccgtaagagtaccaaattacaatctgataataatggatgaagcacatttcacagaccctgctagcatagcagctcgtggttacatatccactcgggtagaaatgggcgaagcagcagggatcttcatgacagcaacgccaccaggttcgagggacccattcccgcaaagcaatgcacctattatagatgaagaaagggagattccggaacggtcatggaactctgggcacgaatgggtaacggattttaagggcaagacagtatggttcgtacctagtattaaagctggcaatgatatagcagcttgtctaaggaaaaatggtaagaaagtaatacaactctcacgtaaaacattcgacagtgagtacgtaaaaactcgtacaaacgattgggactttgtagtgacaacagacatctcggagatgggggccaattttaaagcagaaagagtcattgatccacgacggtgtatgaagccagtaattttaacggacggagaggaacgtgttatattggcaggaccgatgccagttacgcactccagcgcagctcaacgtagaggaagaataggaagaaacccaaagaatgaaaatgatcagtatatatatatgggagaacctctcgaaaacgacgaggattgtgcacattggaaagaggcaaaaatgctacttgataatataaacactcccgaaggaatcattccctcaatgtttgagcctgagcgtgaaaaagtggatgcgatagacggagaatatcgtttgcggggagaagcacgtaagacattcgtcgacctaatgagaagaggtgatttaccagtgtggttggcttacaaagtggcagcagaaggaataaactacgcagaccgtagatggtgctttgacggaatcaaaaataatcaaatactggaagaaaatgtcgaagtagagatctggacgaaagaaggagagagaaagaaattaaagcctcgatggttagatgcccgaatctattctgacccactggcattaaaagaatttaaagagtttgccgcaggaagaaagtcattaacgttaaatctgataacagaaatgggaagattacctacatttatgacacagaaaacaagggatgcccttgataacctagcggttttacatacggctgaagctggaggtcgtgcctacaatcacgccctctctgaacttccagaaacacttgaaacgctcttgttgctaactctccttgcgacagttacaggaggtatatttttgtttctcatgagcgggagaggtataggaaaaatgaccttaggaatgtgctgcattataacagcaagtatactcttgtggtacgctcaaatacagccgcattggattgccgcatcaataatattagagttctttctaatcgtgctgttaattccagaaccagagaaacaaagaactccccaagacaatcaactgacctatgtagtaattgccattttaacagtggtcgcggcgacaatggctaacgagatgggattcttagaaaagacgaagaaagatcttggtctaggttcgatagcaacacagcaacccgagtcgaacatattagacattgatttaagacctgcctccgcatggacgctatacgccgtcgccactacgtttgtgacgcccatgcttcggcattcgatagaaaacagctcagtcaacgtgtctctcacagcaatagccaaccaagcaactgttttgatgggcttgggtaagggatggcctctcagcaaaatggatataggggtaccattacttgcaattggatgctatagccaagttaacccgataacgttaaccgctgccttactactcctggtcgcccactatgcaataatcggaccaggactccaagcaaaagcaacacgcgaggctcagaaaagagcagcggcaggcataatgaagaacccaacagtagatggtattactgtaattgatttagatcctataccgtatgatccaaagttcgaaaaacaattagggcaagtcatgctactcattctctgtgtcacccaagtcttaatgatgagaacaacctgggccctttgtgaagccttaacattggctacgggaccaataagcacactctgggaaggaaaccccggaagattctggaataccacaatagcggtctccatggcgaatatctttcgaggctcatatctcgccggagcagggcttttattttcaatcatgaagaacacaacgaatacacgaagaggcactgggaacataggtgaaacattgggggagaaatggaaaagtagattaaatgctctagggaagagtgagtttcaaatatataagaaaagcgggatccaagaagtcgataggacactagctaaagagggtattaagagaggagaaactgatcatcatgctgtgtcaagaggcagcgcaaagctccgttggttcgtcgagagaaatatggttacaccagaaggcaaagttgtagatctaggctgtggaagaggaggctggtcctattattgtggaggactcaaaaatgttagagaagttaaagggttaactaagggcggacctggtcatgaagaacctatccctatgtcaacatatggatggaacttggtcagactacagtcgggcgtagatgtcttctttataccacccgaaaaatgtgacacacttttatgtgacattggtgagagttcaccaaatccaacagttgaagccggccgaacactaagagtcctaaacttggtggagaattggttgaacaacaatacacagttctgcataaaagtgcttaatccatatatgccatctgtaatagagaaaatggaagcactccagcggaaatatgggggagccttagtaagaaatcctttgtctagaaactcgactcatgaaatgtattgggtttccaatgcaagtggtaatatagtatcttccgtcaatatgatatcacgaatgcttataaatagatttacgatgcgacacaagaaagcgacatatgaaccagacgtggatttgggctcaggaacaaggaatattggtattgagagtgaaaagccgaatcttgacataataggaaaacgtattgagaaaatcaaacaggaacatgagacttcctggcattatgatcaagaccatccctataaaacatgggcgtaccacggtagttatgaaacaaaacaaacaggctcggctagttcgatggttaacggagtggtcagattattaacaaaaccctgggatgtcctgccgactgtaactcaaatggcaatgacagatacaacgccatttggacaacagagagttttcaaagaaaaagtggatacaagaacccaggaaccgaaagaaggaactaagaaactcatgaagatcaccgctgaatggctctggaaggaattaggaaagaagaaaactccaagaatgtgtacacgggaagaatttacaaggaaagtaagaagtaatgctgcattaggggccatatttaccgatgaaaacaagtggaaatcagctcgggaagcggtagaagacagcaggttttgggaattagttgacaaagaaaggaatttacatttagaaggaaaatgtgaaacatgtgtctacaatatgatggggaaaagagaaaagaagctgggagaatttggaaaagccaagggaagtagggccatatggtatatgtggcttggtgctagatttcttgagttcgaggccttaggattcttaaacgaagatcactggtttagtcgagaaaattcattgtccggtgtggaaggagaaggattacataaactaggatatatcttaagggacgtgagcaagaaagaagggggagccatgtatgcagacgacacggccggatgggatactcgaattactttagaggacttgaaaaacgaagaaatggtaacaaatcatatggaaggtgagcataagaaattagccgaggcaattttcaaactgacgtaccaaaataaagtagttagagtacaacgtccgacaccacgaggaaccgtaatggatatcatatcacgcagagaccaacgtggatcaggacaggttggtacatatggattgaacaccttcacgaatatggaagcgcagttgatacgacaaatggagggggagggtgtttttaaaaacatacaacacctcacagtcacagaagaagtagccgtacataattggttagctagagtagggagggaacggctcagtcgaatggctatttctggagatgattgcgtcgtcaaaccattggatgatcgatttgcaaacgctcttacagcactaaatgacatgggaaaaattagaaaagatattcaacagtgggaaccatcaaaaggatggaacgattggacccaggtaccattttgttctcatcatttccacgaattgataatgaaagacgggcgcgtgctcgttgtaccttgccgaaatcaagatgaactcatagggagagcgcgcatcagtcaaggggcgggttggtctctacgtgaaacggcttgcttaggaaaaagttatgcccaaatgtggagcttaatgtacttccatcgaagagacttacgcctggcggccaatgccatctgttctgctgtcccaagtcattgggtcccaaccagtcgtacgacctggtccatccacgcaaaacacgaatggatgactaccgaagacatgttaactgtttggaacagagtatggataagggagaacccatggatggaggataaaacacctgtggaaagctgggaagaaattccgtaccttggcaaaagagaggaccaatggtgcggttcactcataggcttaacaagtcgtgcaacatgggcaaagaatatccaggcggcaattaatcaggtcagatcacttataggtaacgaagaatatacagactacatgcccagtatgaagaggttcagacgagaagaagaggaagcaggagtactttggtaa

SEQ ID NO: 22779 - RNA, 9876 nt, synthetic construct
  misc_feature 1..9876: note = derived and/or modified CDS sequence (opt6) from DENV-2__EU482464__SS-prME
  source 1..9876: mol_type = other RNA
agtgctggaatgataatcatgctgataccaactgtaatggcatttcatttaacaacgcgcaacggagaaccgcatatgattgttgggatacaggaaaaaggtaaaagtcttttattcaaaacggaagacggagtaaatatgtgtacactgatggcaatggatttaggagaactgtgcgaagatacaatcacttataaatgtcctttgcttcgacaaaacgaacctgaagatattgattgttggtgtaatagcacgagcacatgggtaacttatgggacatgtactactactggggagcaccggagagagaaaagatccgtcgccttagttccgcatgttggaatgggtttagaaacaagaactgaaacatggatgtcgtcagaaggagcttggaaacatgcacaaagaatcgaaacatggatacttagacacccgggattcaccatcatggctgctattctcgcatacaccattggtacgacccattttcagagagtgttaatatttattttattaaccgcagtcgcgccaagcatgacgatgagatgcataggaatatcaaatagagacttcgtggaaggtgtgagcggaggctcatgggttgatatagtgttagaacatgggagctgcgttaccacaatggcgaaaaacaaaccaactcttgattttgaactaattaaaactgaggcaaaacaacctgcaactctaagaaaatattgcattgaagcaaaacttaccaacaccacgaccgagagtagatgtccaacacaaggagaaccatcattaaaagaagaacaagacaaacgttttgtatgcaaacatagcatggtagacaggggatggggaaacggatgtggtctgttcggcaaaggagggatcgtaacatgcgcaatgtttacatgtaagaaaaatatggaaggaaaaattgtacagcccgaaaaccttgaatataccatagtagtgacaccacacagcggtgaggagcacgccgtaggcaacgatacaggtaaacacggcaaagaaataaaagtaactccgcaatcaagtatcacagaagcagaactgacgggatacggaacggtgactatggagtgttctccccgaacaggtttagacttcaatgaaatggtattactgcaaatggaaaataaagcatggctggttcatagacagtggtttctggacttgccacttccatggcttcctggagctgataaacaagaaagtaactggatacaaaaagaaacgctggtcacatttaaaaacccgcatgctaagaaacaggatgtggtagtattaggctcgcaagagggtgcaatgcataccgctctaacaggcgcaacagagatccaaatgtcaagtggcaatttactatttacaggacatttgaaatgccgtttacgtatggataaattgcaattgaaaggaatgtcttacagcatgtgtaccggaaagtttaaagtcgttaaagaaatagccgaaacacagcatggtacaattgttattcgagtgcaatatgagggcgatggatccccatgtaagattccattcgaaattatggatctagagaaaagatatgtactcgggcgactaataaccgtcaatccaatagtaactgaaaaagattctccagtgaacatagaagccgaaccaccatttggcgattcgtacattatcattggcgtggaacctggacaactgaaactaaattggtttaaaaagggatctagtattggccaaatgttcgaaacgaccatgagaggggcgaaacggatggccatacttggtgatactgcttgggatttcggaagcctaggaggtgtattcacaagtataggaaaggctttacatcaagtattcggagcaatatatggtgccgcatttagtggtgtatcttggacgatgaagatcttaattggtgtcatcattacctggataggaatgaactctagaagcacgagtctgtcggttagcttagttctagtaggcattgtaacgctttatttaggagttatggtccaagcagactcaggctgtgttgtaagttggaagaataaggaactcaaatgcggaagcggtatttttataactgataacgttcatacttggactgaacaatacaaatttcagcctgaaagccctagtaaacttgcttcagctattcaaaaagcacaagaagagggtatctgtggcattagatccgtaacgcgattagaaaatttaatgtggaagcagattacacccgaattaaatcatattctggcagagaatgaagtaaaacttacaataatgactggcgacatcaaggggatcatgcaggcgggcaaaaggtctctaagaccacaacctacggaattaaaatactcttggaaaacctggggaaaggcaaaaatgttgagtactgaatcgtacaatcaaacgtttctaatagacggcccagaaacgacagaatgtcccaatacaaatcgagcgtggaatagtttagaagttgaagattatggtttcggtgtatttacgactaatatatggctaaaattaaaagagaagcaagatgcgttttgcgatagtaaattgatgtccgcggccataaaagataacagagcggttcatgccgacatgggttattggattgaaagtgccttaaacgacacgtggaaaatcgaaaaggcatcattcatagaagttaaaaactgtcattggccgaaatcccacactttgtggagcaatggagtgttagaaagcgaaatgattattcccaaaaacctagccggaccggtctcccagcataactataggcctggataccatacacaaatagctggtccctggcacctgggcaagttagaaatggatttcgatttctgtgatggcacgacagtgatcgtgacggaagattgcggaaacagaggcccctcgttaaggacaactacagcatcagggaaactgattactgaatggtgctgtcggagttgtacgttgcccccactacgatatagaggagaagacggttgttggtacggtatggagattaggccattaaaagagaaagaagaaaatttagtaaactccttggttactgctggtcacggacaagtcgacaacttctctctaggcgtactaggtatggccctatttttagaggaaatgttacgtacaagagtaggcacaaagcacgcaatactacttgtggctgtttcttttgtgactctgataactgggaatatgagctttaaagatctagggcgtgtcgtggtaatggtcggtacaacaatggctgatgacatcggtatgggtgtaacatatctagcactactagcggcatttaaagtccgacccacgtttgcagcggggttactattacgcaaactaacatccaaagaactaatgatgaccacaataggtattgtcctgcttagccagtcaacaattccagaaacggtcttagagctaactgatgctttagctttaggaatgatggtgcttaaaatagtccgaaacatggagaaatatcaattagcagttactattatggcaattttgtgcgttccaaacgctgtaatattgcaaaacgcgtggaaagtgtcttgcacgatattagctgtggtaagtgtatcacctctactacttacttcatcgcaacaaaagacggattggataccgctagcattaactattaagggattaaatcctaccgctatcttcttaactacattatcccgaactaataagaaacgatcctggcccttaaacgaggcaattatggctgtgggcatggtatctatcctagcaagttcactactaaagaacgatatccctatgacaggcccactggttgctggtgggctccttactgtatgttatgtccttacaggaagatccgcagatttggaactggagagggcaactgacgtaaaatgggaagaccaggccgaaatttccggttcctctccaatactctccataactatttcagaagacggctccatgtcaattaagaacgaggaagaagaacaaacgttaacaattctgatacgtaccggcttattggtgatatctggcctatttcctatttcaattcctataaccgcagcagcctggtatctctgggaggtaaagaaacaaagagccggagtgctttgggacgtaccttctccacccccaatgggaaaagcagaactggaagatggagcatataggataaaacaaaaaggaatactaggttatagtcaaattggtgccggtgtttataaagaaggcacattccataccatgtggcacgtgaccagaggggcagtcctgatgcataaaggaaaacgcattgagccatcatgggctgacgtaaagaaagacttaatatcttatggtgggggttggaaactcgaaggcgaatggaaagaaggagaagaagttcaagttttagccctggaaccgggcaaaaaccctagagcagttcaaactaaacctgggttattcaaaacaaatacaggaacaataggagcagttagcctcgatttctcaccagggacgtcaggttcccccatcatagacaagaaaggaaaagtagttgggctatacggtaatggcgtggtaactcgatcgggtgcctatgtctccgccatagcccaaacagagaaaagtatcgaggataatcctgaaatagaagatgatatatttcggaaaagaagacttacaattatggatcttcatccaggagcaggaaaaactaaaagatatttgccagcaatcgttagagaagctattaaaagaggacttagaacgttgatcttagcacctactagagtagttgcggctgaaatggaagaggctctacgaggtcttcccatacgatatcaaaccccagcaataagagccgaacataccgggcgtgaaatagtagacttaatgtgccacgcgacatttacgatgaggttattatcaccggtacgagtaccgaactacaacttgattataatggacgaggcacacttcactgaccccgccagtatagcggcacgaggttacatatcaacaagagttgaaatgggcgaggctgcaggaatattcatgacagccacccctccaggttccagagacccatttccacaatcgaatgcacccatcatagacgaagaaagagaaatacccgaacgcagttggaacagcggtcatgaatgggttaccgattttaagggcaagactgtgtggtttgtaccgtccataaaagctggaaatgacattgcagcttgtctgcgaaagaacggtaagaaagtaatacaattaagtcgcaaaaccttcgattcggaatatgtaaaaaccagaaccaatgactgggacttcgtagttacaacggacataagcgaaatgggagcaaactttaaggcagaaagagtaatagatccccgacgatgcatgaaacccgtaatcctcacagatggggaagaacgagtaattttagcagggcccatgcctgttacacactcttctgctgctcagaggcgaggacgcataggaaggaacccaaagaacgagaacgatcaatacatttacatgggagaacccttagagaacgacgaagattgtgctcattggaaagaagccaagatgttgctcgacaatatcaacacccccgaaggcataattccatccatgttcgagcccgagcgagaaaaagtagatgctatagacggagagtaccgacttagaggggaagcgagaaagacgtttgtagatttaatgcgaagaggggacttacccgtatggctagcttacaaggtggcagctgaaggtattaattacgcggaccggagatggtgtttcgacgggattaaaaacaaccaaatattagaagaaaacgtggaagtcgagatatggacaaaggagggcgagaggaagaaattaaaacctaggtggctagatgcaagaatatactcagacccattggcacttaaggagtttaaagagtttgctgcaggacgtaaatcgttgacgttaaatttaatcactgagatgggccggttaccaacattcatgactcagaaaactagagatgcactagacaacttagctgtactccacaccgcagaagctggtggacgagcttataatcacgcactttccgaactacccgaaacattagagactcttttattgttaacacttttagctactgttactggagggatatttttatttctaatgtcaggacggggcattggaaaaatgacactcggaatgtgttgtataattacagcatcgatattattatggtacgcacaaattcaaccgcattggatagcggcaagtataatactagaatttttcttaatagtgttattaatccctgaacccgaaaagcaacggacacctcaagataaccaactgacttatgtagtgatcgcaattctcacggtggtcgcagctactatggctaacgagatggggtttctggagaaaactaagaaagacctcggacttggaagtatagctactcaacaacctgaaagcaatattttagatatagatttgagaccggcttcagcctggacattatatgctgtggccacaacctttgtcactccaatgttaagacatagcattgaaaactcatctgtaaatgtgtcactgactgctatagccaaccaagctacagtattgatgggtctgggtaaaggatggcctctgtccaaaatggatattggagtacccttgttagccatagggtgctattctcaagtaaatcccatcacactcactgcagcattattactactggttgcccactacgcaataataggacctggcctgcaggctaaagcgactagagaagcccaaaaacgggctgcagctggaatcatgaaaaatcctacagtcgacggaataacggtaatagacctcgacccaattccatacgatccaaagtttgaaaaacaattaggtcaagttatgctacttattctttgtgtaacccaagtgctaatgatgagaacaacttgggcgctgtgtgaagctctaaccttagcgactggaccaatcagcacactgtgggaaggtaatcccggaagattctggaatacaacaattgcagtgtcaatggcgaacatcttcagaggatcataccttgcgggtgcaggcctactattttcaataatgaaaaacacgacaaacactagaagaggaacaggaaatatcggagagacattgggcgaaaagtggaaaagtcgcctaaacgccctaggcaaatccgagttccagatatacaagaaatctggtatccaggaggtagatcggacacttgctaaagaaggcatcaagagaggagaaacagatcatcacgcagtatctagaggtagtgcaaaactaaggtggttcgttgaacgtaatatggtaacccccgagggaaaagttgtggacctaggatgtggtagagggggatggtcctattactgtggcggacttaaaaacgtacgtgaagttaaaggactaaccaaaggcggaccaggacatgaagaaccgatcccaatgtctacgtatggctggaatctagttagattgcaatcaggcgttgacgtattctttattcctccggagaaatgtgataccctactatgtgatattggagaaagctctccgaacccaacagtagaagcaggtcgtacactaagagtattaaacctggtggaaaattggttaaataataatactcaattctgtataaaagtgctcaatccctatatgccaagtgtaatagagaaaatggaagcgcttcagaggaaatacggcggtgcgttagttagaaaccctttatcacgtaatagtacccacgaaatgtactgggtatcaaatgcaagtgggaacatagtaagcagtgttaatatgattagcaggatgcttattaacagatttacgatgcgacataagaaggccacgtatgaacccgacgttgatcttggctcagggacacgaaacataggtattgaaagtgagattccaaaccttgatataataggtaaacgaatagaaaagataaaacaagaacatgaaacttcttggcactatgatcaagaccatccgtataagacatgggcttaccacggatcttacgaaactaaacaaacaggatctgcatcgagtatggttaatggagtcgtccggctactcaccaaaccttgggacgtactccccactgttacccagatggcaatgacggacacaactccatttggacaacaaagggtgtttaaagagaaggtagatactcggacccaagagccgaaggaggggacaaagaaattaatgaaaattacagcagaatggctatggaaagaattagggaaaaagaaaacgccaaggatgtgcacacgtgaagagttcacgcgaaaagtacgctctaatgcagcgcttggagccatatttaccgatgaaaataaatggaaatccgctcgtgaagctgtagaagattcacgcttctgggaattggttgataaagaacgtaatcttcacctagaaggtaagtgtgaaacatgtgtatataatatgatgggaaaacgagaaaagaaattaggtgagttcggcaaagccaaaggatccagggctatatggtacatgtggcttggagctcgatttctcgaatttgaggcactgggattccttaacgaagatcactggttttctcgagagaacagtttatcaggggtagaaggcgaaggactacacaaactaggatacattctcagagatgtgtcaaagaaagaaggtggtgccatgtatgcagatgatactgcgggatgggacacacggattacattagaggacctcaaaaacgaagaaatggtaacaaatcacatggagggagaacacaagaaacttgcagaagctatattcaaactaacttatcaaaataaagtagtaagggtacaacgtcccacaccaagaggaacggtgatggatatcataagccgacgtgatcaaagaggtagtggtcaggtcggaacatatggattaaatacctttacaaatatggaggcacagctgattcgacaaatggaaggagaaggagttttcaaaaacatccaacatctaacggtaacggaggaagtcgccgtccaaaattggctagcacgggtaggaagagaaagattgtctagaatggcaattagtggtgatgattgcgtggtcaaaccactcgacgacagatttgcgaatgctctagctgctcttaacgatatgggtaaaattaggaaagacatacaacaatgggaaccatcgaagggttggaatgattggacccaagtcccattttgttcccatcactttcatgaattgataatgaaagacggaagggtcctagtggtaccttgcaggaatcaagatgaattaatcgggcgggctagaatttcacagggggccggttggtcactaagagaaaccgcttgcctaggaaaatcttatgcacagatgtggtctttgatgtatttccacaggagagacctcagattagccgccaacgcgatatgtagcgcagtacctagccactgggtgcccacatcaagaacaacttggagtatccatgcaaagcacgagtggatgacgactgaagacatgttgaccgtgtggaaccgagtatggatacgcgaaaatccttggatggaagacaagactcccgtggaatcatgggaagaaataccgtacttagggaagcgagaagaccaatggtgtggatcactcatcggtttgacaagtcgcgctacttgggcaaagaacatacaggcggcaataaatcaggtacgatcactaataggaaacgaagaatatactgactacatgccatccatgaaaagattcaggagagaagaagaggaagccggagtactatggtaa

SEQ ID NO: 22780 - RNA, 9876 nt, synthetic construct
  misc_feature 1..9876: note = derived and/or modified CDS sequence (opt6) from DENV-2__EU482465__SS-prME
  source 1..9876: mol_type = other RNA
agtgctgggatgatcattatgctaatacctacagttatggcttttcacctaacaacacgtaatggcgaaccacatatgatagtaggaatccaggaaaaaggaaaatcattattgtttaaaacagaagatggcgtaaacatgtgcacgttaatggcaatggacttaggtgaattatgtgaagacactatcacttacaaatgtccgctattacggcaaaatgaaccagaagacatcgattgttggtgcaactctacgagcacatgggtcacgtacggaacatgcacaacgaccggcgaacatcgtcgagagaaaagatcagtagctcttgtaccgcatgttggtatgggtttagaaactagaacagaaacttggatgtcatctgaaggtgcctggaaacacgcacagagaatagaaacctggatcttgcgtcatcctgggttcacaatcatggctgcaatactggcgtacacgataggaaccactcattttcaaagagtattaattttcatccttctaacagcggtagcccctagtatgactatgcgatgcattggtattagcaacagagacttcgttgaaggcgtgtcaggaggcagctgggtagacatcgtactggaacacggaagttgcgtcacaacaatggctaaaaacaaaccgacgctagactttgaattaattaaaactgaagcaaaacagccagcaaccctaagaaaatactgtatagaagcaaaattaacaaataccacaaccgaaagtcgctgcccgacccaaggtgaaccaagtctaaaagaagaacaagacaaaaggtttatatgtaaacattcaatggtagacagaggatgggggaacggctgtggcctttttggcaaaggaggaatcgtgacatgcgccatgttcacttgtaagaaaaacatggaagggaaaattgtacaaccagaaaaccttgaatacacaattgttgtgacacctcactccggggaagaacacgcagttgggaatgataccggtaaacacggcaaagaaattaaagtaacaccccaaagcagtattacagaagcggaattaacaggttatggtaccgttacaatggaatgttcgcctcgaactggcttggacttcaacgaaatggtgttgctacaaatggagaacaaagcctggctagtacataggcagtggtttttagacttaccgctaccatggcttccgggtgcagataaacaagaatctaattggattcaaaaagaaaccttagttacatttaaaaacccgcatgcgaagaaacaagacgttgttgtattggggtcccaagaaggggcaatgcacacagcgttaacaggggctaccgagattcaaatgtcgagcgggaatttattgttcacgggccatttaaaatgtagacttaggatggataaattacaactaaaaggaatgtcttatagtatgtgcaccggaaaattcaaagtagtaaaggagatagcagagactcagcacggtacaatagttataagagtacaatacgaaggtgatggaagtccatgcaaaattcccttcgaaatcatggacctcgaaaaacgatatgtcctagggcgattaataacagtaaaccctatcgtaaccgaaaaagacagtcccgtaaatatcgaagctgaacctccattcggtgactcatacataataataggggtcgaaccaggccaactaaaattaaactggtttaagaaaggatcctcaatagggcagatgtttgagacaaccatgagaggagcgaaaagaatggctattttgggggatactgcttgggatttcggcagcttaggaggcgtattcactagcataggaaaagccctacatcaggtatttggagcgatatatggagcagcattcagtggcgtatcatggacgatgaagattctcatcggggtaataattacatggatcgggatgaactcacgaagtaccagtttgtcagtgagtcttgtcctagttgggatagtaacgctatacttgggagtaatggttcaagcagattccggatgtgtagtttcttggaaaaacaaagagctaaaatgtgggagtggaatattcatcactgataacgttcacacatggactgaacaatataaattccagcccgaaagtccctccaaattagctagtgcaattcagaaagcacaagaagaaggaatatgcggaatacggagtgtaacacgattagaaaatcttatgtggaaacagattacaccggaacttaaccatattttggcggagaatgaggtcaaactaactataatgaccggggatataaaaggcattatgcaagctggtaagagaagtcttcgaccacaaccgactgaactaaagtacagctggaaaacatggggaaaggctaaaatgctatctaccgagtcgtataaccaaacatttttaatagacggtccagaaacagctgaatgtcctaacacaaatagagcttggaactcgctggaagtagaagattatgggtttggcgttttcacaactaacatttggctaaaactaaaagaaaagcaagacgcgttttgtgattcaaaactaatgagcgccgcaataaaagacaatcgagcagttcatgcggatatgggatattggatcgagtcagccttaaatgatacatggaaaatagaaaaagccagctttatagaagttaaaaactgtcattggccaaaatctcatacactttggtccaatggggtgttggaatccgaaatgataatccccaagaacttagcaggaccagtatcacaacacaactatcgcccaggctatcatacacaaattgctgggccatggcatcttggaaaacttgagatggatttcgatttttgtgatgggacaacagtaatcgtcacagaagactgtggaaatcgtggacctagtttacgaacaaccacggcatcagggaaactaatcacagagtggtgttgtagaagttgtacgttaccaccattacgataccgcggagaagacgggtgctggtacgggatggaaatcagaccccttaaagaaaaagaggaaaacttagtaaatagtttagtcactgccggtcatggtcaggtagataacttttcattgggtgttctgggtatggcattgtttcttgaagaaatgctccgaacaagagtaggaacgaaacatgccatattgctcgtagctgttagttttgtaaccttaattacaggaaatatgtcatttaaagacctaggaagagtagttgttatggtaggagcaacaatggccgatgatattgggatgggagtaacttatctcgcactgttggccgcctttaaagtcagacctacttttgcggccggcttattgctacgtaaactaacatcaaaagagttaatgatgacaactatagggatagtcctattgtctcaaagtacaatacctgaaaccgtgttggaattgacggacgctttggcattaggcatgatggttcttaaaatagtgcgaaacatggaaaaataccaacttgctgttactataatggccattttatgtgtaccaaatgcagttatcttgcaaaatgcttggaaggttagttgtacaattctagcggttgtaagtgtctcacccctattactaaccagttcgcagcagaaaaccgattggatacccttagcactaacaataaaaggattaaacccaactgctatattcttaactacattatccagaactaataagaaaagatcgtggcccttgaacgaggcgattatggcagtaggaatggtatcaatattggcgagttcactactaaagaatgatatacccatgaccgggccattagtcgctgggggtttattaactgtatgttatgtactaactgggcgctccgccgaccttgagctggagcgagcaactgatgtaaaatgggaggatcaagctgaaattagcggatcatctcctattttgtcaataacgatctctgaagatggatcaatgtcaatcaaaaatgaagaggaagaacaaacacttactatattaatccggaccgggttattagtgataagtggattgtttcctataagtatacctataacggccgcggcatggtatctctgggaggtcaagaaacaaagagcaggagtcctatgggacgtgccaagtccccctcctatgggaaaagctgaattggaggatggagcttacagaattaaacaaaaaggaatactgggatactcacaaattggagcgggtgtgtataaagagggtacttttcatactatgtggcatgtcactaggggagccgtactaatgcacaaaggaaaacgaatagaaccaagttgggcagatgtaaagaaagacctgattagttatggcgggggctggaaattggaaggcgaatggaaagagggtgaagaagtacaagttctagccttagaacctggtaaaaatccaagagccgtgcaaacgaaaccagggttgttcaaaactaatacgggaactattggcgcggttagcctagacttttccccgggtacaagtggtagtccaataatcgacaagaaaggaaaagtggttggactttacggtaacggcgttgtcacgagatccggcgcatatgtttcagctatagcacagaccgagaaatccaccgaggacaacccggaaatcgaggatgacatctttcggaagagacgcttaaccataatggatttacaccctggagcgggaaagacaaagcgttacctccctgcaatcgtccgcgaggcaataaagagagggttaagaactctaatattggcaccaacacgggtagttgcagcagaaatggaagaggccttaaggggactgcctatcagatatcagacaccagccattcgagccgaacatacgggacgagaaattgtagacctcatgtgccatgcaactttcactatgaggctattatcaccagttagagttcccaattataatttaattataatggatgaagcacactttactgacccggcatcaatagctgctcgcggatacatatccacacgagtggaaatgggagaagcagcggggatctttatgactgccactcccccagggtcgagagacccttttccacaaagtaatgcacctattattgacgaggagagagaaataccagaaagatcctggaactcaggtcacgaatgggtcacagatttcaaaggcaagactgtatggttcgtaccaagcattaaagccggaaatgatatcgcagcatgtttaaggaaaaatggtaagaaagtaattcaattatctcgtaaaacattcgatagcgaatatgtgaaaaccagaacaaatgactgggacttcgttgtgaccaccgatatatccgagatgggcgctaatttcaaagcggaaagagtaatagaccctcgtcggtgtatgaaaccagtaatactaacggatggagaagaaagggtaatcttggctgggccaatgcctgtaacacatagtagcgctgcccaacgaagaggtagaatcggacgaaaccctaaaaatgaaaacgaccaatatatatatatgggagagccgctcgaaaatgatgaagactgtgcacactggaaagaagcaaaaatgttattagacaacattaatacgcccgagggtattattccctcaatgtttgaacccgaacgagagaaagtcgacgcaatagatggcgaatatcgcttacggggcgaggcacggaaaaccttcgtcgatttaatgagacgaggcgatctccctgtatggttagcatataaagtagcagctgaaggaatcaattacgcagatcgaagatggtgctttgacggcatcaagaacaaccaaatactagaagagaacgtcgaagtggaaatttggacaaaagaaggggaaaggaagaaattaaagccgaggtggctcgatgcacggatatacagcgacccactggccctaaaagagttcaaagagttcgctgccggtagaaaaagcctaacactaaatttaatcacagagatggggcgattaccaacttttatgacacagaagacacgggatgcattggataacctagcagtactccatacagccgaagccggaggacgagcgtataatcacgcattatcggaactgcctgaaacccttgaaacgctattactattaaccttactcgcgacagtgaccggaggcatattcctgtttctaatgagcggcaggggaataggaaaaatgacactcggtatgtgctgtattacaaccgcatcaattttgctatggtacgcccaaatacagccacactggattgccgcttcaattatactagagttctttttaatagtgctcctaatcccggaaccggaaaaacaacgtacccctcaagataatcaattaacatatgtcgtgattgcaatacttactgtagtggccgcaacaatggccaacgagatgggttttctagaaaagacaaagaaagatctagggctaggctcaatagcaactcagcaaccagaaagtaatatattggatatagatcttagacccgctagcgcatggacactctacgctgtggctactacattcgttactccaatgttgagacatagcattgaaaattcctctgtaaatgtatctctaactgcaattgcaaatcaggcgactgtactcatggggctcgggaaaggatggccgctaagcaaaatggacataggtgtacccctgttagcaattgggtgttattcccaagtgaatccaatcactctaactgctgctttactactcctagtagcgcattacgcgattataggccctggattacaggctaaagctacgagggaagctcagaagcgcgccgcggccggcataatgaaaaatcccacagtagatggaatcacagtgattgatcttgacccaattccctatgatcctaaattcgaaaaacaactaggacaagtaatgcttctgatactatgcgtgacccaagtgttgatgatgagaaccacatgggcattgtgcgaggctttgacactagcaaccggaccaatatcaacattatgggaaggaaaccctgggagattttggaatacaactattgctgtaagcatggctaatatttttagaggcagttatttagccggagcagggctactatttagcataatgaaaaatacaacaaacactcgaagaggaacaggcaacatgggagaaaccttaggagaaaaatggaagagtcgattaaacgccttaggcaaatcagaatttcaaatatataaaaggagtgggatccaagaagttgatagaactctagctaaagagggcattaaaagaggggaaaccgatcatcatgcagtaagccgaggctcggcaaaattgagatggtttgtagaaagaaatatggtaacacccgaagggaaagtagtagacttaggatgcggcaggggaggttggtcgtattattgtggtggactaaagaatgtgagagaggtgaaaggattgacaaaaggtggacctggacatgaggaaccgatacccatgagtacttatggatggaatctagttagattacaatcaggtgtagatgtcttctttataccccctgaaaaatgcgataccctattatgtgatattggagaatcaagcccaaatccaactgtagaagcagggcgaacacttagggtgttaaacttggtcgaaaattggcttaataataacacacaattttgtatcaaggttctcaacccatacatgccttccgttattgagaaaatggaggcacttcaaagaaaatatggaggtgcgcttgtaaggaatccattaagtagaaactcaacgcatgaaatgtactgggtatctaacgcatcaggaaatatagtgagttcggttaatatgatttcaaggatgttaatcaacagattcactatgcgtcataaaaaggcaacatatgagccggacgttgacctaggtagtggcacgcgcaacattggaattgagagtgaaattcccaacttggatattattgggaagcgtattgagaaaattaaacaggaacatgaaacgagttggcactatgaccaagaccacccatataaaacgtgggcctatcatggatcatatgaaacaaaacaaacaggctctgcttccagtatggtcaacggagtagtacgattattgacgaagccttgggatgtcctacctaccgtaacgcaaatggcgatgactgataccactcccttcggacaacaacgcgtctttaaagagaaagttgacactaggacgcaggagccaaaagaaggcaccaagaaactaatgaagataacagcagagtggctatggaaagaattaggtaagaagaaaacacctaggatgtgcactagagaagagttcactcggaaagttagatcaaacgctgcacttggtgccatatttacagatgaaaataaatggaaatccgcccgcgaagcagtagaagactctcgattttgggagctagtggacaaagaaagaaatctacacttggaagggaaatgcgaaacgtgtgtatacaatatgatggggaagagagagaagaaactaggtgagttcggtaaagcaaaaggttcacgggctatctggtatatgtggctaggtgcacgtttcctcgagttcgaagcactgggtttcctaaacgaagatcactggttctctagagaaaactctctcagcggagtcgagggagaaggactgcataagttaggttacatactcagggacgtgagcaagaaagaaggaggggcaatgtatgcggatgacactgcaggatgggacacacgaataacacttgaggaccttaaaaacgaagaaatggtaaccaatcatatggaaggggaacataagaaactagcggaagcgatattcaaattgacgtaccaaaacaaagttgtaagagtgcaaaggcctactcctagaggaacagtaatggatataataagtcggcgcgatcaacgagggagtggacaagtcggaacatacggactgaatactttcactaacatggaagcccaactaataagacaaatggagggggaaggggtgttcaagaacatacaacatttaaccgtgacagaagaggtcgccgttcaaaattggctagcccgagttggaagggaacgattgtcacgaatggcgatttctggagatgattgtgtagtaaaaccattggacgacagatttgctaacgcactcacggccttaaatgatatgggaaaaataagaaaggatatccaacaatgggaaccaagcaaaggttggaacgattggactcaggtaccgttttgttcgcaccatttccatgaacttattatgaaagacggtagagtactcgtagttccatgcagaaaccaagatgaacttattggcagagccagaatatcacaaggagctggttggtcgctaagagagacagcctgcttaggcaaatcttatgcacaaatgtggtcgctaatgtactttcatagacgagatctgagattagccgccaatgctatttgcagcgccgttccgagtcactgggtaccaacgtcgcgaacgacatggagcatacacgctaagcatgaatggatgacgactgaagatatgttaaccgtttggaaccgagtatggataagagaaaacccatggatggaagacaaaaccccagtagaatcatgggaggagattccatatctcggtaaacgtgaagaccaatggtgtgggtcactgatagggttaacgtcgcgtgcaacatgggcaaagaatatacaggcagcgatcaaccaagtaagaagtctcattgggaatgaagagtacactgattacatgccaagtatgaaaaggtttcgacgtgaagaagaagaggctggggtactgtggtaa

SEQ ID NO: 22781 - RNA, 9876 nt, synthetic construct
  misc_feature 1..9876: note = derived and/or modified CDS sequence (opt6) from DENV-2__EU482466__SS-prME
  source 1..9876: mol_type = other RNA
agtgcaggaatgattataatgctaataccaacggtcatggccttccatctgactacccgtaatggagaacctcacatgatagtaggaatacaagaaaaaggtaaatcattactatttaaaactgaagacggggttaatatgtgcacactaatggccatggatctcggtgaattatgcgaagacacaattacgtacaaatgtcctttactcaggcaaaacgaaccggaagacatagattgttggtgtaattcaacctctacgtgggttacatatggaacgtgtactactactggcgaacacaggagagagaaaagaagtgtagcacttgtaccacacgttggaatgggcctagaaacacgaacagaaacgtggatgagtagtgaaggggcatggaaacacgctcaacgcatagaaacctggatattgagacatcctggatttaccataatggcagctatattagcgtacacaataggtacaacacattttcaacgagtattaatcttcatattattaacagccgtcgccccaagtatgacaatgcgttgtattggaatttcaaatcgagactttgtagaaggcgtaagcgggggatcttgggttgacatagtactagaacacggaagttgtgttacaactatggctaaaaacaaacccacattggattttgaactgataaaaacagaagctaaacaaccggcaactttacgtaaatattgcatagaagccaaactgacaaatacaacgacagaaagtcgatgtcctactcaaggcgaacccagcctcaaagaagaacaagacaaaagatttgtatgtaaacactccatggtagatagaggatggggaaacggatgcggactcttcgggaaaggtggaatagttacctgtgcaatgtttacttgcaagaaaaatatggagggtaaaatagtacaaccagaaaacctagaatatactatagtagtgacaccacacagcggagaagaacatgcagtaggcaatgacacaggtaaacacggacaggaaataaaagtcaccccacaatcctctattacagaagccgagttaactggatacggtacagttactatggaatgtagtccacggacaggcctggattttaatgaaatggtactgttgcaaatggaaaataaagcatggttggtgcaccggcagtggtttcttgacttgccattaccatggttaccaggagctgataaacaggaaagtaattggattcaaaaagaaaccttggtgacattcaaaaatccacacgccaagaaacaggatgttgtagtgctcggatctcaagaaggagcaatgcacactgcccttacgggcgccacagaaatccaaatgagttctggtaacttgttatttacagggcatctaaaatgcaggttacgtatggacaaattgcaactgaaaggtatgtcatactctatgtgtacaggtaaatttaaagtcgtgaaagagatagctgaaacgcaacacggaacgatagtcattcgcgttcagtatgaaggcgatggctcaccctgcaaaatacccttcgaaatcatggatctagaaaaacgctatgtactagggagactaataacagtaaatcctatagttaccgagaaagattcaccagtaaacatagaagctgaaccaccctttggagacagttacataataataggagtagaaccgggacaactcaaactgaactggttcaagaaaggttcctcgattggtcaaatgttcgaaacaacaatgcgaggcgccaaaagaatggccatcctaggagataccgcgtgggattttggatcgctgggcggcgtatttacaagcataggcaaagcacttcaccaagtgttcggagcgatatatggagccgcgttcagtggtgtttcttggacaatgaaaattttaattggagtaattataacatggattggaatgaactctagaagtacatcattgagcgtgtccctagttttagttggtatcgtaactctttatttaggagttatggtacaagcagacagcggatgtgtagtttcttggaaaaacaaagaactgaaatgtggatctggaatatttatcactgacaacgtacatacctggacggaacagtataaatttcaacctgagtcacctagcaagttggccagtgctatccaaaaggctcaagaagagggaatttgtggaattagatcagtaacaagattggaaaacttaatgtggaaacagattacaccagaactaaatcacatattagctgaaaatgaagttaaactcacgattatgactggagatattaaagggataatgcaggcgggaaaacgctcgttacgaccacaaccaacagagctaaaatatagctggaagacgtggggaaaagctaaaatgttaagcacggagagctataatcaaacatttctaatcgacggacccgaaactgctgaatgccccaatactaatcgcgcatggaacagcctcgaagtcgaggattatggttttggcgtcttcacaactaatatatggctgaaactaaaagaaaaacaggatgcgttttgtgacagcaaattaatgtcagcagcaattaaagataacagagcggttcatgcagatatgggatactggatcgaaagcgcattaaacgacacctggaagatagagaaagcatcattcatagaagtgaaaaactgtcactggccgaagtcacacacactttggtctaatggggtcttagaaagtgagatgataattccgaagaacttggctggccccgtttctcaacacaattaccgaccgggttaccatacacagatagccggaccctggcaccttggcaaacttgaaatggatttcgacttttgtgatggaacgacagtaatcgtgacagaagactgcggaaacagaggcccaagcctacgtacgaccactgcatcaggcaaactaataacagaatggtgttgcagaagttgtaccttgcctccgttacggtaccgcggagaagatggatgttggtatggtatggagattcgacctctgaaagaaaaagaggagaatttagttaactcacttgtaaccgctggacatggccaagtagataacttctccctaggcgtcttaggtatggcgttatttttagaagaaatgctaagaacacgcgttgggactaagcacgcaatattgctagtcgcagtaagtttcgtaacattaattaccgggaacatgtcttttaaagatctagggcgtgttgtagtaatggtgggagcgaccatggcagacgatattgggatgggggttacctacttagcattattggctgcattcaaagtacgtccgacttttgctgctggattactcctacgcaaattgacgtctaaagaacttatgatgaccactattggtattgtcctattgtcgcaatccacaatacctgaaaccgtcctcgaactcactgatgccctcgcattgggaatgatggtcttaaaaattgtacgaaacatggaaaaataccaactagccgtaactattatggcgatcttatgcgtacctaacgcagtaatattacaaaatgcatggaaggtctcgtgtacaatacttgccgttgtaagcgtatccccgttattattaacatctagtcaacagaaaacggattggatcccactagcactaactataaaaggtcttaatcccacagcaattttcctaactacactatcacgcacaaataagaaaaggtcctggcctttgaatgaggctataatggctgtggggatggtatctatcctagcaagttcactcctgaaaaatgacataccaatgacaggacctttagtagctggtggactactaactgtttgctatgtattaactggaagatccgcagatctagaactcgaacgggcaactgacgtaaaatgggaagatcaagcggaaatttccggctcgtctcctattttaagcataacaatctccgaggacgggagcatgagtatcaagaatgaagaagaagaacaaaccttaacgattctgataagaacaggtctattagttatatcgggtttgtttccaatttctataccaataactgcggcggcttggtatttatgggaagttaagaaacaacgagccggagtattatgggatgtgccttcacctttaccgatgggaaaagcggaattagaagatggcgcttatcggattaagcaaaaaggtattttggggtacagtcagattggagccggagtctacaaagaaggaacgtttcacactatgtggcacgttacgagaggtgctgtgcttatgcacaaaggaaaacgcatcgaaccatcatgggcagacgttaagaaagacttaataagttatggcggtggttggaagttggaaggagagtggaaagaaggtgaggaagtccaggtcttggccctagagcccggcaaaaatcctcgcgcagtccagacgaaaccgggtctttttaaaactaatacaggtaccataggagctgtatctttggattttagcccgggtacttctggatcgcctataatagataagaaaggaaaagtagtgggtctatacgggaatggagtggtaacacgttctggtgcatacgtgtctgctatagctcaaacagaaaaatcaatagaagacaatccggaaattgaagacgatatattcaggaaacggcgtttaactataatggacctgcaccctggtgcaggaaagacaaaacggtatctacctgcaatagtgcgcgaagccatcaagagaggattgcggactctgattctagctccaacacgagtcgttgcagcagagatggaagaggctctacgagggttaccgatacgataccaaacaccagcaatacgagcagaacacacgggacgcgagattgttgacttaatgtgccatgcaactttcactatgcgacttctttccccggtccgggtacccaactataatttgataataatggacgaagctcacttcaccgatccagcatcaatagcagcaagaggatatatttcaacaagagtcgaaatgggtgaagctgcaggaatttttatgactgcaacacctcccgggagccgagacccttttccccaaagtaacgctccaatcatagatgaggaaagagaaataccagaacgcagttggaacagcgggcacgaatgggttacagactttaaaggtaaaacagtatggttcgtaccgagtattaaggctggtaacgacattgctgcatgtctgcgtaaaaatgggaagaaagttatacaactttctaggaaaacattcgactctgaatacgtgaaaacacgcacaaacgactgggatttcgtagtcacgacagacatttcagaaatgggtgctaactttaaagcagagagggtaattgatccgcgacgctgcatgaaaccagttatattaacagatggagaagaacgggttatcttggcagggccgatgccagttacccactcatccgccgcgcaaagacgagggagaatcggaagaaatcctaaaaacgaaaatgatcaatatatttacatgggagaacctctcgagaacgatgaggactgcgcccattggaaagaagccaaaatgttactcgacaacatcaacacaccagaagggataatacccagtatgtttgaacctgaaagagaaaaagttgatgccatagatggcgagtatagactgagaggggaagcgagaaaaacattcgtggatctaatgagaaggggtgacctacccgtatggcttgcatacaaggtagcagcagaaggaataaattacgcggaccgtcgatggtgtttcgacgggatcaaaaataatcaaatactcgaagagaatgtggaggtggagatctggacaaaagagggcgaaaggaagaaactcaagcctcgatggctagacgcaagaatctacagcgatcctcttgccctaaaagaatttaaggagtttgcagcaggtagaaagagcttaacgctaaatttaataactgagatgggacgattacctacatttatgactcaaaagacacgtgatgccttagataatttagcggtacttcatactgctgaagccggtgggagagcatataatcatgccctttctgaattacccgaaactctcgaaactcttctcttattgacattgttggccacagtaacagggggaatctttttatttttgatgtcaggacgcggaataggcaaaatgactctgggaatgtgttgtattataaccgcgagcattcttctatggtacgcacaaattcaaccacattggatcgctgcttcaatcatattggagttctttctgatcgtacttctaatacctgaaccggaaaaacagagaacgccacaagacaatcaactcacatacgtcgttatagcaattctaactgtcgttgcggcaacaatggctaatgaaatgggatttttagagaaaacgaagaaagacctgggattaggatctattgctacacaacaaccagagtccaatatactggatatcgacctgcgccccgcctccgcgtggacgctctacgcagtcgctacgacctttgtaacaccaatgttacgtcattctatagaaaattcatctgtcaatgtaagtttaacagctatcgccaaccaagcgaccgtcctcatgggattaggtaaaggatggccactttcaaaaatggacataggagtacctttactagctataggttgctactcgcaggtaaatcccattacactgacagccgccttactcttattggtagcacattatgcgataataggaccgggtttgcaagcaaaggccaccagagaagcacagaaaagagcagcggcaggtataatgaaaaatccaaccgtggacggaatcacagttatagacttagacccaataccctatgaccctaagtttgaaaaacagttaggacaggttatgctattaattttatgcgtgacccaagtgttgatgatgcggaccacctgggcattatgcgaggcactaacattagccacaggtcccatatcaacactatgggaagggaatccgggtcgcttctggaatactactatagcagtatctatggcaaacatattccgcggatcttatctggcaggagctggtctcctatttagcataatgaaaaatacgacaaacaccaggagaggaactggcaacatgggcgaaacactaggagaaaaatggaaatctagattaaatgcactcggtaagtctgaatttcaaatctataagaagtccggaatccaagaagtcgacaggactctggcaaaggagggcattaaacgtggagagacagatcatcacgcggtctcacggggaagtgctaaactgcgatggttcgtagagaggaatatggtcacgcctgaaggtaaagtcgtcgacttaggttgtggaagaggagggtggtcatattattgtggaggtcttaaaaatgtacgcgaagtaaaaggtcttactaaaggaggtcctggccacgaggaaccgatacccatgtctacctatggttggaatctcgtaagactacaatcaggtgtggacgtcttctttatccctccggaaaaatgtgatacgctattatgcgacatcggtgaatctagtcccaaccctactgtagaagcaggacgcacattaagagtgctcaatctggtagaaaactggctgaataacaatactcaattttgtataaaagtactaaacccttatatgcctagtgtcatagagaaaatggaagctctacaacgaaagtacgggggagctttggtaagaaaccctctttcgcgcaattcaacccacgaaatgtactgggtatctaatgcaagtgggaatattgtctcctctgtcaatatgatcagtcgaatgttgattaataggtttaccatgcgacacaagaaagccacctatgaaccggatgtagacttaggcagtggtactagaaatataggcattgaaagcgagactcccaacctggatataataggaaagaggattgagaaaattaaacaagaacacgagacgagctggcattacgaccaagatcatccgtacaaaacttgggcgtaccacgggtcttatgaaacaaagcaaaccggctccgctagtagcatggtgaatggtgtagtcagactacttacaaaaccctgggacgtcctaccaaccgtaacacagatggccatgacggataccactccgtttggacaacagcgcgtcttcaaggaaaaagtcgacacccgtactcaggagccaaaagaagggactaagaaactaatgaaaatcactgcggaatggctttggaaagaacttggtaaaaagaagacaccacgtatgtgcactagggaggagttcacgcgcaaggttaggtcaaacgcagccctaggagccatctttacagatgaaaacaaatggaaatcagctagggaagcggtagaagactcaagattttgggaattggtggataaagaaagaaatctgcacctagaaggaaaatgtgaaacttgtgtttacaatatgatgggaaaaagagaaaagaagctaggcgaatttggtaaagcaaaaggcagcagggcaatctggtacatgtggttgggcgcaagatttctagagttcgaagcactaggctttcttaatgaagatcattggtttagtagggaaaattccttgagcggcgtggaaggggaaggattacataaattaggatacattctaagggatgtttccaagaaagaaggtggcgctatgtatgcggacgatacggccgggtgggatacaagaataacactcgaggacctcaaaaacgaagaaatggtaacaaatcatatggaaggagaacacaagaaacttgccgaggcgatcttcaagctaacatatcagaacaaggttgtacgggtacaaagaccgacaccacgcggcactgtaatggacataataagtagaagagaccaaagaggcagtggacaagtgggtacttacggacttaatacttttacgaacatggaagcacagctaataagacagatggaaggagaaggtgtatttaaaaacattcagcacctcactgtgaccgaggaggtcgccgtgcagaattggttagctagggtgggaagggaaagattgtcacgtatggcaatctccggagacgattgcgtcgtaaaacctttagatgaccgctttgctaatgcgctgactgcactaaatgacatgggcaaaatacgaaaagatatccaacaatgggaacccagtaaagggtggaatgattggactcaggtccctttttgctcacatcatttccacgagcttattatgaaagacggtagagtgctagtggtaccctgtcgtaatcaagatgaactcatagggagagctcgaatatctcaaggagcaggctggagcttacgagaaacagcttgtcttgggaaatcatacgcccaaatgtggtcactaatgtattttcaccgtagagatctgagactcgcagcaaacgcaatatgcagcgctgttccaagtcactgggtacctaccagtagaacaacctggtcaatacacgctaaacatgaatggatgacaaccgaggatatgctaacagtctggaaccgagtatggatacgcgaaaatccctggatggaagataaaacccccgtcgaatcttgggaagagattccgtatctaggcaaacgcgaagatcagtggtgtggaagcctcattggattaacatctcgagctacatgggcgaaaaatatacaagcagcaataaatcaagtccgaagtttaattggtaacgaagaatatacggattatatgccaagcatgaagagattccgtagagaagaagaagaagccggagtactatggtaa

SEQ ID NO: 22782 - RNA, 9876 nt, synthetic construct
  misc_feature 1..9876: note = derived and/or modified CDS sequence (opt6) from DENV-2__EU482467__SS-prME
  source 1..9876: mol_type = other RNA
agtgccggtatgataataatgctaattcctaccgtaatggcatttcatttaacgacacgaaatggagagccccatatgatagttggaatccaagaaaagggaaaatccttattattcaaaacagaagatggagtaaacatgtgtacactcatggctatggacctaggagagctctgtgaggacactataacctataaatgtccattactccgacagaacgaaccagaagacatcgactgttggtgtaactccacttcaacttgggtgacatacggcacatgcacgacgacaggcgaacatcgacgggaaaaaagaagtgtagcactagtaccacacgtcggtatgggactcgaaacgagaactgaaacttggatgtcatccgagggcgcatggaaacacgctcagagaatagaaacctggattctaaggcacccgggttttacaataatggctgcaatactcgcgtatacaatcggtacaacgcactttcaaagagtactcatttttattcttctaaccgcagtggcaccatcaatgacaatgcgatgtattggtatctcaaatcgtgacttcgtcgaaggagtctccggaggttcgtgggtggatattgtactagagcacggatcatgtgtgacaactatggcaaaaaacaaacccacattagatttcgaattgatcaaaacagaagcaaagcaaccagcaacattgcgaaaatattgcatagaagccaagctgactaatactactaccgaatccagatgtccaactcaaggtgaaccaagcctaaaagaggaacaagacaaaaggtttgtgtgtaagcattcgatggtggacagaggctggggcaatggatgtggattattcggtaaagggggaatagttacatgtgcaatgttcacctgtaaaaaaaatatggaagggaaaatagtccaaccagaaaacttggaatatacgatcgtagtgaccccacactcaggtgaggaacacgcagtggggaacgataccggtaaacatggtaaggaaataaaagttaccccacagagtagtataactgaggctgaactcaccggttacggcacggtaactatggaatgcagcccgagaactggtctagattttaatgaaatggtactactacagatggaaaataaagcgtggcttgtccatcgacaatggtttcttgacttacccttaccgtggttaccaggagcagataaacaagaatccaattggattcaaaaagagaccttagttacatttaagaatccacacgcaaaaaaacaagatgtagtagtcctggggtcacaagaaggtgccatgcacaccgcgttgacaggtgccacggaaatccaaatgtcaagtggcaatctactatttactggtcacttgaagtgcagattaagaatggacaaacttcaacttaaaggaatgagttattcaatgtgtacaggaaaattcaaggttgtaaaggagattgcagaaacacaacacgggaccattgtcattcgggtgcaatacgaaggggacggatcaccgtgcaagataccctttgaaataatggacttagaaaaacgctacgtgctgggtcgacttataacagtaaaccctatagtgactgagaaagatagtcccgtaaatatagaagccgagccaccattcggagattcctatataataataggcgttgaaccgggtcaactgaaactgaactggtttaagaaaggaagctcaataggtcaaatgtttgaaacaaccatgagaggggctaaaagaatggctatattgggtgatacagcatgggattttgggagtttaggcggggtgtttacatctataggtaaagcattacatcaagtatttggagctatatatggggctgcgttttctggcgtatcatggacaatgaaaatattaataggtgtaattataacctggataggaatgaattcaagaagcacaagtctctccgtatccttagttttggttgggattgttacactttacctaggagttatggtacaagcagattctggatgcgtagtaagttggaaaaacaaagaactaaaatgcggatccgggatttttataactgacaatgttcacacatggacggagcaatataaatttcaaccagagagccctagcaagttagcatcagcaatacagaaagcccaagaagaaggaatatgtggtataaggtcagtaactaggctagagaatttgatgtggaaacaaatcacaccagaattgaaccatatcctagcggaaaacgaggtaaagttaactataatgacgggagatatcaaagggattatgcaggcaggcaaaagatcgcttcgacctcaaccaacagaattgaaatatagttggaaaacatggggcaaagcaaaaatgctaagtacggaaagttataatcagacatttctcatagacggtcccgaaacagcagaatgcccaaatacaaacagggcctggaacagtttagaggtagaagactacggctttggagtatttactacaaacatttggcttaaactaaaagaaaaacaagatgctttctgtgactcgaagctaatgtcggcagcgattaaggataaccgggcagtacatgcagatatgggatattggatagaaagtgccctgaacgacacctggaagattgaaaaagccagcttcattgaggttaaaaattgccattggcccaagtcgcacactctgtggtcgaatggcgtattagaatctgaaatgataataccaaaaaatctggccgggccggtctctcagcataattaccgacctggatatcacacgcagatagcaggtccatggcatctaggtaagctagaaatggattttgatttttgtgacggaactaccgtaattgttacggaagactgtggcaacagaggtccgtcattgcgaaccacaactgcaagcgggaagcttatcacagaatggtgctgtagatcttgcaccttacccccgttgcgatatcgaggtgaagacggttgctggtacgggatggagatacggccgctaaaggaaaaagaagaaaacttggtcaatagcttggttacggccggtcacgggcaagtagataactttagtcttggagttcttggaatggcattgtttttagaagaaatgctaagaacaagagtaggcaccaaacatgctattctgctcgtggcagtatcatttgtcacccttataacaggaaatatgagctttaaagacttaggacgggtggttgtcatggttggtgctacaatggctgacgatataggaatgggagtaacatatctagctctattagcagcattcaaggttcggcctacgtttgctgcaggacttttgttgaggaaattgactagcaaagagttgatgatgaccaccataggcatagttctactatctcaatccacgataccagagactgtactcgaacttacagacgctcttgctcttggtatgatggtattaaagatagtacggaatatggaaaagtaccagctagccgttacaataatggcaatattatgcgttccaaacgcggttatactacaaaacgcttggaaagtttcctgtacaatcttggccgttgtttctgttagcccgttattgctcacaagtagtcaacaaaaaacggattggattccgttagccctaactatcaaaggactcaaccccacggccatatttttaaccaccttatcgcgaacaaataaaaaaaggagttggccattgaacgaagctataatggcagtcggaatggtctctatactcgcctcgtcattattgaaaaatgacatacccatgactggaccactggtagcaggcggtttattaacggtgtgctatgtactaacagggagaagtgctgacttagagcttgaaagggcaacggatgtaaaatgggaggaccaagccgaaatatcaggcagcagcccaattttaagcataaccatttcagaagatgggtcgatgtcaataaaaaacgaagaagaagaacaaacattaacgattctgatcagaactggcctacttgtaatttcaggactgtttcctatcagcataccaataacagccgcggcatggtatctttgggaagtgaagaaacaacgagcgggagtactatgggacgtaccatctccgcctcctatgggtaaagcagaattagaagatggagcatatagaataaaacagaaagggattctggggtactctcaaataggagcaggtgtgtataaagaaggtacattccacacgatgtggcatgtgacacgtggggctgtactaatgcataaaggaaagagaattgaaccaagttgggctgatgtcaaaaaagatttgatcagctatggaggtggatggaaattagaaggtgaatggaaagaaggagaggaggtgcaggtactcgcattagagcccggtaaaaatccgcgagcagtacagactaagccaggactctttaagactaatacgggaacgattggggcggtgtccttagatttttccccaggcacctcaggaagcccaatcatagacaaaaagggcaaagtagtagggctttatgggaacggtgttgtcacacgtagcggtgcgtatgtttcagccatagcacaaacggagaaaagtatagaggataaccctgaaattgaagatgatatatttcgaaaacgaagattaaccataatggatctacatccaggtgcaggaaaaactaaaagatacctcccggcaatagtaagagaagcaatcaagagaggtcttcgcacgcttatattagcacctactcgagtagtagccgctgaaatggaggaggcattaagaggactcccaattcgttatcaaacacctgcgatcagagcggaacacacaggaagagaaatagttgacttgatgtgtcacgctaccttcaccatgcgcttactaagcccagttagagtaccaaattataaccttattattatggatgaggcacattttactgatccagcgagcatcgcagcaagagggtacatctcgacgagagtagaaatgggagaggcagcaggtatcttcatgaccgccacacctcctggatcccgtgatccattccctcagtcaaatgcgccgataatagatgaagagcgcgaaatcccggaacgcagttggaatagcggtcatgaatgggttacagatttcaaaggaaagacagtgtggttcgttccatctataaaggcaggaaatgacattgcggcttgcctacgaaaaaacggtaagaaagtaattcagttgtcccgaaaaaccttcgattcagagtatattaaaacgcgaacaaatgactgggacttcgtcgtcaccactgacatcagcgaaatgggtgcaaattttaaggccgaaagggtaattgatccgcgacggtgtatgaagcccgtaatcctcaccgacggcgaagagagagtaatattagccggacccatgccagttacccattcatcggcagctcagcggagaggaagaataggtcgaaaccccaagaatgaaaacgatcaatatatctacatgggagaaccccttgaaaacgatgaggattgcgcccactggaaagaagccaaaatgcttctagataatataaacaccccagaaggtataataccatcgatgttcgagccagagagggaaaaggtagatgcaatcgacggtgaatatagattgcgaggagaagctagaaaaaccttcgttgatttaatgagacgtggtgatttgccagtgtggctagcgtacaaagttgcagctgagggcatcaattatgcagacaggagatggtgctttgacgggatcaaaaacaatcaaattctggaagaaaatgtggaagttgaaatatggacaaaagaaggagagcggaaaaagctaaaaccacgctggttggacgcacgcatatattccgatccattagcattaaaggaatttaaagaatttgcagccggaagaaaaagcttaacattaaacctcatcacggaaatgggacgacttccgacgtttatgactcagaaaacacgagacgctttggataacctggcagttttacacaccgcagaagctggcggacgtgcctacaatcacgctttgtctgaattacccgagacgttagagacattactgttactaacactacttgcaactgtaacggggggcatattcctatttttaatgagcggcagagggataggaaaaatgacgttgggaatgtgttgcattataacagcatcaattttactatggtacgcacaaattcaaccgcattggatagcggcctcaataattttggaattttttctaattgtactcttgattccagaacctgaaaagcaaaggactcctcaagataaccaattaacatatgtagtaatcgcaatattgacagttgttgcggctaccatggctaatgaaatgggttttttagaaaaaacaaagaaagatctaggattggggtctattgcaactcaacagccagaatcaaatatcttagatatagatttaagaccagcttcggcatggacgctctacgcagttgcaacgacatttgtaacacctatgctacgacattcaatagaaaattcaagtgtaaacgtaagtcttacagcaattgctaatcaggcaactgtattgatggggttaggcaaaggatggcccctaagcaaaatggacataggagtccctttactagccataggctgttactcccaagtaaaccccataactctcacagctgcccttttattactagtggcccattatgccataatcgggccaggtttacaagcaaaagcaacacgagaggcgcaaaaacgagccgctgccggtataatgaaaaatcctacggttgacggcattactgtaattgaccttgatccaataccatatgatcctaaatttgaaaaacaactgggccaagtaatgctgttgattctatgcgtaacacaggtactgatgatgcggaccacctgggcactttgcgaagccttaacactggcaactggtcccatatcgacattatgggagggaaatccagggcgtttttggaatacaacaatagcagtcagtatggctaatatatttagaggctcatatcttgcgggagctggcctactattctccattatgaagaataccacaaacacaagaagaggaactggaaatatgggagaaacattaggagaaaaatggaagtccaggctaaacgcactaggaaaatcagaattccaaatctataaaaagagtggcattcaagaggttgaccgtacccttgctaaagaaggcataaagagaggagagacggaccatcatgcggtctctcgcggaagtgcaaaactacgttggtttgtagaacgaaacatggtaacgcccgagggcaaagtagtagaccttggatgcggacgcgggggatggagttactattgcggaggtttaaaaaacgtgcgcgaagtaaaagggctaaccaaaggagggcctggccatgaggagccgattccaatgtcgacatacggctggaatctggtgagattacaatcaggagtcgatgttttctttatacctcccgaaaaatgtgacaccctactatgtgatataggagaaagttctcctaatcccacggttgaagcaggaagaaccctaagggttcttaatttagtagaaaattggctaaataataatacccaattttgtataaaagttctgaacccatacatgccctcggtaatcgagaagatggaagccttacagcgaaaatatggaggtgcacttgttaggaatcccctttccaggaattcgacacatgagatgtactgggtctccaatgcaagtggcaacatcgtaagtagcgttaacatgatcagtcggatgttgataaaccgcttcacaatgcgccataaaaaagccacatatgaaccagatgttgatctaggtagcggtacacgaaatataggaatagaaagcgaaattccaaatttagatataataggaaagcgaatagagaaaataaagcaagaacatgaaacaagctggcattatgaccaagatcatccatacaaaacatgggcctatcatggatcgtatgaaacaaaacaaacgggttcggcttcgtcaatggtcaacggagtggtacgtttattgacaaagccctgggatgttctaccgacagtaacccaaatggcaatgacagatacgacccctttcggacaacaacgagttttcaaagaaaaagttgacaccagaacacaagaacccaaagaaggaacaaaaaaactgatgaaaataacggcagaatggctgtggaaagaattaggtaaaaagaaaactcctcgaatgtgcacaagggaagaatttactcgtaaggttcgaagtaacgcggcgctcggcgcaatttttactgacgaaaacaaatggaagtcagcacgggaggcggtagaagactcccgattttgggaattagtagacaaagaaaggaacttacacctggaaggaaaatgcgaaacatgcgtatacaatatgatgggaaaacgagaaaaaaaactaggtgaatttggtaaagccaaaggctcaagagcaatatggtacatgtggttgggagcccgttttctggaattcgaagcattaggctttttgaatgaggaccattggttctctcgagaaaattctttaagtggagtagaaggagaaggactacataaacttggatacattcttagagacgttagcaagaaagaaggtggagctatgtacgctgacgatacagccgggtgggatacaagaatcacattagaagatttgaaaaatgaagagatggtaacgaaccatatggaaggagaacatcgcaaactcgcagaagccatattcaaattaacttatcaaaataaagtcgtcagggtgcaacgcccgaccccgagaggtacagtaatggatattatcagcagaagagaccagagaggttcaggtcaagttggaacgtatggactaaatacatttaccaacatggaagcacaattaattagacaaatggaaggagaaggggtgtttaaaaatatacatcacctaacagtaacagaagaagtcgccgttcaaaattggctagctagggtcggtagggaaagattaagtcgtatggccattagcggtgacgactgcgtcgttaagccgctcgacgatcgttttgccaatgcactaactgcactaaacgatatgggcaaaatccgaaaagatattcaacaatgggagccaagtaaagggtggaacgattggacacaggtaccgttctgttcacaccactttcacgagctaatcatgaaggacggtagagtgcttgtagttccttgtagaaatcaagatgaactcattggaagagccagaatatctcaaggcgcaggatggagccttcgagaaactgcatgtttaggaaagagttacgcgcaaatgtggagtctgatgtatttccatcgaagagacttgcgactggcagcgaatgcaatatgttctgccgtaccctcacactgggtaccaacgtctagaacaacatggtcaatacatgcgaaacatgaatggatgacgacggaagatatgttaactgtatggaatagagtatggatccgagagaatccatggatggaagataaaactcctgtagagagttgggaggaaatcccgtatttaggcaagagggaagatcaatggtgcggaagccttataggcctgaccagcagagcgacatgggctaagaacatacaggccgctataaatcaagttagaagtctaattggtaacgaagaatacacagactatatgcctagcatgaaacggtttcgcagagaagaagaagaagccggagtattgtggtga

SEQ ID NO: 22783 - RNA, 9876 nt, synthetic construct
  misc_feature 1..9876: note = derived and/or modified CDS sequence (opt6) from DENV-2__EU482468__SS-prME
  source 1..9876: mol_type = other RNA
tctgcaggtatgattataatgttaataccaacggtgatggcttttcatctaacaacaaggaacggtgaacctcatatgattgtaggtattcaagaaaaagggaaatcgctactatttaaaactgaagatggcgtaaatatgtgtacattaatggcgatggaccttggtgaactttgtgaagacacaataacatataaatgtcctttactacgacagaatgaaccagaagacatagactgttggtgcaactcaacgtcaacttgggttacttacggtacatgtacaacaactggggaacatcgacgggaaaaacgttcagttgcgcttgtaccacacgtagggatgggattagaaacccgaactgagacatggatgtcaagtgaaggcgcatggaaacatgcgcagcgaattgaaacatggataatgagacatccagggtttactataatggctgcaattcttgcatataccattggaaccacccatttccagagagtgctgatatttattctattaactgctgtcgcaccttccatgacaatgaggtgtataggcataagtaatcgcgactttgttgaaggggtcagcgggggttcatgggtagacatagtcttagaacatggtagttgcgtcaccactatggctaaaaataaaccaacattagacttcgagcttataaaaacagaagcgaaacaaccagcgacccttcgtaaatattgcatagaagcgaaattgactaatacaaccaccgaaagtagatgtccgacacaaggagagccatccttaaaagaggaacaagacaaacgctttgtttgcaaacattctatggtagaccgaggatggggaaacggatgcggcctattcggaaaaggagggatagttacctgtgcgatgtttacttgtaagaaaaacatggagggtaaaatcgtacagcccgagaatttagagtatacaatcgttgtaacccctcacagtggagaggaacacgcggtgggaaatgacactggaaaacatggtaaagaaattaaagtcacccctcaaagttcaataactgaagctgagctaacaggatatggaacagtaaccatggaatgttcaccacggacgggactcgattttaatgaaatggtgttactccagatggagaacaaagcatggctcgttcatcgtcaatggttcttggacctgccattaccatggcttccaggtgcagacaaacaagaatctaactggatacaaaaagaaacattagtgacatttaaaaatccccatgccaagaaacaagatgtggtagtactgggttcacaagaaggcgcaatgcatacagctctaactggagcgacagaaattcaaatgtcatcaggaaatctcctgtttacaggacacctaaaatgtagactcagaatggataaactacaacttaaagggatgagttattctatgtgtactggcaaatttaaggtagtcaaagaaattgcggaaacgcaacacggaacaatagtaatacgcgtacaatatgaaggcgatggatcgccttgcaaaataccttttgagataatggatctggaaaagaggtatgtattgggccgattaatcacagttaacccaatcgtaactgaaaaggactcgccagtaaacattgaggctgaaccaccatttggagatagttacataattataggtgtggaacctggccagctaaaactgaattggtttaagaaaggctcgtccataggtcaaatgttcgaaactactatgagaggagcgaaaaggatggcgattctgggagatacagcatgggactttggaagtctagggggtgttttcacaagcataggcaaagcccttcatcaagtgttcggagccatctatggcgccgctttttccggagtaagttggactatgaagatattgataggggtgataataacctggatagggatgaatagtaggtcgacatctttaagcgtatcgctagtgttggtaggtatagtaactctttacttaggtgtgatggtacaagcggatagtggatgtgttgttagctggaaaaataaagaacttaaatgcggttcaggtatatttataacggacaacgttcatacttggacagaacaatataaattccaaccggaatcccccagcaaactagctagcgcaatccaaaaggctcaagaggagggtatatgtggtattcggagcgttacgcgccttgaaaatttgatgtggaagcagatcacaccggaattaaatcatatactggctgaaaatgaagtaaaacttacaattatgacaggtgacatacgtggtataatgcaggcgggaaaacgttcgttgagaccgcagccaactgaacttaaatacagttggaagacttggggtaaagcgaaaatgctatctactgaatcctacaatcaaactttcttaatagacgggccagaaacggcagagtgcccaaacacgaatagagcatggaactcacttgaagttgaggattacggatttggagtatttactactaatatatggctaaaactaaaggagaaacaagatgcattctgtgattcaaaattgatgtccgctgcgattaaagacaatagggcagtacacgcagatatgggatattggatggaaagcgctttaaacgacacatggaaaatagaaaaagcgtcgtttatagaggttaaaaactgtcattggccaaaatcccatacactatggtctaatggggtgctcgaatctgaaatgattatacctaaaaatctggctggtcctgttagccaacataattatcgaccaggttaccatactcaaatagctgggccctggcacctaggaaaactcgagatggatttcgatttctgtgatggcacaactgtcattgtaactgaagattgtggaaatagaggacccagcttaagaacgactacggcatccggtaagttaataacagagtggtgttgtcggtcgtgtacactacctcctctgcgatatcgtggtgaagatggatgttggtatggcatggagattcgaccccttaaggaaaaagaagaaaatcttgtaaatagtctagtaacggcaggacatggtcaagtcgataatttctcactaggtgtattaggaatggccctattcttggaagaaatgctacggacaagagtaggtactaaacatgcaatccttttagttgccgtatcatttgtaacccttataactggaaatatgtcattcaaggatctaggcagggtcgttgtcatggtaggagctacgatggcggatgatatcggaatgggggtgacctacctagctcttttagctgcatttaaggtacgaccaaccttcgcagctggtttgctgcttagaaaattaacttctaaagaattaatgatgacaacaataggaatagtactattgagccaatccacgattccagagacggtactcgaactcacagacgctctagcactaggcatgatggtactcaagatagtgaggaatatggaaaagtatcaattagcagtgacgataatggcgatattatgcgttcctaatgctgtaatcctccagaatgcttggaaagtaagctgcaccatattagcagtcgtatcagtgagtccattattgctgacatctagtcagcagaaaactgattggatccctctcgcccttacaattaaaggactaaatcccacagcgatatttttaactacgttatcaagaaccaacaagaaaaggtcatggcccctaaatgaagcaattatggctgtaggtatggtaagtattcttgcatcatcattattaaagaatgatataccaatgactgggcccctagtcgctgggggtcttttaacggtatgttatgttctaacgggaagaagtgcagatctagagttagaacgtgccacggacgtgaaatgggaagatcaagcagaaatctctggaagtagcccaatactatcaataacaatatcagaggacggatccatgtctatcaaaaatgaggaagaagaacaaactcttacgattctaatcagaactggactcctagtaatctcgggattgtttcctattagcataccaattaccgccgctgcatggtacctctgggaggtcaagaaacaaagagctggagtactgtgggacgtaccatctccgccaccaatgggcaaggctgaacttgaagatggagcttatcgcataaagcagaaagggatcttgggttattctcaaataggcgcgggcgtatataaagaaggtacatttcacactatgtggcatgtaacaagaggggcagtgctaatgcataaaggaaaacggattgagccatcatgggccgacgtcaagaaagacttaatatcatacggaggaggatggaagttagaaggagaatggaaagaaggagaagaagtacaagtactagcgcttgaaccaggtaaaaaccctcgtgcagtacaaacaaaacctggacttttcaagacaaatacgggaactataggagcagtaagtttagatttcagccccgggacctcgggtagtccaattatagacaagaagggaaaggttgttggtctttatggtaatggggtagtaaccagaagtggggcatacgtgtccgcaattgctcaaacagaaaaatcaatagaggataatccagaaattgaggatgacattttcagaaagcggagattgacaataatggatcttcatcccggggcgggtaaaacaaagaggtatctaccagctatcgtaagggaggcaataaaaagggggttgcgaaccctaattctcgccccaacccgagttgttgcagctgaaatggaggaggctttaagaggtttacctatacgatatcagacccccgcaattcgtgcagaacacaccggacgtgaaattgtagaccttatgtgccatgctacattcaccatgaggttattgagccctgttcgtgtacctaactataatttaataatcatggacgaagcacattttactgaccccgcttcaattgccgcaagaggctatatatccacacgcgttgagatgggcgaagccgctggtatattcatgacggcaactccaccaggatcccgggatccattcccacaaagtaatgctcctataatcgacgaagaaagagaaataccggagaggtcctggaactccggtcatgaatgggtcaccgattttaagggaaagacggtatggtttgtgccctctattaaagcgggtaacgatattgcagcctgtctacgaaagaacgggaaaaaggtcattcaattatcccggaaaacgttcgatagcgaatacgtcaaaacacgaacaaacgattgggacttcgtagtaacgaccgacatatcagaaatgggagctaactttaaagcagagagagtaatagacccaaggaggtgcatgaagccggttatactaaccgacggtgaagaaagagtaatcctagccggccctatgccagtaactcatagctcagccgcgcaaaggaggggaagaataggaagaaaccccaaaaatgaaaacgatcaatatatatatatgggggagcctcttgaaaatgatgaggactgcgcacattggaaggaagccaaaatgctattagataatatcaatacaccagagggcattataccatcgatgttcgaacccgaaagagagaaagtagacgcaattgatggagaataccgcttgagaggagaagcacgtaaaacatttgtggatttaatgcgcagaggagatctaccagtttggcttgcgtacaaggtagctgcagaaggaataaactacgcagaccgccgttggtgttttgatggtatcaaaaacaatcaaattttggaagaaaacgtagaggtagaaatctggactaaagagggagagagaaagaaactaaagccgcggtggcttgatgctaggatatacagcgatccactggcattaaaagagtttaaagagttcgctgcgggtagaaaaagcctgactttaaatctaataacagaaatgggtcgcttacccacatttatgacccaaaagactcgagatgcactcgacaatttggcggtgttgcacacagctgaagctggaggtcgagcatataatcatgcattatcggaactaccagagactttagaaacattattgcttctaactctgctcgcaacggtaacgggaggtatattcttatttttaatgtcgggcagggggataggaaaaatgaccttgggaatgtgctgtattatcacggcttcaacactcctatggtacgcgcagatccaaccacattggattgcagcaagcataattttagaatttttccttattgtcttactgatacctgaaccagagaaacaacgaacccctcaagacaatcaattgacttatgtagtcatcgctatattaacagttgtcgctgcaaccatggcaaatgagatgggttttctagagaaaactaagaaagacctcggtttgggctcgatcgcaacacagcaaccggaatccaacattttagacattgacctccgacccgcttcggcgtggacattatatgccgtagctaccacattcgtaacgccgatgttacgtcacagtatagaaaactcttcagtaaatgtatcacttaccgcaatagcgaaccaagcaaccgttctaatgggactaggtaaaggttggcccctatctaagatggatattggagtgcccctattagcaatcggttgctattctcaggttaacccaataactctcaccgcagccttactacttctagtagcgcattatgcaataataggtcccggcctacaagctaaagctacaagagaagcacaaaagcgtgcggcggcaggaattatgaagaatccgacagtcgatgggatcacagttattgaccttgacccaataccatacgatccgaaatttgaaaaacaattaggtcaagtcatgttactaatcctatgcgttacacaagtactaatgatgaggacgacgtgggccttatgtgaagctctaacattagctacaggcccaatatctactttgtgggaaggaaatccaggaaggttttggaatacaaccatcgcagtcagcatggcaaatatatttcgaggatcctacttggcgggtgcaggactactatttagtataatgaagaatacaaccaatacaagaaggggtactggaaatataggggaaacattaggagaaaaatggaaatccaggttaaacgccctaggaaaatcagagttccaaatatacaaaaagagcggtatacaagaagtagatcgaactctagcaaaagaaggcatcaaaagaggggaaaccgatcatcacgcagtttcacggggtagtgctaaactaaggtggttcgtagaaagaaatatggtaacgcctgaaggtaaagtagtagatctaggttgtggtcgaggtggttggtcatattactgcggagggctgaaaaatgtaagagaagtaaagggattgaccaaagggggccctggccacgaggaacccatacctatgtcgacttatggatggaatctggtaagacttcagtccggggtcgatgtattctttataccacccgagaaatgtgacactttgttatgtgatataggggaatcatcgcctaatccaacagtagaagcagggaggactctaagagtattaaacctagtagaaaactggttgaacaataatactcaattttgcataaaagtgttaaatccatatatgccatcggttatagagaagatggaggcactacaacgcaaatacggaggcgcactggttagaaatccactatcaaggaacagcacacacgaaatgtactgggtgtcaaacgcatcgggtaacattgtatcttcagttaacatgatatcaagaatgttaatcaatcgctttaccatgcggcataagaaagcaacctatgagcccgatgtcgacttaggttcaggaacacggaatatcggaatagaatcagaaattccaaacttagatataatcggaaaacgaattgagaaaataaaacaagaacacgaaacaagttggcactacgatcaagaccatccttataaaacgtgggcctaccacggaagttatgaaacaaaacaaaccggaagtgcctcaagcatggtaaatggtgtagttaggctacttacaaaaccatgggatgtccttccaacagttacacaaatggctatgacagatacgacacctttcggacaacaaagagttttcaaagaaaaagtagacacgcgtacacaagaaccaaaagaaggaaccaagaaactaatgaagataacagcagaatggttatggaaagaattaggtaaaaagaagacgccacggatgtgcacgcgtgaagagtttacacgaaaagtcagatcaaatgctgcgcttggcgcaatttttacagacgagaacaaatggaagtcagcaagggaagcagtggaagattctagattctgggagttagtagataaagagagaaacttacatcttgaaggaaaatgcgaaacatgcgtctacaatatgatgggaaaaagagagaagaaactaggtgaatttggtaaggcaaaaggatcaagagcaatatggtatatgtggttaggagctagattccttgagtttgaggctttaggcttcttaaacgaagatcactggttctctcgtgaaaattcactcagtggcgtagagggggagggactgcataaacttggttacatactcagggacgtaagtaagaaagaagggggcgcaatgtatgcagacgacactgcaggatgggatactaggattaccttagaggaccttaaaaatgaagaaatggtgactaatcatatggaaggtgaacataaaaagctcgctgaagctatatttaaattgacatatcagaataaagtggtcagagtacaaaggccaacacctcgcggtacagtcatggatatcataagcagacgagatcaaagaggctcgggacaagtaggcacttatggtttaaatacgttcacaaatatggaagctcaattaattagacagatggagggcgaaggtgttttcaaaaatattcagcatctgaccgtaacagaagaagtagctgtgcataactggctagcgcgtgtagggcgagaaagattaagcagaatggcaatatcgggtgacgactgtgtcgtgaaaccgctagatgatagatttgcaaatgccttgacagctctgaatgacatgggcaaaataagaaaggatattcaacagtgggaaccgagtaagggttggaacgactggacacaggtgccattctgtagtcatcattttcacgagctaatcatgaaagatggccgcgttttggtcgtaccatgtaggaatcaggacgagctgataggtcgggctcgaataagccagggcgcaggttggtctcttcgtgaaacagcctgtttaggaaagtcttatgcgcagatgtggtccttgatgtatttccatagaagagacctgcgactagcagcaaatgcaatttgcagcgctgtaccatcacattgggtaccgacatctagaaccacatggagcatccatgccaaacatgagtggatgacaaccgaagatatgttaacagtctggaatcgggtctggattagagaaaatccgtggatggaagacaagactcctgtagaatcatgggaagaaattccatacttaggtaaaagagaagaccagtggtgcggatctctgatagggctaacaagtagagcaacatgggccaaaaacatccaagcagcgattaaccaagttagatcgttaattggaaatgaagaatacacagattatatgccgagcatgaagcgatttcgcagggaggaagaagaagcaggcgtattgtggtaa

SEQ ID NO: 22784 - RNA, 9876 nt, synthetic construct
  misc_feature 1..9876: note = derived and/or modified CDS sequence (opt6) from DENV-2__EU482469__SS-prME
  source 1..9876: mol_type = other RNA
tcagcaggaatgataattatgttaatacctacggttatggcttttcatttgacaactcggaatggtgaacctcacatgatagttggaatacaagaaaaaggaaaatcacttctattcaaaacagaagatggtgtaaatatgtgcacattaatggcaatggacctaggggaattatgcgaagatacaattacttataaatgccccttacttcggcaaaacgaaccagaagacatagactgttggtgtaactccacaagtacatgggtaacatacgggacatgtactacaactggtgaacatcgacgagaaaaacggagcgttgcccttgtaccacacgtaggaatgggactagaaaccagaacagaaacctggatgtcgtcagaaggagcttggaaacacgcacaaagaattgaaacgtggatattgcgacaccccggatttaccatcatggccgcgattttagcgcatacaattggtacaacacacttccaaagggtattaatttttatccttttaactgcagtagctccatcaatgacgatgaggtgtatagggatctcgaaccgcgatttcgttgaaggagtatccggaggtagctgggtcgacatagtacttgaacatggaagttgcgtcacgacgatggctaaaaataaaccaacactagacttcgaattaattaaaaccgaagccaaacaacctgcgacactacgtaaatattgcatagaagcgaaattaaccaatacaacaacagaatcgcgctgcccaacacaaggagaaccgtcactaaaagaagaacaagataaacgatttgtatgtaaacattcgatggtcgaccgaggatggggaaacgggtgtggattatttggaaaaggcggaatagttacatgcgccatgtttacctgtaagaaaaatatggaaggtaaaatcgttcaaccagaaaatctagagtatactatagtcgtgaccccgcattcaggtgaagaacatgcggtgggtaatgacacaggcaaacatggaatggaaatcaaagtaacaccgcaatcttctatcacagaagctgaactaaccggatacgggactgtcacaatggaatgttcccccagaacgggattagattttaatgaaatggtactattacaaatggaaaataaggcttggttagttcacaggcaatggttcctagatttgccgttaccatggttgcccggagcagacaaacaagaatcaaactggatccaaaaagaaaccctagtaacatttaaaaatcctcacgccaagaagcaagatgtagtagtattaggctctcaagaaggcgcaatgcatacagcgttaacaggggccacagaaatacaaatgtcaagtgggaacctcctttttaccggccacttaaagtgtagattacgtatggacaagttgcaattaaagggtatgagctacagtatgtgtacgggaaaatttaaagtagtaaaagaaatagcggaaacacaacacggtactatagtcatcagggttcaatacgaaggtgacgggagcccttgcaagatcccctttgaaatcatggatttggagaaaagatacgtactaggcaggttaataacagtaaatccaatagtcaccgaaaaagactctccagttaacatagaagcagaacccccattcggagacagttacattataataggtgttgaaccaggtcaattaaaactaaattggttcaagaaaggatcaagtattgggcaaatgttcgaaaccactatgcgaggtgcaaaacgaatggccatcttaggagatacagcttgggattttggatctttgggaggcgtattcacgagcataggtaaagccctacaccaagtctttggagcaatatatggagctgctttttctggagtttcatggacgatgaagatactaattggtgtcataatcacttggatcgggatgaatagtcgatcaactagcctctccgtttcccttgtattagtgggaattgtaactttatatttaggtgtcatggtacaagcagattcaggctgcgttgtttcctggaaaaataaggaactaaagtgtgggagtgggatattcatcacagataacgtacacacatggacagaacaatataaattccagccagaatcccctagcaagctagccagcgcaatacaaaaagctcaagaagaaggcatctgtggtattcgttcagtcacaagactggaaaacttaatgtggaaacaaataacaccggagttaaatcatatattagcagaaaatgaagtaaaattaacaattatgactggagatataagaggtataatgcaagcagggaaacgttctcttagaccccaaccaaccgagttaaagtactcttggaaaacatgggggaaagccaaaatgctttcaacggaatcatataatcagacttttctaatagacgggccggaaactgcagaatgtccaaatacaaacagagcctggaactcattagaggtggaagattatggttttggagtattcacaacaaacatctggctaaaacttaaagaaaaacaggatgcattctgtgacagtaaattgatgtcagcagccataaaagataacagggcagtacatgcagacatgggatattggatagagtcggcattaaacgacacatggaaaatcgaaaaagccagcttcattgaagtcaaaaactgtcattggccgaaatcacatacattatggagcaacggtgtgctcgaaagcgaaatgattattcctaaaaacctcgcaggacccgtaagtcaacataattacagaccaggttaccacacgcagatagcagggccatggcacctgggaaaactagaaatggattttgacttctgtgacggaacaacggtaatagtgactgaagactgtggtaataggggacctagtttgagaaccacaactgcctcaggtaaactgataactgaatggtgttgtagatcctgtacattaccaccactaagatacagaggtgaagatggttgctggtatggtatggaaatcaggcctttaaaagaaaaagaggaaaacctagttaactcgttggtcacggcgggacatggacaagttgacaacttctcccttggagtattggggatggcgcttttcttagaagaaatgttgaggacacgcgtgggcacaaaacatgcaattttattggtggccgtcagctttgttacgttaattacggggaatatgagtttcaaagaccttggacgagtagtggtcatggtcggtgccactatggcggatgacattggaatgggggttacttacttagccttgttagctgcctttaaagtacgaccaacatttgcggcaggtcttttgcttagaaaactaacaagtaaagaactaatgatgactacgataggtatagtccttttgtctcagtcgacgatcccagaaacagtgctagagctgactgatgcacttgctttgggaatgatggtactaaaaatcgtaaggaacatggagaagtatcaactcgcggtcacaatcatggccattctttgtgtcccaaatgcagtgattttacagaatgcatggaaggtatcatgtacgatactagccgttgtatccgtctcacctctgctgctaacatcctctcagcagaaaacggactggatcccactagccctaacaatcaaaggtctgaacccgacagcgatctttcttacgaccctatcacggactaacaagaaaaggagttggccattgaatgaagcgataatggctgtgggtatggtatctatcctggcctcttcgctgctcaaaaacgatataccaatgaccgggcccctagtagccgggggacttctcacagtttgctacgttctcacaggaaggagtgcagatctagaattagagagggcaacagatgtgaaatgggaagaccaagcagaaatttcggggtcgagtccgatcctgagtattactatatccgaagatggctcaatgtctatcaaaaacgaagaagaggaacaaaccttaacaattctaattagaactgggcttttagtgattagcggacttttcccaatatcaattccaataacagcagcagcatggtatttatgggaggtgaagaaacaacgggccggggttctatgggatgttccctctccacctcctatgggaaaagctgaactcgaggatggagcctacaggataaagcagaagggaatactcgggtactcccaaataggggcaggagtgtataaagaagggacatttcatacgatgtggcacgtaacaaggggtgcagtattaatgcataaaggaaagcgtatagaaccatcctgggcggatgtcaagaaagatctaatatcgtacggaggaggctggaaacttgaaggagagtggaaggagggagaagaagttcaagtcttggctctagaacctggcaaaaacccaagagccgtccaaaccaaaccagggctgttcaaaacaaacactggaactataggggctgtgtcccttgacttcagtccaggaacttctggaagtccgattatcgataagaaaggcaaagtagtcggcctgtacggcaacggggtagtaacgaggagcggcgcgtacgtatcagcaattgcacaaacagagaaaaatatcgaagacaatcccgagatagaggatgatatatttcgaaagcgtagactaacgataatggacttacatcctggagcaggcaaaactaagaggtatctgcccgcaattgtaagggaagcgattaaaagaggacttcggacactaatcctagccccgacacgagtagtagcagccgagatggaagaagccctcagaggcctacccatacgctaccaaacgccagcaataagggcagagcatactggacgagaaatcgtagatctaatgtgtcatgcaacatttacaatgcgattattatctcctgtcagggtacccaactacaatttgattattatggatgaagcacacttcaccgacccagcgtcaattgctgcgcgtggctatataagtactagggttgaaatgggggaagctgctggtatatttatgacggccacgccgccaggaagcagggacccttttccgcaaagcaatgccccaataattgatgaagaaagagagataccagaaagatcttggaacagcggccatgaatgggtaaccgactttaagggaaaaacagtctggttcgtgccttcaatcaaagccggaaacgatattgcagcgtgtctaagaaagaatggaaagaaagtaatccaactatctagaaaaacatttgattcagaatacgtaaaaacgagaaccaacgattgggacttcgttgtaactacagacatctccgagatgggtgccaactttaaagcagagcgcgtaatagatcctagacgatgcatgaaacctgtgatattaactgacggtgaagaacgcgtcatattagccggacccatgccagtcacacatagctcggcggcacaaagaagaggtcgcattggaaggaaccccaaaaacgaaaatgaccaatatatatatatgggagagcccttagaaaacgatgaagattgtgcgcattggaaagaagccaagatgttacttgacaacataaatacaccagaaggaataataccgtcaatgttcgaaccagaaagagaaaaagtcgatgcaattgatggagaatacaggctacgcggagaggctaggaaaacgtttgtagatctgatgcgtagaggcgatttaccagtgtggttagcatataaggttgcagcagagggcataaactatgcggacagaagatggtgttttgatggaattaagaacaaccaaatcttggaggaaaatgtagaagttgaaatctggacaaaagaaggagagagaaagaaattgaaaccgagatggcttgacgccagaatatattcggatcctctagcgcttaaagaatttaaagaatttgctgctggaagaaaatcactgactctaaacctaattacggaaatgggtcgcttaccgacctttatgacacagaaaacgagagatgccctcgacaacctagctgtacttcacactgccgaagccggaggtagggcatacaatcatgctctgagcgaactacccgaaacgctagagacactcttattacttacgttattggccactgtcactggtggaatatttttgtttttaatgtcagggagaggaataggcaaaatgacacttggaatgtgctgtatcattacagcctcaatcttactatggtacgcccaaatacaacctcattggatagcagcctctattattctcgagttctttttaatagttttattaataccagaacctgaaaagcaaagaacacctcaggacaatcaacttacttatgtggtaatagctattttgactgtggttgctgccaccatggccaacgaaatgggcttcttggagaaaactaagaaagacttaggtctgggttcaatagctacgcaacaaccggagagtaatatattggatatagacttaagaccagcttctgcttggaccttatacgcggtcgccactacattcgttacaccaatgcttaggcactccatagaaaattcgtctgtgaatgttagtcttacagcaatagcaaatcaggcaactgtacttatgggattaggcaagggctggccattgagtaagatggacataggagtaccactcctagctattggatgttatagccaggtgaacccgatcacattgacggccgcacttctactccttgtagctcactatgcaataataggacctggattacaagcaaaggctacaagagaggctcagaaaagagcggctgcaggcatcatgaaaaaccctaccgttgacggaattaccgttatcgacctagatccaattccctatgacccgaaattcgagaagcaattaggtcaagtgatgttactcatattatgcgtaactcaggtcctgatgatgcgaacaacatgggcactttgtgaagctctaacacttgcaacaggaccaatcagtaccctttgggaaggcaatccagggagattttggaatactacaattgccgtaagcatggccaatatttttaggggcagctacctagctggagcaggtttgctattttctatcatgaaaaacacaacaaacaccaggaggggaaccggaaacactggggaaacgttaggggaaaaatggaaatcccgactcaacgctttaggtaagagcgaatttcaaatttacaaaaagtcaggcatacaagaagtagaccgaactctagccaaggagggtattaagaggggagaaactgatcatcacgcggtgtctcgagggtctgcaaaacttagatggtttgtagagagaaacatggtaacacccgaaggtaaagtggttgacctgggctgcggtagaggcggctggtcatactattgtggcggactcaaaaatgtacgagaagttaaaggccttacaaaaggaggacccggacacgaagaaccaataccaatgtctacatatggctggaatctggttaggctacagtcgggagtagacgtatttttcataccaccagaaaaatgtgacactttattgtgcgatataggtgaatcctcgccaaatccaaccgtagaagcaggacgtacattgcgggttttgaacctcgtagagaattggttaaataataatacccagttctgcataaaagtactaaatccatatatgcctagtgtaatagagaaaatggaagcattacaacggaaatacggcggggcattagttcgaaatcctttgtcgcgtaactcaacacatgaaatgtattgggtgtctaatgcttcgggaaacatcgtttcatcggtgaacatgattagtaggatgttaataaacagattcacaatgcgtcataaaaaggcgacttatgaaccagatgttgacctaggatcaggcacaagaaatattgggattgaatcagagatacccaatctagacataataggtaaacgcatagagaaaattaagcaagagcacgagacgagctggcattacgaccaggatcacccatataagacatgggcatatcacggttcttatgagacaaagcaaacaggaagcgcaagttcaatggtcaacggagtagtgcgcttattaacgaaaccgtgggacgtactccccactgttacacaaatggcaatgacagacacaaccccctttggacaacagagagtatttaaggaaaaagtagatactcgaacacaagaacccaaagaaggaacaaagaaattaatgaaaataaccgcagagtggctttggaaggaattaggcaagaagaaaacacccaggatgtgtacaagggaagagtttacaaagaaagtacgtagtaatgctgcactcggcgctatttttacagatgaaaataaatggaaatctgcccgagaagccgtagaagattcaagattttgggagcttgtggacaaggaaagaaacctccatttagaaggaaaatgcgaaacctgtgtctataacatgatgggaaagcgtgagaagaaattaggagagttcgggaaagccaaagggagtagagccatatggtacatgtggttaggtgcacgttttctcgaatttgaagcactcggatttcttaatgaagatcattggtttagtagggaaaactcgttatccggtgtggaaggtgagggactacacaagttaggctatattctaagagacgtctctaagaaagagggaggagcaatgtacgctgacgatactgcaggatgggacacgagaataacgctcgaagatttgaaaaacgaagagatggttacgaatcatatggaaggcgaacataagaaattggctgaagcaatatttaaacttacataccaaaataaagttgtaagggtacaaagacctacgcctcgtggtactgtaatggacattatttcaagaagagatcagcgaggctccggtcaggtaggaacgtacggtttaaacacgtttacaaatatggaagcccagttgattaggcaaatggaaggcgaaggggtctttaaaaatatccagcacttaacggtaacagaggaggtcgctgtacacaattggttagctcgggtgggtcgagagcgattatccagaatggccatctcaggcgatgattgtgtggtgaagcccttagacgatagatttgcaaacgctttaacagctctcaatgacatgggaaaaataagaaaagacatacaacagtgggaaccgtcaaaaggttggaacgactggacccaagtaccattttgctcgcatcacttccatgaactaataatgaaagacggaaggattcttgtagtcccttgccgaaatcaggatgaattgattggcagagcaaggatcagtcagggagccggctggtcacttcgagaaaccgcatgcttagggaaaagttatgcccaaatgtggagtctgatgtatttccaccgaagagacctacgattagccgcaaatgccatttgttctgccgtgccatcccactgggtacccacctcgaggaccacctggtcaatacacgccaaacatgaatggatgacaactgaagatatgcttaccgtatggaatcgtgtgtggattagggagaatccatggatggaagacaaaacacccgtcgaatcttgggaagaaataccctatctaggaaaaagggaagatcaatggtgtggaagtctaatcggattaacttcacgagcaacgtgggctaaaaatatacaggccgctataaaccaggtgcggtctctaattgggaacgaggaatacacagattatatgccctccatgaagagattcagacgagaggaggaagaggctggtgtactttggtaa

SEQ ID NO: 22785 - RNA, 9876 nt, synthetic construct
  misc_feature 1..9876: note = derived and/or modified CDS sequence (opt6) from DENV-2__EU482470__SS-prME
  source 1..9876: mol_type = other RNA
agcgcaggaatgatcataatgctgatacccacggttatggcatttcaccttacaacgcgtaatggcgaaccgcatatgattgtaggcattcaagaaaaaggcaaaagcctactgttcaaaaccgaagatggtgtaaatatgtgtacattgatggctatggacctaggtgaattatgcgaagacacaataacctataaatgtcccctattacgacaaaacgaacccgaagacatcgactgctggtgcaattcaacttcaacatgggttacctatggcacttgtaccacaactggagaacatcgacgggaaaaacgttcggtagctctggtaccacacgtaggaatgggtttggaaacccgaacagaaacatggatgagctctgaaggtgcgtggaaacatgctcaaaggatagaaacttggatactaaggcaccctggcttcaccataatggcggctatactggcctacactatcggtactacccacttccaaagggttttaatctttattctattaactgcggtcgcgccaagtatgacgatgagatgcataggaatcagtaatagagattttgtggaaggagtttctggcgggtcctgggttgatatagtactagaacatggcagctgtgtaaccactatggctaaaaacaaacccacccttgattttgaattaataaaaactgaagcaaaacagcccgcgacgctaaggaaatattgcatagaagcgaaactaacaaacacaacgacagaaagtagatgtccaacacaaggagaaccatctctaaaagaagaacaagacaaaagattcgtttgcaaacatagtatggtagatcgtggttggggaaatggatgtggcctgttcggaaaaggtgggattgtaacgtgcgcaatgtttacatgcaagaaaaatatggaaggtaaaatagtccagcccgaaaacctagaatacactatagtcgtaacacctcactccggtgaagaacacgcagtaggaaacgatacaggcaaacacgggaaagagataaaagtcaccccacagtcaagtattacagaagcagagctaactggttacggaacggtgactatggagtgttccccgcgcacaggcttagatttcaatgaaatggtattgttgcaaatggaaaataaagcgtggttggtacataggcaatggttccttgacctgccgctaccatggttacccggagctgacaaacaagagtcgaattggattcaaaaagaaacgctagtcaccttcaaaaacccacacgccaagaaacaagatgtagtcgttttaggtagccaagaaggagcgatgcatacagctttgaccggagccacggagatacagatgagtagtggtaatttgcttttcaccggtcacctaaaatgtcgcttgcgaatggataaattacaactcaaaggaatgagctattctatgtgtaccggcaaattcaaagttgttaaagaaattgcagaaacccaacacggaacgattgtaatacgagttcaatatgaaggagacggctcgccctgcaaaataccttttgaaataatggacctcgaaaaacgatatgttcttgggcgcctaataactgtaaatccaatcgtaactgaaaaagattcacccgtgaatattgaagctgaaccacccttcggagatagttacatcattatcggagtagaaccaggacaacttaaacttaactggttcaagaaaggctcctctattggacagatgttcgaaacaacgatgcgaggggcaaaaagaatggccatacttggggatacagcttgggacttcggtagtctcgggggtgtattcacaagtatcggaaaggctttacaccaagtgtttggagctatatatggagcagcctttagcggggtttcatggacgatgaaaattttaataggcgttatcataacctggatagggatgaactctcgatcaacgtcgctaagtgtgagtctagtcctagtaggtatagtgacactgtatctcggggtaatggttcaagcagattctggatgcgtggtatcctggaaaaacaaagaacttaagtgcggaagtggaatatttataactgacaatgttcatacttggactgaacaatacaaatttcaaccagaatccccatctaagctagcgtcggctatccagaaagctcaggaagaaggaatctgcggaatacgtagtgtaactagattagaaaacttaatgtggaaacagataacacctgaattaaatcacatattagctgaaaacgaggttaaactcacaattatgacaggtgatataaaaggcataatgcaagcaggaaaacgatctctgcgacctcaaccaactgaactgaaatatagctggaagacatggggcaaagccaagatgttatccacagaatcgtacaatcaaacattccttattgatgggccagagactgcagaatgccccaacactaatcgagcctggaactctctagaggtagaagattacggttttggtgtttttacaaccaatatctggttgaaattaaaggagaaacaagatgcattttgcgacagtaaattaatgtctgcagccataaaagacaatcgagcagtacatgcagatatgggctattggattgaaagtgccttgaacgatacatggaaaatagagaaggcatcatttatcgaagtcaaaaattgccattggccaaaatctcacaccttatggtcgaatggagtattagaatcagagatgatcattcccaaaaatcttgcgggtccggtcagtcaacataattaccgacccggatatcacacgcagattgccggaccgtggcatttagggaaacttgaaatggattttgatttttgtgacggtacaacagttattgtaacggaagattgcgggaatagaggaccatcgctcaggactaccaccgcatcaggaaaactaattaccgagtggtgttgccgttcttgtacattacctccattgagatatcggggtgaagacggttgttggtatggtatggagatcagacccctaaaagaaaaagaagaaaatctagtaaattctctagttacagcaggacacggacaagttgacaatttctcattaggcgtcctgggaatggcactatttctggaggagatgctgagaacaagagttggtacaaaacacgcgattttgcttgtagccgtctcatttgtgacgttaataactggaaatatgtccttcaaagacctaggcagagtggtagtaatggtaggggccactatggctgacgacataggaatgggcgtaacctatctagcgctactagcggctttcaaagtgagaccgacatttgctgccggcttacttcttcgaaaattaacatcaaaagaactaatgatgaccaccatagggatagtattgctaagccaatcgacaatcccggaaaccgtacttgagctgacggatgcattggcattaggcatgatggtgctcaagatagtaagaaatatggagaagtaccaattagctgtcacaataatgaccattttatgcgtgcccaatgcagtaattctacaaaacgcatggaaagtgagctgtacaatattagcggtagtatcagtgagccccttacttttaacctcaagtagacagaaaacagactggataccattggcgctgaccataaaaggtctgaatcctactgcaatcttcctcaccacgttgagcagaacgaataagaaacgaagttggcccctgaatgaagccataatggctgtcggaatggtctcaatattggcttctagtctactgaaaaacgatatacctatgacggggcctttagtagccggcggcttactaacagtctgctacgtactcacaggacggtcagctgatctagaacttgaacgagcgacagatgttaagtgggaagatcaagcagaaatttctgggagtagtcccatactcagcatcactatctctgaagacggctcaatgtccattaaaaacgaggaagaagaacaaaccttgacaatactgattcgtaccggattattagtgattagcggcctatttccaattagtattcctataacagctgctgcttggtacctttgggaggttaagaaacagagagccggagtgctgtgggatgtgccatcacctcctccaatgggaaaagcagaactagaagacggagcataccgaattaaacaaaagggcatacttgggtacagccaaataggcgcaggagtatataaggaaggtacgttccatacgatgtggcatgtaactagaggtgcagtactcatgcataaagggaagagaatagaacctagttgggcagacgtcaagaaagatctaatatcatacggcggaggatggaaactagaaggcgaatggaaagaaggtgaagaagtgcaggtattagctttagaaccagggaaaaacccaagggcggtacaaacgaaacccgggctatttaaaacaaatactggaacaataggagcggtatcattagacttttcaccaggaacttctggaagcccgattatagacaagaaaggtaaagtagtagggctctatggcaacggtgttgtaaccagatcaggggcttatgtcagcgccattgcgcaaaccgaaaaatcaatagaagataaccccgaaatcgaagacgatatctttcgaaagcggagactgacgatcatggatctacatccaggcgctggaaagaccaaacgttatctgccagcaatagtaagggaagcaataaagagagggttgaggacactcattcttgcgcctacacgtgtcgtagctgcggaaatggaggaagccttacgaggtctcccaattcgctatcaaactcctgctattagagcagagcacacgggacgtgaaattgtagacttgatgtgtcatgctacattcacaatgagattactatcacccgtaagagtcccaaactacaaccttataataatggacgaagcacatttcacagatcccgcatcaatagcagcacggggttacatttctactagagtcgaaatgggcgaagcagcaggaatctttatgacagcaaccccacctgggtcaagagacccatttcctcaaagtaatgcgcctataattgatgaagagagagaaataccagaaagatcgtggaactctggacatgaatgggttacagattttaaaggaaaaacagtttggttcgtaccatctataaaagcaggaaatgacatagcagcatgcttgaggaaaaatggcaagaaagtaattcaactaagcaggaaaacgtttgatagtgaatatgtaaaaacaagaacgaacgactgggattttgtggtaacgacagacattagtgaaatgggagcaaatttcaaggcagaacgagtaattgatcccagacgttgtatgaagcccgttattctaacagatggagaagaaagagtcatcttagctggacccatgccagttacccactcaagtgctgcccagagaagaggcagaattggaagaaatcctaaaaatgaaaatgaccagtatatttatatgggtgagccactcgagaacgacgaagattgcgcccactggaaagaagcaaagatgttactagataatatcaatacaccagagggaatcatcccaagcatgtttgaacctgaaagagaaaaggtcgacgcgatcgatggagaatacaggcttagaggggaagcccgcaaaacttttgttgatttgatgagaagaggtgacttgccagtctggttagcatataaagtggcagcagaaggcataaattatgcagataggagatggtgcttcgacggaataaagaataaccaaattttggaagaaaacgtagaagtagaaatttggacaaaggaaggagaaagaaagaaattaaaaccaagatggttggacgcacgaatatattcggacccacttgcactcaaggagtttaaagagttcgccgctggtagaaaatcactaacgttgaatcttataacagaaatgggaagacttcccacctttatgacacagaaaacacgagacgcactagacaatctagcggtcttacatactgcagaggcaggaggccgagcttataaccacgcactctcggagttacctgagacactcgaaacactactcctactgacattactagccactgtcactggcggaatatttttattcctaatgagtggaagaggaataggtaagatgactctaggaatgtgttgtatcataacggctagtatactactgtggtatgctcagatacaaccacactggatcgcagccagcattatacttgagttctttttaatagtcttattaataccagaacctgaaaagcaacgtacaccacaagacaaccagctaacatatgtagtaatcgcaattttaacggtagttgcagccacaatggcgaatgaaatgggatttctggagaaaacaaagaaagatttaggacttggaagcatcgcaactcaacaaccagaatcgaacatactggacatcgatttgaggccagctagcgcctggacgctatacgccgtagcaacgacattcgtgactccaatgctcagacatagcatcgaaaattctagtgttaatgtatcacttacagcaatcgcgaatcaggcgactgtattaatggggttaggaaaagggtggccgctatcgaaaatggacataggcgtaccacttttggcaatagggtgctattcccaagtcaatccaataactttaacagctgccttattgttgttagtagctcattatgcaatcatcggaccgggactacaggctaaagctacacgagaggcacaaaaacgagcagctgctgggattatgaaaaaccccacagtggatggcataaccgtaatcgacttagatcctataccttacgacccaaaattcgaaaagcagctcggacaggtaatgcttctcatcctctgcgttacccaagtattaatgatgagaaccacatgggcattatgtgaggccctaacactagcaacaggccctatttcaaccctatgggaaggaaatccaggcaggttctggaatacaaccattgcagtctcaatggcaaatatatttagaggaagctatttagccggagctggactactattctcgatcatgaaaaatacgacaaatacacggcgtgggactggtaatatgggtgaaacattaggagaaaaatggaaatcgcgattaaatgcactcggcaagtcagagttccagatctacaagaaatctggaatccaagaggtggatcgaaccctagcgaaagaaggaattaaacgaggcgaaacagaccatcatgctgtatcccgaggttcagccaaactacgctggtttgtcgagcgaaatatggtaaccccagaaggaaaagtagtagatttgggatgtggaagaggtggttggagttactactgcggtggactcaaaaatgtacgagaagtaaaaggactaacaaaagggggtccagggcacgaagaaccaatccctatgtccacctatggttggaatttagtgagactacagtcgggggtagatgtattctttataccaccagaaaaatgtgataccctactatgtgacattggggaatcttctcccaaccccaccgttgaagcaggaagaacactaagagtcttgaaccttgtagagaattggctaaataacaatacacaattttgcattaaagtgctcaacccctatatgccgtcggtaatagagaaaatggaggctttacaacgtaaatacggcggagccctagtaagaaatcctctaagtagaaattctacgcatgaaatgtactgggtttcaaatgcctcagggaatatagtatctagtgtaaacatgattagtcgaatgctgatcaaccgattcactatgcgccacaagaaagcgacatatgagccagacgtagatttaggatcaggaacaagaaacattggaattgagtcagaaattcccaatttggacataattggaaaacgtattgagaaaataaaacaagaacatgagacaagttggcattacgatcaggatcatccatacaaaacttgggcatatcatggaagttatgaaactaaacaaacaggctctgcaagcagtatggtcaacggagtagttcgattactgaccaaaccatgggatgtgttacctaccgtcactcaaatggcaatgacagatacaactccttttggacagcagcgggtctttaaggagaaagtagatacacggacacaagaacctaaagagggtaccaagaaactaatgaaaataaccgcggaatggctatggaaggaattggggaagaagaaaacacctagaatgtgtacccgagaggagtttacccgtaaagtaaggtcgaacgcagctctaggagctatttttaccgacgaaaataaatggaaatctgcgagagaagctgttgaagactcgggattctgggagctagtagacaaagaaagaaatctccacctagaaggtaaatgcgagacatgtgtatataacatgatgggtaaacgcgagaagaaattaggtgagttcggtaaagcaaaaggttcccgtgctatatggtacatgtggttgggggcaaggtttctggaatttgaagctcttggttttctaaacgaagatcactggttttcacgagagaactcgttgtcaggcgtagagggagaaggtttacacaaattgggctacattctaagagatgtcagcaagaaagagggtggggccatgtatgctgatgacacggctggttgggatacccgcataactctggaagatcttaaaaacgaagaaatggtaactaatcacatggaaggagaacacaagaaactagcagaggcaatatttaaactaacttatcaaaataaagtggtgcgagtacagagacctactccgaggggaaccgtaatggacatcatcagccgacgggaccaaagaggatccggccaggtagggacatatgggcttaacacatttactaatatggaggctcaacttatcaggcaaatggaaggcgaaggtgttttcaaaaatatccagcatctaacagtaaccgaagaagtagctgtacagaactggcttgcaagagtaggtcgagagcgattgtctcgtatggcgatctcaggggacgattgtgtagtaaagcccttggacgacaggttcgcaaatgcattaacagccctaaatgatatgggtaaaataagaaaagacatccaacaatgggaaccgagtaagggatggaacgactggacccaagttccattttgctcacatcattttcatgaactgataatgaaagacggaagagttctggtcgtaccttgtaggaaccaagatgaacttattggcagagcgcgtatttcacaaggagcaggatggtcgttacgtgagacagcatgcctcgggaagagttatgcgcaaatgtggagtttaatgtatttccatcgtagagatctaagactggctgcaaacgccatatgttcggcagttcctagtcattgggtgccaacgagtaggacgacctggagtatccatgccaaacatgaatggatgacaactgaagatatgttaaccgtatggaacagagtatggattagagagaatccatggatggaagacaagacccccgtagagagctgggaagaaataccttatctcgggaaacgtgaggatcaatggtgcgggagtcttataggattaacaagtcgagcaacgtgggcgaaaaatatacaagcggctatcaatcaagtaagaagtctaatagggaatgaagaatacacagattatatgccctctatgaaaagatttagacgtgaagaggaggaggcaggagtcctttggtga

SEQ ID NO: 22786 - RNA, 9876 nt, synthetic construct
  misc_feature 1..9876: note = derived and/or modified CDS sequence (opt6) from DENV-2__EU482471__SS-prME
  source 1..9876: mol_type = other RNA
tcagccggaatgattattatgcttattccaacagtaatggcattccacctaacaacacgaaatggtgaaccccacatgatagttggaatacaagaaaaaggcaaatcattactttttaaaaccgaagatggagtaaatatgtgcacacttatggcaatggatttaggcgaactatgcgaagatacaataacatataagtgccctcttttaagacaaaacgaaccagaagacatagactgttggtgcaactcaacaagcacttgggttacatacggaacgtgtaccacaactggtgagcataggagagaaaagcgatcggtcgccctagtaccacatgtggggatgggccttgaaacgcgaaccgaaacgtggatgtcttctgagggtgcctggaaacacgctcaaagaatagaaacttggatactacgacaccctgggttcacaatcatggccgcaatattagcgtacactatcggaaccactcattttcaaagagttcttatatttatattgttaactgccgtagcacccagtatgaccatgagatgcataggaatcagtaacagagattttgtcgaaggtgtttcaggaggttcctgggttgatattgtacttgagcatggtagctgtgtcacaactatggctaaaaataaaccgaccctagatttcgagctaataaaaacagaagctaaacaacccgctactttacgtaagtattgtatcgaggctaaattgacaaacacgacaacagagagtcgatgtccgacgcaaggtgaacctagcctaaaagaagaacaagataaacgatttgtatgtaagcactcaatggtagaccgaggatggggtaatggatgtggacttttcggtaagggaggaatcgtaacatgtgcaatgtttacctgtaaaaaaaacatggaaggcaagatagtacaaccggagaatctagagtacaccatagtagtgacaccccactcaggggaagaacactctgtaggtaatgatacaggaaaacatggcatggagataaaagttacaccccaaagttcgatcacagaggccgagcttacgggatacggaacagtgactatggagtgcagtcccagaactggcttggactttaacgaaatggttctgttgcagatggagaataaagcatggctcgttcatcgtcaatggtttcttgacttacccctaccatggcttcctggagcagacaaacaagagtccaattggattcaaaaagagactttggtcacatttaagaatccccacgctaaaaagcaggacgtagtggtgctaggatcgcaagagggagcgatgcatacagccttgacaggtgcaactgagatacagatgagtagcggtaatttgctatttacaggacatctcaaatgtcgtctacgaatggataagcttcagcttaaaggcatgtcgtattccatgtgtacaggcaagtttaaagttgtaaaggaaatcgcggaaactcaacatggtactatcgtgattagagtccaatatgagggggacggatctccttgtaaaataccgtttgaaattatggatctagagaagcgatatgtacttggtcgtctaatcacagtaaatccaatagtaaccgagaaagattcaccagtaaatattgaagctgagcctccgtttggtgactcttatatcattatcggtgtggagcccggtcaattaaagttaaactggtttaaaaaggggtccagcataggacaaatgtttgagactacgatgcgtggcgctaagaggatggccatactaggcgatactgcatgggactttggtagcctgggtggagtttttacctcaataggaaaggcactacaccaagtgtttggagcaatctacggcgcggcattttcaggcgtctcctggacaatgaaaatactaattggagtaattataacctggatcggaatgaatagccgaagtacgtctctgagcgtctcacttgtcctcgtaggtatagtgacattatatctgggagttatggtacaagctgattctggatgcgttgtaagttggaaaaacaaagaactaaaatgtggtagtggcatcttcataactgataacgtacatacctggactgaacagtataaattccaaccggagagcccttcaaaattggcgagtgccattcaaaaagctcaagaagaaggcatttgcggcatccgaagtgtaactagactagaaaacctcatgtggaaacaaattacaccagagcttaaccatatcctagcagaaaacgaagtaaaattaactataatgactggagacattagaggaattatgcaggcaggcaaacgatcattaagaccacaacctaccgaattaaaatacagttggaaaacatggggtaaggcaaagatgttatctacagagagttacaatcagacattcctgatagatggacccgagacagcagaatgtccaaacaccaatagagcatggaactcattagaggtagaggattatggtttcggtgtctttacgaccaatatatggctaaagctgaaggaaaaacaagacgcgttctgtgattccaagttaatgtcggcggccattaaagacaaccgtgccgtccacgcagacatgggctattggatcgagtccgcactaaatgacacatggaaaattgaaaaagcttcattcatagaagttaaaaactgccattggccaaaatcacatacactatggagtaatggtgttttagagtctgaaatgataatacctaaaaacctagcaggacctgtttcacaacacaactatcggcctggttaccatactcaaattgcaggtccgtggcatctcggtaaactcgaaatggattttgatttttgtgatgggacaacagtaattgttacagaagattgtggtaacaggggtccctctttacgaaccaccacggcgagtgggaaattaataaccgaatggtgctgtcgatcttgtacattaccacccctccggtatagaggagaagacggttgttggtatggtatggaaatccgaccgttaaaagaaaaagaagaaaacctagtcaattctttagtaactgctggacacgggcaagtagacaatttttcactgggtgttctggggatggcgctattcttagaagaaatgctaagaactagggtcgggactaaacatgcaatacttctagtagcagtatcatttgtaactcttataactggaaacatgtcctttaaagatcttggtagagtagtagtaatggtgggtgccacaatggctgatgacataggtatgggagtcacctatctagctttactagcagcatttaaagtcagacccacctttgcggcaggtttactacttcgcaaacttacgtctaaagaactgatgatgacaactataggcatagttcttttaagccaatcaacaataccagagactgtcctcgaattgaccgatgcacttgcattaggaatgatggttttaaagatcgtccgaaacatggaaaaatatcaactcgcagttactataatggcgatcctgtgcgtaccaaatgctgttattcttcaaaatgcctggaaagtatcatgtacaatattagcggtagtttctgtatcacccttgttactaactagttcacagcagaaaacagattggatacccctagctcttaccataaaagggttgaatccgacagcaatctttctaacaacattaagcagaacaaataaaaaaagatcttggccacttaatgaagcaataatggctgtgggaatggtctctatactagcgtcatcactccttaaaaacgacattccgatgaccggtcccctcgtggcaggaggattgctaactgtttgctacgtcctcacagggcgatcggctgatttagaattggaacgtgcaacaaatgtaaaatgggaggatcaagccgaaatatctggtagcagcccaatactctcgataacaatatctgaagatggatccatgtcaataaaaaatgaagaggaagaacaaacacttacgattttaattaggactggcttactagtaatatccgggctattccctattagcataccaatcacagcggccgcgtggtatctgtgggaagttaaaaaacaacgagctggtgtactatgggatgtcccgagtcctccaccgatggggaaagctgaattagaagatggagcatataggattaaacaaaaagggattttagggtactcacaaatcggcgccggggtttataaagaaggcactttccatacaatgtggcatgtaactagaggagctgttctcatgcataaaggtaaacgcatagaaccatcgtgggcagatgtaaagaaagacctaatttcatacggtgggggttggaaactcgaaggcgagtggaaagaaggagaagaggtgcaagtcttagcattagaaccaggaaagaatccgagagcagtgcaaacaaaacccggtctatttaaaacgaacactggaacaataggagccgtaagcctagacttttcaccaggtacgtcgggatcacccattatagataaaaaaggaaaagtcgtcggactgtacggaaatggagtagtgacaagaagtggggcatatgtatccgcaattgcacaaacggaaaaatcgatagaggataatccggagatcgaagatgacatatttcggaaacgacgcctaaccattatggacctacatcccggagcaggaaaaacaaagcgatacttacccgcaatagtaagagaggcaattaagcgaggtctgagaacgctaattctagctcctacacgagtcgtagcggctgaaatggaagaggctcttcgtggcttaccgattagatatcaaacccctgcaatcagagcggaacataccggtcgagaaatagttgatttaatgtgtcacgctacctttacaatgcggttattgagtccagttagagtaccaaattataacttaattataatggatgaagcacatttcactgatccagcctctatagcggcaagaggttatataagcacgcgtgtagaaatgggagaagcagcaggaattttcatgaccgctacacctccaggatctcgtgatcctttccctcagagcaatgcgccaataatcgatgaagaaagggaaatacccgaaagatcctggaatagtgggcatgaatgggtgacagacttcaaaggaaaaactgtgtggttcgtaccgagtattaaagcgggtaatgatatcgcggcatgtctcagaaaaaatggaaaaaaggtaatccaattatccagaaagacgttcgactctgagtatgtcaaaactagaaccaacgactgggatttcgtagtaaccacagacataagtgaaatgggcgcaaattttaaagcggagcgcgttatcgatccaagacgatgtatgaagcctgtgattcttacagacggagaagagcgcgtaatactggccggacccatgccagtcactcattcaagtgctgctcaacgtagagggcgaataggaagaaatccaaaaaatgagaacgatcaatatatatatatgggcgaacctttagaaaacgatgaagactgtgcgcattggaaagaagcaaaaatgttattggataacatcaatacacccgaaggaatcataccaagcatgttcgaaccagaacgcgagaaggtagatgcaatagatggggaatatagactaagaggagaagctagaaaaactttcgttgatcttatgagaagaggagatttaccagtttggctagcttacaaagtagcagcagaagggataaattatgcggaccgtagatggtgttttgacggtatcaaaaacaaccaaattctagaggagaacgtggaagtagaaatttggaccaaagaaggggaaagaaagaagttgaaaccccggtggctcgacgctagaatctattctgaccctttagccctaaaggaatttaaagagtttgccgctgggcgcaaaagcctcacattaaatttaatcaccgaaatggggcgacttcctacatttatgacgcaaaagaccagagatgcactggataacttagctgtacttcatacggctgaggcgggcggcagagcatataatcacgctttgtctgagctccccgagacgctagaaacattattactactgacattattagcaacggtaacgggcggaatattcctatttttgatgtctggtagaggaatcggaaaaatgaccctcggaatgtgttgtataatcacggcgtctatcttactatggtacgctcaaatacagcctcactggatcgcagcatccatcatactcgaattctttctgattgttttattaataccagaaccggaaaaacagagaacaccacaagataatcagctaacatatgtggttatagccatattaactgttgtagcggccactatggcaaacgaaatgggttttttggaaaagacgaaaaaggaccttggattaggatctatcgcaacgcaacaaccggaatctaacatactagatatagatctacgaccggcttccgcatggactctgtacgcggtagcaacaacatttgtcacacccatgctaagacatagcattgaaaattcctcagtgaacgtatcattaactgctatagctaatcaggctacagtcctcatgggcctaggtaaaggatggccactttcaaaaatggacattggggtaccgcttttagcaataggatgctactctcaggtcaacccaataactctgacagccgcattacttttattagtcgcgcattatgccataatcggaccaggtctacaagcaaaagcaaccagagaagcacaaaagagagcggcagctggcataatgaagaatccaacagtagacggtattacagtaatagatcttgatccaattccctatgatcccaaatttgaaaaacagcttggccaagtaatgcttttgatactgtgtgtaacccaggtactcatgatgagaactacgtgggctttatgcgaggctctcacactagcaacaggaccaatcagtaccctctgggaaggtaatccaggacgattttggaatactacaattgcagtaagtatggcgaacatcttcagaggtagttatctagcaggcgctggactactttttagtataatgaagaataccactaatactcgacgtggaactggaaacatcggtgagaccctgggggagaaatggaaaagtaggcttaatgccctgggtaaatcggagtttcagatctataaaaaatctggtattcaagaagtcgaccgcacactagcaaaggaagggataaagcgaggagagacagaccaccatgcagtctcacgagggtcagcaaagctgaggtggtttgtcgagaggaacatggttacaccagaaggaaaagttgtagatctagggtgcggaagaggtggatggtcatattattgcggcggattaaaaaacgtcagggaagtaaaaggtttgaccaagggaggtccgggtcacgaggaacctatcccgatgagcacttacggatggaacttagtcaggttacaatcaggtgtggatgtttttttcattccaccagaaaaatgtgacacacttctatgtgatataggagaatcttcccccaacccgaccgtagaggccggccgcacactgagagtattaaatctggttgaaaattggttaaacaataatactcagttctgcatcaaagttcttaatccatatatgccttccgtcatagaaaaaatggaagctttacaaagaaaatatggtggagcactagtaaggaatcctttatcacgaaacagtacccatgaaatgtattgggtctcaaatgcaagtggcaatatagtatcatctgttaatatgatatcgcgaatgcttatcaacagatttaccatgagacataagaaagccacatatgaaccggatgtcgatctggggagtgggaccaggaacataggcattgaatctgaaattccgaatttagatataatcggaaaacgcatcgaaaaaataaaacaagaacacgaaacgtcatggcattatgatcaagatcatccctataaaacatgggcataccatggaagctatgaaacaaaacaaacaggttctgcatctagcatggtcaatggagttgtaagattgttaacaaagccatgggacgtcttacccactgtaactcagatggccatgacagatacaacaccatttggccagcaaagggtcttcaaagaaaaagtagataccaggactcaggaaccaaaagaagggacaaaaaaactaatgaaaattactgcagaatggctatggaaagaactaggaaagaaaaaaacaccaagaatgtgcacacgcgaggaattcacaagaaaggtgagaagcaatgcagcattaggggcaatttttactgacgagaataagtggaaatctgcaagagaagcagtcgaagattctagattctgggagttggtagataaagagagaaatttacatctcgagggtaaatgtgagacttgcgtatacaatatgatgggaaaacgagaaaagaaacttggggaatttggaaaggctaaaggttcgcgcgcgatttggtacatgtggcttggagcgaggttccttgaattcgaagccttagggtttctcaatgaggaccactggttctcaagggagaactctttaagcggagttgaaggagaaggcttacataagttaggatatatattaagagatgtcagcaagaaagaagggggagcaatgtacgcggatgacaccgcagggtgggacactaggataacattggaggatttaaaaaatgaagaaatggttacgaaccatatggaaggagaacacaaaaaattagctgaggctatctttaagttaacttaccaaaacaaagttgtacgtgttcagagacctacccctagaggaacggttatggatattataagccggagagatcagcgaggctctggacaggttggaacctatggactgaacacatttacgaacatggaagcgcaactgataagacaaatggaaggcgagggtgttttcaaaaatattcaacatctaacagtgaccgaagaagtcgccgtacataattggttagctagagtaggcagagaacgcttgtctcgcatggcgataagtggggacgattgcgtcgtgaaaccccttgatgaccgtttcgcaaacgcactcactgcgctaaatgatatgggtaaaatacgcaaggatattcaacaatgggagccaagcaaaggttggaacgactggacacaagtgccgttttgttcgcatcatttccacgaattgataatgaaagatggtaggatcttggtggtgccttgtcgaaaccaagatgagctgataggtcgcgcgcggatttcccaaggtgcgggatggagtttaagagaaacggcttgtctcggaaagagttacgcacaaatgtggtcactaatgtattttcaccggagggatttacgcttagccgcaaacgcaatatgctcggcagtgcctagccattgggtgccaacttccagaacaacgtggagtatccatgccaagcacgagtggatgacgacagaagatatgctaacagtttggaacagagtctggatccgtgaaaatccgtggatggaagacaaaacacctgtagaatcttgggaagaaatcccatatctgggaaagagggaagatcaatggtgtggatcacttataggcctaacatcgagggcgacatgggcaaagaatattcaagcagcaataaaccaagtaagatccttgataggaaacgaagaatatacagactatatgccgagtatgaaaaggtttagaagagaagaagaggaagcaggagttttatggtag

SEQ ID NO: 22787 - RNA, 9876 nt, synthetic construct
  misc_feature 1..9876: note = derived and/or modified CDS sequence (opt6) from DENV-2__EU482472__SS-prME
  source 1..9876: mol_type = other RNA
tcagcaggtatgatcataatgctaatccccactgtaatggctttccacctaacaactaggaacggagaaccccatatgattgttggtatacaggaaaaagggaaatcacttttatttaaaaccgaagatggggttaatatgtgcacacttatggcaatggacttaggtgaactatgtgaagatacaattacttacaaatgtcctttactaagacagaacgaaccggaggatattgattgctggtgcaattcgacaagcacttgggtcacatatggcacttgcaccacaactggagagcacagaagagagaaaaggtcagtggctctagtaccccacgtaggaatgggtttagaaactagaaccgagacctggatgtcatctgaaggggcgtggaaacacgcgcagagaattgaaacttggatactacggcaccccggttttacaataatggcggcaatattggcatacacgattgggacaactcacttccaacgagttctaatatttattctactaacagctgtagccccaagcatgacaatgagatgcattgggataagtaaccgagattttgtagaaggagtctctggcggttcatgggtggacatagttctagaacatggatcatgtgtaaccacaatggctaaaaataaacctacattggacttcgaattaataaaaacagaagcaaaacaaccagcgacgctaagaaaatattgcatagaagccaaactcacgaacaccacaacagaaagccgttgtccaacccagggtgagccgagccttaaagaagaacaggataaaagattcgtgtgtaaacattcgatggtagatcgaggatggggaaacggttgtggtctttttggtaaaggaggaatcgtaacctgcgcgatgttcacgtgcaagaaaaatatggaaggaaaaatagtccagccagagaacctagaatacacaatagttgttacgccgcactcaggtgaggagcatgcagtagggaatgacactggaaaacacggaaaagaaataaaagtcacgccgcaatcgagcataacagaagccgagttaaccggctacggaacagtcactatggaatgtagcccaagaacggggctcgatttcaacgaaatggttctgttacaaatggaaaataaagcatggctagtccaccgccaatggtttcttgatttacccttaccttggctccctggtgcagataaacaagaaagtaactggatccaaaaagaaacattagtgacatttaagaaccctcacgctaagaagcaagatgtagtagtacttggttcgcaggaaggcgcgatgcatacagcactcacgggcgctactgaaatacaaatgtcttccggaaatcttcttttcacaggccacttaaaatgtcgacttaggatggataaattacaattaaaaggaatgagttattcaatgtgcaccggaaaattcaaagtagtaaaggaaatagcagaaacacaacatggtacaatagttatcagagttcaatatgagggtgatggttctccttgtaaaataccatttgaaattatggacctagagaaacgatatgtgttaggaagactaattacagtcaatccaatcgtcacagaaaaagacagtccagtaaacattgaagcagaacctccatttggtgatagttatattatcataggtgttgaacccggacaacttaaactgaactggttcaagaagggcagttccataggacaaatgtttgagacaaccatgaggggagccaaacgcatggcaatcttaggagacacagcttgggattttgggagtcttggtggtgtctttacttcaatcggaaaagcactacaccaggtctttggcgccatttacggcgctgcttttagcggtgtaagttggactatgaaaatactaataggcgtaataataacatggataggtatgaatagtcgttcaacttcattatcagtatcactcgtgttagtgggaatagtaacactttatttaggagtcatggtacaagcggacagtggctgcgtagtatcttggaaaaataaggaactcaagtgtggaagtggtatctttatcaccgataacgtacacacttggacagaacaatacaaattccaacctgaaagtccatcaaaactagcatcagctatacaaaaagctcaggaggaaggcatatgtggaattagatcagttaccaggttagaaaacttaatgtggaaacaaataaccccagagcttaaccacattctcgccgaaaatgaggtaaaactaactataatgaccggagatattcgtggtattatgcaagcagggaaaaggagcctacgaccgcagccaaccgagttaaagtatagttggaagacatgggggaaggcaaagatgttgtctacggagagttacaatcagacatttttaatagatggccccgaaactgcggaatgtccgaacaccaatagggcctggaactcgctagaagtggaggactatggttttggcgttttcacgactaatatatggctgaaactaaaagagaaacaagatgcattctgtgactccaaactcatgtctgcagctatcaaagacaaccgtgcagtacatgcagacatgggatattggatggaatcagctttgaatgatacttggaagatagaaaaagcatcatttattgaagtcaaaaactgtcactggccgaaaagtcatacgctgtggtcgaatggcgtcttagagtcggaaatgataatccccaagaacttagcgggacctgtaagtcaacacaactatcgtccgggatatcacacacaaattgcaggcccttggcaccttggcaaactggaaatggattttgatttttgcgacggaacgaccgtgattgttacggaagattgtggaaaccgtggtccaagcctcagaacaacaaccgcttcgggaaaactaataactgaatggtgctgcagaagttgtacgctacctccactacgttatagaggcgaagatgggtgctggtatggaatggagattcgacccctaaaagagaaagaagagaacctagtaaatagtcttgttaccgcggggcatggacaagtagataacttctcgctgggcgtacttgggatggctctatttttagaagaaatgttgcgtactagagtcggaacaaaacatgctatcttgttagtcgcagtttctttcgtaacactaataacaggcaatatgtcgtttaaggacctaggtagagtagttgtcatggttggtgctacaatggcagacgatatcggtatgggggtcacttatctagcactattagctgcatttaaagtccgaccgacattcgcagctggactacttctgaggaaactcacatcaaaagagcttatgatgacaacgatcgggatcgtgctactaagccagtctactatacctgagacagtactcgagctaacagatgcgctggcgttaggaatgatggtattgaaaatagtaagaaacatggagaaataccaattggcagtaactataatggcaattctgtgtgtgccgaatgcagtcatactacaaaacgcgtggaaagttagttgcacaatactagcagtagttagtgtttctcccttactactgacaagttcacaacagaagacggattggatcccattggcccttacgattaaaggcttgaaccctacagcgatttttctaacaactctgtcccgtactaacaagaaacgtagctggccgttaaatgaagctataatggcagtagggatggtatcaattctggcttcctcactattaaagaacgacatccccatgaccgggcctctagtggctggtggattattaaccgtctgttatgtattaactgggcgaagtgcggatctagagctcgaaagagcgacggatgtgaaatgggaagaccaagcagaaatctcaggatctagcccaatcctgtcaataacaataagtgaggacggatcaatgagtattaaaaacgaagaagaagaacaaacacttacaattctcatacggacaggattattagttatttcaggattgttccccatttcaataccaataacagcagccgcgtggtatctatgggaagttaagaaacagagagccggtgtactgtgggacgtaccttctccacctcctatgggtaaggcagaattagaagatggagcatacagaataaaacagaaaggcatcctaggatattctcagataggggcaggagtgtacaaggaaggaacttttcatactatgtggcacgtaactcgtggagccgtacttatgcataaaggaaagcggattgaaccttcatgggcagatgttaagaaagatcttatatcttatggcggtggatggaaattggagggcgagtggaaagaaggagaagaagtacaagtcttggcactagaaccgggcaaaaatcctcgagcagtacagaccaaaccaggcctatttaaaacaaatacaggaataataggagccgtcagcttggatttctctccaggcacatcgggatcacctataattgacaagaaggggaaagtagtggggttatatggaaatggcgtagtaacaagatctggagcatatgtgagtgctatagctcaaactgaaaagtctatagaggacaatccggagattgaggatgacatattcagaaagaggaggttaacaattatggaccttcaccctggtgccggcaagaccaagagatacctaccagctattgtaagagaggctataaagagaggattaagaactctgatactcgcaccaacccgcgtagtcgcggctgagatggaagaagccttgagaggtcttcctatccgctatcaaacaccagccattagagccgaacacacgggtcgcgaaatagtcgacttaatgtgtcacgctacatttacaatgcgattacttagccctgtgagagtaccgaattacaacttgattataatggatgaagctcacttcactgatccagcatcaatagcagcgcgtggttacataagtacgagagttgagatgggtgaagcagctggaattttcatgactgctacgccacctggtagtagagacccatttccccagtcaaacgcaccaataatagatgaggaacgggaaattccagaaagaagctggaacagtggacatgaatgggtaacggactttaagggaaaaacagtatggttcgtgccatcaattaaagccggcaacgatatagctgcgtgcctacgcaaaaatgggaagaaagttatacaactgtcaaggaaaacctttgacagtgagtatgtcaaaacaagaaccaacgattgggactttgtagttacgactgatatatcggagatgggagcaaactttaaagctgagagagtaatagacccaagaaggtgtatgaaaccagtaattctaacggatggagaagaacgagtaatactagcaggacctatgccagtaacacactcgtcagctgcacaaagaagaggacgaatcgggcgcaacccaaagaatgaaaatgaccaatatatttatatgggtgagccattagaaaatgacgaagactgtgcacattggaaagaggcaaaaatgctactagacaatataaacacaccagaaggtataattccatcaatgttcgaaccagaacgggaaaaagttgacgcaattgacggggaatatcggctaagaggggaagctagaaagacgtttgtggatttgatgcgaagaggggatctacccgtctggttagcatataaagtagcagcagaaggaataaattacgcggacagaagatggtgcttcgatggaattaaaaataatcaaatattagaagaaaatgtcgaggttgaaatatggacaaaagagggagaaagaaagaaactgaaaccaagatggttagatgctcgcatatatagcgatcccttagcattgaaagaatttaaagaatttgcagcaggtcgaaagagcttaactctgaacctaatcacagagatgggaagattacctacattcatgacacagaaaaccagggatgctttagacaacctagccgtcttgcacactgcggaagcaggaggtagagcatataatcatgccctatcagaattgccggaaactttggaaaccttgctcttattgacgctgttggctacagtaacaggcggaattttcttattcctaatgtcaggtaggggaattggaaaaatgaccttaggaatgtgctgcataataaccgcatcaatcctactatggtacgcacaaatccaaccgcattggatagcagcatcaataatccttgaatttttcctaattgtattacttataccagaaccagaaaaacagaggacacctcaagacaatcaattaacctatgtcgtaatagctatcttaacagttgtcgctgcaaccatggcaaacgaaatgggattcttagagaaaactaagaaagacctcggtttgggttcaatcgctactcaacaaccggaatcaaatatcctcgatatcgatttacggccagcatccgcgtggacattatatgctgttgccacaacttttgttactcccatgcttcgacactctattgaaaattcatcagtaaatgtatctctgacagcaattgctaaccaagctactgtattgatgggtttaggcaaaggatggcccctatctaaaatggacatcggcgtcccactattagcaataggatgttatagtcaagtaaacccgatcaccctgacggcagcacttctactcttagtagcacattacgctataattggaccaggacttcaggctaaagcgacgagggaagctcagaaacgtgcggctgccggcattatgaagaatccaactgtcgacggcattaccgtaattgatctagatccgattccctacgaccctaagtttgagaagcaactcggacaggtcatgttactaatattgtgcgtgacacaagtactaatgatgaggacaacctgggccctttgtgaagcgctcacgttagccactggtccaatttcaacattatgggaaggtaatcctggaagattttggaatacaactatagctgtatctatggcgaatatatttagaggaagttatttagcaggagccggactcttgtttagcattatgaaaaatacgaccaatacacgaagaggtactggaaacatcggagaaacattaggcgagaaatggaaatctcgactaaatgcgttaggtaagtcagagttccaaatttacaagaaatccggcatacaggaggtagatagaacattagcgaaagaaggtataaaacgtggagagacagatcaccatgctgtgtccaggggtagtgcaaaattaagatggttcgtagaaagaaacatggtcacgcccgaaggaaaagtcgtagatttaggatgcggcagaggaggttggagttactattgtggtggcctaaagaatgtaagagaagtaaaaggactaacaaaaggaggtcctggccatgaggaacctattccaatgagcacctatggctggaacttagtaagattacagtcgggagtagatgtattctttataccacccgaaaaatgcgatacacttctgtgcgacattggcgagtctagcccaaatccaactgttgaggccggtcgaacactacgggtcttaaacttagtagaaaattggttaaataacaacactcaattttgcattaaagttctaaatccatatatgccatcagttatagagaaaatggaagcacttcaacgtaaatacggtggtgcattagtacgaaatcctctaagtagaaattcgacacatgaaatgtactgggtcagtaatgcgagtggaaatatcgtctctagcgtaaatatgatttctcgaatgttaataaaccgttttacaatgagacataagaaagcgacatacgaacccgacgttgatctaggaagcggaacacgtaacataggtatcgagagcgaaattccgaacctggatattatagggaaaaggattgagaaaataaaacaggagcatgaaacgtcttggcattacgaccaagatcacccgtataaaacttgggcgtatcacggaagttatgagacgaaacaaaccgggtccgcctccagtatggtcaatggcgtagttcgacttttaacaaaaccttgggatgtcctccctaccgttacacaaatggccatgacagatacaacgccgttcggacaacaaagagtattcaaagaaaaggttgatacccgaactcaagaacctaaagaaggtactaagaagttgatgaagataactgctgaatggctatggaaggaacttggcaagaagaaaacaccaaggatgtgcacgagagaagaatttactcgaaaggtacgttcaaatgcggctctgggagcaatatttacagatgaaaataaatggaagtccgcacgagaagctgtcgaagattcacgattttgggaattagtagacaaagaacgtaatttgcacttagaaggtaaatgtgaaacttgtgtttacaacatgatgggaaaaagagagaagaaactaggagagtttgggaaagccaaaggatcgagagccatttggtacatgtggttaggtgctagattcctggagtttgaagctcttgggtttttaaatgaagaccactggtttagtagggagaactctctatcaggcgtggaaggagaagggctacataaacttggatacatactaagagatgtttccaaaaaggaaggtggggcaatgtatgcggacgacactgctggatgggatacgagaataacgttagaggatctcaagaacgaagaaatggtaactaaccacatggagggagagcataagaaattagctgaagcgattttcaaattaacctaccagaataaagtagtccgagtacaacgcccaactccaagaggtacagttatggatataatttctcgacgcgaccagagaggttccgggcaagttgggacttacggacttaacacattcactaatatggaagcacaattaatcagacaaatggaaggagaaggggtatttaaaaacattcagcacctcactgtaaccgaagaagtcgcagtacataattggctggcccgtgtggggagggaacgattaagcagaatggccatctctggagacgattgcgttgtgaaaccactagacgatagattcgctaatgcactgacagctctcaatgatatgggaaaaatacgcaaagatatacaacaatgggagccatcaaaaggatggaatgactggacccaagttcctttctgctcacatcacttccatgaattaataatgaaagacggtcgagttctggtagtaccctgtaggaaccaagacgaattaataggtcgtgcaagaattagtcaaggagcgggctggagcttacgagaaactgcttgcttaggaaagagctatgcacaaatgtggagtctaatgtactttcacaggcgagacctcaggttagcggcgaatgcaatttgttctgcagtgccctcccattgggttccaacttcacgaacaacctggtccatacatgcaaagcatgagtggatgaccacggaagatatgttaactgtatggaacagagtatggattagagaaaatccatggatggaggataagacgcccgttgaatcctgggaggaaattccctacttaggcaaacgtgaagaccaatggtgtggcagtttaataggactaaccagccgggcaacatgggccaaaaatatccaagccgcaattaatcaagtgaggagtttaattggaaacgaagaatatacagactatatgccatcaatgaaacgctttcggagggaagaggaggaagcaggggtactatggtaa

SEQ ID NO: 22788 - RNA, 9876 nt, synthetic construct
  misc_feature 1..9876: note = derived and/or modified CDS sequence (opt6) from DENV-2__EU482473__SS-prME
  source 1..9876: mol_type = other RNA
agtgcaggtatgattataatgttaattccgactgtaatggcatttcatttgaccaccagaaatggagaaccacatatgatagtaggaatacaagaaaaaggaaaatcactgctatttaaaacagaagacggtgtgaatatgtgcacactgatggcaatggacctaggtgaattatgtgaagacactataacatacaaatgcccattgcttcgacaaaacgaacctgaagacatagattgttggtgcaattcaacctcaacttgggtaacatatggcacatgtactacaaccggtgaacatagacgggaaaaacgttcagtggcgttagtacctcatgtcgggatgggactcgaaactagaacagaaacatggatgagctcagaaggtgcatggaaacatgcacaaagaatagaaacgtggatattaagacacccgggattcacaataatggcagcgatactggcatatacaataggcaccactcatttccaacgggttctcatatttatccttttaacggctgtcgctcctagcatgacaatgcgttgcataggtatttctaacagggattttgtagaaggtgtttctggcggctcatgggtcgacatcgtcctcgaacacggatcctgcgtaaccacaatggcgaaaaacaaaccgacactagattttgagttaattaaaactgaggcaaaacaaccagctactttacgcaaatattgtatagaagcgaagttgacgaatacaacaactgaatcaagatgtcctactcaaggggaaccatctttaaaggaagaacaagataaacgatttgtatgtaaacattcgatggtagatcgaggttggggtaacggctgtgggttattcggaaagggcggaatagtcacatgtgccatgtttacatgcaagaaaaatatggagggaaaaatcgttcagccagagaatctagaatatacaatcgtagttacgccacatagcggtgaggaacacgcagtaggcaacgatactggaaagcatggtcaagagataaaagtgacaccacaaagttcaatcactgaagctgagctaactggatacggtactgtgacaatggagtgttctccaagaacaggtttggattttaacgaaatggtattgttacaaatggaaaataaggcatggctagtgcacagacaatggtttttagatttacccctgccatggctgccgggagctgacaagcaagaatcaaattggatccaaaaggagacgctagttacctttaaaaatcctcatgcaaagaaacaggacgtagtagtgttaggatctcaggaaggagcaatgcataccgctttaacaggagccacggagattcaaatgtcttccggaaacttactgttcactgggcacttgaaatgcagattacgcatggataaacttcaattgaaaggaatgtcgtactcaatgtgcacgggtaagttcaaagtagtgaaagaaatagcagaaacccaacacggaaccatcgtaatacgtgtacaatatgaaggcgacgggagtccatgtaaaataccgttcgaaataatggatttagagaaaagatatgtactaggcagactgataacagttaatcctattgtgaccgaaaaggattcaccggtaaacatcgaagcagaacctccgtttggagacagctacattataataggtgtagaaccagggcaactaaaattaaactggttcaagaaaggatcatctatcgggcagatgttcgaaactacgatgaggggagcaaaaagaatggcaattctcggtgacacggcatgggatttcggctctctaggtggagtattcacgtcgataggaaaggcgctacatcaggtttttggcgctatatatggagccgccttttctggtgtatcatggacgatgaagatattaataggagtcataattacatggataggaatgaactctcgatcaacaagtctaagcgtatccttagttcttgtaggaatagtaacactatatttaggagttatggtacaagctgactctgggtgtgttgtaagctggaaaaataaagaactaaaatgtgggtctgggattttcataaccgataatgtacatacttggaccgaacaatacaagttccaaccagaaagccctagtaagctcgcgtctgcaatacaaaaagcgcaggaggaaggaatctgtggaatacgatccgttacgagactggaaaacttaatgtggaagcaaatcacaccagaactgaatcacatattagcagaaaatgaggtgaagctgactataatgactggcgatattaaagggataatgcaagctggtaaaaggtcacttcggccccaaccaacagaattaaagtacagctggaaaacatggggaaaagccaagatgctaagcacagagtcatataatcagacgttcttaatcgatgggcctgaaacagctgagtgccctaatacaaacagagcttggaatagcttggaagttgaggattacggattcggtgtatttacaactaatatttggttaaaactaaaggaaaaacaagatgctttttgcgactcaaaactaatgagtgctgcgataaaagataaccgtgcggttcatgccgacatggggtattggatagagtcagcattaaatgatacgtggaaaatcgaaaaagccagctttatagaggtcaaaaactgtcattggccaaagagtcacacactgtggtcaaacggtgtactcgaatccgaaatgattattccgaaaaaccttgctggaccagtctcacaacacaattatagaccaggatatcacacgcagatagcgggcccgtggcatcttggaaaactagaaatggactttgatttctgcgatggaactacagttattgttactgaagattgtggcaatcgagggcctagcctaaggacgacaacggcatcaggtaaattgattacggaatggtgttgtagatcgtgtactttaccaccgctacgctaccggggagaagatggttgctggtatggtatggaaataagaccgttgaaagagaaggaagaaaacctcgtcaactcacttgtaacagcaggacatggccaggttgacaatttttcattgggagtattgggaatggcactatttttggaagaaatgctacgtactcgtgtgggaactaaacatgcaatactactggtggcggtaagtttcgtaaccctgattaccggtaatatgagcttcaaagacttaggtcgagtcgtagtcatggttggagcgacgatggccgatgatatcggtatgggggttacttatctagccttacttgcagcgtttaaggtacgcccaaccttcgcagcaggtttacttctgagaaagctgacctctaaagaattaatgatgacgaccataggcattgtactactcagtcaaagcaccattcctgaaacagtactcgagttaacagatgccttggcattagggatgatggtccttaagatagtaaggaacatggaaaaataccaattagcagttacaataatggctatcctctgtgtcccaaacgcggtaatcctccaaaacgcatggaaggtatcatgtacgatactggcggtcgttagcgtatccccactcttactaacgtctagccaacagaaaacagattggatcccattagctctaacgatcaaaggtctaaatccgaccgccattttcctaaccactttatcgaggactaataagaaaagaagttggcccctgaacgaagcaattatggctgtaggaatggtttcgattcttgcttcttcattacttaaaaatgacatccccatgacgggccctcttgtggcagggggtctactaaccgtatgttatgtattgactggaagaagcgcagatctagaactggaacgcgctaccgatgtaaaatgggaagatcaagctgagatttcgggatcaagtccaatactatcgattacaatatcagaagatggtagcatgtctatcaaaaatgaagaagaggaacagacgttaaccattttaataaggacggggctcttagtgatcagtggtctattccctatttctatacctataacagcagcagcttggtatctttgggaagtaaagaaacaaagagcaggcgtactttgggacgttcccagtcctcccccaatggggaaggctgaactggaagatggggcatatagaataaaacaaaagggaatacttggatattcccaaataggggcgggagtttataaggaaggaactttccatactatgtggcacgttacacgaggagccgttttaatgcacaaaggaaaaagaatagaaccatcctgggctgatgtcaagaaagaccttatctcttatggaggtggttggaaactagagggagaatggaaagaaggagaagaggtacaggttttagctctagaacccggcaagaatcccagggccgttcaaactaaacccggattgtttaaaacaaatacaggtacaattggtgctgtatcattagatttcagtccagggacgagtggttcccccatcattgataggaaaggaaaagtagtcgggctatacggaaatggagttgtcaccagatccggggcatacgtgtctgcaatagcccaaaccgagaaaagcatagaggacaaccctgaaatagaagatgatatatttaggaaaagaagattaaccatcatggatttgcatcctggagcgggtaagacgaaaagatatttaccagctattgtacgggaagcaattaaaagaggtcttagaacccttatcctagctccaacacgtgtggtagcggcagagatggaagaggccctaaggggactacctattcggtatcaaacccctgctattagggcagaacatacgggaagagaaatagtcgatctgatgtgccacgcaacgttcactatgcgactgctctcaccggttcgagtacccaactataacctaataataatggacgaagcccattttactgatcctgcgtcaatagcagcacgtgggtacatatcaaccagagtcgaaatgggagaagcagccgggatattcatgactgcaacaccaccaggaagccgcgatcctttcccacaatcaaatgccccgataatagatgaagagagggaaatcccggaacgttcgtggaactcaggtcatgaatgggtgaccgatttcaaaggaaagaccgtatggttcgtaccatcaataaaggcgggcaacgatattgcggcctgtttgcgaaagaacggcaagaaagtcatacaacttagcagaaaaacattcgattcagaatatgtaaagacacgaacaaacgattgggactttgtggttactacggacataagtgaaatgggggccaactttaaagcagagcgagtcatcgaccctaggagatgtatgaaacccgttattttaactgatggagaggaacgagttatactcgccggacctatgccagtaacacatagctcagcagcccaaagaagaggtagaataggtcggaaccctaaaaatgagaatgaccaatacatatacatgggagagcccttagagaacgatgaagattgcgcccattggaaagaagcaaaaatgctcttagacaatataaatactccagaaggcataattccatcaatgtttgaaccagaacgcgaaaaagtagacgctattgatggcgaatatcgtttgcgcggagaagcccgtaagacattcgtcgatctcatgagacgaggagatttacccgtatggcttgcctataaggttgctgcggaaggtattaactatgcagacaggagatggtgtttcgatggaatcaaaaacaatcaaatactcgaagaaaacgtggaagtagaaatttggactaaggaaggagaacgcaagaaattaaagcccagatggcttgacgcaagaatttacagtgaccccctggcactaaaagaatttaaagaatttgcggcgggaagaaaatccttaacgctaaatttaattacggagatgggaagacttccaacctttatgacacagaaaacaagagacgcactggataatcttgcagtacttcatactgccgaagcgggtgggcgagcgtataaccacgccctgagtgaactacctgagactctggaaacattactgttactaacgctattggctactgtaacagggggaatatttctgttcttaatgtcgggacgaggaattgggaaaatgactttaggaatgtgctgcataataacagcgagtatcctactttggtatgcccaaatacaacctcattggatagcggcttccataatcttagaatttttcttaattgtactcctaattccagagcctgaaaaacaaagaacaccacaagacaatcaattaacatacgttgtcatagcaatattgacagtagttgccgctacaatggcaaacgaaatgggattcttagagaaaactaagaaagatctcggcttggggtcgatcgcaacgcagcagccagagtcaaatatactagacatcgacttgagacccgccagtgcgtggacactttatgctgtcgcaacaacatttgttacccccatgctgagacattctatcgaaaactctagcgtcaatgtgtcactcactgcaatagcgaatcaagcaaccgtacttatgggcctaggaaaaggatggcccttgtcaaagatggatattggagttccacttttagccatagggtgttacagtcaagtaaatcccataacattgacagctgcactgttgctcttagtagctcattatgctataattggcccaggactacaagcgaaagcaacaagagaggcccaaaagcgagctgcagccggaattatgaaaaatccgacagtagacggaataacagtaatagacttagatccaatcccttatgatcccaagtttgaaaaacagctcggacaagtaatgttactcattttatgtgttacacaagttctaatgatgagaactacgtgggccttatgcgaggctttgacgcttgcaactggtccaatatcaacgctatgggagggtaatccaggtcgtttctggaacaccactatagccgttagtatggccaacatatttagaggatcatatctagcgggtgcgggactattatttagtataatgaaaaacactacaaatacaagacgaggaacgggaaacatgggagaaacattgggcgagaagtggaagtcacgactgaatgcgcttggaaaaagcgagtttcagatatataagaaaagcggcattcaagaagtcgacaggacacttgctaaagaaggaattaaaagaggtgaaacggaccatcatgctgtttcaagaggctcagccaaattacgatggttcgtggaaagaaatatggtgacacccgaaggaaaagtagtagatctaggctgtggacgtggaggttggtcatattattgcggtggcttgaaaaatgtgagagaagtgaaaggactaacaaaaggtgggccaggacatgaagaacctatacccatgagcacttacggatggaatttagtaagactacaaagcggcgtagacgttttctttatcccaccagaaaaatgtgatacacttctttgtgacattggcgaatcttcaccaaatccaacagtcgaagcagggagaaccctgagggttcttaacttagtagaaaactggttaaacaataatacacaattctgcataaaagtcctgaatccatacatgccttcagttatcgagaaaatggaagcattacaacgtaaatacggaggagcgctagttcgaaaccctctcagccgtaacagtactcacgaaatgtattgggtgagcaatgctagtgggaacatagtatcatcagttaatatgatatcacgcatgttaattaatcggttcacaatgcgtcataagaaagcaacttatgaaccggatgtggatctgggctcggggacaagaaacatagggatagaatctgagacaccgaatttggacataatcggaaaacgaatagagaaaataaaacaggaacatgaaacgtcatggcactatgatcaggatcatccatacaaaacatgggcataccacggtagttacgaaacaaaacaaacaggatcagccagcagtatggtcaatggtgtagtaaggctactaaccaaaccatgggatgtactaccgaccgttacacaaatggcaatgaccgatacaacgcctttcggccaacagagggtttttaaagaaaaagtagacacaagaacacaagaaccgaaggaagggaccaaaaagctaatgaagataacggctgagtggctatggaaagaactaggtaaaaagaaaaccccgcgcatgtgtactagagaagagttcacccgtaaagtaagaagtaatgcagccctcggagcaatctttactgatgaaaataaatggaaatcagcgagagaagccgttgaggactcaagattttgggagttagttgacaaagaaaggaacttgcacctggaaggtaagtgcgagacttgtgtttataatatgatgggaaagagggaaaagaaactaggagagttcggcaaggccaaagggtcgcgagcaatctggtacatgtggctaggggcacgctttcttgagttcgaagctcttggatttttaaatgaagatcattggttctccagagagaacagtctttctggggtagagggagaggggcttcataaacttggatacattttaagagatgtaagtaagaaagaaggcggggcgatgtatgctgacgacaccgcaggctgggatacacgaataacacttgaagatcttaaaaatgaagaaatggtaacaaaccacatggaaggcgaacataagaaactagcggaagcaattttcaaacttacatatcagaataaagtggtacgtgtgcaaagaccgacaccacggggaacagtgatggatatcatatctaggagagatcaaagagggtcaggacaagtaggaacatacgggttaaataccttcacaaatatggaagcccagttaataagacaaatggaaggggagggagtgttcaaaaatattcaacatttaacggtcacagaggaagtcgcagttcaaaactggctcgcgagagtaggacgcgaaaggctctctcgaatggcgataagtggggatgactgcgtagttaaacccttagatgatagatttgcaaatgcattaacagccctgaacgatatgggaaagatcagaaaggacatacaacaatgggaaccctcaaaaggttggaacgattggacccaagtgccgttctgttcacaccacttccatgaactcataatgaaagacggcagggtgctagttgtcccctgcagaaaccaggatgaactaataggccgtgctcgtatctcacaaggagcgggatggagtttaagagaaacagcttgtctaggcaaatcttacgcgcaaatgtggtcccttatgtactttcatagacgtgatttgcgactagcggcaaatgcaatatgttctgcggtccccagccattgggtaccgacatcccgcacgacgtggtcaatacatgcaaaacatgaatggatgacaactgaagacatgttgacagtctggaatcgggtatggataagagaaaatccatggatggaagataaaacgccagttgagagttgggaagagataccgtatctaggcaaaagagaggaccaatggtgtggttcattgatagggttgacctcaagggcaacatgggccaaaaatattcaggtggcaattaaccaagttaggagtcttattggaaatgaagaatatacagattacatgcctagcatgaagcgattccgtcgtgaagaagaggaagctggtgtactatggtaa

SEQ ID NO: 22789 - RNA, 9876 nt, synthetic construct
  misc_feature 1..9876: note = derived and/or modified CDS sequence (opt6) from DENV-2__EU482474__SS-prME
  source 1..9876: mol_type = other RNA
tcagcaggtatgataataatgcttataccaacagtaatggctttccatcttacaactaggaacggtgaaccacacatgattgtggggattcaagaaaaagggaaatcgttactattcaaaactgaagatggagtaaatatgtgtacgttaatggcaatggatttgggtgaattatgcgaagatacaataacttacaaatgccctctgcttagacaaaatgaaccagaagacattgactgttggtgtaactctacatcaacgtgggtaacctacggcacatgtactaccacaggagagcacaggagagaaaaacgaagtgtggcattagtgccgcatgttggaatggggttagaaactagaacagaaacatggatgtcctcagaaggtgcgtggaaacatgcgcaacgaattgaaacatggatactccgacacccaggatttaccataatggctgccattttagcttatactataggaaccacacactttcaacgcgttttaatttttattttactcactgcagttgctccgagtatgacaatgagatgcataggtatatcaaatagggacttcgtagagggtgtgtccggtggcagttgggttgacatagtgctggaacacgggagttgcgtgactactatggccaaaaataaaccaacactagacttcgaactcataaaaaccgaggctaaacaaccggcaacgctacgaaaatactgtatcgaagcaaaattaactaatacgacaacagaatcccgatgcccgacgcaaggtgaacctagtttgaaagaagaacaagataaaagattcgtttgcaaacatagcatggtagaccgtggttggggaaacggttgcggactgtttggcaaaggagggattgtcacgtgtgctatgtttacatgtaagaaaaatatggaaggtaaaatagttcaacccgaaaatctagaatatacaattgtggtgactcctcatagcggcgaagaacatgccgtaggcaatgataccggcaaacatggtaaagagattaaagttactcctcagagttcaattaccgaggcagaactgacaggttatggaacagtgactatggaatgttcacctaggactggactcgatttcaatgaaatggttttattacaaatggaaaataaagcatggttagtacatcgacaatggttcctagatttgcccctaccttggttacctggagcggacaaacaggagtctaattggatacaaaaggaaacgcttgtaacattcaaaaacccacatgcaaagaaacaagacgttgtggtgttaggttcacaagaaggggcaatgcacacggcgctgactggggcaacggaaatacaaatgagttcagggaatcttttgtttacaggacatcttaaatgcagactcagaatggacaaactacagttaaaaggaatgtcctacagcatgtgtactggaaaatttaaagtagtgaaagaaattgctgagactcaacatggcacgatagtcataagagttcaatacgaaggagacgggtcaccttgcaaaatacccttcgaaatcatggatctagaaaaacgatatgttctaggtagactgattacagttaaccctattgtcactgaaaaagacagtcctattaacattgaggcagaaccaccttttggagactcctacataataattggagttgaacctggtcaattaaagttgaattggtttaagaaaggctctagtataggtcaaatgttcgaaactacaatgagaggtgcaaagcggatggctatattgggagacactgcttgggattttgggtcattgggaggagtatttacctcaattgggaaggcactccatcaagtttttggagcaatttatggcgctgcatttagcggcgtttcttggacaatgaaaattttaatcggagttattataacttggataggcatgaacagccgcagcacgagtctatcggtgtccttagtcttagtaggcattgtcacactctacctaggtgtaatggtacaagcagactcaggttgcgtcgtctcatggaagaataaggagttaaaatgtgggtctggcatcttcattacggataatgttcacacgtggacagagcaatataagtttcagcccgagtcacccagcaaattggcatccgccattcaaaaagcacaagaagaaggcatatgcggtattcgatcagtaactaggctcgagaatctcatgtggaaacagatcactccggaattaaaccatatattggcggaaaacgaagtcaaattgacaataatgactggagatataaaaggaataatgcaagccggaaagaggtctcttaggccacaacctacagagttaaaatattcatggaagacatgggggaaagccaaaatgctaagtacagaaagccacaatcaaactttcctaattgatgggccggagacggcagaatgtcccaacacgaatcgggcctggaactctctagaagtagaagactatgggtttggagtcttcacaacaaatatttggctacgtttaaaagagaaacaagatgccttttgtgacagtaaactcatgagtgcagcaattaaagataatcgcgccgtccatgcggatatgggttactggattgaatcagccctaaacgacacctggaaaatagaaaaagccagctttatagaggtcaaaaactgccactggccgaagtcacatactctgtggtctaacggagttttagagtctgaaatgattatacccaaaaacctagccggaccagtttcccaacataattacagacccggatatcatacacagatagccggcccttggcatttaggaaagttagaaatggatttcgatttttgtgacggcacaacagtcattgtaacagaggattgtgggaatagaggaccaagtttacgtaccacgaccgcatctggaaaacttataacagaatggtgctgtagatcatgtactttaccaccactcagatatcgaggagaagatggctgttggtatggcatggagatacgaccgttgaaagagaaagaagaaaatttggtgaactcactggtaacagccgggcacgggcaagttgataactttagcttaggcgttttgggaatggcattattcttagaagagatgctgagaacaagagtaggaacaaaacatgctatactattagtagcagtcagctttgtaacattaatcacgggtaacatgagcttcaaggaccttggaagggtggtggttatggtaggggcaacgatggccgatgatataggaatgggggtaacatatcttgccctattagcagcattcaaagttcgaccaacttttgcagcaggacttctattgcggaagttaacctctaaggaactaatgatgactactattggaatcgttctactatctcagagcacaatcccagaaactgttctggagctcaccgatgcacttgctttaggaatgatggtactaaaaattgtaaggaatatggaaaaatatcaacttgcagtaaccataatggcaatattgtgtgtaccaaacgcagtaatattacagaatgcctggaaggtgagttgtacaattttagctgttgtctccgttagtcctttactgttaacatctagccaacagaaaacagattggataccacttgcattaactataaaaggattaaatccaacggcaatcttcttaactactttaagtcgtacaaacaagaaacgcagttggccattaaatgaagccatcatggccgtaggtatggtaagtatattagcatcgtcgcttctaaagaatgatattccgatgactggaccactcgttgccggaggattacttaccgtctgctatgttctaacaggaaggtcggcagatctagaattagaacgagctactgatgtgaaatgggaagaccaagcagaaatttctggatcatcacctatactatcaataacgatatcagaagatggttcaatgagcatcaaaaatgaagaagaagaacaaacactaactatattaataaggactggtttactcgttatatctggactatttccgatcagcattcccattacggctgctgcgtggtatctatgggaagttaaaaagcaacgcgcaggagtcttatgggacgtaccatccccgccacctatggggaaagctgaattagaggacggagcctatagaataaaacaaaaaggcatactagggtactcacagataggagctggtgtatacaaagaaggaacgtttcacacaatgtggcatgttaccagaggtgcagtacttatgcataaaggaaaaagaatagagccatcttgggctgacgtgaaaaaggatttaataagttacggaggaggctggaaactagaaggtgagtggaaggaaggggaagaagtccaagtcttggccttagaaccaggcaaaaacccacgcgctgtacaaaccaaacctgggttgtttaaaacgaatactgggaccattggcgccgtgagtctagactttagtcctggcacttctggatccccgataatagataagaaaggaaaagtggtgggcttgtatggaaacggagttgtcaccaggagtggggcatatgttagtgcaattgctcagactgagaaatcgatagaagataacccagaaatagaagatgacattttccgtaagagaaggttaacaataatggatttgcatccaggcgcgggcaaaaccaaaaggtacttaccggcgatcgtaagggaagctataaagagaggcctacgaaccctcattttggctccaactagagtagtagctgccgagatggaagaagccttaagaggactaccaataagataccaaacaccagcaatacgagcggaacatacaggacgagaaatagtggatttgatgtgccatgcaacatttacaatgaggctactttctccggtacgagtgcctaactataacctgattataatggacgaagcccatttcacagatcccgccagcatagccgcaagaggctatatttctactagggtagaaatgggggaggcagctgggatatttatgacagcaacacccccaggttcccgagacccatttccacaaagcaacgcacccataatagacgaagaaagagaaattccagagagatcctggaatagtggtcatgaatgggtgacagactttaaaggaaaaacagtatggtttgtaccttctattaaagcgggtaacgatattgctgcttgcttacgcaagaacggcaagaaagttatacaactttcaagaaaaacctttgattcagaatacgttaaaacccgaacaaatgattgggactttgtggtaacaacggatatttcagaaatgggcgcaaactttaaagcagaacgtgtgatagatccaaggagatgcatgaaaccagttatactaacagacggagaagaacgagtaatcttagcaggaccgatgccggtaacacattcaagtgcagcccaaagaagagggagaatcggaagaaatcccaaaaatgaaaatgatcaatatatctatatgggagaaccattagagaatgacgaagattgcgcccattggaaagaagccaaaatgctacttgacaacattaataccccagagggaatcatcccatccatgtttgaaccggaacgagaaaaggtcgatgcagtggacggggaatacagactaagaggggaagctcgtaagacatttgtagacttaatgcgccgcggagatctacccgtctggttggcatacaaagtcgctgcggaaggaatcaattacgccgatagacgttggtgctttgacgggatcaaaaacaatcagattttagaagaaaatgtggaggttgaaatctggacaaaagaaggcgaacgtaagaagctcaaaccaagatggctggatgctagaatctactcagacccgttagctttaaaagagtttaaagaatttgctgcgggcagaaagtcgctaacattgaatcttataacagagatgggacgtctcccgacgttcatgacacagaaaaccagagacgcattagacaatctcgccgtgctgcacaccgcggaggcgggaggcagagcatacaatcatgccttatctgagctgcctgaaacgttagaaacgttgttactcctcacacttttagccacagtcacaggcggcatattcttgttcctaatgagcggtcgcgggataggaaaaatgacactgggaatgtgttgtatagttacagcttcaatcctactatggtacgcacaaattcagccgcattggattgcagcctcgataatattagagttcttcttaattgttctattgatcccagaacccgaaaaacaacgcaccccacaggataatcagttaacttatgttgtgatcgcaattttaacagtggtggccgcaacaatggcaaatgaaatgggatttctggagaagacgaaaaaggatctgggtctaggatcaatagcgacgcaacagccagaaagcaatatactggacatcgacctaaggccagcctcagcatggactctttatgctgtcgctacgacattcgtaactcccatgctccgccactcaatcgaaaattctagtgtgaatgttagtctgacagccatagctaatcaagccacagtactgatgggattaggcaaagggtggccattgtcaaagatggacataggagttccactgttagcgataggatgctattcccaggtgaatccaataacactaacagcggcattattacttttagttgcgcactatgcaattataggacccggactacaagccaaggcgacgagagaagcacaaaaacgagctgccgcaggaattatgaaaaatcctacagtcgacggtatcacagttattgacctggatcccatcccctacgacccaaaattcgagaaacaactagggcaagttatgctattaatactatgtgtaacacaggtattgatgatgcgtacaacctgggctctatgtgaagcattgacactagccacaggccccatctcaaccctttgggaaggtaatcctggtcgattttggaataccacgatagccgtgtctatggctaacatttttcgtggttcatacctggccggtgcaggactactattttctatcatgaaaaatactactaatactagacgaggtactgggaacatgggcgaaaccttaggggagaaatggaaaagtagacttaacgcacttggaaaatcagaatttcaaatctataaaaagagtggtatacaagaagtagacagaacattagccaaagaagggataaagagaggggaaaccgatcaccacgctgtgtcgaggggctctgccaagctaagatggtttgtcgaaagaaatatggtaacccctgaaggaaaggtagtggatttaggatgcggtaggggagggtggtcgtattattgtggaggcctaaagaatgtgcgagaagtgaaagggctaacgaaagggggacctggccacgaagaacccataccaatgtccacatatgggtggaatcttgtacggttacaatcgggagtagacgtgttctttattcccccggagaaatgcgataccttactttgtgatataggagaaagctccccaaacccgacggtagaagcaggtcggactttaagagtcctcaatcttgtggagaattggctcaataataacacacagttctgcataaaagtgttaaacccgtatatgccctcagttattgagaaaatggaagcactacaacgcaagtacggtggagcattggttcgcaatccactcagcagaaacagtactcatgaaatgtattgggtctccaatgcatctggtaacatagttagtagtgtaaatatgatatctagaatgctcataaacaggttcaccatgagacacaagaaagccacctatgagccagatgtagatttaggctcaggtacaagaaatatcggaattgaatcagaaattcccaaccttgatatcataggaaaacggatagagaaaataaaacaggaacacgagacatcatggcattatgaccaagatcatccttataagacttgggcttaccatgggagctatgaaacaaaacaaactggtagtgcatcatcaatggtgaatggagtggttagattattaacaaagccttgggatgtcttaccaacagtgacccaaatggcaatgaccgatacgactccatttgggcagcagagagtatttaaggaaaaagttgacacaaggactcaagaaccgaaagagggcactaagaagttaatgaaaatcactgccgaatggctctggaaagaattaggcaagaagaaaacccccaggatgtgcacgagggaggagttcacaagaaaagttagatctaatgcggccctgggtgccatatttacagacgaaaacaaatggaagagtgcgcgagaagcagttgaagattcaaggttctgggagctagtggataaagaaagaaacttacatctagaaggaaaatgtgagacatgtgtctacaatatgatgggtaaaagagaaaagaagttaggggagttcggtaaagcaaaaggaagtagagcaatatggtacatgtggttgggcgcaagatttcttgagttcgaagccttaggatttttaaatgaagatcactggttctcacgtgaaaattccctatctggagtagagggagagggactccacaaactcggttacatactacgtgatgtcagcaaaaaggaaggaggggcgatgtacgcagatgatacagcgggatgggacactagaataacattggaggatcttaaaaacgaggaaatggtcaccaatcacatggagggggaacataagaaattagcagaagccatattcaaattaacataccagaacaaagtagttagagtgcaaagaccaacgccacgaggaacggtaatggatataatatcaaggagagatcaaagaggaagtggacaagttggaacgtatggcttgaatacttttacaaatatggaagctcaactcatccggcaaatggagggtgaaggagtctttaaaaatattcaacatctaacagtaacggaagaggtggctgtccaaaattggcttgctagagttggtagagaacgtttaagccgaatggccataagcggagacgattgtgtcgtaaaacctttagacgatagatttgccaatgctctaactgcattaaacgatatgggtaagataagaaaagatatacagcaatgggaaccgtcaaagggctggaacgactggacacaagttccattctgtagccatcatttccacgagttaattatgaaggacgggcgcgttttagtcgtgccctgtcgcaatcaggatgaactgatagggcgtgccagaatatcacagggagcaggttggtcgttaagggaaacggcttgtctggggaaaagctacgcgcagatgtggagcttgatgtattttcacagaagggacctccgattagcagctaatgcaatatgttccgctgtaccatcccactgggttcctacaagtagaaccacatggagtatacacgcgaaacatgagtggatgacaacagaggacatgctgaccgtgtggaatcgagtgtggatacgcgaaaatccttggatggaagataaaacacctgtagaaagttgggaagagataccatatttaggaaaacgagaagaccaatggtgcggatcattaataggattgacgtcacgggctacatgggccaaaaatatacaagctgcaataaaccaagtcagatcgttaattggtaatgaggaatacactgattacatgccatctatgaagcgttttcgcagggaggaagaagaggcaggagtattatggtaa

SEQ ID NO: 22790 - RNA, 9876 nt, synthetic construct
  misc_feature 1..9876: note = derived and/or modified CDS sequence (opt6) from DENV-2__EU482475__SS-prME
  source 1..9876: mol_type = other RNA
agcgctggcatgataataatgttaattcctacggtaatggcgtttcacttgaccactcgaaacggagaaccacatatgattgtcggtattcaagaaaaaggcaaatccttgctgtttaaaacagaagacggtgttaatatgtgtacgctaatggcgatggacttaggagaattatgcgaagatacaataacctacaaatgtcctttattaagacaaaatgaacctgaagatatagactgttggtgtaattcaacatcgacatgggtcacgtatggaacctgtacaaccactggagaacatcgtagagagaaaagatcagtggcgctcgtaccgcatgtaggcatgggtttagaaactagaacggaaacgtggatgtcctctgaaggggcgtggaaacatgcgcaacgaatagaaacttggattctaagacacccaggcttcacgataatggcagcaatactagcttacacaatcggaactactcattttcaacgggttcttatattcatcctcctaactgctgtagcaccatcaatgactatgagatgcataggaataagcaatagagattttgtagaaggtgtctccgggggatcatgggtcgatatcgttttagaacatggctcctgtgtgacaactatggctaaaaataaacctacactagatttcgaattaataaaaacagaagcaaaacaaccagcaactctgagaaaatattgcatagaggcgaaactcacgaatacaacaaccgaatcacggtgtccaactcaaggtgagccatctctaaaagaggaacaagacaaaagatttgtatgtaaacattcaatggtggacagaggatggggaaacggatgtgggctttttggtaaaggaggtatagtaacatgtgctatgtttacctgcaaaaagaatatggagggtaaaatcgtccaaccagagaatctggaatatactatagtagtcacacctcattcaggggaagaacatgcagtaggaaatgacacaggcaaacatgggaaggagataaaggtcaccccacaatcaagcatcacagaagcagaattaacaggttatggcacagtaaccatggaatgcagcccacgaacgggactcgactttaatgaaatggttcttctccagatggaaaacaaagcatggttggtccacagacaatggtttttggatttgcccttaccctggctaccaggagcggacaaacaagaaagtaattggatccaaaaagaaaccttggtaacatttaaaaatcctcacgccaagaaacaagatgtagttgtcttaggcagtcaagagggagcaatgcacactgcactaactggagcaacagaaatacaaatgtcatcgggtaatctactcttcacggggcatttaaagtgtagattgagaatggataaattgcaattgaaaggtatgagctactcaatgtgcaccggtaaatttaaagtagttaaagaaatcgcagaaacacaacatgggacgattgttattcgtgttcagtatgaaggtgatggatctccgtgtaagatcccgttcgaaattatggacctcgaaaaacgatatgttctaggacggttgatcacagtaaatccaatagtaacggaaaaagatagtcctgtcaatattgaggcagagcctccctttggagactcatatataataatcggggtagaaccgggacaactcaaactcaattggtttaagaaaggatctagtataggccagatgttcgaaaccacaatgcgtggagccaaacgcatggccattttaggggacacagcatgggactttggctcattaggtggtgtgtttacctccatcggtaaagccttacatcaagtattcggtgccatatatggggcagcattttcgggggtatcatggacaatgaaaattcttataggagtcataattacatggataggaatgaatagcagatcaacaagtttatctgtatctttagtattagtaggtattgtcacgttgtacttgggtgtgatggtacaagcagacagcggttgtgtggtgtcctggaaaaataaggaactaaaatgtggcagtggaatattcattacggataatgtgcatacgtggaccgagcaatataaattccagccagaaagtccttcaaagctggcatcagcaatccaaaaagctcaagaagaggggatatgcggcatcagaagcgttactagacttgaaaacttaatgtggaaacagataacccctgaactaaaccatatacttgcagaaaatgaggtaaaattaactatcatgacaggtgacattaaaggtattatgcaagctggtaaaaggagtcttaggccccaaccaacagaacttaaatattcctggaagacatggggaaaagctaaaatgctatcaactgaaagttacaatcaaaccttcctcattgacggcccagagaccgccgagtgtccaaatacaaatcgtgcatggaacagtttagaggtagaagactacggattcggcgtctttacaacaaatatctggcttaaattaaaagaaaaacaagacgcgttttgcgatagtaaacttatgagtgcggctataaaggacaatcgggctgtacatgcagacatgggctattggattgaatctgcactaaatgatacatggaaaatagaaaaggcttcatttatcgaagtcaaaaattgccattggccgaaatcccatacgctgtggagtaatggcgtactagaatccgaaatgataatacccaaaaatttggccggcccagttagtcaacacaactatagaccaggctatcatacacaaatcgcaggtccatggcatttgggcaaattggagatggatttcgacttttgcgatggaacaactgtaatcgtaaccgaagactgtggcaacagaggaccaagtctacgtacaacaacagcaagtggaaaactaataacagaatggtgttgtcgaagctgcacattgcccccattaagatacaggggagaagatggttgctggtatggaatggagataagacctcttaaagaaaaggaagaaaacttggtcaacagcctggtgacagcaggacacggccaagtggataattttagtctgggtgtattgggaatggcgttattcctagaagaaatgttgagaacacgggttggtacaaaacacgcaatactgttggtagcagtctccttcgtaacattgataacagggaacatgtcctttaaagatttaggaagagtagtagtcatggtaggggcaacgatggccgacgatatcgggatgggagtcacatatttagccctcttggctgcatttaaggttcgaccaacattcgcggcagggttactattaagaaaattgacatctaaagaactaatgatgacaacaattgggatagttctcctgtcacagtcgacgatcccagaaactgtacttgaactaacggatgcactggctttaggtatgatggttttaaagatagtacgaaacatggagaaatatcaactagctgtaacaataatggcaattttgtgtgttcccaatgcagtaattctacaaaacgcatggaaggtttcttgcacaatacttgccgtagtgagcgtttctcccttattattgacatcatcccaacagaaaactgattggataccgttagcactaactataaaaggacttaaccctacagccatttttcttactacattgtctagaacaaataagaaaagatcatggccgcttaacgaggcgataatggcagtaggaatggtatctatactagcatctagcctacttaaaaacgacatacctatgacaggaccccttgttgcaggaggtctccttaccgtatgttacgtgcttacggggcgatcagcggatttagaactagaacgtgcaacagatgttaaatgggaagatcaggctgagataagtggcagctcgccaatattaagtataactatatcggaagatggaagcatgtccatcaaaaatgaggaggaagaacaaactcttacgatactaatacgaacaggactacttgtaatatcaggcctgtttccgataagcattccaatcacagcagccgcttggtatctctgggaagtcaagaagcaaagagcaggagttttgtgggacgtaccatcacctcctccaatgggtaaagcagagttagaagatggtgcgtacagaattaaacagaaaggaatactagggtattcacaaataggcgccggtgtatacaaagaaggaactttccatactatgtggcatgttacacgtggggcagtactaatgcacaaaggaaaaaggatagagccgtcatgggctgacgtgaagaaagacttaatatcgtatggcggtgggtggaagttagaaggagaatggaaggaaggtgaggaggttcaagtactagctctagagcccggaaagaaccctagagcagtccagaccaagccagggctattcaagacaaatactggaacaattggcgcggttagtttggatttttcaccaggcacaagtggatcgccgataattgataagaaaggcaaagtagtcggtctctatggtaacggagttgtcaccagatcgggagcttacgttagtgcgatagcccaaacagagaaaagtatagaagacaatccggaaattgaagacgatatttttagaaagagacgtttaacaataatggacttacatcctggtgcagggaaaacaaaaagatatcttcccgccatagtacgggaggctataaaaaggggattacgtaccttgatattggcaccaacaagagtagtcgcggcagaaatggaagaagcattaagaggcctaccgatccgctaccaaactccggcaatacgagccgagcatactggtcgcgaaatagtagatttaatgtgccacgcaacatttacaatgcggctgctttcccctgtaagagttcccaactacaacctgataattatggacgaagcgcacttcactgatccggcctctattgcagcaagaggctatataagtaccagagtagaaatgggagaagctgctggtatcttcatgactgcaaccccacccggatctcgtgacccatttccacaatcaaatgcccctatcattgatgaagaaagagaaatacccgagagaagctggaactctggccatgaatgggtaacagattttaagggtaaaacagtttggttcgttccatccataaaagcgggaaatgacatcgccgcatgcctgaggaaaaatggaaagaaagtaatacaactaagcaggaaaacttttgattcagaatacgtaaaaaccaggacaaatgattgggacttcgttgttactacagacataagcgaaatgggagcaaatttcaaggctgaacgagtaatagacccgaggagatgtatgaaaccagtcatcctaactgacggagaagaacgcgtaattttagcgggaccaatgcctgtcactcattcgagtgctgcgcaaagaagagggagaatcggacgaaatccgaaaaatgaaaatgatcaatatatatacatgggtgagccgctggagaacgacgaagattgcgctcattggaaagaagcaaaaatgttactggataatataaatacccccgaggggataatcccatctatgttcgagcctgaaagggagaaagtcgacgcgatcgatggagaatacagactaaggggagaagcgaggaagacatttgtggacttaatgcgacgtggcgatctccctgtttggttggcctataaagtcgctgcagaaggaataaattatgttgatagacgatggtgcttcgacggaatcaaaaataatcaaatactagaagaaaacgtggaggttgagatctggacaaaggagggtgaaaggaagaagttgaaacctaggtggctagatgctcggatctacagcgatccgttagcattaaaagaatttaaagagttcgctgctggaaggaaaagtctaactcttaatttgatcacagaaatgggtcggcttcccacgttcatgactcaaaagacacgagatgcactggacaatctggccgtgcttcatacagcggaggctggaggacgcgcatacaatcatgctttatcagaattgccagaaaccctagagaccttactattgttaactttattagccacagtaactggaggaattttcctgtttcttatgtcggggagagggataggtaaaatgacattaggaatgtgctgtattataactgcatcaattttactatggtatgcacaaatacaaccgcattggatagccgcatcgattatattagaatttttcctaatagtactattgatcccagaaccagaaaaacaacgtacaccccaggacaatcaacttacttacgtagtcatcgccattctcactgtagtagcggcaacaatggctaatgaaatgggattcctagagaaaactaagaaagaccttggcctaggtagcatcgctactcaacagcccgagagtaacatattagatatagacttaaggccagcatccgcttggaccttatacgctgttgcaactactttcgtaactcccatgttaagacacagcatagaaaatagttcagtcaatgtctcgttaacagcaatagcaaaccaagcaacagtattgatgggtctaggaaaaggttggccacttagcaaaatggacattggcgtaccactattggccatagggtgttattcacaagtaaatccaatcacactcactgctgctttgttacttctggtagcacactatgcgattatcgggcccggacttcaagcaaaagcaactagagaggcacaaaagagagcagcagcaggaataatgaaaaacccgacggttgatggaattacggttatcgacctagatcccatcccatatgatccgaagttcgaaaaacagttaggacaagtaatgttattgatcctctgtgttacgcaagtactcatgatgcgaactacgtgggctttgtgtgaggcattgactctagcgacaggtccgattagcacactatgggaagggaaccctggtcggttctggaacacgactatagcagtttcaatggcaaacatattcagaggcagctacctagctggtgccgggttactatttagcataatgaaaaatactaccaatactagacgtggcactggaaatatgggagaaacactgggagaaaaatggaaatcgaggttaaacgccttaggtaaaagtgaatttcagatctacaaaagatctggaatacaggaagtggacagaaccttagcgaaagaaggtatcaaacgcggcgagacggaccatcatgcggtctctcggggatcggcaaaattgcgatggtttgttgaacgtaacatggttactcccgaaggtaaagttgtagacttaggatgtggccgtggcgggtggagctattattgtggtggcctcaaaaacgtaagagaagttaaaggcttaactaagggaggccccggacatgaagaacccatacccatgtccacctatggatggaacttagtacgactgcagagtggcgtagacgttttctttataccaccagagaaatgtgatacccttttatgcgatataggggagtctagtccgaatcctactgtcgaagcgggccgaacacttagagttttgaatttagttgagaattggctgaataacaatacccagttctgtataaaggtgttaaacccatacatgccttcagtaatcgagaaaatggaggctctccagcgaaaatatggtggagctttagtccgtaacccattgtcacgaaatagtactcacgagatgtattgggtaagcaatgcaagcggaaacattgtaagctctgttaacatgataagcagaatgttaataaacagattcactatgagacacaagaaagctacgtatgaaccagacgtagatctaggatccggtacacgcaacataggaattgaaagtgaaatcccgaacttagatataataggcaaacgaatagagaaaatcaagcaggagcatgaaacaagttggcattacgaccaagatcacccatacaagacatgggcttatcacggtagttacgaaaccaaacagacaggaagtgcttcatcgatggtgaacggagtagttagactgctaacaaaaccatgggatgtccttcccactgttacgcaaatggccatgacagacacaactccgtttggtcagcaacgtgtattcaaagaaaaagtcgatacaaggacacaagaaccaaaagagggcaccaagaaattaatgaaaattacggctgaatggttgtggaaagaactaggtaagaagaaaaccccacgcatgtgtaccagagaggaatttacaagaaaagtacggtccaatgcggcactcggagcgatttttacagatgaaaataaatggaaatctgctagagaggcggtagaagattcaaggttttgggagttagtagacaaagaacgtaatttacatctagaaggaaaatgtgaaacctgcgtttataatatgatgggaaaacgggagaagaaacttggtgagtttggtaaagcaaaaggatcacgcgcaatatggtatatgtggttaggggctagattccttgaatttgaagcactcggcttcctgaacgaagaccattggttcagtcgagagaacagtctttctggagtcgagggtgaagggttacataaacttggatatatcttaagggatgtaagcaagaaagaagggggtgccatgtatgctgatgataccgctggatgggatactaggataactttagaagatcttaaaaacgaggagatggttactaaccacatgaaaggagaacataagaaactagccgaagcaattttcaagttaacttaccaaaataaagtcgtaagagtgcaacgtccaactcccagaggaaccgtaatggatattatctcgagacgggatcagagggggagtggacaggtaggtacctacgggctgaatacatttacaaatatggaagcccaactcatccgccaaatggagggtgaaggggtatttaaaaatattcaacacctcacggtaaccgaagaagtcgcagtccaaaactggttggctcgagtaggccgtgaaagactcagtcgtatggcaataagtggtgatgattgtgtagtcaaacccttggatgatcgtttcgctaatgcattaacagctctcaacgatatgggaaagataagaaaagatattcagcaatgggaaccatcaaaaggatggaatgactggactcaagtaccattttgttcacatcatttccatgaactaatcatgaaagatggacgcgtcttagtggtaccatgcagaaaccaagacgaactaataggtagggccaggattagtcagggcgccggatggtctttaagagagacagcctgtttaggaaaatcctacgcacaaatgtggagcctcatgtattttcatcgccgcgatcttagacttgctgcaaatgctatatgtagcgcagtacccagccattgggtacctacgagtagaacgacctggtcaatacatgcaaaacatgaatggatgacaacagaagacatgttgacagtatggaatagagtttggattagagagaacccatggatggaagataagacacccgtcgaatcatgggaagaaataccctaccttggcaaaagggaggaccaatggtgtggatccttaattggattaacgtcaagagcgacttgggcgaaaaacatacaagcagctataaaccaagtgcgatctctaataggaaatgaagaatatacggactatatgcctagcatgaagagatttaggcgagaggaagaggaggctggtgttttatggtaa

SEQ ID NO: 22791 - RNA, 9876 nt, synthetic construct
  misc_feature 1..9876: note = derived and/or modified CDS sequence (opt6) from DENV-2__EU482541__SS-prME
  source 1..9876: mol_type = other RNA
tcagcaggaatgataattatgttaataccaacagtgatggcattccaccttacaacgagaaacggtgaacctcacatgatagtaggaatacaagaaaaaggtaaatcactcctattcaaaacagaagacggtgtcaacatgtgcacattaatggctatggacttgggagaattatgtgaagacacaataacttataaatgtcccttattacgtcaaaatgaacctgaagatatagactgttggtgtaactctacaagtacttgggtaacttatggaacatgtaccacaactggtgaacatagaagagagaaaagatctgtggcactggtaccacatgttggaatgggattagaaacaaggaccgaaacctggatgagtagcgaaggagcttggaaacatgcacaacgtatagaaacgtggattctcagacacccgggatttactataatggcagcaatattagcgtatacaataggtactacccactttcaaagagtgttaatatttatattgctaactgcagtggcaccaagcatgacaatgagatgtataggtataagtaaccgagattttgtagaaggtgttagtggaggatcttgggttgacatcgtacttgaacacggtagctgcgttacaacaatggccaaaaataaacccaccttagatttcgaattaataaaaacggaagcgaaacaaccagcgacgttacgaaaatactgtatagaagcaaaactaacaaatacgaccacggaaagcagatgccccacacaaggtgaaccgagtctgaaagaagaacaagacaaaagatttgtatgtaaacactcaatggtagatagaggatggggtaatggatgcgggctttttggaaaagggggaatcgttacgtgtgctatgtttacatgtaagaaaaatatggaaggcaaaatcgttcaaccagaaaatttagaatatactattgtagtcacacctcattcgggcgaagaacatgcagtaggaaatgacacaggcaaacatggcatggaaataaaagtaacaccacaaagttcaatcacagaggccgagcttacaggatacggaacagtaacaatggaatgcagtccaagaaccggtctggacttcaatgaaatggtcctactccaaatggaaaataaagcatggttagttcacagacaatggtttctagaccttcctttaccgtggctccctggagccgataaacaggaatcaaattggatacaaaaagaaaccctagtcacatttaaaaatccccatgccaagaaacaagatgtagtggttctaggcagccaagaaggtgccatgcatacagcactgactggagctaccgaaatacagatgagttcaggaaatttgttatttacaggtcacttaaaatgcaggttacgaatggataaactacaattaaaaggaatgtcatattctatgtgcacgggcaaattcaaagtagtcaaggagattgctgaaactcaacatgggacgattgtaatacgagtccagtacgaaggggatggttccccgtgcaagattccatttgaaattatggacctcgaaaagcggtatgtcttaggaaggctaataacagtaaatccaatagtaaccgaaaaagatagtccagtcaacatagaagctgaaccaccatttggcgattcatacattataataggagtagagccaggacaattaaagctaaactggtttaagaaaggcagtagcattggacaaatgttcgaaactaccatgagaggtgctaaaaggatggccatccttggtgatactgcttgggattttggatcgttaggtggagtatttacctctataggaaaagccttgcaccaagtttttggagcaatatatggcgccgcgttttctggcgtcagctggacaatgaaaattctaattggtgttattattacatggatcggaatgaatagtcgaagtacctcgctaagcgtaagcctagtattggtaggaattgtaactctttacttaggagtaatggtccaagcagattctgggtgtgtagttagctggaaaaacaaagagttaaaatgcggaagcggaatttttatcacagataatgtacacacttggactgaacaatataaattccagcctgaatccccaagtaaactagctagtgccatacagaaagcgcaagaagaaggaatatgtggtattaggagtgtgacaaggcttgaaaatctaatgtggaaacaaataactcctgaattaaatcatattctagcagaaaacgaagtgaagctgactattatgactggcgatattagaggaattatgcaagcaggtaaaagatcgttaaggccacaacctgcagagctaaaatactcatggaaaacatgggggaaggcaaagatgctatcgacagaaagttataatcaaacgttcttaatagacggcccggaaactgcagaatgtccaaatacaaatagggcttggaactcattagaagttgaagactacgggtttggagtattcacaacgaatatttggctaaaactcaaggagaaacaagatgcattttgtgattccaaattgatgtcggcggcaataaaagataatcgggcagtgcatgcagatatgggatattggatagaaagtgcactgaatgacacatggaagatagaaaaagcgtcttttatagaggttaaaaactgccattggccaaagagtcatactctatggtcaaatggagtacttgaatcagaaatgataatacccaaaaatctcgcaggccccgtttctcaacacaactataggccgggttatcacacgcagatcgctggtccttggcatctcggtaaattagaaatggatttcgatttctgtgacggaactaccgtcatagttacggaagattgtgggaatcgcggtccaagtttaagaacgacaacagcttcaggaaaattaatcacagaatggtgctgtaggagttgcacactgcctcccctaagatatagaggggaagatggatgttggtacggtatggaaatacgaccattgaaagagaaagaagaaaacttagtaaattcactcgtaacagccggccatggccaagtcgacaatttttcattaggcgttctaggaatggcgctctttctggaggaaatgctacgcactagggtagggaccaaacacgccatactattggtcgcggtctcattcgtaacattaataactggaaatatgtcgtttaaagatttagggagagtggtcgtaatggttggggcaaccatggctgatgatataggaatgggtgtaacttacctagctctactagcagcgtttaaagtgagacctacctttgctgcaggcttattactgagaaagctaacttcaaaagaactaatgatgactacaatagggatagttttgttatcgcaatctactataccagagacagttttggagttaactgatgcattagctcttggaatgatggtcctaaaaattgttagaaatatggagaaataccaactggcagtaactatcatggcaatcctatgcgtcccgaacgcagtgatactacagaacgcttggaaagtaagttgtacgatcttggctgttgtctccgttagtcctctcttgctaaccagttcgcaacagaaaacagactggatcccactggcattgaccatcaaaggactcaatccaactgccatattcttaacaactctatcccggacaaacaagaaaagatcatggccacttaatgaggccataatggccgtcggcatggttagcatcttagcatcatctctcctcaaaaatgatataccgatgactggccctctagtggcgggtggactcttaactgtatgttatgtgttaacgggacggtcagcagatctagagttggagcgggccacagacgtaaaatgggaagatcaagctgaaatctcgggctcaagtcctatactatcgattactatttcagaagacggttctatgagcatcaagaatgaagaagaagaacaaactctaactatcttaattaggacaggacttctggtcataagcggtctatttccaatttcaatacctattaccgcggccgcatggtatctatgggaggtcaagaaacaacgagccggggtactttgggatgtaccaagcccaccgccgatgggaaaagctgagctggaggacggagcttacagaataaaacaaaaaggcatcttaggctatagccagatcggggcaggagtatacaaagagggtactttccacacgatgtggcacgtcactcgcggtgctgttctcatgcacaaaggtaaacgtatagaaccatcttgggctgatgttaagaaagacttaattagttacggaggcggttggaaactcgagggtgaatggaaagagggagaagaggtacaggtcctcgccttagaacctggcaaaaatcctagagctgtccaaactaaacctggcctatttaaaactaacactggcactatcggagcagtctcattagacttctccccaggaacatccgggtctccgattattgacaaaaagggaaaagttgtcgggctctatggaaacggagtagttacacgttctggagcgtatgttagcgctattgcgcagaccgaaaaatcaatcgaagacaatccagagatagaagatgacatattccgtaaaagacgattaactattatggatttacaccctggagctgggaaaacgaaacggtacttgccggcgatcgtgagagaggcaataaaacgaggtctaagaacacttatactggctcctaccagggtcgtagcggctgaaatggaagaggcattaagaggtttaccgattagatatcaaacccctgcaattagagcggagcacacaggcagagaaatagtagacttgatgtgtcacgccactttcactatgagattattaagtccagtacgcgtcccgaattataatttaattataatggacgaagctcatttcactgatccagccagcatcgcagctcgaggatacatatctacgagagtagaaatgggggaagccgcgggtatattcatgactgccacacccccgggatcaagggatccatttccacagtcaaatgcacctatcattgatgaggaaagggaaataccggaaaggagctggaactctggacatgagtgggtaacagattttaaaggaaaaacagtctggttcgtgccaagtataaaagccggaaacgacatagctgcgtgtctgaggaaaaacggcaagaaagtaatccagttatcgcgtaaaacattcgattcagaatatgtaaaaacaagaacaaacgactgggatttcgtcgtgacaacagatatatcagaaatgggtgctaactttaaagccgaacgagttatagacccgcgtcgttgcatgaaaccagtcattcttacagacggggaggaaagagtaattttagccggtccgatgcctgtaacacactcttctgcagcgcaaaggcgaggtcgaattggacgcaatcctaaaaatgaaaacgatcagtatatatatatgggcgagcccctagaaaatgatgaggattgcgcgcactggaaagaagcaaagatgctattagataacattaacaccccggaaggtattattccctcgatgtttgaaccagaacgagaaaaagtagacgccattgacggggagtatcgactacgaggagaagccagaaaaaccttcgtagatttaatgagacggggagatttgccagtatggctagcatacaaagtagcagcagaggggataaattacgcagatagaaggtggtgcttcgatggaatcaaaaataatcaaattcttgaagaaaacgtagaagttgaaatttggacaaaagaaggtgagaggaagaagctaaaaccgagatggttagacgccagaatttactcagacccactagcactcaaagagtttaaagaatttgcggctggtaggaaatcattaacactgaatttaattacagaaatgggaaggctaccgaccttcatgacacagaaaactagagatgctcttgataacttggcagttttgcatacggcagaggcaggcggacgggcctacaaccatgcattaagtgaattaccagaaactctcgaaacactactcttgcttaccttactggctactgtcacgggtggcatatttctctttttaatgagtggccggggtataggtaaaatgacattaggcatgtgctgtataattactgcaagtatcttattatggtacgcgcagatacagccccattggattgctgcgtcaataatactagagttctttctcattgttttacttataccggaacccgaaaaacaacgaacacctcaagataatcaacttacctatgtagttatagcaatcctgactgtagtcgccgcaacaatggcaaatgaaatgggatttttagaaaagaccaaaaaggaccttggattgggaagtattgccacacaacaaccagaaagtaacatactagacatagatttaagaccggccagcgcgtggacattgtatgccgtcgctacaacgtttgttactccaatgttgcgacactctatagaaaattcttctgttaatgtatcattaacagcgattgctaatcaagcaacggtattaatgggacttgggaagggctggccactttcaaaaatggacataggagtaccattattagccataggatgttattctcaagttaacccaatcacattaacagcagctttactacttctagtagcccattacgccataattggtccaggtttacaagccaaagctacacgagaggcccagaaacgcgctgccgcaggtataatgaaaaatccaacagtggacggtatcaccgttattgatttagatccgataccatatgatcccaaatttgagaaacagttaggtcaagtaatgctgttaattctttgcgttacacaagtcttaatgatgagaacgacctgggcactttgcgaagcattgacccttgcaacaggaccaataagcactctatgggaaggaaacccaggcagattctggaacacaaccatagcggtaagtatggcaaacatatttcggggatcgtatttagctggggcaggactgttattctctattatgaagaacacaaccaacacaagaagaggtacgggaaatatcggggaaacattaggcgaaaagtggaagagtagactaaatgcactcgggaaatctgaatttcaaatctataagaaatctggaatccaagaagtcgatagaaccttagctaaagaagggattaagagaggggaaacagatcaccatgcagtttcacgtgggtcggccaaattaaggtggtttgtggaacgaaatatggtgacacctgaaggcaaggttgttgatcttgggtgcggcagaggaggttggtcttattactgtggaggacttaaaaacgtcagagaagttaagggcctaacaaaaggcggaccagggcacgaagaacctataccgatgtctacttatggttggaaccttgttcgtttacaaagtggagtcgacgtatttttcatccctccagaaaagtgtgacactttattgtgcgatattggagaaagctcaccgaacccaacagtagaagcaggccgtacgcttcgagtactgaatcttgtagaaaactggttaaataataacacccagttttgcattaaggtactgaatccatacatgccatcagtgatcgagaaaatggaagcattacaaagaaaatatgggggtgcattggttagaaatccactatctaggaactctacacatgaaatgtattgggtcagtaatgccagtggtaatatagtcagttcagtaaacatgattagtaggatgttaattaaccggtttacaatgagacacaaaaaggcaacctacgaacccgatgtcgacttagggtccgggactcgtaacataggtatagaatcagaaatacctaacttggacataataggtaagcgaatcgagaaaattaaacaggagcatgaaactagctggcattatgaccaggatcacccctataaaacatgggcgtaccacggatcctatgaaactaaacaaactggatctgcatcttcaatggtgaacggtgttgttagattactgaccaaaccatgggacgttctccctaccgttacacaaatggctatgactgacacaactccgtttgggcaacaaagagtgttcaaggagaaagtggacacccgtacgcaggagccaaaggaaggcaccaagaaacttatgaaaattacagccgaatggttgtggaaagaactagggaaaaagaaaacaccaaggatgtgtactagagaagagttcacacgcaaagtccgttcaaacgctgccctaggagctatattcacagacgaaaataaatggaaaagcgctcgtgaagcagtagaggattcacgtttctgggagttggtagataaagagcgtaacttgcatctagaaggaaaatgtgagacatgtgtatacaatatgatgggaaaaagagagaagaaattaggcgagttcggcaaagctaaaggaagcagggccatatggtacatgtggcttggagcaagattccttgagttcgaggcgttaggattcttaaacgaagatcactggttctctcgagaaaactctttaagcggcgttgaaggtgaaggactacataaactcggatacatattgagagatgtatctaagaaagaaggaggtgcaatgtatgcggatgacaccgcaggctgggatactagaatcacattggaagacctcaaaaacgaggaaatggttacaaatcacatggagggtgaacataagaaactggcggaggctattttcaaactcacctaccagaataaagtagtgagagtgcagcggcccacgccaagaggtactgtaatggacatcataagtcgtagggatcaaagaggctcaggtcaggttggtacatatggtctcaatacattcactaatatggaagcccagctaataagacaaatggagggtgaaggcgttttcaaaaatattcaacgacttacagttacggaggaggtggcagttcataattggctagctagagtgggcagagagcgtttaagcaggatggcgatttcgggagacgattgtgtcgtaaaacctttagacgaccggtttgcaaatgcactgactgcgttgaatgatatgggaaagatcagaaaggatatccaacaatgggaaccatcaaagggatggaatgactggactcaagtacctttttgttcacaccactttcacgagcttataatgaaagacggtcgtatcttagtggttccttgtcgtaatcaggacgaattaataggacgggccaggatatctcaaggagcaggctggtcattgcgagaaaccgcatgcttaggaaaaagttatgcccagatgtggagtttaatgtacttccacagaagagatctgagacttgcggctaatgccatatgtagcgcagtaccatcacactgggtaccaacctcacgtactacatggagtatacatgctaagcatgaatggatgactacagaagatatgctcaccgtatggaacagagtgtggatccgagagaacccatggatggaagataagacacctgtagaaagttgggaggaaattccatatttaggtaaaagagaagaccaatggtgtggaagtttaataggattgacctcaagggcaacctgggccaaaaatattcaagcagctatcaatcaagttcgtagcttgatcggtaacgaagaatatactgattacatgccatcaatgaagagatttagaagagaagaagaagaagcgggtgtactctggtaa

SEQ ID NO: 22792 - RNA, 9876 nt, synthetic construct
  misc_feature 1..9876: note = derived and/or modified CDS sequence (opt6) from DENV-2__EU482542__SS-prME
  source 1..9876: mol_type = other RNA
agtgcagggatgattataatgctaataccaactgttatggcatttcacctaactacgcgcaatggtgaaccccacatgatagtcggcattcaagaaaaaggaaagagcttgctttttaaaacagaagacggggttaatatgtgtaccctaatggctatggatctaggggaactgtgtgaagatacaataacatataaatgccccttattacgacaaaatgaaccagaagacatagactgttggtgtaattccacatccacgtgggttacttacgggacatgtacaactactggagagcataggcgggagaaaaggtctgtagctttggtgccacatgttggcatgggtttggaaacaagaaccgaaacatggatgtcttcggaaggagcatggaaacacgcacaaaggatcgaaacctggatactaagacatcctggcttcacgatcatggctgcaatactcgcatataccatcggaaccacgcattttcaaagagtattaatatttatactcttaaccgcggtagcaccatcaatgacaatgagatgcataggaatttctaatagagattttgtagaaggagtgtccggaggttcctgggtagacatagtcctggaacatgggtcttgtgtcactacaatggctaaaaataaacctactttggactttgaattgattaaaacagaagcgaaacaaccggcgacactgcgaaaatattgcattgaagcaaaactaacaaatactaccacagaaagtcgatgtccaactcaaggagagcctagcctaaaagaagaacaagataaaagattcgtatgcaaacattcaatggtcgacagaggctgggggaatggttgcggactgtttggaaaaggaggaatagtaacttgtgctatgtttacgtgtaagaaaaatatggagggtaaaatagtccaaccagagaaccttgagtacacgatagtagtcacacctcactcaggcgaggagcacgcggtaggcaatgacacaggtaaacatggacaagaaataaaagttacgccacaatcatctataaccgaggcagagctgaccggttacgggactgtcacgatggaatgtagtccaaggacaggtttggattttaatgagatggtgctcctacaaatggaaaataaagcatggctagtacatcgacaatggtttttagacttaccactaccgtggttaccaggtgcggacaaacaagaaagtaattggatacaaaaagaaacattagtaacattcaaaaatccacacgcaaagaaacaagacgtagtagtgctaggttcacaagagggcgcaatgcacacagcattaacgggcgctacggagatccagatgtcttctggaaacttgttgtttaccggacatttaaagtgccgtttgaggatggataaactgcagctaaaagggatgtcatatagcatgtgtactggtaaattcaaagttgtaaaagagattgcggaaactcaacacggaacaattgtgataagagtccaatatgaaggggacgggtctccatgtaaagtaccctttgagatcatggatcttgagaaaagatatgttttaggaagactcattactgtaaacccaatagtaactgaaaaagactcaccggttaacattgaggcagaacctccattcggggactcctatatcataattggcgtggaacctgggcaattaaagctgaattggttcaagaaaggcagttcgatcggtcaaatgtttgagaccaccatgaggggagctaaacgtatggctattctgggggatactgcgtgggacttcggatccctgggaggtgtcttcacatctatagggaaggcgttgcaccaagtatttggcgcgatctacggcgcagcatttagtggagtcagttggaccatgaaaattctaataggtgttataataacgtggattggtatgaactccagatctacatccctttctgtaagcctagttttagtcggtatagtcacactttatttaggagtaatggtacaggctgacagcggatgtgtagtaagctggaaaaacaaagagttgaagtgcggctctggaatatttataactgacaatgtgcatacttggacggagcaatataaatttcagccagagtcacctagtaaactggccagtgcaatccaaaaagcacaggaggaaggtacttgtgggataagatcagtaactaggctcgaaaaccttatgtggaaacaaataacgccggaattgaatcacattctagcagaaaatgaggtcaaactaaccattatgactggagacataaaaggcataatgcaagcaggtaaaagaagtctcagacctcagcctactgagttgaaatattcatggaaaacctgggggaaagcgaaaatgctaagtactgaatcttacaatcaaacgttcctaatcgacggacccgaaaccgcagaatgcccaaatacaaatcgagcctggaatagcttggaggtcgaagattacgggtttggagtttttactacaaatatatggctaaaactcaaagaaaaacaggacgctttttgtgattcaaaacttatgtcagctgcaattaaagacaatcgagcagtccatgctgatatgggatactggatcgaaagcgcactaaacgacacatggaaaatagagaaagcaagttttatagaagtcaaaaattgtcactggccaaaaagccacactctgtggtcaaatggggtattagaatcagaaatgatcatacccaagaatctagctggaccggttagtcagcacaattatcgccctgggtaccatacgcagattgcaggtccttggcacttaggaaagctagaaatggattttgacttttgtgatggaacaacagtaatagtaaccgaagattgcggtaatcggggcccctctttacggacgacaactgcttccgggaaactcatcacagaatggtgttgcagaagttgcacgctgccaccgttaaggtatagaggcgaagacgggtgttggtatgggatggaaataagaccactgaaggaaaaagaagagaacttagtgaacagtcttgtaactgcaggtcatgggcaagtagacaattttagtttgggagtactgggaatggcattatttctagaagaaatgctaaaaaccagggtggggacaaaacacgcaatactattagtagcagttagctttgtaactttaatcacaggaaatatgagctttaaagacttaggtcgagtagtggttatggttggagcaacgatggctgatgacataggaatgggtgtcacatacttagcattattggcggcatttaaagtacgacctaccttcgcagcaggactattactacgtaagctcaccagcaaagaattaatgatgacaacaataggaatcgttttactttcacaaagcacaatcccagaaaccgtattggagctaacggatgccctggcactagggatgatggttttaaagattgtgagaaacatggaaaaataccaacttgctgtgaccattatggcaatcttatgcgtacccaatgcagttatattacaaaacgcgtggaaagtatcctgcacgatactagctgttgtatcagtatccccgcttttgcttacttcaagccaacagaaaacagattggatacccttagcccttacgataaagggattaaatcccacagccatatttctcactactttaagcagaacaaataagaaaagaagttggccactaaacgaagcgattatggcagtgggcatggttagtatattagcgagtagtctattaaagaatgatattccaatgacaggaccactcgtcgccggtggcttactaactgtatgttacgttctaacgggaaggtctgcagatttggagttagaaagggctacggatgtaaaatgggaagatcaagcagaaatatcgggaagtagccccatattgtcgatcactataagtgaagacggatctatgtccataaagaatgaagaagaagaacaaactcttacaatccttatcaggacaggtttattagttataagtgggttattccccatatctattcctataacagccgcagcttggtacttatgggaggtgaagaaacaacgtgccggtgttctatgggacgttcccagcccgcctcccatgggcaaagcggaacttgaagacggagcttatcgaataaagcagaagggtatactgggatatagtcaaatcggggcaggagtatacaaagaaggaacttttcacacgatgtggcacgtcactcgtggagctgtactcatgcataaaggcaaacgcattgagccatcctgggcggacgttaagaaagaccttataagttacggaggtggttggaaattggaaggagaatggaaagaaggagaagaagtacaagtcttagcattagagccaggtaaaaatccgagagcggtacagactaagccaggccttttcaagacgaacacgggaacgataggagctgtaagcctagatttttcccccggaacttcaggctctccgataattgacaagaaaggaaaagttgtcggactgtatggtaacggagtggtcacaagatcaggcgcttacgtctcggccattgcacagacggagaaatcaatagaggacaaccctgaaatagaagatgatatttttcgcaaacgtcgcttaacgattatggacctacaccctggagccggaaaaactaaaaggtatttgccggcgattgtacgcgaagcaattaaacgtggtttaagaacgctaatattagctccaacgagagtcgttgcggccgagatggaagaagcattaagaggactaccaataaggtaccaaacaccagcgatccgcgctgaacatacaggtcgggaaattgtagacctgatgtgccatgcaacatttacaatgagacttctctcgccagtgagggttccgaattataatttaatcataatggatgaagcacacttcacagatcctgcgtcaattgcagcaagaggttatattagcacaagagtcgaaatgggcgaagctgccggaatatttatgacagcaacgccacccggatcccgggacccatttccacaaagcaacgcaccaataatcgacgaagaaagagaaatccctgaacgttcctggaactcaggacacgaatgggttacagactttaaaggcaaaacagtctggtttgtgccaagcattaaggccggtaacgacattgcggcatgcctgaggaaaaatggaaagaaagtcattcaattatcaagaaaaactttcgactccgagtatgtaaaaacacgaacaaatgattgggactttgtggtaacaacagatattagcgagatgggtgcaaatttcaaagcagaaagggtaatagacccacgtagatgtatgaaaccagtgattctgacagacggtgaggaacgagtgattttagccggaccaatgccagtaacacatagtagtgctgctcaaagaagaggaagaataggaagaaaccccaaaaatgaaaacgatcaatatatatatatgggtgaacctctcgagaatgacgaagattgcgcccattggaaagaagcaaagatgttactagacaatataaatacaccggagggtatcattccgtctatgtttgaacccgaacgcgagaaagtagacgcaattgatggcgaatatcgattgcggggtgaagctaggaagacatttgttgatttgatgagaagaggcgacttacctgtttggttggcctataaagttgcggcagaaggaataaattatgcagatcgaagatggtgctttgacggaataaagaacaatcaaattctggaggaaaatgtcgaggtggaaatatggaccaaagagggcgagaggaagaaacttaaaccacgatggttagatgcaagaatttactccgatccattagccctaaaagaatttaaagagtttgcggctggcagaaagtcattgactttaaatcttattactgaaatggggagactcccgacatttatgactcagaaaacgcgcgatgccttagataacttagcggttcttcacacggcagaagcaggcggtcgggcatacaaccatgcgttatcagaattaccggagaccctagaaacactccttttactaacacttttagctacagtcacagggggaatattcttgttcttaatgagcgggaaaggaataggcaaaatgacacttggaatgtgttgcataataacagcttctattttattatggtatgcccaaatccaacctcattggatcgcggcaagtattattttagagttctttcttatcgtactactaattcccgaaccagaaaaacaacgaacgccccaagataatcagctaacttatgttgtaatagcaatactcactgtagtggcagctacaatggcaaatgagatggggttccttgaaaagactaagaaagatttggggctaggttcgatagctacacaacaaccagaaagtaatatccttgatatcgatttacgacccgcctcggcatggacattatacgcagtggcaactactttcgtaacccccatgttgagacatagtatcgagaatagtagcgtgaatgtctcattgactgcaatagcaaatcaagctacagtactcatgggtctgggaaaaggttggccgctttcaaaaatggatatcggcgtacctctgctcgccattggttgctattctcaagtaaaccctataacattaactgccgcattattactccttgtagcgcactacgctattatagggcccggtcttcaggccaaggctacacgtgaagcacagaaaagagctgcagcaggtataatgaaaaacccaacagttgacggtataactgttattgatcttgaccccataccctacgatccaaagtttgaaaagcagttaggacaagtgatgctactcatcttatgtgtaacccaagtattaatgatgcggactacgtgggctctatgtgaggcgttgacactggccaccggtcctatctctactctctgggaaggcaatccaggacgcttctggaataccaccattgcggtaagtatggccaacatatttcgcggtagctatttagccggggccggtctcctcttctctattatgaaaaatacgactaatacgcgaagaggaacaggtaacatgggggaaacgctgggcgaaaaatggaaatcacgtttgaacgcacttggaaaatcggaatttcaaatatataagaaaagcggaatccaggaggttgatcggacattggctaaagagggcattaagcggggtgaaaccgatcatcatgcggtttcgcgtgggagtgcaaaacttagatggtttgtcgaaaggaatatggtaacgccagaaggaaaagtagtagatttagggtgcggtcgcggtggatggtcatattattgtggtgggttgaaaaatgtgcgtgaggttaaaggattaacaaaaggaggacctgggcatgaagaaccaatacccatgtcaacatatggatggaatcttgttaggttacagagtggagtagatgtattcttcatcccgccagagaaatgtgacacattgctatgtgatattggagaaagcagcccaaatccaactgttgaagctggacgtactttaagagtattaaacctggtagaaaactggttaaataataacacacagttctgtattaaagttcttaacccgtacatgccaagcgtgatagaaaagatggaagcacttcagcgtaaatacggaggggctctggtccgaaatcccctcagtcgtaatagtactcatgaaatgtactgggtatcaaatgcatcgggaaacatcgtaagcagtgtaaatatgatatctcgcatgttaataaatcgttttacaatgaggcataagaaagcaacatatgaaccagatgtcgacttaggatcaggcacccgtaacataggcattgaaagcgaaataccaaatctggacataatcggtaagagaatagagaaaattaaacaggaacacgaaacttcctggcattatgatcaggaccacccctataagacatgggcgtaccatggtagctacgaaacaaaacaaaccggctcggcatcatctatggttaacggagtagttaggcttttaacaaaaccttgggatgtattacccacagtaacccaaatggcaatgacagacacaactccgtttgggcaacagcgagtatttaaagaaaaggttgacactcgcacgcaagaaccaaaggaaggtaccaaaaagctaatgaaaattacagcagaatggttatggaaagagctgggtaagaagaaaacccccagaatgtgtacacgcgaagagttcacaagaaaagtacgaagtaacgcagcactaggtgcaatctttacagatgagaacaaatggaagtctgcgagagaagccgttgaagatagtaggttttgggagctagtagataaagaaagaaatttacacttagaagggaagtgtgaaacgtgcgtatacaatatgatgggaaaaagggagaagaaacttggagagtttgggaaagcgaagggttctagagcaatatggtatatgtggttaggagccaggtttctagaatttgaagcattgggcttcctaaatgaagatcattggtttagccgtgaaaacagcttaagcggagtcgaaggcgaaggactacataagctcggatacatactcagggacgtgagtaagaaagagggcggcgctatgtacgccgacgacacagcaggatgggatacacgtataacattagaagacttgaaaaatgaagaaatggtaacgaaccatatggaaggtgagcataagaaattagcagaagcaatattcaaactaacttatcaaaacaaagttgtgcgcgtgcaaaggcctactccgcgtggcacagttatggatatcataagtagaagagatcaacgtggcagtggacaggtagggacatacggcttaaatacgtttacaaatatggaagcacaattaatacgacaaatggaaggtgagggcgtattcaaaaacattcaacacttaacagtcacagaagaagtagccgtgcaaaattggttagcacgcgttggtcgagagagattaagtaggatggcaataagtggggacgattgcgtagtcaagccgttagacgatagatttgccaacgctttaacagcgttaaacgacatgggaaaaattagaaaagatattcagcagtgggaaccatctaaaggttggaacgattggacacaagtgccattctgtagtcaccacttccacgagttaattatgaaggatggtcgcattcttgtcgtaccctgtcgtaatcaagatgaactcattggaagggcccgaataagccagggtgcaggatggagtctaagggagaccgcatgcctgggtaaaagctatgcacaaatgtggtcactgatgtattttcaccgccgcgacctacgtcttgcagcgaatgctatttgcagcgcagtaccgtcccattgggtaccaacaagcaggacaacgtggtccatccatgccaaacatgagtggatgacaacagaagatatgctaaccgtctggaacagagtgtggattagagaaaatccctggatggaagataaaactcccgtagagtcgtgggaagagataccatatttgggaaaaagagaggaccagtggtgcggctcgcttataggtctgaccagtagggccacatgggcaaagaacatacaagcagccattaatcaagtccgatctcttatcggaaacgaagaatatacagactatatgccgtccatgaagcgattcagaagagaggaagaagaagcgggagtattgtggtag

SEQ ID NO: 22793 - RNA, 9876 nt, synthetic construct
  misc_feature 1..9876: note = derived and/or modified CDS sequence (opt6) from DENV-2__JX966380__SS-prME
  source 1..9876: mol_type = other RNA
acagctggaatgataataatgttaattccaactgtgatggcatttcatttgacgacgcgtaacggtgaaccgcatatgattgtttcgcgacaagaaaaaggaaaatcattattattcaaaacaaaagatggaacaaatatgtgcacactcatggcgatggatttaggagaactatgcgaagacacgattacgtataaatgtccatttcttaaacagaatgagccggaagatatagactgctggtgcaactctacatctacatgggtaacgtacggtacttgtacaacaacaggtgaacatagacgggagaaacggtcagtagcacttgtacctcatgtcggtatggggttagaaaccagaacagagacctggatgtcatccgagggtgcttggaaacatgcacaacggatagaaacgtggattttacgacatccaggatttacgataatggcggcaatcttagcgtacactataggaaccacacatttccaacgggtattaatatttatacttctaactgcgattgctccctcgatgacaatgagatgcataggaatatcaaacagagactttgtcgagggtgtaagcggaggtagttgggtcgacatagtacttgagcatggaagctgtgtaacaactatggctaaaaacaagccaacattagatttcgaactaattaaaacagaggcgaaacagcccgccaccctaagaaagtactgcatcgaagccaaattgacgaacactacgactgattctcgatgtcccacacaaggagaaccaacattgaacgaggagcaggacaaaagatttgtctgcaagcactcaatggttgaccgtggctggggaaatgggtgcggactatttggcaaagggggaatcgtaacatgcgccatgttcacttgcaagaaaaatatggaaggcaaaatagttcaacccgagaatctagaatatacagtggtaattacccctcactcaggagaagaacacgcggttggaaacgatactgggaaacacgggaaagaagtaaaaatcacacctcagagtagtataactgaagccgaactgacgggatatgggactgtaacaatggaatgttctccgagaactgggctagactttaacgaaatggttctccttcaaatgaaagataaggcgtggctagtccatcgacaatggtttttagatctccctttaccatggctcccgggagcagatacacaaggaagtaattggatccaaaaggaaacactcgtaacattcaaaaacccacatgctaaaaagcaagatgtcgtcgtattgggatctcaagaaggcgcaatgcacacagcactcactggtgcaacagaaatacaaatgtcaagtggcaatctcttgtttacaggacatctcaaatgccgactaagaatggataagttacagctaaagggcatgtcctattcaatgtgtacgggtaagtttaaaattgttaaagaaatagcagaaactcagcatggaactatagtcataagggtgcaatacgagggagacggctcaccgtgtaaaatcccttttgagattatggatctagaaaaacgacacgtattaggccgactaataactgtaaacccaattgtaacagaaaaagatagtccagtaaacatcgaagccgaaccaccctttggagatagttacataatcattggagtggaaccgggacaactcaaacttgattggttcaaaaagggaagtagtataggccaaatgttcgaaacaacaatgcgaggagcaaaacgaatggctattttaggcgatacggcatgggattttgggagtctaggaggagtgttcacaagcatcggaaaagcccttcaccaagtgttcggtgctatatacggagcagccttttcgggtgtcagttggactatgaaaatattaataggggtgattataacatggattgggatgaactcgcgctcaacttcgttatctgtatcattagtgctcgtaggaatagtaacattatatcttggagtcatggttcaggcagattcgggttgcgtcgtaagttggaaaaataaagagctcaagtgtgggagcggtatattcgtgacggacaatgtacatacatggacggaacagtacaaatttcaaccagaaagtccaagcaagctcgctagtgcaatccagaaggcgcacgaagagggcatctgcgggattcgaagtgtgacacgactggaaaatctaatgtggaaacaaatcacatcggaactaaatcatattttgtccgaaaatgaagtaaagctaacgatcatgacaggtgacataaaagggataatgcaagtaggaaaacgctcactaagaccccaaccgacggaacttagatatagttggaaaacatggggaaaagctaaaactctaagtactgaattacataaccaaactttcttaatagatggtcccgaaacagcggaatgtcccaacacgaatagagcctggaacagtttagaggtcgaagattacgggttcggagtattcacgactaacatatggcttaggttaagggaaaaacaagatgtcttctgtgactcgaaactaatgtcagcagctattaaagataatcgagctgtccacgctgacatgggttactggattgaaagcgcgctaaacgatacttggaagatagagaaagctagctttatagaagttaaatcatgtcactggcctaagagccatactttgtggtccaacggagtcttagaatccgaaatggttatccccaaaaactttgcagggcctgtatcccagcataataacagaccaggttatcatacacaaactgccggcccttggcatctaggaaagctcgaaatggacttcgacttctgtgaaggcacaacggtagtcgtgacagaagattgcggtaaccggggaccctcgctacggaccactactgcaagcggaaaactaattactgaatggtgctgccgatcttgtacactccctccgctgcgatatcggggtgaagacggatgttggtacggcatggaaataagacccttaaaggaaaaggaggagaatctagtttcaagtctcgtaactgcaggtcacggtcaaatcgataatttttctctgggaatattagggatggccttgttcctcgaagaaatgctaagaacacgagttggtactaaacatgcaatactattagtagcggtttcttttgttacgcttataaccggtaacatgtcattcagagacctcggtagagttatggtaatggttggtgccaccatgacagacgacataggaatgggtgtcacgtacttagcattactagctgcctttaaagtaagaccgactttcactgcgggtctgctactccgcaaactaacatccaaggaactaatgatgactacaatcgggatagtactattgagtcaatcatcaattccagaaacgatactagaactgacagatgcactagcactgggtatgatggtacttaaaatggtgcgtaacatggagaaataccaattggcagtcactataatggctatactctgtgtgccaaacgcggttatactacaaaacgcatggaaagtatcatgcacaattttggcagttgtatctgtaagtccattgcttttaacaagtagtcaacaaaaggcggattggattccccttgcattaacaataaaaggacttaatcctacagcaattttcttaacaactctcagcagaacaagtaagaaaagaagttggccattaaatgaggccataatggcggttggtatggtaagcatactagcttcatcgcttttaaagaacgatatacctatgactgggcctcttgtggcgggcggcctattgacagtatgctacgtacttacaggtcgaagcgcagatttagagctggaaagggcaacggatgtaaaatgggacgatcaggcagagatatcaggatcgtcgcctatactctcgattaccattagtgaagacggaagtatgagtattaagaatgaagaagaggaacaaacgctaacaattttaataagaacagggcttctagttatcagtggcttatttcctgttagtattccaataactgcagcagcatggtatctttgggaagtgaagaaacagagggcaggagtattgtgggacgtaccctccccacctcctgtaggtaaagcagaattagaagatggagcttatcgcattaaacaaaaaggcattctgggttattcacaaataggcgcaggagtgtataaggaaggtacttttcacacaatgtggcatgtaactagaggagcagtgctgatgcataaagggaaacggatcgagccttcttgggcagacgttaagaaagatttaataagttatggaggtggttggaaacttgaaggagaatggaaagaaggagaagaagtacaggtcctcgcattagaaccagggaaaaatcctcgcgcagtacaaacaaagccaggattattccgtacaaacacgggtacaattggtgccgtttcactagattttagtcctggaacgtcaggttcaccaatcgttgataagaaaggaaaagtcgttggactttatggaaacggtgtcgtgacccgatcgggtgcatatgtgtcagccatagcccagactgagaagagtatagaagacaaccccgagatagaagatgacattttcagaaagaggagactaaccataatggatctacacccaggcgcaggaaaaacaaaaagatacctaccggcgattgttagagaagcaattaaaagagggttaagaaccctgatactggcgccaacgagagtagtggccgctgaaatggaagaggcactcagagggctaccaataagatatcaaacaccagctataagagctgaacataccggtagagaaatagtcgatttaatgtgccatgccacctttacaatgaggttgcttagtccaataagagtaccaaattacaatcttataattatggacgaagcgcatttcacagatcctgcttcaatcgccgcccgtggatatatttccacgagggtggaaatgggcgaggcggcaggtattttcatgacagctacacccccaggctctagggaccccttcccacaatctaacgcacctattatggatgaggaacgtgaaataccggagagaagttggaactccgggcacgaatgggtaaccgatttcaaagggaagactgtatggttcgtaccatcaatcaagacaggtaatgatattgcggcgtgtctcaggaaaaatggtaaacgagtaatacaactaagtcgaaagacttttgacagcgagtacgtaaaaacaagaaccaacgattgggatttcgttgtgacgacggatataagcgaaatgggagcaaatttcaaagcagaaagggtaatagacccgcgcagatgcatgaaaccagttattctaacagatggggaagaacgcgttattttggctggaccgatgcctgtaactcattcatctgcagcacaacgtagaggaaggataggtagaaatcctcgtaatgaaaatgaccaatatatatacatgggggagccattagaaaatgatgaagattgcgcacattggaaagaagctaaaatgctattggacaatattaatacgccagaagggataataccaagtatgtttgaacctgaacgtgaaaaagttgatgcaatagacggcgaataccgtctaaggggagaagcacggaaaacgtttgtcgatttaatgcgaagaggagatttacctgtatggttggcgtataaggtagcagcagaagggataaattatgccgacagaaggtggtgtttcgacggcacgagaaataaccaaatactcgaagaaaacgtcgaagtggaaatctggactaaggaaggagaacgaaagaaattaaaaccaagatggctcgatgcaagaatttacagtgacccactagcacttaaagaatttaaagaatttgccgcaggacgtaagtcgttaacactaaatttgattaccgagatgggcagactaccgacgtttatgacacaaaaagcgagagatgcactggataatcttgcggtgctccacactgcagaagctggaggaaaagcgtataatcatgcactttcagaactacccgaaactttagaaactttactacttttaactttattggcgacagtcacgggtggaatcttcttatttttgatgagcggacgaggtattggaaagatgacattaggtatgtgttgtatcattacagcgagtattttattatggtacgcgcaaatacagccacactggattgcagctagtataattctagagttctttttgattgtgttgctaataccagaacctgaaaaacaaagaacacctcaagataaccagcttacgtacgtaatcattgccatattaacagtcgtcgccgctacgatggcgaatgaaatgggatttttagaaaagactaagaaagatttaggattaggaaacatagcaacccaacagccagaaagcaatatcctggatattgatttacgtccggcaagcgcatggacactatacgctgtagcgacgacattcattacgccaatgctccgtcattccatagaaaactcatcagttaacgttagtttaactgcaattgctaaccaagcaacggtattaatgggattaggtaaaggttggcctcttagcaaaatggatataggcgttccattattagctatagggtgttattcgcaggttaatccgataaccttgactgccgccttactactattagttgctcattacgcaataatcggacctggtctacaagccaaagcaaccagggaagcgcaaaagagagcagctgctggcataatgaaaaatcctacagttgacggaataacagttatcgacttagatcctataccatacgatccaaaatttgaaaaacaacttggtcaagtaatgctattagtattgtgcgtcactcaagtattaatgatgcgtacaacatgggctttatgtgaagccctcactctagcaaccggtcccgtgtctacattgtgggagggaaaccctggaagattctggaatacaacaattgctgtgagcatggctaacatatttagaggatcgtatctagctggagccggattactttttagtataatgaaaaatactaccagcacacgacgaggaacgggaaacattggggaaacgttaggcgaaaaatggaagagtcgactcaacgctttaggaaaatccgagttccaaatatacaagaagtccggaatacaagaggtagatcgaacgttagccaaagaagggataaagagaggggaaactgaccaccatgctgtctcacggggttcggcaaaacttagatggtttgtagaaagaaacttagtcacaccagaaggtaaggtcgttgacctaggatgtggcagagggggatggtcttattactgcggaggactaaagaatgtccgcgaagtaaaaggattgactaaaggcggcccaggacatgaagaacctataccaatgagtacctatggatggaacttggtaagactacaatctggcgtagatgtattctttgtaccaccagaaaaatgtgatacattactgtgcgacattggtgaaagttcaccaaatccaactgtagaagctggtcgaacgctcagggtgttaaatcttgttgagaactggcttaataataatacgcaattttgcgtaaaagtacttaatccgtatatgccctctgtaatagagagaatggagaccctacaacgaaagtatggaggagcattggttaggaatccgcttagtcgtaactccacgcacgaaatgtactgggtaagtaacgcttcaggcaacatagtaagttccgtaaatatgatttcaagaatgttaataaacagattcacaatgcgacataagaaagcgacatatgagccagatgtagatttaggaagtggtacacggaatattggtatagaaagcgaaacacctaatttagacatcatcggaaagaggatcgaaaagataaaacaagaacatgagacctcatggcattatgatcaagatcacccatataaaacgtgggcataccatggttcgtatgaaaccaaacaaacaggttctgcatcaagtatggttaatggtgtggtaaggctccttacaaaaccgtgggatgtcgttcctatggtaactcaaatggcaatgactgacacaacaccgttcggtcaacaaagggtgtttaaggagaaggttgacacacgaactcaggaaccaaaagagggtactaagaaattgatgaaaatcaccgcggaatggctatggaaggagttgggcaaaaagaaaactcccagaatgtgcacacgagaggagttcactaagaaagtacgttccaatgccgcattgggcgcaatcttcacggacgagaataaatggaaatctgctagagaagcagtagaggacagtcgtttctgggagctagtagataaagagagaaatctccatttagaaggtaaatgtgagacgtgtgtatacaatatgatgggaaaaagagaaaagaaactaggcgagttcggtaaagccaaaggtagccgagcaatttggtacatgtggttgggcgcacgattcttagagttcgaagcactaggtttcttaaacgaagaccattggttcagtcgggaaaattcactaagtggtgtagagggagagggactacacaaattaggctacattcttagagaggtgagcaagaaagaaggtggtgctatgtatgctgatgacaccgcaggttgggatacacggatcacaatcgaagatcttaaaaatgaagagatgattacgaatcacatggcaggcgaacacaaaaagttagccgaggccatattcaaattaacgtaccagaataaagttgttcgagtccaaagaccgacacctagaggtactgttatggacataatatccagaagagatcaaagagggtcaggacaagtcggaacctacggtctgaatacctttacgaatatggaagcacaactaattagacaaatggaaggcgaagggatctttaaaaatatccagcacctcacagcaagcgaagaaatagctgtgcaagattggctcgtcagagttgggcgagaaagattaagcagaatggcaatttccggagacgactgtgtagtaaaaccgttagatgaccgcttcgcacgagcgcttactgccttaaatgatatgggaaaagtaagaaaagacatccagcagtgggaacccagtcgaggttggaacgattggacacaggttcccttctgcagccaccattttcatgaactcatcatgaaagacggccgcacgcttgttgtaccgtgcagaaaccaagatgagcttatcggcagagctaggatttcccaaggagcgggatggtcgcttagagagacagcatgtctcggaaagtcttacgcacaaatgtggtcactaatgtacttccatagacgagatttaaggttggccgcaaacgcaatatgcagtgcagttccaagccattgggttcctacatcgaggacaacgtggtcaatacatgcctcgcatgagtggatgactaccgaagatatgttaacggtctggaacaaggtatggattttagagaatccctggatggaggataaaactccagtcgaaagttgggaggagataccttatttaggaaagcgagaagatcagtggtgtggatcattaataggattaactagcagggccacgtgggccaaaaatatacaaacggcaatcaatcaagtcagaagtttaatagggaatgaagaatatacggattatatgccctcaatgaagcgattcagaagagaagaggaagaagctggggtactatggtaa

SEQ ID NO: 22794 - RNA, 9876 nt, synthetic construct
  misc_feature 1..9876: note = derived and/or modified CDS sequence (opt6) from DENV-2__JX966379__SS-prME
  source 1..9876: mol_type = other RNA
acagcagggatgattataatgttaataccgacggtaatggcatttcatttgacaactcggaatggggaacctcatatgatcgtttcacgacaagaaaaagggaaatcactattattcaaaacaaaagatggaacaaacatgtgtacgcttatggctatggatctaggagaactttgcgaagataccattacctataaatgtccatttcttaaacagaacgaacctgaagatattgattgctggtgcaactctacttcaacatgggtgacgtatggtacttgtacaacgacaggagaacacaggaggggtaaaaggtcggtggcattagtaccacacgtgggtatggggttagaaacaaggacagaaacatggatgagttctgaaggtgcatggaaacacgcgcaaagaatagaaacttggatcctaagacatcctggttttactataatggccgcgattcttgcgtatacgataggaactacacattttcaaagagtattaatattcatacttctgaccgcaattgccccaagtatgaccatgcgatgtattggaataagtaacagagattttgtagaaggagtgtctggtggaagttgggtagacatcgtactagaacacggatcatgtgttacaactatggcgaaaaataaaccgacacttgattttgaactgattaaaacagaggccaaacaaccagcaagccttaggaaatactgtattgaagcaaaattaactaacacgaccaccgattccagatgtcccacacaaggagagcctacacttaatgaggagcaagacaaaagatttgtatgtaaacattcgatggttgaccgaggatggggaaatggatgcggcctattcgggaaaggagggatagtaacgtgcgcaatgtttacatgcaagaaaaacatggaaggtaaaatagtacaacctgagaatcttgaatatacagttgtgatcactcctcactcgggcgaggaacatgctgtgggcaatgataccggaaaacatggaaaggaagtaaaaatcacaccgcagagtagtataaccgaagcagaattaacgggctatgggacagtaacaatggagtgttcgccaaggactgggctagacttcaatgagatggtgttgctccaaatggaggataaagcctggttggtgcataggcaatggttcctcgacctacctcttccatggcttcctggtgctgatacacagggaagcaactggatacaaaaagaaacacttgttacgtttaaaaacccacatgcgaagaaacaagatgtagttgtactaggatcacaagaaggtgcaatgcatacagcacttactggagcaactgaaatccaaatgtcaagtggcaacttactctttacgggccaccttaaatgtcgactccgcatggataaacttcaacttaaaggcatgtcatactcaatgtgtactggtaagttcaagatagtaaaagagatcgcggagacacagcatggtacaatagtaattagagtacagtatgaaggagacggaagtccctgtaaaattccatttgagataatggatctcgagaagcggcacgttctgggtagattgataacggtcaatccaattgttacagagaaagatagtcccgtaaatatagaagcggagcccccgttcggcgattcttacattattatcggtgtcgaaccaggtcagcttaaactagattggtttaagaaagggagttcaatagggcaaatgtttgaaactacgatgagaggagcaaagcgaatggcgatactaggagacacagcatgggatttcgggtctttagggggcgtatttacaagcatagggaaagcacttcatcaagttttcggtgctatttatggagctgcctttagcggagtgagttggactatgaaaatattaatcggggttattattacgtggataggtatgaactctaggagtacttctttgtctgtcagcttagtacttgtcggtatagttacactttacctaggtgtgatggtacaagcagactcaggatgtgtcgtatcatggaaaaataaagaactaaaatgtggttccggaatcttcgtaacggacaacgtacacacatggacagaacaatacaagtttcaaccagaatcaccctcaaaactcgcgagtgctatacagaaggcacatgaggaggggatttgcggcataagaagtgtaacgaggttagaaaacttaatgtggaaacaaataaccccagagttgaaccacatactaagcgaaaatgaagtaaaattaacaattatgacgggtgatatcaaaggcataatgcaagtaggaaaacggagtctacgaccacaaccaacagaattaagatatagttggaaaacatgggggaaggcaaagatgctaagcacagaacttcataatcagacgttcctaatcgacggaccagaaaccgcagaatgccctaacacaaatcgtgcttggaactccttagaagttgaagattatggatttggggtttttactacaaatatatggttgcgtttacgggaaaaacaagacgtcttttgtgattctaagttgatgtctgctgcaataaaagacaatagagctgtacacgcagatatgggttattggatcgaatctgctctaaacgacacttggaagatcgaaaaggctagcttcatcgaagtgaaatcgtgccactggcccaagagtcatacgttatggagcaatggcgtgctggagtctgaaatggtcatacctaaaaattatgcgggccccgtttcgcagcacaataatcggccaggctaccacacacaaacagcagggccctggcacttgggaaagctagaaatggacttcgatttctgtgaaggtacaactgtagtggtcacagaagaatgtggaaatcggggaccttctttgagaacaacaaccgccagcggaaaattgataacggaatggtgttgtagaagctgcacattaccaccactacgctacagaggggaagacgggtgttggtatggaatggagattagaccacttaaagaaaaagaagaaaacttagtatcaagtctagtgacagcgggacacggccaaattgacaacttttctctaggtatcttgggaatggcattatttctagaagaaatgttacgtagtcgagttggtaccaaacacgctatcttgttggttgcagtctcatttgtaacacttataactggtaatatgagttttagagatttgggtcgagtaatggtaatggtgggtgccacgatgactgacgatataggcatgggagtcacgtatcttgcccttctagcggcctataaagtacgaccaacatttgcggcaggtcttttacttcggaaactaacttccaaagaattaatgatgactactatagggatagttcttttaagccagagctcaattcccgaaacaatcctggagttaacggatgccttagctctcggaatgatggttttgaaaatggtcagaaacatggaaaagtaccaactcgccgtcactatcatggcaatactatgcgtaccaaacgcagttattctgcagaatgcatggaaggttagctgtactacccttgcagtcgtttccgtaagtccactactattaacctcatctcaacaaaaagcagactggataccactggccttaacaataaagggattaaatccaacggcaatatttttgacaacgctcagcagaactagcaaaaagagatcatggcctctcaatgaagcaattatggctgttgggatggtgagcattctggcgtcatcgctactgaaaaacgatatccccatgactggaccacttgtagcagggggtttactcacagtatgttatgtactcaccggtagatcagccgacctagagcttgaaagagcaacggatgttaaatgggatgatcaggctgagatctcaggaagttcgccgatattgagtattacgatctcagaagacggatccatgtctattaaaaacgaagaagaagaacaaaccttaacgattctgatccggacaggactgttagttatttccgggttgtttccagtaagcactcctattacagcagctgcgtggtatctatgggaagtcaagaaacagcgagcaggagtactttgggatgtaccaagccctcctcccgttggaaaagcggaattggaggatggagcgtaccggataaaacaaaaaggaatcctgggttatagccaaatcggtgctggtgtatataaagaaggaacctttcataccatgtggcatgtaacaagaggggccgtactgatgcataaaggcaaacgaatcgagccttcttgggctgacgtcaagaaagacctaatatcatatggaggaggatggaaattagagggggagtggaaagaaggggaggaagttcaagtactagctctagagccgggcaaaaatcctcgtgcggtacagaccaagcctggcctgtttcgtacaaatactggaacaatcggagcagtatcactggacttctcacccggaactagcggtagtccaatagtagataagaaaggcaaagtagtaggattatacgggaatggagttgtaactaggtctggtgcatacgtaagtgcaattgcccagacagaaaaatcaattgaagacaatccagagatcgaggatgatatttttagaaaacggcgactcacaatcatggatcttcatccgggggcaggtaaaactaaacgataccttccagcgattgtaagagaagcaatcaaacgaggtctgagaacacttatcttggcaccaacaagggtagtagctgcggagatggaggaagctcttagagggcttccaataagatatcaaactccggccataagggcagaacatacgggtcgtgagatcgttgacttaatgtgtcatgcaacgtttactatgagactgttatcacctattagagtaccgaattataacctaattataatggacgaagcacactttacggacccggcaagcatagcagcgagaggttatatctccacgagggttgaaatgggggaagcggctgggatttttatgacagcaactccccctggaagccgggatccatttccccagagcaatgcacctataatggacgaagaacgggaaataccagaaagatcctggaatagcggtcacgaatgggtgacagattttaaaggaaaaactgtatggttcgtccctagcattaaagctggaaacgatattgctacttgtctaagaaagaatggaaagcgtgttattcaattaagcagaaaaacattcgattcggagtacgtaaagactcgaactaatgattgggattttgtagttaccactgacatatctgaaatgggagcaaattttaaagcagaaagagttattgacccacgaaggtgcatgaaaccggttattctcactgacggcgaagagagagtgatactggcaggtccaatgcccgtaacacattctagcgctgctcaaagaagaggccgaatcggtagaaacccacgaaatgaaaacgaccaatacatatatatgggggaaccacttgagaacgacgaggattgtgcacattggaaagaagcgaaaatgctactggacaatattaacacgccagaagggattatcccttctatgttcgagccggaacgtgaaaaggtggatgctattgacggcgaatatagattacgtggagaggcacggaaaactttcgtggacctcatgcgccgaggggatttacccgtctggcttgcatataaagtagctagtgaaggaataaattatgcagatagacgttggtgcttcgatgggacgcgaaataaccaaattttagaggaaaatgttgaagtcgagatttggacaaaggaaggcgagagaaagaaactgaaaccaaggtggttggatgctaggatttactccgacccactagcacttaaagaatttaaagagttcgctgcaggtagaaaatcattgacactaaacttaataacagaaatgggcagactacctacgttcatgacgcaaaaagcacgggatgcgcttgataacctggcagtgcttcatacagctgaagctggaggcaaagcatataatcacgcgctttcagagttaccagagacactagaaactctgctattattgactttattggcgacagtaacgggaggaatctttttatttcttatgagcggtcgcggaataggaaaaatgactttaggcatgtgttgtataattacagcaagtatacttctctggtatgcacaaatacaacctcattggatagcagccagcataatattagagttctttttaatagtccttcttattccagaaccagagaaacaacggactcctcaagataatcaattaacctatgttatcatagcgattttaactgtagtcgcagctacaatggcaaatgagatgggttttctggagaagaccaagaaagatctaggactgggacatatagcgacacagcagccagaatcgaatattttagacattgatctaagaccagctagcgcatggactctttacgctgtcgctactaccttcataactccaatgctaaggcatagcatagaaaatagttcagttaacgtctctttaacagcaatagccaatcaggcgacagtgttaatgggactcggtaaaggatggcctctatcaaaaatggatataggtgtgccattacttgccataggatgttactcgcaagtgaatcccattacgctcactgcagcactattattactggttgcacactatgcaataataggtcctgggcttcaagccaaagcaacaagagaagctcagaaaagagcggcagcggggataatgaaaaatcctactgtcgacggaataacagttattgaccttgatcctataccatatgatcctaaatttgaaaaacaattgggacaagttatgctgctggtattgtgtgtgacccaagtgcttatgatgagaaccacgtgggcgttatgcgaagcacttacacttgccacaggtccagttagcacgctttgggaggggaaccctggtcgattttggaatacgacaattgcagttagcatggctaatatatttagaggttcatacttagcaggcgcgggactcctgttctccattatgaaaaataccactagcacaagaagaggcacaggcaatataggagaaacccttggcgaaaaatggaagtcaaggctcaatgcactagggaaatcagaatttcaaatatataagaaaagcgggattcaggaagtagatcgtactctcgcaaaagaaggaataaaaaggggtgagactgaccatcacgcggtatcaagaggatccgctaagttgaggtggtttgttgaaagaaatctagtaactcccgagggaaaagtagtggatctcggctgcgggagagggggttggtcatactactgtggaggactaaagaatgtgcgagaggtaaaagggttaacgaaaggcgggccgggccacgaagaacccattcccatgtctacctacggttggaatttagtaagactacaatcaggagtagacgtgttcttcgtaccacccgaaaaatgtgatacactactctgcgacattggagaatcttcaccaaacccaacagttgaagccggtaggaccttaagagttttgaatttagtggagaactggcttaatgacaatacccaattctgtgtaaaggtactgaacccatacatgccgtctgtaatagaaaggatggaaacccttcaacgtaagtatggaggcgcattagtccgaaacccgctatcgcgcaattccacacatgaaatgtactgggttagtaatgcatcgggaaacgtggtgtcctcggttaatatgataagtcgtatgttaattaaccgatttacaatgcgccacaagaaagcgacgtatgagcctgatgttgatctcggaagtggaactaggaacataggcattgagtcagaaacccctaatctagacattataggtaagaggatcgagaaaataaaacaagaacatgaagcgagttggcactatgaccaagatcatccttacaaaacctgggcatatcatggatcatatgaaacaaagcaaacaggatctgcgtctagtatggtaaacggtgtagtacggttgttaaccaagccctgggacgtagttccaatggttactcaaatggccatgaccgacacaacgccattcggacaacaacgcgttttcaaggagaaagtagatacaagaacacaagaaccgaaagagggtaccaagaaattaatgaaaataactgcagaatggctttggaaagagcttggcaagaagaaaactccaagaatgtgtacacgcgaggaatttacaaagaaagtgagatcaaacgcagctttaggtgccatttttacggacgaaaacaaatggaagtccgcacgagaagcagtagaagataatcgattttgggaattggtagataaagaaagaaaccttcatctcgaaggcaaatgtgaaacctgcgtatacaatatgatgggaaaacgagagaagaaattaggagagtttggaaaagctcgaggaagcagagcaatctggtatatgtggcttggggcaaggttcttagaatttgaggctttaggttttcttaacgaagatcattggttcagcagagaaaactctttgtcaggcgtagaaggggaaggcttacacaaattaggatatatcttacgcgaagtatcaaagaaagaaggaggggcaatgtacgctgatgatacggctggttgggacacacgaattaccattgaagacctcaaaaatgaagagatgatcacgaatcacatggccggtgaacataagaaactagccgaagcgatttttaaattaacctaccaaaataaggtagttagagttcaaagacctacacctagaggtacagtgatggatataatatcaagaagggaccaacgaggtagtggccaagtcgtaacttatgggcttaacacatttacaaatatggaagcgcaattaatccgccaaatggaaggagaaggcatcttcaaatcaattcaacacctaacagcatcagaagaaatcgctgtacaagactggttagctcgcgtcggtagagaaaggttgagtagaatggcaatttccggcgacgactgcgtagtgaaacctttagacgacaggttcgcgagggcgttgaccgccttaaatgacatgggtaaagtgcggaaagacattcaacaatgggaaccgtcaagagggtggaatgattggactcaggtccccttctgttcacaccactttcacgaactaattatgaaggatggtagaacattagtggtcccatgtcgaaatcaagatgagttaattggacgtgctcgtataagtcaaggggccggatggtctctacgcgaaaccgcctgccttgggaaaagctatgcacaaatgtggtcattaatgtattttcaccgacgagatttgagactggctgcaaacgcgatatgttccgcagtaccgagtcactgggtgccgacaagtagaacgacttggtcaatacatgcatctcacgagtggatgacaaccgaggacatgttgactgtatggaatagggtttggatattggaaaacccgtggatggaggataagactcctgttgaatcgtgggaagaaataccctaccttggaaaaagagaagaccaatggtgtggttctttaatagggctaacttcacgagcgacttgggccaaaaatatacaaactgccattaatcaagtaagatcattgattggaaatgaagaatatacagattacatgccgtctatgaaaagatttcgtcgagaagaggaagaagccggggtactatggtaa

SEQ ID NO: 22795 - RNA, 9876 nt, synthetic construct
  misc_feature 1..9876: note = derived and/or modified CDS sequence (opt6) from DENV-2__KP012546__SS-prME
  source 1..9876: mol_type = other RNA
acggcggggattattattatgatgattccgacagtaatggcgttccacttaacaacacgaaatggcgaaccccacatgatagtaagtagacaggaaaaaggaaaatccttgctattcaaaacagaaaacggcgttaacatgtgcacattaatggcaatggatttaggagaactatgtgaagatactattacgtataattgtccattactaagacaaaatgaaccagaagacatcgattgttggtgcaattccacgtcaacgtgggtcacttacgggacatgcactgcgactggcgaacaccgccgagagaaaagatcagtagcgcttgtaccgcatgtgggaatgggactagaaacaagaacagaaacatggatgagcagtgaaggcgcttggaaacacgcacaacggatagaaacatgggtactacgacatcctggtttcacaataatggctgctatattagcctacactattgggaccacgtattttcagagggttttgatatttatcttattaactgctgtggccccgtcaatgacgatgaggtgtataggaattagcaacagagattttgtcgaaggtgtctctggcggttcatgggtagacatagtgttggagcacggcagctgtgtgactacaatggccaaaaacaaacccaccttagattttgagctaataaaaacagaagcaaaacatcccgctactttaaggaaatactgtatagaagccaaattaacaaacacaaccacggcatcaaggtgccctacacagggggaaccatcattgaatgaagaacaagataaacgatttgtatgcaaacatagtatggtcgacagaggatggggtaacggctgtggcttattcgggaaaggaggaattgttacttgtgcaatgtttacatgtaagaaaaacatggagggaaaaatagtgcaacctgaaaatcttgagtatactattgtcataacgccgcacagtggggaggaaaacgccgttggcaatgatacagggaaacatggaaaagaaattaaagtcactccccaaagttcaattacagaggctgaacttacagggtacggtactgtcactatggaatgttcgccgagaaccggactagacttcaacgaaatggtgcttttacaaatggaaaacaaagcctggttagttcatcgccaatggtttctggatttgccactaccatggttaccgggcgctgacactcagggcagtaactggatccaaaaagaaacattagtaacattcaaaaatccccatgctaagaaacaagacgttgtggtactaggtagccaagagggagcgatgcacacggcattgacgggagctacggagatacaaatgtctagcggaaacctattatttacaggacacttaaagtgcagacttcggatggacaaactacagctaaagggtatgtcctactcaatgtgtacaggtaaattcaaagtagttaaagaaatagcagagacccaacatggtactatagtaattcgggtacaatatgaaggagacggttctccgtgtaaaattcctttcgaaatcatggacctggaaaagagacatgtcttaggtcgattaataacggtgaacccgattgttactgaaaaagattcgcccgtaaatatagaggcagaaccaccttttggagatagttatatcatcattggggtagagccaggtcaactcaaactttcatggtttaagaaaggaagttctatcggccagatgtttgaaacaaccatgcgaggagcgaaaagaatggcaattctgggagatacagcgtgggattttgggagcttaggcggcgtcttcacatccataggaaaagcactacaccaagtctttggcgcgatttatggagcagcgttttcaggagtctcatggacaatgaagatattaataggagtagtgattacctggatcggtatgaactcgaggagtacgtcattgagtgttagtttagttctagtaggagtagtgacactataccttggggtgatggtgcaagcggactccggatgtgttgtatcatggaagaataaggaattgaaatgtgggtcagggatattcattaccgataatgttcacacttggactgagcaatataaatttcagccagagtcaccatcaaagttagcatctgcaatccaaaaagcacatgaggaaggcatttgcggaatccgaagtgttactcgtctagaaaatttgatgtggaagcaaatcactcctgaattaaatcatatactatcagaaaatgaagtgaagttaacaataatgacaggagatattaaaggaataatgcaagcaggaaaacgatcgctaagacctcaacctacagaactcaaatatagttggaaaacatggggcaaagcaaagatgctcagcaccgaactccacaaccacacgttcttaattgatgggcctgaaacagctgaatgcccaaatacgaatagagcttggaatagtttagaggtagaagattacggttttggagtgttcacaacgaatatttggttgaaattaaaagagagacaagacgtattttgcgacagcaaattaatgtccgcggcaataaaggacaatagggcagttcatgctgacatgggctattggattgaaagtgctctcaacgatacttggaaaattgagaaggccagctttatagaagtgaaaagttgtcattggccaaaatcacatacattatggagcaatggcgtcttagaaagtgaaatgattatccctaaaaattttgcgggccctgtatcccaacacaattatcgccctggttaccatacacagactgccggcccttggcacttaggccgactagaaatggatttcgatttctgcgaaggtacaacggttgttgtgactgaagattgcggtaatagaggaccttctttaagaacaacaacagcctctggtaagttaattacagaatggtgctgtagatcatgtacacttcccccattacggtaccgaggtgaagacggttgctggtatgggatggaaatccgccctcttaaagaaaaagaagaaaatttggtgaactcgttagttacggccggtcatggtcaaattgataacttttcgttaggagtattaggcatggctctattcctagaagaaatgttacgtactagagtcggtactaaacacgcaatactcttagttgcagtcagctttgtgacattaattaccggaaacatgtcctttcgagatcttggaagagtaatggtaatggtcggggcagctatgaccgatgatattggcatgggcgtaacttacttagccctgctcgcagcttttaaagttagacccacctttgctgcaggtttgttgctaaggaagttaacctcgaaagaattaatgatgacaacaataggaattgtactactttcacagtccactatgcccgaaacaattttagagttaactgacgccctggcattaggaatgatggttttaaaaatagttagaaatatggagaagtatcaacttgccgtcacaataatggccattctgtgtgttccgaacgcggttatcctacaaaatgcatggaaagtttcatgcacaactttagcggtagttagcgtgagcccgttgttacttacctcctcacagcaaaaagctgactggataccattggcccttacaattaagggattaaatccaaccgctatatttttgacgactctaagtagaacaagtaagaagcgcagttggcctttaaatgaggcgattatggctgtggggatggtcagcatcctcgcttcctcactccttaaaaatgatatacccatgacaggaccgcttgtggcgggaggactgttaactgtatgctatgtactcacaggtcgatcagctgatctagaactagaaagagctgcagatgttcgttgggaagaacaagcggaaatcagtggtagttctcccatactttcaataacaattagtgaagacggatccatgagtataaagaacgaagaagaagaacagactttaacaatattgatacgtactggattgttagtaatttctggactatttcctgtgtctatcccgataacagccgcggcatggtatctctgggaagttaaaaagcaaagagcgggagtgctatgggacgttccaagtcctccacctgtaggtaaagctgagcttgaagatggagcatacagaataaaacaaaagggcattctaggttacagtcaaataggtgccggtgtgtacaaagaagggacatttcacacaatgtggcacgttacaagaggtgcagtactgatgcacaaaggaaaacggattgaaccaagctgggcagacgtaaagaaagaccttataagttatgggggtggatggaaattagaaggcgagtggaaggaaggtgaagaagtccaagtactcgcgctagaacccggcaagaatccgagggctgttcaaactaagccaggattgtttaaaacaaacaccggtacaataggggcagtatcacttgattttagtccaggaacaagtggttccccgatagtggataagaaaggaaaagttgtaggactctatggaaatggcgtagttacccgttccggtacttacgtatcggcgatagcgcaaaccgaaaagtcgatagaagataacccagaaattgaggacgacatttttcgaaagaaaagactgactatcatggacctacaccctggagctggaaagacaaaaagatacttgcctgctattgtacgtgaagcgatcaagcgtgggctccgaacgttaattctagcaccaacaagggtcgttgccgctgaaatggaagaagcgttgaggggattacccattcgctaccaaactcctgcgatacgagcggaacatacagggagagaaattgtagatctcatgtgccacgcaacattcactatgagattattgagtcctataagagttcccaattacaaccttataatcatggacgaggctcatttcacggatcccgcctcgatagcagctaggggttacatcagtactcgggtcgagatgggtgaagcagccggaatcttcatgactgctacacctcccggatctagagacccattcccgcaatccaatgcaccaataatggatgaggaacgagagatacctgaacgaagttggaactctggtcacgaatgggttaccgattttaaaggcaagacggtatggttcgttccttccataaaagcagggaatgatattgctgcctgtctcaggaaaaatggtaagaaagttattcaattgtcccgtaaaacttttgattcagagtatatcaagactaggacaaatgactgggattttgttgtaactactgatatcagtgagatgggagcaaactttaaagctgaaagagtaatcgacccacgacggtgcatgaaaccagtaattctaaccgatggagaagaaagggtgatcttagcagggccaatgccagtcacacactcgtccgcagcccagagacgcggcagagtgggaagaaatcctaaaaatgaaaatgatcagtacatatatatgggcgaaccactggagaacgacgaagattgcgcacattggaaagaagcgaaaatgttattagataatatatcaacccctgagggtattattccttcaatgtttgaaccagaacgagagaaagtagatgccatcgacggcgaataccgtctccgcggtgaagcgaggaaaacatttgtggacttaatgagaagaggcgacttacctgtttggttagcatatagggtcgccgctgaaggaattaattacgctgatcgacgatggtgctttgacggagtaaagaataatcaaatcttagaagaaaatgtagaggtcgaaatatggaccaaagagggtgaaagaaagaaacttaagccaagatggttagatgctagaatctattctgacccacttgccctaaaagagttcaaagaatttgccgctggaagaaaaagtctgacgctcaacttaataactgagatgggtcgactacccactttcatgacacaaaaagccagaaatgcccttgataatctggcagttctccacacagcggaggcaggaggacgagcctacaaccatgccttgagtgagctgccagagacattagaaacattattattattaacgctccttgctgctgtcacgggcggaatcttcctattcctaatgagcggcaaagggatagggaaaatgaccctaggaatgtgttgcataataacagcttcaatattgctttggtatgctcaaatacagccacactggattgcagcatctatcattctagaatttttccttatcgtactattaataccggagccagagaaacagaggacaccacaagataatcaacttacatatgtagtgatcgcgatactgactgttgtagctgcgacaatggcaaacgagatgggatttttagaaaagacaaagaaagattttggcttgggaagcactaccactcaacagccagagtcaaatatcctggatattgatctgagaccagcaagtgcatggacattatatgccgtagcaacaacctttattacaccaatgctaagacatagtatcgaaaacagttcggtaaacgtcagcctgacagccatcgcaaaccaggcaacagtactcatgggactaggaaaaggatggcctttaagcaaaatggacatcggtgtaccactattagcgattggatgctatagtcaagtaaatcctataacactaaccgctgcgcttttactcctagttgcccattatgctataattgggcctggcctacaagcaaaggcaacaagagaagctcagaaaagagccgcagccggtattatgaagaatccaaccgtggatggtattactgtaatcgacctagaccctataccctatgaccctaaatttgaaaagcaactgggtcaggtaatgttattagtattgtgcgtaacacaagtcttaatgatgcgaacaacatgggcactatgtgaagcgctaacattagcaacggggccgatatccacattatgggaaggcaaccccggacggttttggaacacaacgattgctgtctctatggcaaacatcttccgtgggagttatttagcaggcgccggattgttattctcaataatgaagaacacagcgaataccagacgtggaacaggcaacacaggcgagacattaggagaaaaatggaaaaatagattaaacgccctaggaaaaagtgagttccaaatatacaagaaaagcggtattcaagaagtagatagaacgctggccaaggagggaataaagaggggagaaacagaccatcacgcagtatctagagggagcgctaagttacgctggttcgtagaacgaaaccttgtgacacctgaaggaaaagtcgtcgatttaggttgtggtagaggaggttggtcctattactgcggtggactgaaaaatgtaaaggaagttaaaggactaaccaaaggcggaccagggcatgaagaaccaataccaatgagcacatacggttggaacttagtacgattacaaagtggagtagacgtgttctttacaccgcctgagaaatgcgatacattgctgtgtgatataggagaaagttcgccaaacccgacagtagaagcaggacgcaccctccgagtcttaaacttagtcgaaaactggttaaacaacaatactcaattctgcataaaagtattgaatccctatatgccatctgtcatagagaagatggaggcgcttcagagaaaatacggaggagcattggtcagaaaccctttaagtagaaactcaactcacgaaatgtactgggtaagtaatgcgtctggaaatatcgtatcatcggtcaatatgatatccagaatgctcataaaccggtttaccatgagacataagaaagctacttacgagccagatgtcgatttaggatcgggcacaagaaatattggcatagaaagtgagactccgaatctcgatatcattggtaaaagaattgagaaaattaaacaagaacatgaaacaagctggcactacgaccaggaccatccttataagacatgggcatatcatggaagttatgagacgaagcaaacaggaagtgcatcttcaatggtcaatggagtcgtaagacttttgactaagccgtgggatgtgattcccatggtcacccaaatggctatgacagatacaacaccctttggacaacaaagagtatttaaagaaaaagtggacacccgaacacaagaacctaaagagggcaccaagaaactaatgaaaattacggcagaatggctttggaaagagttagggaaaaagaagactccccgaatgtgtactcgtgaagagtttactcgtaaagtacgatccaatgcagcattaggggcaatattcacagatgagaataaatggaaatccgcgagagaagcggtcgaagattcagggttttgggagcttgtagataaagagagaaacttacatctcgaagggaagtgtgaaacatgcgtatataatatgatgggcaaacgcgagaagaaactcggagagttcggaaaggctaaaggatcaagagcaatatggtacatgtggttgggagcacggttccttgaatttgaagctcttggatttttaaatgaggatcattggttttcgagagagaacagtctgtcaggagtagaaggagaaggtttacacaaattaggctacattttacgggatgtcagtaaaaaggaagggggtgctatgtacgcagatgatacagcgggttgggatactaggataactcttgaagaccttaagaacgaagaaatggtaactaaccatatggaaggagaacataaaaagttggcagaagcaatattcaaacttacatatcagaacaaagtcgtaagagtacagaggccaacaccgcgtggaactgtcatggatataatctctcgacgagatcaaaggggatcaggccaggtcgtaacttatggcttaaatactttcactaatatggaagcacaactgataaggcaaatggaaggagaaggagtattcaaaagtatacaacaactaactgttacagaagaaattgccgtcaaaaactggttagtaagagttggacgtgaaaggctttctcgaatggccatttctggggatgactgcgtagtaaaacctcttgatgaccgatttgctagtgcactgaccgcactgaacgatatggggaaagtacgtaaggacatccagcaatgggagccatcaagaggatggaatgattggacccaagtaccattctgttcacatcactttcacgaattaatcatgaaagacggtagagttcttgtagtaccttgtcgtaatcaagacgaactaataggtagagctaggataagccagggtgccggatggtcgctaagagaaacagcatgtttaggcaaaagttacgcacaaatgtggaatctaatgtacttccataggcgcgatctacggcttgctgcgaacgcaatatgttctgccgttcctagccactgggtaccaacatcacgtacaacttggtccatacacgccactcatgagtggatgacaacagaagatatgctaacagtctggaatagagtttggatacaagagaacccatggatggaggacaaaactccagtagaatcctgggaagaaattccatacctaggtaagagagaagatcaatggtgtggcagcctcataggactcacatcaagagccacttgggcaaagaatatccagaccgctattaatcaggttagaagcctaataggtaatgaggaatacacagactacatgccaagcatgaaacgttttagaagagaggaagaagaggccggagtactatggtga

SEQ ID NO: 22796 - RNA, 9876 nt, synthetic construct
  misc_feature 1..9876: note = derived and/or modified CDS sequence (opt6) from DENV-2__KP723478__SS-prME
  source 1..9876: mol_type = other RNA
acagcaggcatcataatcatgatgatcccgacagtaatggcttttcacttaaccacccgaaatggcgaacctcacatgattgtctcccgacaagaaaagggtaaatcacttctatttaagactgaaaatggtgtaaacatgtgcacattaatggcgatggatttgggagagttatgcgaagacactataacgtataattgcccattactacgtcaaaatgaacccgaagatattgattgttggtgcaattctaccagcacatgggtgacttatggaacttgcactgcgacaggtgagcatcgacgtgagaaaagaagtgtggctttggttccacatgtaggaatggggttggaaacaagaacggagacttggatgtcgagcgaaggtgcatggaagcacgcccaacgcatagagacttgggttttaagacatccgggctttactatcatggcagccatacttgcctatacaataggaaccacatattttcaaagagtattaattttcattctactaacagcagtggcaccaagtatgacaatgcgttgcataggtatcagcaatagggactttgttgaaggtgtttctggtggctcatgggtagacattgtccttgaacacggatcttgtgtgacaacaatggcgaaaaataagcctacacttgacttcgaactgattaaaaccgaagcaaagcacccagcgactttgcgtaagtactgtatagaggccaaattaaccaatacaacaactgcctctcgatgtccaacgcaaggcgaaccatccctcaatgaagaacaagacaaaaggttcgtctgcaaacatagtatggttgatagaggatggggaaatggttgtggtttatttggtaaaggaggaatcgtaacatgtgcaatgtttacatgcaagaaaaacatggaaggaaaaatagtgcaacctgagaacttggaatatacaatagtgataacccctcacagtggcgaagaaaacgcggtaggcaacgacacgggaaaacatggtaaagagatcaaggtaacgccacaatcgtcaataacagaagcagaattaaccggatacggaacggtaactatggaatgttcccctcgtactggtctagatttcaacgagatggtcctcttacagatggagaataaagcatggcttgtacatagacagtggtttttagatctgcccttgccatggttacccggagctgatactcagggttcgaactggattcaaaaagaaactctggtaacgttcaaaaacccacatgccaaaaagcaagatgtagtcgtgttaggctcgcaagaaggagctatgcatacagcactgacaggcgctacagaaatccaaatgagtagtggcaaccttctttttacaggacatcttaaatgtaggttgcgaatggataagcttcaacttaagggaatgtcatattctatgtgcacaggtaaatttaaagtggtaaaggagattgcagaaactcagcacggaacgatagtaattagagtgcaatatgaaggggatggatctccatgcaaaatccccttcgaaataatggatttagaaaaacgacacgtactcggtagattaatcactgttaacccaatagtcacagaaaaagattccccagtgaatatagaagcagagcctccatttggtgattcgtatataatcattggagttgaaccaggtcagttaaaattaagctggtttaaaaaaggatccagcatcggacaaatgtttgagactactatgcgcggtgcaaagagaatggcgatcctcggtgatacggcctgggatttcggcagtttaggcggcgtgtttacatctatcgggaaagctttacaccaagtattcggggcaatatacggggcagctttcagtggagtaagttggacaatgaaaatattgataggagtagttattacttggattggaatgaatagtagatcaaccagcctctcggtaagtctagtgttagtaggagtagtaactttatatttaggtgtaatggtgcaagctgacagtggatgtgtagtttcatggaagaacaaagaattaaaatgtggttcaggaatctttataactgacaatgttcatacatggacggaacaatataaatttcaaccagagagtccttctaaactcgcctctgccatacagaaagcacatgaggaggggatatgtgggataagaagtgtaactcggttggaaaaccttatgtggaaacaaataactccagaactaaatcatattcttagtgagaatgaggtgaaactaacaataatgactggtgacatcaaaggaatcatgcaggctggaaaaagaagtttaagaccccaaccaactgagttaaaatatagttggaaaacatggggtaaagcaaaaatgctttcaaccgaacttcacaaccacacctttctcattgacggtccagaaaccgcagagtgtcctaatactaatcgagcttggaattcccttgaagtcgaagactatggttttggggtattcacaacaaacatatggttgaagttaaaggagaggcaagatgtgttctgtgattctaaactgatgagtgcagcaataaaagataatagagctgtccatgcagacatgggatattggatcgagtcagcactaaatgatacctggaagatcgaaaaagcatcattcattgaagttaaatcttgtcactggccaaagtcacacacattatggtcgaacggtgtactggaaagcgaaatgattatacctaaaaatttcgccggaccaatgtcgcaacataactataggcctggatatcatacacaaactgcaggtccctggcatcttggacgattagaaatggattttgacttttgcgaaggtacaacagtagtggtaaccgaagattgcggtaatcgtggaccgtcacttagaacaacaactgcttccggaaaattgattacagagtggtgttgtagaagttgcacgttaccgcccttacgatacagaggagaagatgggtgttggtacggtatggagattcgaccactgaaagagaaagaagaaaatctggtcaattcactcgtaacagccggccatggacaaatagataatttcagcttaggtgtgttaggtatggcgttgttcttagaagaaatgcttagaaccagagttggtaccaaacacgcaatactactagtagcagttagttttgttacactaataacgggtaacatgagttttagagatctgggacgcgtgatggtaatggtaggagcggccatgacagatgatatcggcatgggagtgacgtatttagcactactcgcagcatttaaagtacgaccgaccttcgcggccggactattattaagaaaactaactagtaaggaacttatgatgactacgataggcatagtgttattatcccaaagtacgatgccggagacgattttagagttaacagacgctctcgctttagggatgatggtcctaaagatagtcaggaacatggaaaaataccaactcgcagtgacaataatggccatactatgcgtcccaaatgctgtgattctacagaacgcttggaaggtgagttgtaccacgttagctgttgtatctgtttcgcctttactgctaacatcatcccaacaaaaagcagattggattcctcttgcactcactatcaagggattgaacccaaccgcaatttttttgacaactctgtccaggacttctaagaaaagatcttggccattgaatgaagctataatggcagtaggcatggtatcgattctggcctcctcattgcttaaaaacgacatacccatgacggggcccctagtagcgggaggactattaactgtatgctacgtattgactggccgtagtgctgatttagagttggaacgtgcagccgatgtacgatgggaagaacaagcagagatttcaggctcttctcctattttgtcgataaccatatcggaagatgggtcaatgtcaataaaaaatgaggaagaagaacaaactctaactattctaataaggactggattgctggtgatatcaggactcttccctgtttcaactcctataacagcagcagcttggtacctttgggaagtaaagaaacaacgggccggggtcttatgggacgtgccctcgccaccgccagttggtaaagcggagttggaagatggtgcatatcgcatcaaacagaaaggaatattagggtattcacaaattggcgcaggagtttataaagaaggcacttttcatactatgtggcatgtaactcgaggtgcagtgctaatgcataagggtaagagaattgaacccagctgggctgatgtaaaaaaggatcttatctcatacggagggggctggaaactagagggagaatggaaagagggagaggaagttcaagtcttagctttagaacccggtaagaacccacgagctgtacaaacgaaaccagggcttttcaagaccaatactggaaccattggggcagtgtcactcgacttctctccgggcacatcgggatcgccgatagtggacaaaaaaggaaaagtagtcgggctatacggaaatggagtggttacgagatccgggacatatgtttctgcaattgctcaaacagagaaatcgatcgaagataaccccgaaattgaagatgatatttttcgtaaaaaacgattaactattatggatttgcaccctggagcaggcaagacaaaacgatatttaccagccatcgttagagaagctataaaaaggggattgcgtacattgatactagcacccacgagagtcgtagcagcggagatggaagaggcacttagagggctacctatccggtaccagaccccagctatacgagcagaacatacaggtagggagatagtagatttgatgtgtcatgccacatttacaatgagacttctatccccaatcagagtacctaattacaatctaatcataatggatgaagcacattttactgaccccgcttctatcgccgcgcgaggttacatatctactagagtagaaatgggcgaagcagcggggatcttcatgactgcaacccctcccgggtcaagagatccctttccgcagtctaatgcaccaattatggatgaggaaagagaaatccctgaaaggagctggaactccgggcatgaatgggtaactgacttcaaaggtaagacagtttggttcgtaccttcaataaaagctgggaacgacatagctgcatgtttgcgaaaaaacggaaaaaaggtgatacaattatctcgaaagactttcgattcagaatatattaagacgcgaaccaacgattgggactttgttgtcactactgacattagcgaaatgggggcaaattttaaagcagagcgagtaattgacccacgacgatgtatgaaaccggtgatacttacggatggtgaggaaagggtgattttagccgggccaatgccggttactcatagttcggcggcacaaagaagggggagagtcggcagaaatccaaagaatgaaaacgaccaatacatatacatgggagaaccgctagagaacgatgaagactgtgcgcattggaaggaggcaaaaatgctattagacaatatatcaactccagaaggtataatcccaagcatgttcgagccagaaagagaaaaggtggatgctatagatggcgaatatagactgcgaggtgaagcgcgtaaaacgtttgtagatctaatgagacgtggagacctgccagtgtggctagcctatagggtagctgcagaaggcattaactacgcggatcggaggtggtgctttgacggcgtgaagaataatcaaatattagaggaaaatgtagaagtggaaatatggacgaaggaaggagagagaaaaaagctaaaacctcgatggttagatgcaaggatctattcggacccgttagccttaaaagagtttaaggagtttgcagctggaagaaaatctttgacactgaatttgataacagaaatggggcgactgccgactttcatgacacagaaagcgcggaatgctttggacaacttagccgtgcttcatacagcagaggccggaggtagggcatacaatcatgcgttgtctgaattgcccgaaactctagaaactttattgctattaacacttctagcagcggtcaccggagggatttttctatttctcatgtccggtaagggaatcgggaagatgacattgggcatgtgttgcataatcacggcaagtattttactatggtacgcacagatacaaccacattggattgctgcatctattatattagaattttttctaatcgttctacttattcctgaaccggaaaaacaaagaacccctcaggacaaccaattgacttatgttgtaatagcaattttgaccgtagtcgcagcaaccatggctaatgaaatgggtttcctagaaaaaactaagaaagattttggtcttggatccactacgacacaacaacctgaaagtaatattctagatattgatctacgtcctgcctcggcgtggaccttatatgcagtagcaactacattcatcactccaatgctgcgccattctatagaaaattctagcgtaaacgtttcactcacggctattgcgaaccaagcgaccgtactcatgggattgggaaaaggttggccccttagtaaaatggatattggcgtccctttactagcaataggctgttattcccaagtaaaccctattacacttacagcagccctgctattattggtcgcgcattatgcaatcataggacctggattgcaagctaaagcgacacgagaagctcagaagcgtgccgcagctgggataatgaaaaatccaacagtagacggtattactgtaattgatcttgacccaataccatatgatccgaaattcgagaaacaacttgggcaagtaatgctactggtgttatgtgtaacccaagttctcatgatgagaactacttgggctctttgtgaagcattaacactagcaacaggccctataagcaccctatgggaaggaaatccaggtagattttggaatacaacaattgccgtatcgatggcaaacatttttcgaggaagttatctagcgggagctggactgttattttctataatgaagaacaccgcaaatacaagaaggggtactgggaacacaggtgaaaccctgggagaaaaatggaaaaatcgactaaacgccctgggaaagtctgaattccagatctataaaaagtctggaatccaagaagtcgatagaaccctcgcaaaggaaggtataaaaagaggagaaacagaccatcatgcagtatccagggggtccgcaaaacttcggtggttcgttgaaagaaatttggtaactccagaaggaaaagtagtagacctaggatgtggacggggaggctggagctattactgtgggggattaaaaaatgtaaaggaagtaaaaggactaacgaaaggaggaccaggccacgaagaaccaatcccaatgtcaacgtatggctggaatttagtccgtttgcaaagtggtgttgatgtgttcttcaccccacccgaaaaatgcgatacacttttatgtgatataggtgaaagctctcctaatcctacggtagaagctggtagaactctacgtgtacttaatcttgtggaaaactggctaaataataacactcaattctgtataaaagtactaaacccctatatgcctagcgtaatcgaaaagatggaagctctacaaagaaaatacgggggtgccttagtacgcaaccctttaagtagaaactcgacacacgaaatgtattgggttagtaatgcgagtggaaatatcgtgtcttctgtaaatatgatatctcgaatgctgataaatcgttttacaatgcgccacaagaaagctacgtatgaacctgatgttgacctgggatcgggaactcgaaatatagggattgagtcagagacaccaaatcttgatattataggaaaaagaattgaaaaaattaaacaggagcacgaaacatcatggcattatgatcaagaccatccgtataaaacttgggcttatcatggatcatatgaaacaaaacaaaccggatcggcgtcttcaatggtcaacggagtagttaggttgttaacaaaaccttgggacgtgattccaatggtcactcaaatggcgatgaccgatacaacaccattcggtcagcaaagggtatttaaggaaaaagtagatacgagaacacaggaaccaaaagaagggaccaagaagcttatgaaaataacggcagaatggctgtggaaagaacttggtaagaaaaaaactccacggatgtgcactagagaagaattcacgagaaaagtccgttccaacgctgcactaggagcaattttcactgacgaaaacaaatggaaatcagcgagagaagcagtagaagattcgggattttgggaattagtggataaggaaagaaacttgcacttagaaggtaaatgcgaaacgtgtgtctacaatatgatggggaaacgagaaaaaaaattaggcgagtttggaaaggctaaaggcagcagagcaatctggtatatgtggcttggggcgagatttcttgagttcgaggccctaggtttcctgaacgaagaccattggttttcacgtgaaaacagcctgtcgggcgtagagggggagggtttacacaaattgggttatatattacgggatgtatcaaaaaaagaaggaggtgcaatgtatgcagatgacaccgctggatgggacacacgtattacactggaagatttaaaaaacgaggaaatggttactaaccacatggaaggggaacataagaaattagcagaagctatattcaaactaacttatcaaaataaagtagtaagagtacaaagaccgacaccgagagggacagtaatggacataatctcaagacgagaccaacgaggatcaggccaggtagtgacctatggtctaaacacgtttactaatatggaggcacagttgataagacaaatggaaggtgaaggagtgttcaagtcgatacagcaattaactgtaacagaagaaattgctgtcaagaattggttagttagggtagggagggaaagattgtcccgaatggccatatcaggagatgattgtgttgtcaaaccattagacgaccgatttgcttctgccttgaccgccttaaacgacatgggcaaagtacgtaaagacattcaacaatgggaaccatcgaggggatggaacgactggactcaagtaccattctgttctcatcattttcacgaacttattatgaaagatggaagagtactcgttgtcccatgcaggaatcaagacgaactcatcggtagagcacgaatctcccaaggagcagggtggagcttaagggagactgcatgtctgggcaaatcttacgcacagatgtggaacttaatgtacttccaccgtagggacctgcgtctcgcggccaatgcaatatgttccgcagtgccatcgcactgggtgccgacaagtagaacaacttggtcaatacatgcaacccatgagtggatgaccactgaagacatgttaacagtatggaaccgagtttggattcaagagaacccttggatggaagataaaactcccgtcgaaagttgggaagaaattccatatctgggaaaaagggaagaccaatggtgtggcagccttataggactaacaagcagagccacttgggcaaaaaatattcaaacggcgattaatcaagttaggagccttataggaaatgaagagtacacagactatatgcctagtatgaaacgatttagaagggaagaagaggaggcaggcgttctctggtaa

SEQ ID NO: 22797 - RNA, 9876 nt, synthetic construct
  misc_feature 1..9876: note = derived and/or modified CDS sequence (opt6) from DENV-2__KP723479__SS-prME
  source 1..9876: mol_type = other RNA
actgcaggtataattattatgatgattccgacagtaatggcattccacttaacaacacgaaatggagaaccgcacatgattgtatccagacaagaaaaaggaaaatcattactattcaaaactgaaaatggtgttaatatgtgcaccttgatggcgatggacttaggagaactttgtgaagacaccatcacgtataattgtccattactaaggcagaacgaaccggaagatatcgattgttggtgtaattcaacttccacatgggtgacatatggtacatgcacagcgacaggcgaacatcgtcgtgagaaaagatctgttgctctagtaccacacgtaggtatgggattggaaacgagaaccgaaacatggatgtcgagtgaaggcgcatggaaacatgcgcaacgaattgaaacgtgggtactaagacatccaggctttacaataatggcagcaatccttgcatatactattggtacgacttatttccaacgtgttttgatatttattctattaacagcagtcgcaccatccatgactatgagatgtattgggataagcaaccgagattttgtggaaggagtatcaggaggtagttgggttgacatagtcttagaacatggcagttgtgtaaccacaatggctaaaaataaaccaaccttagatttcgaattaataaaaactgaagcgaaacatccagcaactttacggaaatattgcatagaagcgaaacttacaaatacaacaaccgcatcaagatgtcctacccaaggggaaccatccttgaacgaagaacaggacaaacgatttgtttgtaaacatagtatggttgatagaggttggggtaacggatgtggtctattcgggaaaggaggaatagttacgtgtgcgatgttcacatgtaagaaaaatatggaagggaaaatagtgcaacctgaaaatcttgaatataccatcgtgataacccctcattctggagaagaaaacgcagttggaaatgacaccggtaaacatggcaaagaaataaaagtaacaccgcaaagctcaataaccgaagccgaactcacagggtacggcacagtcacgatggaatgttctccgaggactggactagattttaatgaaatggtcttattacaaatggagaacaaagcatggctagtacaccgacaatggttcctggatttaccgttaccgtggttaccgggcgccgatacacaaggatctaactggatacaaaaagaaaccctagtgacatttaaaaatcctcatgctaagaaacaagatgtagtagttctagggagtcaggagggagcgatgcacacggctctaacaggagcaacggaaatacaaatgtcatccggtaacttactttttactgggcacctaaaatgccgtctaagaatggacaaattacaattgaaaggaatgtcttattcaatgtgtactggaaaattcaaagtagttaaagagattgccgaaacacaacacggcacaatagtcattagagttcaatatgaaggcgacggatcgccatgcaaaattccattcgaaataatggacctagaaaagagacatgtactcggaaggttgataacggtaaatcccattgtgactgaaaaagattcaccagttaacattgaagcagagccaccctttggagactcatacattataataggggtagaaccaggtcaactgaaactctcctggtttaagaaaggaagttcaataggacagatgtttgaaactacaatgagaggggcgaagaggatggcaatactaggagacacagcttgggactttggtagtctgggaggagtatttacgtcaattggaaaagcattgcaccaggtattcggtgcgatttacggtgcagctttttcaggcgtttcatggactatgaaaattttaataggagtagtgattacttggataggaatgaatagccgaagtacgtcattgagcgtaagtctggtattagtaggagtggtaacactatacttaggagtcatggtgcaagccgattctggatgcgtggtaagttggaaaaataaagaattgaaatgtggtagtgggatattcattactgacaacgttcatacatggactgaacaatataagtttcaacctgaatctccttctaaacttgcgtctgccattcaaaaggctcatgaagaaggaatctgcggtatacgatcagtaacacgactagaaaacttaatgtggaaacaaataacgcctgaacttaatcatattctctcagaaaatgaggtaaaattaaccataatgacaggggacattaaaggcattatgcaagccggaaaaaggtctctacgcccacaaccaaccgaattgaaatattcatggaaagcctggggcaaagcaaaaatgcttagcacggagttacataatcacacgttcctaatagacggacctgaaacagcggaatgtccaaacaccaacagagcctggaactccttggaagtggaagattatggctttggtgtcttcacaactaatatatggcttaagatgaaagaaagacaagatgtgttttgtgattcaaagctcatgagtgcagcaatcaaagactcgagagctgttcacgcggatatgggatactggattgaaagtgcattgaatgatacctggaaaattgagaaggcttctttcattgaagttaaaagttgccattggcctaaaagtcataccttatggagcaatggcgtactagaatcagaaatgataattcccaaaaatttcgctggaccggtctcccaacataattaccgacctggttatcatacacaaacggctggaccttggcatctcggaagattagagatggatttcgatttttgtgaaggaaccacagtggtagtaacagaagactgtggtaacagaggtccgtcactaagaacaacaacagcttccggtaaattgataacagaatggtgctgcagatcttgtacgctgccaccattaagatacagaggagaagatggatgctggtatggtatggaaataaggccgttgaaagaaaaagaagaaaaccttgtaaactcacttgtgacagcgggacatgggcagattgataattttagtcttggggttttgggtatggctctattcctcgaggaaatgttgagaactagagtaggaaccaagcacgcgatattattagttgcagtatcatttgttaccctaattaccggaaacatgtcctttcgtgatttgggcagagtaatggtgatggtaggagctactatgacagatgacataggtatgggtgtaacctatttggcactactagctgcttttaaagtgcgtccaacatttgcagcaggtctgctacttcgaaagttgacatcaaaagagctaatgatgaccaccatcgggattgtactcttatctcaggccaccatccccgaaacaatacttgaactgactgatgcattagcattagggatgatggtgttaaagatagtgagaaatatggagaaataccaattagctgtaacaataatggcgatactatgcgtacctaatgcagtaattctccaaaacgcatggaaggtgtcctgtaccacactcgcggtcgtgagcgtgtcccctctactattaacctcatcccaacagaaagcagattggattcctctagcattaacaattaaagggcttaatccaactgctatatttttaacaactttaagtcgaactaataagaaacgatcgtggcctctcaatgaggcaatcatggcagtgggtatggtaagcattctagcgagctctttattaaagaatgatattccgatgacgggtcctctagtcgctggcgggctattaacggtatgctacgtacttaccggccgctctgctgatcttgaactagaacgagcagcagatgtaagatgggaggaacaagctgaaattagtggttctagccctatactgtcaattacaatatcggaggacggctcaatgtcaatcaaaaatgaagaagaggaacaaacactaaccatcttgatacgaacaggtctgttagtagtcagtggcttatttccagtatcgacaccgataaccgcagccgcatggtacctatgggaagtcaagaaacagcgagccggcgtattatgggacgtgccaagtcctccaccagttggaaaagccgaattggaggacggagcgtacagaatcaagcaaaaaggcatactaggttactctcaaataggtgcaggagtctacaaagaaggcacgtttcatacaatgtggcacgtaacaaggggtgcagtgctaatgcataagggtaaacgcatagaaccttcctgggcagatgtgaagaaagatttaatatcgtacgggggtggttggaaactcgaaggagagtggaaggagggagaggaagtgcaggttctcgctctagaacccggcaaaaatccaagagcagtacaaacgaaaccgggattgtttaagacaaatacgggaactatcggagcagttagtttagatttcagcccaggaacctcaggatctccaatagtggacaagaaaggaaaagtcgtaggtctatacggaaacggcgtagtcactagaagcggtacatatgtatcagccattgctcagacagaaaaatcaatcgaagataatccagaaatcgaagacgatatatttcgaaagaagaggctcacaataatggatctacacccaggagctggtaagactaaaagatatctcccagcgatagttcgagaagcgataaaacgaggactaaggacactcatcctcgcgcctacaagagttgtggcagcagaaatggaggaagctctacggggcttgccaattagatatcaaactccggccattcgagcggaacacacaggtagagaaattgttgatcttatgtgtcacgcgacattcacaatgcgactgcttagtccaatacgcgtaccaaattacaacttaataataatggacgaagctcacttcaccgatcccgctagtattgctgcacgcggctatatcagtactcgagtagaaatgggcgaagcagcgggtatatttatgacggcgactccccctggctcacgagatccatttccccagtcaaatgctcccattatggacgaagaaagggaaatacctgagaggagctggaactctggacacgagtgggttacagattttaaaggaaaaacagtatggtttgttccaagtattaaggcaggaaatgatattgctgcttgcctgaggaaaaatgggaaaaaggtcatccagcttagtagaaaaacatttgactcggagtacattaaaacaaggaccaatgattgggatttcgtagtaactactgacatatccgaaatgggagcaaattttaaagcggaaagagttatcgatccccgacgttgtatgaaaccagtaatattaactgacggagaggagagggtaatccttgcgggccccatgcctgtaacacatagtagtgcggctcaaagaagaggacgggtgggaagaaacccaaagaatgaaaatgatcagtacatatatatgggagaacctctcgaaaatgacgaagactgcgcacattggaaggaagcaaagatgcttctagacaatatcaacacccctgaaggcatcattccatctatgtttgaaccagagcgtgagaaagtcgacgctattgatggtgaatatcgattacggggcgaggcccggaaaacgttcgtagatctaatgaggagaggcgatctacctgtttggttggcctatagagtggctgcagaggggataaactacgcagacagacgttggtgtttcgacggtgtaaagaataaccaaattttagaagaaaacgtagaggtagaaatttggacaaaggagggggagagaaagaaattgaaaccgagatggttagatgctagaatctacagtgaccctctagcccttaaagagttcaaagagttcgcagctggaagaaaaagcctgacattaaacctgattacagaaatgggtcgcttacctacattcatgacacaaaaagctcggaacgcacttgacaacttagctgttttacacacggcggaagccggtgggcgtgcctataaccacgcgttaagtgaattaccagaaacgctagaaacattattactactcacattactagctactgttaccggcggaatattccttttcttaatgtcggggaaaggcatcggaaaaatgacattaggtatgtgttgtataattaccgcttcaatactactatggtacgcacaaattcaaccgcactggattgcagcaagtattatcttagagttctttttaatagtgcttctcatccctgagcctgaaaaacaaaggactccccaagataatcaactgacatacgtggtaatagccatacttactgtggtcgctgccacgatggcgaatgaaatgggatttttggagaaaaccaagaaagattttgggctaggttctatcacaacccaacagcccgaaaacaatatactagatatcgatttacgtccagcatccgcatggacgttatacgcagtagcaacaacattcataactccgatgttgcgacattcgatagaaaattcatccgttaatgttagccttactgccattgcaaatcaagcaactgttttaatgggattaggaaaagggtggccgttgtcgaaaatggatataggagtgcctttattagcgatagggtgttattcacaagtaaatccaattacgttaacagcggcccttttactcttggtagcacattatgcgataataggtcctggtctccaggcaaaagcaacaagggaagcacaaaaacgtgcagcagctggaataatgaaaaatccgacagtagacggtataacagtcatcgacttagacccaattccatatgaccccaaattcgaaaagcaactcggacaagtaatgcttcttgtcctttgcgtaacacaggttttgatgatgagaacgacatgggcactttgtgaagctctaacacttgccaccggacctataagcacgctatgggaaggaaaccctggtagattttggaacaccactattgctgtaagtatggccaatatattcagaggtagctatctagcaggagcgggactgttattttcaataatgaagaataccgccaatacgagaagagggacaggtaacacaggagaaacactaggggaaaaatggaaaaaccgtttaaacgcacttggtaaaagtgagttccaaatctacaagaaaagtggaatacaggaggtggaccggactttagcgaaagaaggtataaagagaggagagacagatcaccatgctgtaagcagggggagtgcgaaattaaggtggtttgtagagagaaacttagtaacaccagaaggaaaagtcgttgatttgggatgtggaagaggaggttggtcgtactactgcggagggttaaagaatgtaaaagaggtgaagggtctaacgaaaggagggcccggtcacgaagaacctataccgatgagcacgtatggttggaatttagtgagattacagagcggggtggatgtatttttcacaccaccagagaagtgtgacactctactatgcgacattggggaatcaagtcctaatcccacagtagaggcgggaaggacattaagagtgttaaatctcgtcgaaaactggctaaacaataatacccaattttgcataaaagtgctgaatccctatatgccttccgtaatagagaaaatggaggctttacaacgaaagtacggcggagcattagtaagaaatcctttatcacgaaactccacgcacgaaatgtactgggtaagtaatgcatctggaaatatcgtaagcagtgtcaacatgataagtaggatgcttataaacagatttactatgcgacataagaaagcgacttacgaacctgatgtagatcttggtagtggcactaggaatattggtatcgagtccgaaacaccaaatcttgatataataggaaagcgaatcgaaaagattaaacaagagcatgagacgtcttggcactatgatcaagatcacccttataagacctgggcataccatggtagctatgaaaccaagcaaacgggaagtgcttcgagtatggtaaacggggtcgtgcgcttattaacaaaaccgtgggatgttataccaatggtcacacaaatggcaatgacagacactactcccttcggacaacaacgagtatttaaagaaaaggtcgatactagaacgcaagaaccaaaagaaggcacgaaaaagctcatgaaaattacagcggaatggttatggaaagagctgggcaagaagaaaacacctaggatgtgtacacgcgaagagtttaccaggaaagttaggtcaaatgcggcattaggcgccatattcacagacgaaaataaatggaaaagtgcaagagaggcagtcgaggatagcggattctgggaattagttgataaagaacgaaatttgcatctagaaggtaaatgcgaaacatgtgtttataatatgatggggaaacgggagaaaaagctcggtgaatttggaaaagcaaaaggatcccgcgccatatggtatatgtggctcggggctcgatttttagaatttgaagccctcggcttcttaaacgaagaccattggtttagtcgtgaaaattcactttcaggagttgaaggtgaaggcctacacaaactaggatatatcctacgcgacgtttcgaagaaggaaggcggagcgatgtacgctgatgatactgctgggtgggatacaagaattaccttggaagatttgaaaaacgaagaaatggtaacaaatcatatggaaggtgaacataagaaactagcggaggcgatattcaagctaacatatcagaacaaagtagtcagagtacaaaggccaacccctagagggacagtaatggatataatatctagacgagaccaaagaggatccggacaagttgtcacgtatgggctaaacacttttactaacatggaagcgcagttgatacgacaaatggaaggggagggagtgtttaagagcatacaacaattaacagtcactgaagaaattgcagtcaaaaactggcttgttcgtgtcggtcgagaaaggttatcgaggatggcaatctccggcgacgactgtgtagtaaaaccactggatgatcggtttgcatcagctctcactgcccttaacgatatgggaaaagtgaggaaagatatccaacagtgggaacctagtagggggtggaacgattggacgcaagtaccattctgctcacatcacttccatgagttaattatgaaagatggacgagtgctggtcgtaccatgcagaaatcaagatgaacttatcgggcgtgccagaatatcccaaggcgcggggtggtcgctaagagagacagcatgtctagggaaaagctacgcacaaatgtggtcgcttatgtactttcatagaagggatttgagacttgcagcaaacgcaatatgttctgcagtaccttcccactgggtaccaacgtcgagaacaacatggtcaattcacgcaacgcacgaatggatgacaactgaagatatgttaacagtttggaatagagtgtggatacaagagaacccctggatggaagataagacaccggtagaatcctgggaggagattccttacctaggtaaaagagaagatcagtggtgcgggagtctaataggcctgacctcaagagccacttgggccaaaaacatccagaccgcaataaaccaagtgcggtccttaataggaaacgaagaatacacagattacatgccaagtatgaagagatttaggagagaagaggaggaagctggagttctttggtaa

SEQ ID NO: 22798 - RNA, 9876 nt, synthetic construct
  misc_feature 1..9876: note = derived and/or modified CDS sequence (opt6) from DENV-2__KT187554__SS-prME
  source 1..9876: mol_type = other RNA
acagctggaataatcataatgatgattccgacagtgatggcttttcacttaacaactaggaacggagagccgcacatgatcgttagcagacaagaaaaaggaaaatctttactttttaagaccgaaaacggggttaacatgtgcactcttatggcgatggacttaggagaattatgcgaagatacaattacatataactgcccattattaaggcaaaatgagccagaagatatagattgttggtgtaactcaacttcaacatgggttacatatgggacatgtactgccactggggaacatagacgagaaaagagatcagtagccttagtgcctcatgtaggtatgggattagaaactcgaaccgaaacatggatgtctagtgaaggtgcatggaaacacgctcaacggatcgaaacctgggtactgcgacatccgggttttaccattatggctgcaattttagcctatacgataggcacaacatatttccaacgagtattaatattcatattgctaacagcagttgctcctagcatgacaatgcgatgtataggcatatcaaatcgagatttcgtagaaggagtgagtggggggtcttgggtagacatcgtcctagaacacggcagctgcgtcaccacaatggctaaaaataaacccaccctagactttgaattaatcaaaacagaagcaaaacatccagccacccttaggaagtattgtatagaagcgaagctaactaacaccacaactgcaagccgttgtccaactcagggcgagccttctctgaatgaagaacaagacaagcggtttgtctgcaagcatagcatggtagaccgaggttggggaaacggttgtgggttgtttggcaaaggaggtatcgtgacctgcgcaatgtttacttgtaaaaagaatatggaaggaaaaatagttcaacctgagaatttggaatatacaatagtgattacgccccattctggagaagaaaatgccgttgggaatgacactggaaaacacggcaaggagattaaagtcactccacaatctagcataactgaggcagaattaacgggttacggaactgtaacaatggaatgttcaccacgcacaggattggacttcaacgaaatggtacttttgcagatggagaacaaagcatggctagtccacagacaatggtttctagacctaccattaccgtggctacctggtgctgatacgcagggatctaactggattcaaaaagaaacattggttacatttaaaaatccacacgccaaaaaacaagacgtagtcgttttgggaagtcaggaaggcgcgatgcatacggctctgaccggtgcgacagagatccaaatgagttcaggtaaccttctctttactggacatttaaaatgtagactaagaatggataaactgcagttaaaggggatgagttattcaatgtgtaccgggaagtttaaagtagtgaaagaaattgcagaaacacaacatggaactattgtaattagagtccaatatgagggagatgggtcaccttgcaagataccctttgaaataatggatctggaaaaaagacatgtgctgggcagactaattaccgtcaatcctatagttaccgaaaaggattcaccagtaaacatagaggcagagcccccttttggtgacagttacatcataatcggggtagaacctggacagttaaaattatcatggtttaaaaagggatcttcaataggccagatgtttgaaacaacaatgagaggtgcgaaaagaatggcaatattaggggacaccgcatgggacttcgggtctttaggtggtgtattcacatcgattggaaaggcgttacaccaagtctttggcgccatatatggagcagcattttctggagtttcttggacaatgaaaatattaataggagtagtcattacatggatcggcatgaatagtagatcaacctccctatcggtatccttagttctagtaggcgtagtaactctctatttaggagtcatggtccaagcagactccggatgtgttgtaagctggaagaacaaagagttgaaatgtggttcggggatatttataactgacaacgttcacacatggactgagcaatataagttccaaccggagtcgccatccaaactcgcgtcggccatccagaaagctcacgaagagggaatatgtggaatcaggtctgtgactcggctagaaaaccttatgtggaaacagataacaccagagctgaatcatatcctgagcgaaaatgaagtcaaactgactattatgaccggagatatcaagggcataatgcaagccggcaaacggagcctccgcccacaaccaacagaactcaaatattcttggaagacatggggtaaagctaaaatgctaagtaccgaattacataatcacacctttcttatcgatggtccagaaactgcagagtgcccgaatacgaatcgagcatggaacagtttagaggtagaggattacggttttggcgttttcaccacaaacatatggttaaaattaaaagaaagacaagacgtattttgtgactccaaattgatgtcggcagcaataaaggataaccgggcagtccatgctgatatggggtattggattgagtcagctcttaacgacacttggaaaatcgagaaagcgagtttcattgaagtcaaatcttgccattggccaaaatcccatacactttggtctaacggagtgttggaatcagaaatgataataccaaaaaatttcgctggacctgtaagccaacataattataggccaggatatcatacacagactgccggaccatggcatttgggtcgtttagaaatggactttgatttttgtgaaggaactacagtggtagtgactgaagactgcggcaacagaggcccatcactgcgtactaccaccgcttcaggcaaattaataacagaatggtgctgtagaagttgcacacttcccccattaagatacagaggtgaagacgggtgttggtacgggatggagattcgaccattgaaagaaaaggaagagaatctagtaaatagcttagtaactgctggtcatggtcaaattgataacttcagtttaggtgtccttggtatggcactttttttagaagaaatgctccgaacaagagtaggaacaaaacatgctattctactggtagccgtatcctttgtgacattgataaccggtaatatgtcatttagagatttaggaagggtaatggtcatggttggcgcagccatgacagatgatataggcatgggagtgacatacctagcgctactagcagcgtttaaagtgcgacccacgttcgcggctggtttactattacgaaaacttacgagtaaagagttaatgatgactacaataggcattgttctcctatcacaaagcactatgccagaaacgatattggagcttactgatgcactagctttgggaatgatggtcctcaagattgtccggaatatggaaaaataccaattggcagtcacaatcatggcaatactgtgtgtaccaaatgcagtcattttacaaaacgcatggaaggtaagctgcacaactttagctgtagtatccgtatcccccttgtttctaaccagtagccaacaaaaagccgactggatacctttagcattaaccattaaaggtttaaaccctaccgctatctttttgacgactctgagtcgaactagtaagaaacgatcatggcctttgaacgaagcaataatggccgttggaatggtatcgatcttagcatcatcactgttaaaaaatgatataccaatgacaggccctctggtagcaggtggattactaacagtttgttatgtactaacaggacgtagcgcagatttagaacttgaaagggcagcggacgttcgatgggaagaacaagcagaaatctccggctcgagtccaatattaagtattacgatatctgaggatggttccatgtctatcaaaaacgaagaagaggaacaaacgctcactatactaattcgcacgggccttttggtgatatcaggtttattcccggttagcatacctataaccgctgcggcctggtatttatgggaagtgaaaaaacaaagagcaggagtcctttgggatgtacccagcccaccacccgtagggaaagctgaacttgaagatggcgcataccgcatcaaacaaaaaggtatactaggatatagtcagattggggctggggtatataaggaaggtacattccatacaatgtggcacgtcaccaggggtgctgtacttatgcataagggaaaaagaattgaaccgagttgggcagacgtgaaaaaggatctaatctcgtatggcggaggatggaaacttgagggagaatggaaagaaggagaagaggtccaagtactagcgctagaacctggaaaaaacccgagagcagttcaaacaaaaccagggttattcaagactaacaccggaacaataggagccgtctcactcgacttctctccaggcacctctggatcacctatagttgataaaaagggtaaagtggtcgggttatacgggaatggcgtcgtgacgaggagtggcacttatgttagcgccattgcacaaacggaaaaaagcattgaagataatcccgaaatcgaagacgacatctttagaaaaaaacgactgactattatggatctgcatccaggggccggcaagacgaaacggtatctaccagccattgtaagagaggctataaaaagaggtctaagaacattgatactagcaccgactcgcgtagtcgctgcagagatggaagaagcgctacgaggactacctatacgttaccagacgccggctataagggcagaacatactggtcgagaaattgttgacttaatgtgccacgccacgttcacgatgcgactcctgagtccaatccgagttccaaactataatcttatcataatggatgaggcccactttacggacccagcatctatagcagcaaggggctatataagcacacgcgtagagatgggagaagccgcaggtatctttatgaccgctactccacccggatctcgcgatccgtttccccagtcaaatgcccccataatggatgaagaacgggaaattcccgaaaggagctggaattccggacacgaatgggtcacagatttcaaaggaaaaacggtatggtttgtgccatctataaaggcagggaatgacattgctgcttgtcttagaaaaaacgggaaaaaagttatacaattgagccgaaagactttcgacagcgaatacatcaaaactaggaccaacgactgggactttgtagtaacgacagacatatctgagatgggtgcaaacttcaaagctgaaagggtaatagaccctagacgatgtatgaaaccagtgatcctaacagacggcgaagaacgagtcatactggcaggaccaatgccagtaactcattcatcagcagcacaaagaagaggacgagttggaagaaatcccaaaaacgaaaacgaccaatatatctatatgggcgaaccgctagaaaacgacgaagattgtgcccattggaaagaagcaaaaatgttacttgataatatctctacgcctgaagggatcataccatccatgtttgaaccagaacgagaaaaagtagacgcaatcgatggagagtatcgattacgaggagaagcgcggaaaacatttgtcgaccttatgcgacgaggagatctaccagtctggttggcataccgagtcgccgcagagggtatcaattacgcagatagaagatggtgcttcgacggagttaaaaataatcagatattagaagaaaacgtcgaagtagaaatttggacgaaagagggcgaacgaaaaaaacttaaacctagatggttagatgctagaatatactcagatccattagcattaaaagaatttaaagagttcgcagctggacgcaaatctcttacattaaatctaattactgaaatgggacggttgcctacatttatgacacaaaaggcccggaatgcactggataacctagcagtattacatactgcagaagctggtggtcgagcttataaccacgcgcttagtgaactacccgaaacattagagacattactcctcttaacactgctagccgcagttacaggtggcatatttttattcttaatgagcggcaaaggcataggaaagatgacattaggaatgtgctgcataataacggcctccattctactttggtatgcacaaatacagcctcattggatcgcagcttcgattatcttagagttcttccttattgtgcttttaataccagaacccgaaaaacaacgaactcctcaagacaatcaattaacgtatgtggtgatagcgattctaactgtcgtcgctgcaacaatggccaatgagatgggtttcttagaaaaaaccaaaaaagactttggattgggaagcaccacaacacaacaaccggaatcaaacatacttgacatagacttacgtccagccagtgcgtggactttatacgcggttgccactactttcatcacacctatgttgaggcattcgatagagaactcaagcgtaaacgtttcactcacagccatcgcaaatcaagcgacggtactcatgggacttggtaaaggatggccactaagcaaaatggacatcggagtaccacttttagctattggctgctactcgcaagttaatccaattacgttaaccgccgcattattattattagtcgcccattacgcaattataggtcccggtttacaagcaaaagcaacacgggaggcccaaaaaagagccgcggcaggtataatgaaaaatcctacggtcgacggaataactgtaatagatcttgatccaattccatacgatcccaaatttgaaaagcagttaggacaagtaatgttacttgtcttatgcgtaacacaggtattaatgatgaggacaacatgggcattgtgtgaggcactcaccctagctacgggacccatatcgacgctatgggagggcaatcctggtaggttttggaataccacaatagcagtctctatggctaacatttttagaggcagctatttagcaggtgcaggcttattatttagcataatgaaaaacacagctaatacaaggcgaggaacaggtaatactggggaaacattaggagaaaaatggaaaaatcggttgaacgccttaggcaaaagtgaattccaaatttataagaagagcggcatacaggaagttgatagaactttagcgaaagaaggtattaaaagaggcgaaacagatcaccatgccgtaagtagaggaagtgccaaactccggtggtttgtggaaaggaatctggtaacacctgaaggtaaggtagtagacttgggctgcggacgaggcggctggtcatattattgtgggggccttaagaatgtaaaagaagttaagggactaacgaaaggcgggcctggtcatgaagaacctataccgatgtccacatacggttggaatttagttcgactgcagtcaggcgtagatgtgttttttacgcctccagagaaatgcgatacattactttgtgacataggtgaaagctccccgaatcctactgtggaggctggacggacccttagagtactaaatttagtcgaaaactggttaaacaataatactcaattttgtataaaagttttaaacccatatatgccgagcgtcatagaaaaaatggaagccctacaacgcaagtacggcggggctctagtacgaaatcccttatcacgaaattcaactcatgaaatgtattgggttagtaatgcatcaggaaatatagtttccagcgtaaacatgatctcgagaatgctaataaatcgttttactatgagacataaaaaagcgacgtacgaaccggatgtggatttaggatccggtacacggaatatcggaatagagtccgagacaccaaacctagatatcataggaaaaaggatagaaaagataaagcaagaacatgaaacttcgtggcactatgaccaagatcatccttataaaacttgggcctatcacggttcatatgaaaccaagcaaactggaagcgcaagctcaatggtgaacggagtagtacgattgctgacgaaaccctgggacgtaataccaatggtcacacaaatggcaatgactgataccactccattcgggcaacaaagggtatttaaagaaaaagttgatacaaggacccaagaaccaaaggaaggaacgaaaaagctaatgaaaattacggccgaatggctatggaaggagttaggaaagaaaaagaccccgaggatgtgcacacgggaagaattcactagaaaagtacgaagcaatgcggctctaggagcgatcttcaccgatgaaaataaatggaagagtgctcgagaagcagttgaagattcgggcttctgggaacttgtagataaggaacgaaatctacacttagaaggaaaatgtgaaacttgcgtttacaatatgatgggtaaaagggagaaaaagttaggagaatttggtaaggcgaaaggatctcgtgccatatggtacatgtggctaggtgcaagatttctggaatttgaggcactgggatttttaaatgaagatcactggtttagtcgggaaaacagtctttctggggtagaaggtgaaggattgcacaaattgggctatattctgcgagatgttagcaaaagggaaggaggcgccatgtatgctgacgacacagctggttgggatactagaataacactcgaagatttaaaaaatgaagaaatggtaacgaatcatatggaaggagaacataaaaaattagctgaagctatcttcaaattgacataccaaaataaagtcgttagggtccaacgacctacgcccagaggaaccgtcatggatattattagccgacgtgatcaacgtggatccggacaggtggttacctacggcctgaacacatttacaaatatggaagctcagttgatccgacagatggaaggtgagggagtttttaagtccattcaacaactaacagttacagaagaaatcgcagtcaagaattggttagttagggttggacgagaacgcctatcaaggatggctatttctggagatgattgcgttgtgaaacctttagacgaccgatttgcttcagccctgactgcattgaatgacatgggcaaagtgagaaaagacattcaacaatgggaaccttctagaggttggaacgactggactcaagtcccgttttgctcgcaccattttcatgaattaattatgaaagatgggcgtgtattagttgtaccttgcagaaaccaggacgagttgatagggagagcgcgaatctctcagggtgcgggatggtcgttacgtgaaacggcatgtctaggaaaaagctatgctcaaatgtggaacttgatgtattttcaccgaagggacctccgactcgcagcgaacgcgatttgtagcgccgtaccctcccattgggtgcccacctctcgcacaacatggtccattcatgctacacatgaatggatgacaacagaagacatgcttactgtctggaaccgagtctggatccaagaaaatccatggatggaggataaaactccagtcgaaagctgggaagaaataccgtatttaggcaaacgtgaagatcaatggtgcgggagtctcataggacttacttcaagggcaacatgggcaaagaatatccaaacggcaattaatcaagtcagaagtctaataggtaacgaagagtacacggattacatgccgagcatgaaaaggtttcggagagaagaagaggaagcaggagttctctggtaa

SEQ ID NO: 22799 - RNA, 9876 nt, synthetic construct
  misc_feature 1..9876: note = derived and/or modified CDS sequence (opt6) from DENV-2__KT187557__SS-prME
  source 1..9876: mol_type = other RNA
acagcaggcataataattatgatgataccgacggtaatggcttttcacttaactactcggaacggtgaaccgcacatgattgtgtcaaggcaagaaaaaggaaagtcattattattcaagacagagaacggggttaatatgtgcacacttatggcgatggacctaggtgaactatgcgaggatacaataacttataactgtccccttttaagacagaatgaacctgaagacatagactgttggtgtaattcaacatcaacctgggtgacttatggaacctgtacagcaacaggagaacatcgccgcgagaaaaggtcggttgcactggttccacacgtaggtatgggattagaaacgcgtaccgagacttggatgtcaagtgaaggagcctggaaacacgcgcagagaatagagacatgggtcttacgacacccgggttttactatcatggcagccatccttgcttacaccattggaacgacctattttcaaagagtactgatatttatcttactaacagcagttgctccatcaatgacaatgcgttgtatcggtattagtaatcgtgattttgtagaaggggtaagtggaggctcttgggtagatatagtgctagagcatggatcatgtgttactacaatggcaaagaacaagccgacgctagacttcgaattgattaaaaccgaagccaaacatcctgcaacacttagaaaatactgtatagaggcaaaacttacaaatacaacaactgcctcaagatgccctacacaaggcgaaccctcgcttaatgaggaacaagacaaaagattcgtctgtaaacattctatggttgatcgcggatggggaaatggttgtgggctcttcggtaaaggcggtatagtgacatgcgctatgttcacatgcaaaaaaaacatggaaggaaagatcgtccagcctgagaatttagagtacaccattgtcattacaccacactcaggcgaggaaaatgccgtaggtaacgacacaggaaaacatgggaaagaaattaaagtaactccgcagtctagcataaccgaagcggaattaacggggtacggtactgttaccatggaatgttcccctagaactggattagactttaacgaaatggtattgctccagatggaaaacaaagcatggttggtccatcgtcaatggttcttagatctgccccttccatggcttcccggagctgacactcagggtagcaattggatacaaaaggagacattagttaccttcaaaaatccacacgctaaaaaacaggatgtcgtggtcctcggatcgcaagaaggtgcgatgcatactgcattaacaggagcaaccgagatacaaatgtcaagcggaaaccttctatttactgggcacttgaaatgcaggcttaggatggataaactacaactaaagggtatgtcttatagtatgtgtactgggaaatttaaagtagtaaaagaaattgcagaaacacaacacggcactatagtaataagagtgcagtacgaaggcgacggatctccatgcaaaattccatttgaaataatggatttggaaaaaaggcatgttctaggtagattaataacagtaaatccaatagttactgagaaggattcacctgttaatatagaagctgaacccccatttggagatagctacataattataggtgtagaaccgggacaattaaaattaagctggtttaaaaaagggagctccatagggcaaatgtttgaaactacaatgcgcggagcgaaaagaatggccattctaggagatactgcctgggatttcggaagtttaggcggagtatttacttcgattggcaaagcccttcatcaagtatttggtgctatatatggcgccgccttctcaggagtgagctggacaatgaaaatattaataggggtggttataacttggattgggatgaattctaggagcacttcattgtcagttagtttggttttagttggtgtggttactctctatttaggtgtcatggtacaagctgactcaggatgtgtagtatcatggaaaaacaaggagttgaaatgtggatcagggatatttataacggataatgtgcatacttggactgaacaatataagtttcaacccgagtctccctccaagttagcttcagccatccaaaaagcccatgaggaaggcatatgtggcattagatccgtcacgcgactggaaaacttaatgtggaaacagattactccagaacttaaccacattttgtcagaaaatgaagttaaactaacgattatgacgggagatatcaaaggtataatgcaagcagggaagagatcgcttcgcccgcaaccaacagagttaaaatactcttggaagacttggggaaaggcgaagatgttatcgacagagttacataatcatacattccttatcgatggtcctgaaactgccgaatgccctaatactaacagagcatggaattctctagaagtagaggattatggatttggagtattcaccactaatatatggctcaaattgaaagagagacaagatgttttctgcgatagtaaattaatgagcgcagccataaaagataaccgagccgtacacgcagacatgggatattggattgagtcagcacttaatgacacttggaagatcgaaaaagccagctttatcgaagttaaatcatgtcattggccgaaatcacacaccctttggtcaaatggtgtactagaatcagagatgataattccaaaaaacttcgcaggtccaatgtcacaacataattacagaccgggctatcatactcaaacagcgggaccctggcacctgggaagactcgaaatggactttgacttctgtgaaggcacgacggttgtggtcacagaagattgcggaaatagaggaccatccttacgaacaacaacagcatcaggaaagctcattacagaatggtgctgtaggagttgtaccttacctcccctacgatacagaggtgaggatggctgctggtacggcatggaaataagaccactgaaagaaaaggaggaaaatctagtgaattcgctcgttactgccggtcacggccaaatagacaatttctcactaggagtgctgggaatggcactattcttagaagaaatgcttcgcactcgggtgggtactaaacacgccatcctcttggtcgccgtgtctttcgtcactcttattacggggaatatgtcgttcagagacctagggagggttatggttatggtaggtgctgctatgactgatgatataggtatgggtgtgacttatctcgctctattggccgcattcaaagtacgaccaaccttcgcagcggggctattattacgcaaactaacgtcaaaagaactaatgatgacaaccataggtatagtcttgctgagccagagtacaatgccggagacaattttggagcttacagacgcactcgctcttgggatgatggtgctaaaaatagtccgaaacatggaaaagtatcaactagcagtgacaataatggctattctatgcgtacctaatgcagttatacttcaaaacgcctggaaagtatcatgcacgactctcgctgtagtatctgttagtccacttcttcttacgagttcacaacaaaaagctgactggatacctttagctttgactataaaaggtttaaacccgactgcaatttttttaactacactctcacggacttcaaagaaacgttcatggccactaaatgaagcgataatggctgtagggatggtaagtatattagccagttccctcttgaagaatgacatacctatgactggcccgttagtagcaggcgggttacttacagtatgttacgtactcacaggtcgatcagcagatctggaactcgaacgagctgcagacgtaagatgggaggaacaagcagaaatctcgggctcgtccccaatattatctattactatatccgaagatggtagtatgagtatcaaaaacgaagaagaggaacaaacactgacaattttaattcgcacaggattacttgttataagtggattatttccagtttcaatcccaatcacggctgcagcatggtatttatgggaagttaaaaaacaacgcgcaggcgttctttgggatgtaccttcgcctcccccagtaggtaaagcagaattagaagatggagcatatagaataaaacaaaaaggtatattgggttatagtcaaattggagcaggcgtttacaaggaaggcacattccacacaatgtggcacgtaacccgaggagctgtattaatgcacaaaggcaaacgtattgaaccttcttgggcagatgtaaagaaggatctaataagttacggaggagggtggaaactagaaggagagtggaaagaaggtgaggaagtccaggtgctagcattagagccgggtaaaaatccccgagcagtacaaacaaagcctgggttgtttaaaacgaatacaggaacaatcggggcggtctccttggatttctctccaggaacgagtggaagccctatagtcgacaaaaagggaaaagttgttggactgtatggaaacggagtagtaacgagatcgggaacttacgtatccgcaattgcacaaacagaaaagagtattgaggataatcctgaaatcgaagacgacattttccgaaaaaaaaggctaactataatggatcttcaccctggagcaggaaagacaaagagatatctgcccgccatcgtacgcgaagctataaagagaggtctacgaacattaattctagcgccaacgagagtggttgcggctgaaatggaagaagccttgagaggcttacctattcgttatcagactccagccatccgcgccgaacatactggtcgcgaaattgtagatttgatgtgccacgctacatttacaatgagacttctatcgcctattagagtaccgaattataacttaatcataatggacgaagcgcatttcactgatccagcttcaatcgccgcacgtggatacattagtactagggtcgagatgggtgaggcagcgggaatatttatgacagcaacaccgccagggtctcgcgacccatttccgcaaagtaacgctccaattatggatgaagagagagaaatccccgaaagaagctggaactcaggacatgagtgggttacagattttaaaggaaaaaccgtctggttcgtcccaagcataaaagcaggcaacgacatcgcagcttgcctcagaaaaaacggcaaaaaagtgatacaactatcaagaaaaacgttcgatagtgaatacataaagacacgtaccaatgattgggacttcgtcgtgacaaccgatatatccgaaatgggtgccaatttcaaagcagaaagagtaattgacccacgtagatgtatgaaaccagtaatattgactgacggtgaagaaagagtaatattagcgggaccgatgcctgtaacacacagttcagcagcacaaagaagagggcgagttgggcggaatcctaagaacgaaaatgatcaatatatatacatgggagagccactagaaaatgacgaggattgtgcgcattggaaagaagcgaaaatgttacttgacaacataagtactcctgaagggataataccatcaatgtttgagcccgaacgagaaaaggttgatgctatagatggtgaataccgactacgaggagaagcaagaaagacttttgtagacttgatgagacgaggggatctcccggtatggcttgcataccgagttgcagcggagggtatcaactatgcagatagaaggtggtgttttgatggagtaaagaataatcaaatattagaagagaatgttgaggtcgagatatggactaaagaaggagagaggaaaaaacttaaacccagatggcttgatgcacgaatctactccgatcccttagctcttaaagagtttaaagagtttgctgcaggtcgaaaatccttaaccttaaacttaataacagagatgggaagactgccgaccttcatgacgcaaaaagccagaaatgctctagacaacctcgcagtcctacatacggcagaagcaggaggtcgagcttacaatcacgcactctctgaactcccagaaacactcgaaacgttactacttttgaccttactggctgcagtcactggaggaatattcctgtttcttatgtccgggaagggtataggcaaaatgactctaggcatgtgctgtatcatcactgcaagcatattactatggtatgctcaaatccaaccccattggatagccgcaagtataatcttagagttctttctcatcgttctattgataccagaaccagaaaaacaaaggacaccacaggacaatcaattaacatatgtagtgatagcaatattaacggtcgtggcagcaacgatggcaaatgaaatgggttttcttgaaaaaactaaaaaagactttggactaggatcgacaacaacgcagcaaccagaatctaatatacttgatatagatttaagacctgcgagcgcgtggacactatatgccgttgctacaacctttataactccaatgcttcgtcatagtattgaaaattcgagtgtgaacgtaagtctgacagcaatcgctaaccaggcaacagtcctaatggggttagggaaagggtggcctttaagtaaaatggatataggtgtacctcttttagctatcggctgctactcacaagtcaaccccattacattaacggcagctctgttactgctggtagcacattacgccataattggcccggggttacaagcaaaggcaacgagggaagcacaaaagcgggctgcggcaggtataatgaaaaacccaaccgtagatggaataactgtcatagatctggaccccatcccctatgatccaaaatttgaaaaacaattaggtcaagttatgcttctcgttttatgtgtaactcaagtcctaatgatgaggacgacgtgggctctgtgtgaagccctaacattagcgacaggtccaatctcaacactatgggaaggtaatccaggcagattctggaacaccaccatagctgtctcaatggcgaatatctttagaggaagctatctagcaggggcagggcttcttttctcaatcatgaaaaacactgcgaacacaagaagaggaacaggaaataccggagaaactcttggagagaaatggaagaacagactgaatgccctagggaaatctgaattccagatttacaaaaaaagtggaatacaagaagtagatcggacactggctaaagaagggataaaaaggggagaaaccgaccatcacgcagtaagccgaggctcagccaaactaagatggtttgtggagagaaatctcgttactccagagggcaaagtggtcgatttaggttgtggaaggggaggttggtcatattattgtggtggcctaaaaaatgtaaaagaagtaaaaggattaacgaagggaggtccaggacacgaggaaccaataccaatgtcaacgtatggttggaacttggtccgcttgcagtcaggagtggatgtttttttcacaccaccagagaagtgcgatacattgctgtgcgatataggcgaatctagtcctaaccctacggtcgaagcaggtagaacacttcgtgttttaaacctagtagaaaactggttaaacaataacacacagttctgtataaaagtcctgaatccatacatgccttcggtaattgaaaaaatggaagcgctacaaagaaagtacggaggggcgctagttaggaatccattgtctaggaacagtactcacgaaatgtattgggtctcaaacgccagtggcaatatagtcagtagcgtcaatatgatcagtcgaatgctaattaatagatttactatgaggcacaaaaaagctacctacgaaccagatgtagatctgggcagcggcacgcgaaatataggaattgagtccgaaacacctaatttagacatcatcggcaaacggatagagaaaatcaagcaagaacacgagacgtcatggcactatgaccaggatcacccctataaaacatgggcataccacgggtcatacgaaacaaagcaaacgggcagtgcatcaagcatggtaaacggcgttgtgcgcctacttactaaaccgtgggacgtgatacccatggtaacacaaatggcaatgacagatacaacgccattcggacaacagagagtttttaaggagaaggtggataccaggacacaagaaccgaaagagggaacaaaaaagttaatgaaaataacagcagaatggctatggaaagagctaggaaaaaaaaaaacacccaggatgtgcacacgcgaagaatttactagaaaagtaagatcaaacgcggcactaggcgcaatctttactgacgaaaataaatggaagtcagctcgcgaagcagtagaggattcaggattttgggaacttgtagataaagagcgaaatttacacttagaagggaaatgtgaaacctgtgtttacaacatgatgggaaaaagagaaaaaaaattaggcgaatttggaaaggcaaaaggatcaagggctatttggtatatgtggctcggagcgaggtttttagagttcgaagctcttggatttctaaacgaagaccattggtttagtcgtgaaaacagtttgtctggtgtggaaggcgaaggtttacataaacttgggtacatcttacgggatgtgtcaaaaaaagaaggaggagctatgtatgcagacgacacagccggctgggacacgaggattaccctagaagacttaaaaaacgaagagatggttacaaaccatatggaaggtgaacacaaaaagttagccgaagcaatttttaaactaacataccaaaataaagttgttcgtgtacagcgacctacaccacgagggaccgttatggacataatctcacgtagagaccaaagaggttcaggacaagtggtaacttatggtctaaatactttcactaatatggaagctcaactgatacgacaaatggaaggagaaggggtttttaaatcgatacaacaactgacagttacagaggagatagcagtaaagaattggcttgttagagtggggagggaacggctatcaagaatggccatcagtggtgacgactgcgtagtcaaacctcttgatgacaggttcgcatcagcactaacagctttaaacgatatgggaaaagtccgtaaagatatacaacaatgggaacctagtcgcggatggaacgattggacacaagtgccattctgttcacaccatttccacgaattaatcatgaaagatggtagggttctagtagtaccctgccgcaatcaggatgaattaataggaagggcaagaataagccaaggcgcaggatggtcacttagagaaacagcgtgtcttggaaagtcttatgcgcaaatgtggaatctaatgtactttcatagacgagacttacgtttagcagccaacgccatctgcagtgccgtcccatcacattgggttcccacatcccgaactacgtggagtatccacgcaacgcatgaatggatgacaaccgaggacatgttaacagtgtggaatcgagtctggattcaagaaaatccttggatggaagacaaaactccagtagaatcatgggaagaaatcccgtacctcggtaaacgagaggaccaatggtgcggctctttgattggattaacaagcagagctacgtgggctaaaaacatccagacagctataaatcaagtaagatctctaataggaaatgaagagtatacggattatatgccatccatgaagaggtttcgccgggaagaagaagaagctggagtgttgtggtga

SEQ ID NO: 22800 - RNA, 9876 nt, synthetic construct
  misc_feature 1..9876: note = derived and/or modified CDS sequence (opt6) from DENV-2__JQ045670__SS-prME
  source 1..9876: mol_type = other RNA
tcggcaggaatgataataatgttgattcctacagtcatggcatttcacctaactacccggaatggcgaacctcatatgatcgtagggattcaggaaaaaggtaagagtctcctatttaaaacagaggatggtgtaaacatgtgtactttgatggctatggacttgggcgaattatgtgaggatacaataacctacaaatgcccgctacttagacagaatgaacccgaagatatagattgttggtgtaatagtacatccacttgggttacttatgggacatgtacaacaacaggagaacaccgaagggagaaacggtcagtcgcattggtgccacatgtaggaatgggattagaaacacgaactgaaacatggatgtcaagtgaaggggcctggaagcatgctcaaagaatagaaacatggatacttcgccaccctggattcacgatcatggcagcgatattggcatacacaataggaacaacgcatttccagcgagttcttatttttatattactaacagcagtcgcgccgagtatgaccatgcgatgcataggaatcagcaatagagatttcgtagaaggagtctccggggggagttgggtcgacattgtattagagcacggctcgtgtgtaacaacgatggcgaagaacaaaccgacattggacttcgaactaataaaaactgaggcgaaacaacctgcaacgttaagaaaatattgtatagaagctaaacttacgaataccaccacggaatcaagatgtcctacccagggggagccctcattaaaagaagaacaggataagagatttgtatgtaaacattcaatggtggatagagggtgggggaacggatgtggtctcttcgggaaagggggtatagtgacttgtgctatgtttacttgtaagaaaaacatggagggtaagatagtgcaaccggaaaatctagaatataccatcgtagtaactccacatagtggtgaggagcacgcggttgggaacgacacgggtaagcatggaaaagaaattaaggtgacaccacaatcttccataactgaagcagaattaacaggctatgggacagttaccatggaatgttcaccaagaactggcctggatttcaacgaaatggttctactacagatggaaaataaggcatggctagtacataggcaatggttcttggatctcccacttccatggttacctggagcagacaaacaagaaagtaactggatccaaaaagaaactttggtaacattcaagaaccctcacgcgaagaaacaggacgtagttgttctcggttcacaagaaggagccatgcatacagcgctaaccggagcaacagaaatacaaatgtcaagtggaaacctcttatttacgggacatttgaaatgtagattgaggatggataaactccaattaaagggcatgtcatactcaatgtgtaccggcaaatttaaggtagtaaaagaaatcgcagaaacccaacatggaaccatagtaatcagggttcaatatgaaggtgacggatctccctgtaaaatacctttcgaaataatggatcttgagaaaaggtacgtattgggtcgactgattacggtaaaccctatagtcacggaaaaagattcacctgttaatattgaagccgaacccccatttggtgattcctatattattataggggttgaacctgggcaactaaaactaaactggtttaaaaaaggtagctccataggtcagatgttcgaaaccactatgagaggtgcaaagcgtatggcgatcctcggtgatacggcatgggactttggcagtctaggaggtgtctttacatcaataggaaaagcgttacaccaagtgttcggtgctatatatggagcagcctttagtggagtttcatggacaatgaaaattttgataggcgttatcataacatggatcggaatgaattccaggtcaacctccctttcagtttcactagtcctcgtcggtatagtaactctttatctcggggtcatggtacaagctgatagcggatgcgtcgtatcatggaaaaataaggagcttaaatgtgggtcggggatttttataacggataacgttcacacttggactgaacagtataagtttcaaccggagtcaccctccaaactagcatcggctatacaaaaagctcaggaagaaggtatttgtgggattcgctccgttacaagattggagaatttaatgtggaaacaaattaccccagaactcaatcatatacttgccgagaacgaagttaaacttacaatcatgactggcgatataaagggcataatgcaagcagggaagaggtccctacgaccacaaccgacggagttgaagtatagttggaaaacatggggaaaagctaaaatgctgtcaacagagtcatataatcaaacatttctgatagacggacctgaaactgcagaatgcccaaatacaaaccgagcgtggaactcattagaagtcgaagactatggatttggtgtctttacaaccaacatatggttgaagctcaaagaaaagcaagacgcgttttgcgactcaaaattaatgagcgcagcaataaaagacaatagggcagtccacgcagatatgggatattggatagaatctgcactaaacgatacgtggaagattgagaaagcatctttcatcgaagtgaagaattgccattggccgaaaagtcatactctttggagcaacggagttctggaaagtgagatgataattccgaaaaacctagccggacccgtatcgcaacacaactataggccaggatatcacacacagattgctggtccatggcatctcgggaaactagaaatggacttcgatttttgtgatgggactacagtcatagttacagaagactgcggtaatcgaggaccatcacttagaacaaccaccgcctcagggaagttgataactgaatggtgttgtcgctcatgtacattacctcccttacgatacaggggtgaggatggatgttggtatggtatggaaatacgcccccttaaggaaaaggaagaaaaccttgttaattcattagtaaccgctggacatgggcaagtagataacttctcgttgggggtattaggtatggctctatttttagaagaaatgctaaggacaagagtgggtaccaagcatgcgatacttctagtagcagttagttttgttacactaataacaggaaacatgagttttaaggacttgggaagagtagttgttatggtgggcgccgcaatggcagacgatataggcatgggagtcacgtacctggcactattggcggcgtttaaagtaagacctacctttgcagcgggtttgctactgagaaagctaacttcgaaggagctaatgatgacgactattggaattgtgttactatcccagtcaacaattcccgaaacagtcttagaattgacagatgcattagcactaggtatgatggtcctgaagattgtaagaaacatggagaaatatcaattagcagtaactattatggcaattttgtgtgtaccaaacgcagttattttgcaaaatgcatggaaagtaagctgcacgattctcgcagtcgtatcagttagcccgctactattaacaagttctcagcaaaaaacagactggatccctttggccttaaccataaaaggtttaaacccgactgcaatatttctgacaaccctgtcacgcactaacaaaaaacggagttggcctttaaatgaagcaattatggcagtggggatggttagcatattagcaagctccttattaaaaaacgacattcctatgacaggacctttagtagctgggggactgttgaccgtctgttacgttttgacaggaagatcagctgacctagaattagaaagagcaacagatgtaaaatgggaagaccaagcagagattagtggcagttcgcctatactttcaatcactataagtgaagatggatcaatgagtatcaaaaacgaagaggaagaacagacgctaactattcttataagaaccggattattagtcatcagcggattgtttccgattagcataccgataaccgcagcagcatggtatctatgggaagttaaaaaacaaagagccggcgtcctctgggatgtaccaagtcctccaccaatggggaaagcggaacttgaagacggagcctatcgaattaagcaaaaaggaattctaggttattcgcagataggagcaggtgtctacaaggaagggacatttcatacgatgtggcacgtcacaagaggtgctgtacttatgcacaaaggcaaacgaatagaaccatcatgggcagacgtcaaaaaagatttaatttcgtacggagggggatggaaactggaaggagaatggaaagaaggcgaagaagtccaagtattagctctagaaccaggaaagaacccaagggcagtccaaacgaaacccgggctatttaaaactaatactggcacaatcggagcagtcagcttggacttcagccccggcacatcaggatccccaatcatagataaaaagggcaaagtagttggcttatatggaaatggggtagtaacgagaagcggggcgtacgtatcagcaattgcgcaaactgaaaaatcaatagaggacaatcctgaaatagaagacgacatttttagaaaacggagactcaccataatggatctgcatccgggagccggtaaaacaaaacggtacctcccggccattgtcagagaagcaataaaacgaggtctccggaccctaatactagcccctacgagagtggttgcagcagaaatggaggaagcacttaggggattgccaatccgataccagactcccgcaattagagcagaacataccggcagggaaatagtagatctaatgtgccatgcaaccttcacaatgaggttactttctccagtacgtgtcccaaattacaacctaattattatggatgaagcacactttacagatccggcgagtattgcagcacgaggatatatttctacaagagtagagatgggtgaagccgcaggtatttttatgacagctacaccgcccggatctagggacccgttcccacagtcgaatgcacccataatggacgaggaaagagaaatcccagagagatcctggaactctggacacgagtgggtaacggattttaagggaaagacggtatggtttgttccatctattaaagcaggaaacgacatcgcagcatgtttgagaaaaaatggtaaaaaagtaatacaactgagcagaaaaacattcgattctgagtatgtaaaaacgagaactaatgattgggattttgtggtcacaacagatatatcagaaatgggagctaatttcaaagcagaaagagtgatagatccgagacgatgtatgaaacctgtgatattaaccgatggagaagaaagagtaattttagctggacccatgcctgtaacacattcgtccgcagcccaaagaagaggacgaattggcagaaaccctaaaaatgaaaatgatcagtatatctacatgggagaaccattagaaaacgacgaagactgtgcgcattggaaggaagcaaaaatgttactggacaacataaacacaccagaaggcataatcccttctatgtttgaaccggaaagagaaaaggtagacgctatcgacggggagtatcggctacgtggtgaagcacgtaaaacgttcgttgatcttatgagaagaggcgatttaccggtctggctggcatataaggtagcagctgagggaatcaattacgccgataggagatggtgttttgacggtatcaagaacaaccaaatcttagaggagaacgttgaagtagaaatatggacaaaagaaggagaacgaaaaaaactgaagccacgttggttagatgctaggatatactctgaccccctagctttaaaagaattcaaggaatttgctgcagggcgaaaatcgcttactctcaatttaatcactgaaatgggacggttaccaactttcatgacacaaaaaacacgcgatgctctagataacttagctgttttacatacagcagaagcaggaggcagagcttataaccatgctctttcagagctacctgagactttagaaacattattactattaacattgttggccaccgtaacaggaggtatatttctattcttaatgtcagggcgaggcataggaaaaatgactttaggaatgtgctgtattattaccgctagtatactactatggtacgcacaaatacagcctcactggatagcggctagtatcatattagaattctttcttattgttttattaattccagaaccagaaaagcaaagaacgccgcaagacaatcaattgacatacgtagtcattgcgatacttactgtagtagcagctactatggcgaacgaaatgggttttttagagaaaacgaaaaaagactttggattagggtccattgcgacacagcaacccgaatctaacatactcgatatagacctgaggcccgcgtccgcatggacgttgtatgctgtagcaaccacgttcgttactcctatgctaagacattcaatcgagaactcgtctgtaaacgtcagtttaactgcaatagccaatcaagcgactgtattgatgggtcttggaaaaggatggcctctttcgaaaatggatataggcgttccgctattagcgataggttgttactcacaggtaaatccaattacattgactgcagcgttacttcttttggtagcccattatgcgatcataggcccgggattacaagctaaagcgacccgggaagctcaaaaaagagccgccgccgggattatgaaaaacccaaccgtagacggaattacagtaatcgatttagatcctataccttacgaccccaaattcgaaaaacaacttggacaagtaatgcttttgatcttatgcgttacacaagtccttatgatgcggactacatgggcattgtgcgaggctctaaccctagccacaggtccaatatccacgctatgggaaggtaaccccggtagattctggaacacaacaatagcggttagtatggccaatatcttcagaggatcatatttagcaggcgcgggtctactcttcagtataatgaaaaacactactaacactagaaggggcactggcaatattggagagacactcggcgaaaagtggaaatccagattaaacgccttaggcaaaagtgaattccaaacctataaaaagagtggaattcaagaagtggaccggacgctggccaaagagggtattaaaagaggagaaaccgaccaccatgcagtaagtagaggcagcgcaaaactaagatggtttgtggaaagaaacctggtgacgccagaaggaaaagttgttgacctaggttgtggccgagggggttggagttactactgtggaggcctaaagaacgttcgggaagtgaaaggattaacaaaaggaggccctggtcacgaagaaccgataccaatgtcaacatacggctggaacctggtgagactgcaatcgggggttgatgttttctttattccaccggaaaaatgcgatacattattatgtgatataggcgaatcatcacccaaccccacagtggaggcgggaagaacgctaagagtattaaatctggttgaaaattggttaaacaacaacactcaattctgtataaaagttttgaatccttacatgccaagcgtgatcgaaaagatggaagctcttcaacgcaagtacggtggagccttagttcgtaatgacctatctcgcaactcaacacacgaaatgtattgggtatcaaacgcgagtggaaacattgtatcctctgttaacatgatttctagaatgttaataaacaggtttacaatgaggcacaaaaaagcgacgtatgaacctgatgtggatcttggaagcggcacacgaaatatcggtattgagagtgaaatacctaatctcgacataataggcaagcggatagaaaaaataaaacaagaacatgaaacgagttggcattacgatcaagaccatccatataaaacttgggcttaccatggctcgtacgaaacaaaacaaactggatcggcctcgtcaatggtcaatggagtagttagacttctcaccaaaccctgggatgtattgccaacggtaacacaaatggcaatgacagatacaactcccttcgggcaacaacgggtatttaaggaaaaggtagacacgcggacacaagaacccaaagaaggaactaaaaaactaatgaaaataactgcagaatggctctggaaagaattaggtaaaaaaaaaacaccacgaatgtgtacacgagaagaattcaccaggaaagtacgtagcaatgcagcactaggagcaattttcacggatgaaaacaaatggaaatcagctcgagaagcagtggaggattccagattctgggaactagttgacaaagaaaggaatctacatctcgaaggcaaatgcgaaacatgcgtatacaacatgatgggaaaaagggagaaaaagttaggagagttcggaaaagcgaaaggatctagagcaatatggtatatgtggcttggagctaggtttctggagtttgaagcattaggttttttaaacgaagatcactggtttagcagggaaaatagcctcagcggagtcgaaggagaaggattacataaattaggatatatactacgagacgtgagtaaaaaggagggaggagcaatgtacgcagatgatacggctggatgggacactaggattaccttggaggatctaaaaaatgaagaaatggtaaccaaccatatggaaggcgaacataaaaaattggctgaggcgatatttaaactcacgtaccaaaacaaggtagtaagagtacagcgacctactccaagaggaacggtaatggatataataagcagaagagaccaacgtggatcaggtcaagtaggcacgtatggactaaacacattcaccaacatggaggctcaattaatccggcagatggagggcgaaggggtattcaaaaatatccaacatttaacagttacggaagaggtcgcagttcagaattggctagcgagagtgggaagagaacgactaagtagaatggctatttctggggacgattgcgtcgtgaagccgctagatgaccgttttgccaatgctctcacagcgctaaatgacatgggaaaaattagaaaagatatccaacagtgggaaccctccaaaggttggaacgactggacgcaggtaccattttgttcgcatcatttccatgaactcatcatgaaagacggcagggtgttagttgttccttgccggaatcaagacgaactaataggtcgagcaagaataagccagggcgctggttggtccttaagagaaacagcttgcctggggaaatcgtatgcccaaatgtggagccttatgtattttcatagaagagatttaaggttagcggctaatgcaatctgctcggctgtgccgtcacattgggtgcccacatctcgaactacatggagcatacatgcgaaacatgaatggatgacaaccgaagatatgttgactgtatggaatcgagtgtggattcgagaaaatccttggatggaagataagacgccagtagaaagttgggaagaaataccctatctaggtaagcgggaagatcagtggtgcggttctttgatcgggctaacttcaagagcaacttgggcaaaaaacatccaagctgccataaaccaggtccgtagtttaataggtaacgaagaatacacagattatatgccgtcaatgaaaaggtttaggcgcgaggaagaagaggcgggagtactttggtaa

SEQ ID NO: 22801 - RNA, 9876 nt, synthetic construct
  misc_feature 1..9876: note = derived and/or modified CDS sequence (opt6) from DENV-2__JQ045686__SS-prME
  source 1..9876: mol_type = other RNA
agcgctggaatgattattatgcttataccgaccgtaatggcatttcatctcaccacgcgtaatggcgaaccacacatgattgtgggcatacaagaaaaaggaaaatcattactgtttaaaacagaagatggtgttaatatgtgcacactaatggcaatggatttgggagaactatgcgaagacacaataacatataaatgtcctttattaagacaaaacgaacccgaagatattgattgctggtgcaacagtacatcaacgtgggttacgtatgggacgtgcacaacaaccggagaacaccggcgagaaaaacggtcagtggcattggtaccacatgtaggaatggggttagaaactcgaactgaaacatggatgtccagtgaaggggcatggaaacacgcacaaagaatagaaacatggatattacgtcacccagggtttacaataatggctgtcatcctagcttatacaataggtacaactcattttcaacgagtactaatattcattctacttacggccgttgccccctcaatgactatgcggtgcataggaatttcaaatagagattttgtagaaggagtcagcggaggatcatgggtagacatagttttagaacacggttcttgcgtgacgactatggccaaaaataaacccactctagactttgaactcataaaaaccgaagccaaacaacctgccactttgaggaaatattgcattgaagcaaaactaacaaacacgacaacagagtccagatgccccactcaaggagaacctagtttaaaagaggaacaagataaaaggtttgtttgcaaacactcaatggtcgacagaggctggggaaatggatgcggactttttgggaaaggagggatagtaacatgtgctatgttcacatgtaagaaaaacatggaaggcaaaattgttcaaccagagaatttagagtacactattgtagttacaccccactcaggagaagaacacgctgtaggtaatgatactggaaaacatggacaagagataaaagttactccacagtctagcataactgaagctgaattaacgggttacggtaccgtaacgatggagtgtagtccacgcacgggactagattttaatgaaatggtactactccaaatggaaaataaagcatggttagtacacagacaatggtttttagatctacccttaccatggttaccgggggccgacaaacaagaatccaattggattcagaaagaaactcttgtgacattcaaaaatccacatgccaagaaacaggatgtcgtcgtattaggatcccaagagggtgcaatgcatactgctcttacaggagcaactgagatacaaatgagttctgggaatctactatttacaggacacctgaaatgtaggttaagaatggacaaactacaactcaaaggtatgagctactctatgtgtactggaaaattcaaagtggtgaaagaaattgctgaaactcaacacggtacgatagtaatacgggttcaatacgaaggcgacggaagtccatgtaaaataccatttgaaattatggatctcgagaaaagatacgtccttgggagactgataacagtaaaccccatagtcactgaaaaagatagtcctgtaaacatagaagcagagccgccattcggggacagttacattattataggggtagaaccgggtcaactcaaattaaactggtttaagaaaggttcctctattggtcaaatgtttgagactactatgagaggagcgaaacgaatggctattctaggagacacagcatgggattttggatctcttggaggtgtatttacttcaattggaaaagccttgcaccaagtatttggtgccatatacggcgcagctttcagtggtgtgtcttggacaatgaaaatccttataggggtgataatcacgtggataggaatgaatagtcgctcaacctctctttctgtaagtttagtattggttggaattgttacactttatctaggagtaatggttcaggctgattcgggatgcgtagtatcctggaaaaacaaagaacttaaatgcgggtcgggaatttttatcacggataatgtgcacacttggacggagcaatataaatttcagccagaaagtccatcaaaacttgcctcggccatacaaaaagcccaagaagagggaatatgtggtataagatctgtaacacgattggagaatttaatgtggaaacaaataacaccagaattgaatcacattctagccgagaatgaagtgaaactgacaataataactggagatattaagggtataatgcaagccggtaaaagatcattaaggccccaaccaacggaactaaaatattcctggaagacatggggtaaagcaaaaatgttatctacagaatcctacaatcaaacatttcttatagacggcccagagactgcggagtgcccaaacacaaatagagcgtggaactctttagaagtagaagattacggattcggcgtcttcactacaaatatatggctcaagctcaaagaaaaacaggatgctttttgtgattccaaacttatgagtgcggccattaaagataatcgagctgtgcatgccgatatggggtactggatagaaagcgcactaaatgatacatggaaaatagaaaaagcaagttttatagaagtcaaaaactgtcattggccaaaaagtcatacactatggtctaacggagtactcgaatcggaaatgatcatcccgaaaaacctcgctggcccggtatctcaacacaattatcgcccaggttaccatactcagatagcaggcccttggcatcttggaaagttggaaatggacttcaacttttgtgatggaacaacggtaattgtaaccgaagattgcggtaatcgtggaccgtctctacgaacaacaacggcaagcggaaaactaattacagaatggtgttgccgatcctgcacgcttcctccccttaggtatagaggggaagacggatgttggtatggtatggagataagacccctaaaggaaaaggaagagaatttagtcaactcgcttgtgactgcaggccatggtcaagtagataattttagtttgggggtactaggcatggctttatttctagaggaaatgctaaggacccgcgtaggaacaaaacacgcaatcctattagtagcagtctccttcgtgacactaataaccgggaatatgagttttaaagatctagggcgggtcgtagtaatggtaggcgcaacaatgaccgatgatataggaatgggagttacatatctagcgctattagcggcatttaaagtacgacctacatttgctgcaggtctgctattacgaaaacttacatcgaaagaactgatgatgaccacaattggcatcgtgcttttgagtcaaagcacaataccagagacagtactagagctcaccgatgcactcgcattaggaatgatggtactcaaaatagtacgaaacatggaaaaataccaactagcagtgactattatggcaattctgtgcgtaccaaatgcggtgatcctacaaaatgcctggaaagtctcgtgtacgatattagccgtggtatccgtttcgccgcttctactaacttcatcacaacagaaaacagattggattcctcttgccttaaccataaaaggactaaatcctacggccatatttttaacgaccttatcacggacaaataagaaacgcagttggccattaaatgaagctattatggctgtcggtatggtatccatcttagctagttccctactcaaaaatgatatacctatgacaggacccctagtagctggtggattattaacagtgtgttacgtactgaccggacgatctgcagatttagaacttgaacgcgctactgatgtcaagtgggaagatcaggcggaaatatcaggctcatctcccatattatccataacaatatccgaggatggcagtatgagtatcaagaatgaggaggaggaacaaaccttgacgattctaattagaacgggcctccttgtgatatctggattatttcccatatccatcccgatcacagcggccgcatggtatttatgggaagtaaagaaacaacgcgcaggggttttgtgggatgtgccttcaccaccacccatggggaaagcggagttagaggatggagcttatagaattaaacaaaaaggaattttaggatacagccagattggcgccggtgtatataaagaaggaactttccacacaatgtggcatgtaacaagaggcgctgtactaatgcataaaggtaaacgcatcgaaccatcttgggcagacgttaagaaagatcttatatcatacggaggaggttggaaattggaaggggagtggaaagaaggtgaagaagtacaagtacttgcactggaacccgggaaaaacccccgagcggttcagactaaaccgggtctgtttaaaacaaacacgggaacaattggagctgtttcgttggacttctctcctggtacctcgggctcgcctattatagacaagaaaggaaaagtagtaggcctgtatggcaatggagtggttactcgttccggagcatacgtttcagctatcgcacaaacagaaaagtcaatcgaggataatccagaaatcgaggacgatatatttagaaaacgtcggctaacgattatggatttacaccctggtgctggtaaaaccaaaaggtatctgccagcaatagtgagagaagctattaaaaggggtttgcgtaccttgatactagctcctacgagagtagtagccgcagagatggaggaggccttaagaggacttccgatacgataccaaacgcctgcaattcgtgccgaacatacgggaagagaaatagtagacctgatgtgccatgccaccttcactatgagattattatcaccggtgcgggtgccaaactacaacctgatcataatggacgaagcccatttcactgatccagcttccatcgccgctagagggtatatatcaacaagagttgaaatgggagaggcagcagggatcttcatgactgcaacaccccctggttctcgcgacccatttcctcaatctaacgctccaataatcgacgaagaacgagaaataccggaaagatcgtggaactcgggtcatgagtgggttactgatttcaaaggaaagacggtttggtttgttccaagtattaaagcaggtaatgacatagcagcgtgtttacggaaaaatggtaagaaagtaattcagttgtcacgaaaaacattcgacagtgaatacgtaaaaactaggacaaacgattgggactttgtcgttacaacagatatatcggaaatgggggcaaactttaaggcggaacgtgttatcgatcccagacgatgtatgaaaccagtaatactaactgacggagaggaaagggtaattttagcaggccctatgcctgttacacacagttcagcagctcaaagaagaggtagaattggccgaaatcccaagaacgagaacgatcaatatatatatatgggagaaccccttgaaaatgacgaggattgtgcgcattggaaagaggcgaaaatgctcttagacaatattaatactcctgaagggataataccatcgatgtttgagccagagagagaaaaggttgacgctatagtaggtgaatataggctccgcggggaagcgaggaaaactttcgtagacctgatgcgacgaggagatttgcccgtatggttagcatacaaggtagctgcagaaggaatcaactacgctgataggagatggtgttttgatggtatcaaaaataatcaaatacttgaagagaacatggaggttgaaatttggacaaaagagggggagaggaagaaactgaagccgcgatggctcgatgctaggatatattcggatccattggctctgaaggaatttaaagaatttgctgctgggaggaaatccttgactctaaatttaattacagaaatgggacgattacccacattcatgacccagaaaacacgggacgcattagataacttagcggtactgcatactgctgaggcaggagggagggcatacaatcatgcactatcggaactgcctgaaacattggagaccctactgctactaacactcctagcaacagtaactgggggaatcttcttattcttaatgtcaggaagaggtataggaaaaatgacactaggaatgtgttgcataataacagcaagtatacttctttggtatgcacaaatacaaccacattggatagctgcaagcataatattagaatttttcctcatcgttttactaatacccgaacctgaaaaacaacgtacgccgcaggacaaccagctaacatatgtggttattgctatccttactgtagtagcggcgacgatggcaaatgaaatggggttcctggaaaagactaagaaagatttgggactagggtccatagcaacacaacaacctgaatctaatatcctcgatatagacctaagaccagcaagtgcatggaccttgtacgcagtagcaactacattcgttacaccaatgcttcgtcactcgattgagaactcatctgttaatgtcagtctaacggccatagcaaatcaagctacagttttaatgggactggggaaaggctggccacttagcaaaatggatataggcgtacctctactcgcaattggttgctactcccaagtaaatccaattacactgacagcagcattactcctactcgtagcacattacgcaataataggacccgggttgcaagctaaggcgactagggaagcacagaaaagggcagcagccgggataatgaaaaatccaacagttgatgggataactgttatagatttagatcccatcccatacgacccaaaatttgaaaaacaactaggtcaagttatgctattagttttatgtgtaacacaagtcttaatgatgaggactacgtgggcactatgcgaagccttaacactagcaactggacctatcagtactctatgggaaggaaatcccggaagattttggaatacgacaattgctgtttcgatggcgaacatattcagaggaagctacttggccggagctggacttctgtttagtattatgaaaaatactacaaacactcgcaggggaaccggtaatatgggggaaacactaggggagaaatggaaatcacggttaaatgcattgggaaaatcagagttccaaatctataagaaaagcggcatacaagaagtagaccgtactttggcaaaagagggtattaaaagaggggaaacggatcaccacgccgtaagcagaggttctgccaaacttaggtggtttgtggagaggaatatggtaacaccggaaggaaaggtagttgatttgggctgtggtcgcggaggatggtcatactactgtggtggattaaagaatgttagagaggtcaaaggattaactaaagggggtccaggccacgaagaacccattccaatgtccacttatggttggaatctagtgaggctacagagcggtgtagatgtattctttataccaccagaaaagtgtgacacattactatgtgatataggtgagtcgagtccaaatccaacggtggaagcaggtagaacgcttcgcgtacttaatctagtagaaaattggttaaataataacacgcaattttgcatcaaagttctaaatccctacatgccttcagtcatagagaaaatggaggctttacagcgaaagtatggtggtgcattagtacggaatcccctgtcccgtaacagcactcacgaaatgtactgggtgagcaatgcatcaggaaacattgtctcttctgttaatatgattagtagaatgctaatcaatagatttactatgcgtcataagaaagcgacttacgagcctgacgtggatcttgggtcgggtactcggaacattgggatagaatctgagatcccaaatttagatataattggaaaaaggatagagaaaataaaacaggaacatgaaactagctggcattacgaccaagatcacccatacaagacgtgggcatatcatggttcatatgagacaaaacaaacaggctcggcatcaagcatggtaaacggagtagttaggttactaactaaaccttgggatgttttgccgactgttacgcaaatggctatgactgatacaacaccatttgggcaacaaagagttttcaaagaaaaagttgatactcggacccaagagccgaaggaaggcaccaagaaattaatgaaaataactgccgaatggctatggaaagaactcggtaaaaagaagacacctcgtatgtgtacaagagaggagttcacgcgaaaagttagatcaaacgctgcactcggagccatattcaccgatgaaaataaatggaaatcggccagggaggctgtagaagattcaaggttctgggaattagtcgacaaggaaaggaacctacatctagaaggaaaatgcgaaacttgcgtctataatatgatgggtaaaagagagaagaaactaggggagttcggaaaagcgaaaggatcacgcgccatatggtatatgtggttaggagcacgatttttagaatttgaggccctggggtttctaaatgaagaccactggtttagtagggaaaattctctctcgggcgtcgaaggcgagggcctgcataaacttggctatatactccgagatgtgagtaagaaagaaggaggtgctatgtatgcagatgatactgccggatgggatactagagttacactcgaagacttaaagaacgaagaaatggtgacaaatcatatggaaggagaacacaagaaattagctgaagcgattttcaaactaacgtatcaaaataaagtcgtacgagtgcaaagacctacgcctagaggtacagttatggatattatcagccgtagagaccaacgaggttccggccaagtaggcacttacggactaaatacttttactaatatggaggctcagctcataaggcaaatggaaggtgagggggtctttaaaaatatacaacatttgactgtaactgaagaagttgctgttaaaaactggttagcgagagtagggcgtgaaagattaagtagaatggctatatctggggacgactgtgtagtaaaacctctggatgatcgattcgcgaatgctcttacggccttaaacgacatgggaaagatcagaaaggatattcaacaatgggagccgtctagaggctggaacgattggacgcaagttcctttttgttctcatcactttcacgagttgatcatgaaagatggaagagtattggtagtaccctgccgtaatcaagatgaattgatagggagagctcgtatatcacagggcgcgggatggtctttacgtgaaacagcatgtctcggtaaatcttatgcccaaatgtggagtcttatgtactttcacaggagagacctccgacttgcagcaaacgcgatttgttctgcggttcctagtcattgggtgcccacaagtagaaccacatggagcattcatgcgaaacatgagtggatgacaacggaagacatgctaaccgtgtggaacagagtatggattagagaaaatccttggatggaggataaaacacctgtcgaatcgtgggaagaaataccatacttgggtaaaagagaggatcagtggtgcggtagtcttattggactgacatccagggcaacttgggcgaagaacatccaagcggctataaatcaagttcgcagcttaataggaaacgaagaatatactgattatatgccttctatgaagcgctttcgtagagaagaggaagaggcaggagtactttggtag

SEQ ID NO: 22802 - RNA, 9876 nt, synthetic construct
  misc_feature 1..9876: note = derived and/or modified CDS sequence (opt6) from DENV-2__KU094070__SS-prME
  source 1..9876: mol_type = other RNA
actgcagggatgataattatgttgatcccaacagtgatggcgttccatttgacgaccagaaatggagaaccacatatgatagtatcaagacaagaaaaaggaaaatccttactgtttaaaacagaagacggagtgaatatgtgtacgttaatggcaatggatttaggagaatggttagaagataaaataacttataaatgtccactattacgacaaaatgaaccagaagatatcgattgttggtgtaatagcacatcaacgtgggtaacttacggaacctgcacaacaacaggggaacacagaagagaaaaacggtcagttgcattggtcccccacgttgggatgggtctagaaaccagaacagaaacatggatgtcttcagaaggagcctggaaacacgcgcaacgaatagaaacatggattttaagacatccaggatttacgatcatggcagcgatattagcatacacgataggaactactcactttcagcgcgccttaatatttatactattgaccgccgtggcgcccagtatgaccatgcgatgtataggaatctctaatagagacttcgtcgaaggagtatcgggaggatcctgggtagacatcgtgctagaacacggaagctgtgtaactactatggcgaaaaataaaccgacattagattttgaactaataaaaacggaagccaaacaaccggccacattaaggaaatattgtatagaggcgaaactaaccaatacgacaacagaatctcgatgcccaacacaaggagagccttcacttaatgaagaacaagacaaaaggtttgtgtgtaaacactcaatggttgatcgcggatggggcaatggatgtgggctattcgggaaaggcagcatagtaacatgcgcaatgtttacgtgtaagaaaataatgaaaggaaaagtagtacaacctgaaaatctcgagtatacgatcgttattacaccccattctggagaggagcacgcagtcggaaacgacaccggaaagcacggtaaagaaataaagattacacctcaatcatctataactgaggccgaattaaccggatatggaactgttacgatggaatgctctccaaggacggggcttgatttcaacgaaatggtcttattacaaatggagaacaaagcctggctcgtacatagacaatggtttcttgatttaccattaccttggctgccaggagccgacacacaagggtctaattggatacaaaaagaaacattagtcacattcaaaaacccgcacgcaaagaaacaagatgtagtcgttctcggcagccaagaaggagccatgcacacagctttaacaggagcaactgaaatacaaatgtcgagcggctaccttctctttaccgggcacctaaagtgccgcctcagaatggacaaactacaactaaagggaatgtcatactctatgtgtactggaaaatttaaagtagtaaaagagatagcagaaacccaacacggcacaatagtcatccgtgttcaatatgaaggtgacgggtctccttgtaaaattcctttcgagattatggatcttgagaagcgtcacgttctaggcagacttataaccgtaaacccaatcgtcacagaaaaggacagccctgtgaatattgaagcagaaccaccattcggagactcatacataataattggagtagaaccaggacaattgaaactgaactggtttaagaagggaagtagtataggacaaatgtttgaaacaactatgagaggagccaaacggatggctattttaggcgataccgcctgggactttggttctttgggtggagtatttacatctataggcaaggcactacatcaggtattcggggctatttatggtgcagcttttagtggagtttcgtggactatgaaaatcttgactggggttattattacttggataggaatgaactcaagatccacgagtctatcagtttcgcttgtacttgtgggcgcagtaactctatatttgggtgtcatggttcaagctgacagcggatgtgtggtatcgtggaagaacaaagaactaaaatgtggttcaggtatattcataacagataacgtccatacgtggaccgagcagtataaatttcaacctgaaagtccatccaaattagccagtgccatacaaaaagcacatgaagaggggatctgtgggataaggtctgtgactaggctggagaatctaatgtggaaacaaataacacccgagctcaatcacatcttatcagagaacgaagttaaacttactatcatgacaggtgatattaaaggtataatgcaagctggtaagagatctctgagaccacagccgacagaattaaagtatagctggaaaacgtggggtaaagcaaaaatgttatcaacggagtcacataatcaaacatttttgatcgacgggccagaaactgcagaatgcccaaatacaaacagggcatggaactccttagaagtagaagactatggttttggggtttttacaacaaatatatggctcaaattaagagaggaacaagatgtcttttgtgatagtaagctaatgagcgcagctataaaagacaacagagcggttcatgcggacatggggtattggattgaatcggcgttaaacgacacatggaaaatcgaaaaagcatcattcatagaagtaaaaagttgccattggccaaagtcgcacaccttatggtccaatggagttctcgaatcagaaatgattatacctaagaactttgcagggccagtatcccaacataattatagaccgggataccacactcagaccgcaggcccgtggcatcttggtaagctagaaatggattttgacttttgtgagggaacaacggttgtcgttacggaggattgtgggaataggggtccgtccctacgaaccacaaccgctagcgggaaactcataactgaatggtgttgtaggagttgcacgttgccgccactaagataccgaggggaagatggttgttggtacggcatggagatcagacctcttaaagaaaaagaggaaaatttggtcaattccttagtaacagcaggacatgggcagattgacaacttttcgttaggtgttttaggaatggctctctttttagaagagatgctcagaacacgagttgggacaaaacatgcaattctattagttgctgtctcctttgtaacactcattacaggaaatatgtcctttagggatctaggaagagtaatggttatggtcggtgcaacaatgacggatgatatcgggatgggtgtcacctacctcgccttactagcggcattcaaagtaaggccaacctttgctgcaggattgttactaaggaaattaacatccaaggagcttatgatgacaacaattggaattgtacttttatcccagtcaaccatacctgaaaccatacttgaactgactgacgccctagctctaggaatgatggtactaaaaatggtacgaaaaatggaaaaataccagctagcagtaacaataatggcaattttatgtgtcccaaatgcagtaattctgcaaaacgcatggaaagtaagttgtacaatattagctgtcgtatcggtaagcccactgttccttacaagtagccaacaaaaagcagattggatacccttagcacttacgatcaaagggttaaatccaacggccatatttcttaccacgctatcgagaaccaataagaaaagatcgtggccattgaatgaagctattatggcagttggaatggtatcaatacttgcttcgagtttactaaagaacgacataccgatgacaggaccgctagtcgccggagggttattaaccgtgtgttacgtcttaactgggaggagtgcggacctggagctggaacgcgcggctgatgttaagtgggaagatcaagcagaaataagtggatcaagcccaatactgagtataacaatatcagaagatgggtcgatgagtataaagaacgaagaagaagaacagacgttaacaatattaattaggacgggtttattagtgatatcaggtctatttcccgtcagcatacctataacggcagcggcttggtacctatgggaagtgaagaaacaaagagccggtgttctctgggacgtaccaagtcctccacccgtaggcaaagcggaactagaagatggagcttaccgaataaaacaaaaaggcattcttggttatagtcagataggagccggagtatataaagaaggtactttccacacaatgtggcacgttactagaggcgctgtccttatgcataaaggaaaaagaatagagccgtcatgggctgatgtgaagaaagatttgataagctatggtgggggctggaaacttgaaggcgaatggaaagaaggggaagaagttcaagtcctcgctctagagcctggcaaaaatcctagagcagtgcaaacgaaaccaggcttgttcaagactaacgcaggaacaattggcgctgtttcgcttgacttcagccctgggacaagtggcagtcctataatagacaagaaaggcaaggtagttggcctatatggaaacggcgttgtaacacgttcgggagcatatgtatctgctatcgctcaaacagagaagagtatagaagacaatccagagatcgaagatgacatatttaggaaaaggaaactcactataatggacctgcacccaggagcgggaaagacaaaaagatacttaccggctatagtgcgagaagcaataaaacgcggattacgtacactcattctggctccgactcgtgttgtagcagcagagatggaagaggcgttgcgaggactacccataaggtaccaaacgccagctatacgggccgagcacacagggagagaaattgtagatttaatgtgccatgctacttttactatgagacttttaagccccgttagagttccaaattataatctgattattatggacgaagcacactttacagatcctgcatcgattgctgcccgaggatacataagcacacgcgtagaaatgggcgaggctgctggcatatttatgaccgcgacgccgccaggctcgagagatccatttcctcagtctaatgcaccgataatggatgaagaacgagaaataccagaacgtagctggagttcaggacacgagtgggttactgactttaaaggtaagacagtatggttcgtaccatctattaaagcaggcaacgacatagcagcttgcctccgcaaaaatggcaagaaagtaattcaattaagcagaaagacatttgattcagagtatgtaaaaactaggacgaatgattgggactttgtggttacaacagacataagcgaaatgggagcaaacttcaaagcagaacgcgttatagaccctagaaggtgtatgaaaccagtgatactaacagatggtgaggaaagagttacgctcgcaggacctatgccagttacacactcctccgcagcacagcgacgtggacggataggccgtaatccgaaaaacgagaatgatcaatacatttatatgggagagcctttagaaaatgatgaggactgtgctcattggaaagaggcgaagatgttactagataatattaacaccccggaggggatcataccctcgatgttcgaacctgagagagaaaaagtagatgcgatcgatggagagtatcgactacgaggggaggctcggaaaacttttgttgatcttatgagacgaggggatttaccagtatggctcgcctatcgggtagcagcagaaggaattaattacgctgaccggcgctggtgttttgacggaatcaaaaataaccaaatattagaggagaacgtcgaagtcgaaatatggacaaaggaaggtgaaaggaagaaactaaaaccacgatggctagatgctcggatatattcagaccctctggcattgaaagaatttaaagagttcgcggccggtcgtaaatcactaacattaaatctaattacagaaatggggagattgcccacattcatgacacaaaaggcacgagacgcactagataatcttgctgtacttcacacagcggaggcaggaggcagagcgtataatcatgcattatcagaactaccagaaacattagaaaccttattacttttaaccttattagctactgtgacaggagggattttcctatttttaatgtcgggaagaggaatcggaaaaatgacactggggatgtgttgcatcatcacagcttcgattctcttgtggtatgctcaaattcaaccacactggatagcagcatccattattttagagttctttttaatagtgctgctaatcccagaacctgagaaacagcgaacacctcaagacaatcaattaacatatgttgtaatcgcaatactaaccgttgtagctgcgaccatggcaaatgaaatgggatttctcgagaaaactaaaaaggatctaggactaggatccataacaacccaacaacctgagtcaaacattctcgatattgaccttagacctgctagcgcgtggactctctacgcagtagcgactacttttgttacaccgatgttacgacatagtatagaaaactcttcagtgaatgtatctcttaccgccatcgctaaccaagcaacggttttaatggggctcggaaaaggctggccactgtctaagatggacataggagtaccactattagcgataggttgttattcacaggtaaatcctatcactcttactgcagctctattcctgcttgttgcacattacgccataatcggacctggattgcaagcaaaagctactcgggaggcccagaaacgagctgctgcgggcattatgaagaatccaactgtagacggaattacagtgatagacctagatcccattccttatgatcctaaatttgagaaacaattaggtcaagtaatgctcttagttctatgtgtcacacaagtattgatgatgagaacaacttgggcgctatgtgaagctctgacactagctaccggccccataagtacactctgggagggaaatcctggtagattttggaacacgactatagcagtatcgatggctaacatctttcgcggctcttatctggccggagcgggactattgttctctatcatgaaaaacacaaccaacacacgaagaggaactggcaacataggcgaaactttaggagaaaagtggaaatcaagacttaatgcacttggtaaatcagagttccaaatttacaagaaatcaggcattcaggaagtagaccggactctcgccaaagaagggattaaacgaggggaaactgaccatcatgcagtttcacgtggatctgctaaactcaggtggttcgttgaaagaaatctagttactcctgaaggaaaagttgtcgatttaggctgcggacggggaggatggagttattattgtggtggtctcaaaaatgtaagagaagtaaagggactaactaaagggggacccggacatgaagaaccaataccaatgagtacgtatggttggaatcttgtcaggctacaatctggtgttgatgtattcttcacacccccagagaaatgtgatacgcttttatgtgatattggagagagctctccaaatccaactgtagaagccggaagaacactgagagtactgaacttggtcgaaaactggcttaacaacaatactcagttctgtatcaaagttctgaacccttacatgccatccgttattgaaaagatggaggctctacagcgtaaatacgggggagcgttggtgagaaatccactatcccgaaatagcacgcatgaaatgtattgggtatctaatgcttcaggcaacatagtatctagcgtaaatatgatatcaagaatgctaattaataggtttacgatgcgtcataagaaagcgacatacgaacctgatgtcgaccttggctcgggaactcgaaacatagggatagaatcggagatacctaatcttgacatcataggaaagcgaatcgaaaagatcaagcaagaacatgagacgtcttggcattacgatcaagatcatccatacaagacatgggcatatcatggttcatacgaaaccaaacaaaccggatcagcatcatccatggtaaatggtgtggtcagattgctgacaaaaccttgggatgtagtaccaatggtaacccaaatggcaatgacagacaccacaccctttggacaacaacgcgttttcaaggaaaaggtagataccaggactcaagaacccaaagaggggactaaaaagctgatgaaaatcacagccgagtggttatggaaagagttgggtaagaaaaagactcctcgcatgtgtacgcgggaagagtttactcgtaaagtcaggagtaacgctgccctaggagccatatttacagacgaaaataaatggaaatcggcaagagaagcagtagaagattcgcgattttgggagttagttgacaaagaaagaaatctacatctggaaggaaaatgcgaaacctgtgtttataacatgatgggaaagagagagaaaaagttgggagagttcgggaaagcaaaaggctctagggcaatttggtacatgtggctaggcgccagatttttggaatttgaagcattaggattccttaatgaagatcattggttttcaagggaaaactcactaagcggggtcgagggtgaagggctacacaaacttggctatatactccgtgacgtaagcaagaaagaaggtggagcaatgtacgcagatgatacggccggatgggatacaaggatcactttggaagatctgaaaaatgaagaaatggtgacaaaccacatggaaggtgaacacaagaaactagcagaagccattttcaaattgacataccaaaataaagtggtgagggtgcagaggccaaccccgagaggaacagtcatggatattatatctagaagggaccaacgcggaagtggacaagttggaacgtacggcctaaacactttcacaaatatggaagctcagttgatacgccagatggaaggagaaggagtgtttaaatctattcaacatttgaccgtcaccgaagaaattgcagtacagaattggttggcacgagtagggagagagaggctaagtcggatggcaatcagcggggatgattgcgtagtcaaacctcttgatgatagatttgcgtcagcactgactgcactcaatgatatggggaaagtgagaaaggatatccagcagtgggaaccgtctcgaggctggaatgattggacacaggtaccattctgctcccatcatttccatgaattgataatgaaagacggaagagtactcgtagtgccctgcaggaatcaagatgaattaatcggcagggcgaggatctcccaaggtgctgggtggagtctgcgcgaaacggcgtgtctaggaaaatcctatgctcaaatgtggagtttaatgtattttcaccgacgagacctaagacttgccgctaacgcaatttgttctgcagttccttcccactgggtcccaacatcaagaacaacatggtcaatacatgctaaacatgaatggatgactacagaggacatgttaactgtatggaatagggtttggatacaggagaatccatggatggaagataagactcccgttgagagctgggaagagatcccatatctaggcaaaagagaagaccaatggtgcggcagtttaataggactgacaagtagagttacttggggcaaaaatatacagacagccataaaccaggtaagatcgttaatcggaaatgaagaatatacagattatatgccctcaatgaagcgatttcgcagagaggaagaagaagcaggggttctatggtaa

SEQ ID NO: 22803 - RNA, 9876 nt, synthetic construct
  misc_feature 1..9876: note = derived and/or modified CDS sequence (opt6) from DENV-2__FM210215__SS-prME
  source 1..9876: mol_type = other RNA
agtgcaggtatgattgtaatgttaataccaaccgtaatggcattccacctgactacgaggaacggcgaaccacatatgatagtcggtattcaagaaaaaggtaaatccttattattcaaaaccgaagatggagttaatatgtgcacgttaatggcaatggacttgggggaattatgtgaagatacgataacatataaatgtcccctcttaagacaaaatgaacctgaagatatagattgttggtgtaatagtacaagtacttgggttacatatgggacctgtacaacaacaggcgaacacagaagggaaaaacgatcggtagcgctggtaccccatgtcggtatgggattagaaaccaggactgaaacatggatgtctagcgaaggtgcttggaaacatgcacaacgaatagaaacctggatactcagacacccaggttttacaattatggcagctatacttgcttatacaattggaacaacccatttccaacgcgtactaatattcattttattgacagcagtggccccaagtatgacaatgcgctgtataggcattagcaacagagattttgtagaaggggtctctggaggatcctgggtagacattgtattagaacatggttcatgtgttacaacaatggcgaaaaataaacctacactagatttcgaattgataaaaactgaagccaaacagccagcaactctaaggaaatattgtatagaagcaaaattaacaaatacaacgactgagagtaggtgtccgactcagggagaacctagcctgaaagaagaacaggataaaagattcgtttgcaaacattcaatggtagatagaggctggggaaatggatgcggactatttggcaaagggggtattgtaacgtgtgctatgtttacatgtaagaaaaacatggagggaaaaattgtacaaccggaaaacttggagtacacaattgttgttaccccgcatagcggcgaagaacacgcagtgggaaatgacactggtaaacacggaaaagagataaaagtaacaccccaaagctcaatcacagaagcagaacttacaggttacggaacggtgacaatggaatgctcacccagaaccggactggatttcaatgaaatggtactccttcagatggaaaataaagcctggctagttcatcgacaatggttcctggatttgccattgccatggctacccggtgccgacaaacaggaaagtaactggatacaaaaagagactctggtaacgtttaaaaatccgcatgctaagaaacaggacgtagtagtcttaggaagccaagaaggtgcaatgcacactgcattgacaggtgctacagaaatacaaatgagtagtggaaacttactcttcacgggacatctaaagtgcagactgagaatggataaactacaattgaaaggaatgtcatactctatgtgtactggaaaatttaaagtggtcaaagaaatcgcagaaacccaacacgggaccattgttatacgagtacaatatgaaggggacggaagtccatgcaaaatacctttcgaaataatggatctagagaaaaggtatgtactaggtagattaatcacagtaaatcccattgtcacggaaaaagattcccccgtaaatattgaagcagaaccaccgttcggagattcttacataataataggcgttgagcccgggcaacttaaattaaattggtttaagaaaggttccagcattggacaaatgttcgaaacgaccatgagaggtgctaagagaatggcgattcttggagatacggcatgggattttggatccttgggcggagtgttcacatcaattggtaaagcgttgcatcaagtatttggagcgatctacggagcagcattctcaggtgttagctggactatgaaaatactaataggcgtgatcattacatggataggaatgaatagtagatcgacatctttatcagtatccttggtgctagttgggatagtaactctatatttaggagtaatggtacaagcagacagcggttgtgtcgtatcatggaaaaataaagaattgaagtgtggatctgggattttcataacagacaatgtacacacatggactgaacagtacaaattccaaccggagtcaccgtccaaattggcttcagccatacagaaggcccaagaggaaggtatatgcggcatacgttcggtaactcgactcgaaaacctcatgtggaagcaaattacccctgaattaaatcacatactcgcagagaatgaagtaaagttaacgatcatgaccggagatattaaaggaataatgcaagcaggcaagcgttctctgcgacctcaacctacagagctaaaatatagctggaaaacatggggtaaggccaagatgctaagcactgaaagctataatcagacatttttaattgacggccccgagacagcagagtgtcctaatacgaatagggcatggaactcactagaggtagaagactacggttttggagtgttcacaacaaacatttggcttaagctaaaggaaaaacaagatgcgttttgcgactctaagctaatgtcggcagctataaaggataatcgcgcagtacatgcagacatgggatactggatagaatctgcattaaatgatacttggaaaatagaaaaagctagctttattgaagtcaaaaattgccactggcctaaatcgcacacactttggagtaacggagtacttgaatcagagatgataattcctaagaaccttgcgggtcctgtttcacaacacaattatagacctggctatcatactcaaatagccgggccatggcatctagggaaattggagatggatttcgacttctgtgatggtaccactgtaattgtgactgaggactgtggaaacagaggccccagtctaaggacaacaaccgcgagtggaaaactaatcaccgaatggtgctgtagaagttgtaccttacccccactaagatacagaggggaagatggttgttggtacggcatggaaattaggccattaaaagaaaaagaagagaatctggttaatagtctagtcactgctggacacggacaagtggacaacttcagccttggggtacttggaatggcgctatttttagaggaaatgttgaggacaagggtgggtacaaaacacgccatattgcttgtagccgtatcatttgtcactttaattacaggcaacatgtcatttaaggatctaggcagggtagtagtgatggtaggggctacgatggcggatgacataggaatgggagtaacgtacttagcgcttttagcggcatttaaagtgagaccaacatttgcagctggactcctactacgaaaactgacaagcaaagaattaatgatgacgaccattgggatagttctactatctcaaagcaccataccggaaacagtactcgaactgaccgatgcactagcattaggaatgatggttttaaaaattgtacgtaacatggaaaaatatcaactagcggtcacaattatggcaattctatgtgtgccaaacgcggtggtattacagaacgcatggaaagtgtcttgtacaatactggctgttgtttccgttagcccgcttttacttactagcagccaacagaaaactgattggatcccattagctttaacgattaaaggcctgaacccaacagcaatctttttaaccacattatcacgaacgaataagaaaaggtcatggccactaaatgaagccataatggcagtgggaatggtttctatccttgcttcctcattactaaagaatgatatcccaatgacaggtccattggtcgctggtgggttattaacggtatgctatgtcctaaccggcaggtccgcagacttagaacttgaaaaagcaacagatgtcaaatgggaagatcaagcagaaatcagtggctccagtccaattttaagcatcactatttctgaagatggaagcatgagcattaagaatgaagaagaagaacaaacactgacgatactaatacggaccggattactcgtgattagtggattatttcctatatcgatacctattaccgcggctgcctggtatctatgggaagtcaagaaacaacgagccggggttctatgggatgtaccgagcccacctccaatgggcaaagcagagctcgaagacggggcataccgaataaaacagaagggaatattgggctacagccaaattggagctggcgtgtataaagagggtacttttcataccatgtggcatgtgacaagaggcgcagtacttatgcataaaggtaaacgcatagaaccatcttgggcggacgtcaagaaagatttaatatcatatggtggagggtggaaattagaaggagaatggaaagagggggaagaagtacaagtattagcattagaaccgggtaaaaatccacgtgctgttcaaacaaaaccaggtctatttaaaacaaacacaggtacgataggagccgtcagtttagatttttctccaggaacaagtggcagtccaataattgataagaaagggaaagtcgtcggcctatatggaaacggtgtagtaaccagatcaggagcgtacgtatcagcaatagctcagacagagaaaagcatagaagataatccagagattgaagatgacatatttcggaaaagacgactgaccataatggacttacaccctggcgctggaaagacgaaaagatatttacctgcaatcgttagggaggccataaaacgaggcttgagaactttaattttagctccaacgcgtgtagtagcagctgagatggaagaagcattgagaggtttacctattagataccagactcctgcaataaaagcagaacatacaggaagggaaatcgtagatctaatgtgccatgcaacatttacgatgagactcctatctccagtcagagtaccaaactataatctaatcatcatggatgaagctcactttaccgaccctgcaagcattgcagccagaggttacatttctactcgagtggaaatgggagaggcagcgggaatcttcatgacagcaacaccgccagggtcacgagatccattccctcagtctaacgctcccataatcgacgaggaacgagagattcctgaacgtagttggaactcgggacatgagtgggttacagattttaaggggaagacggtgtggttcgtaccatcaattaaagctggtaatgatatagcggcttgcttgcggaaaaatggaaagaaagtaatacaactatcacgaaaaaccttcgattcagagtacgtcaaaactaggactaatgattgggactttgtagtaaccactgacatatcagaaatgggggctaattttaaagctgaaagagtaattgaccctagaagatgtatgaaacctgtaatactaaccgacggtgaagaaagagtcattttagcaggccctatgcctgtaacacatagttctgctgcacaaaggcgaggaaggataggtcgaaatcccaaaaatgagaatgatcaatacatctacatgggagaaccactggaaaatgatgaagattgtgctcattggaaggaagctaagatgcttttggacaatataaatactccagaaggaataataccaagtatgtttgaaccagagagagaaaaagtagatgcaattgacggtgagtatagactgcgcggtgaagctcgcaaaactttcgtagaccttatgcgacggggagatttaccagtttggttagcatacaaggtagcggcagaaggcattaattatgcagaccgacgatggtgttttgatggaatcaaaaataaccaaatattagaagaaaatgttgaagttgaaatatggacaaaggaaggtgaaagaaagaaactaaaaccgaggtggttggatgctagaatctattccgacccactagcattgaaagaatttaaagagttcgctgccggccgtaagagtctaacactaaatctgataaccgaaatgggtaggctacccacctttatgactcagaaaactagagatgcattggacaatctcgctgttttacacacggcagaagccggaggacgagcctacaatcacgcgctgagcgagctacctgagacgttagaaacattgctgctattgacattactggctacagtgacgggaggtattttcctctttctgatgtcaggtcgtggcataggaaagatgacattgggtatgtgttgtattattaccgcgtcaatacttctttggtacgcacaaatacaaccacactggatagcggccagtatcatattggagttcttcttaatcgtacttctcattccagaaccagaaaaacaaagaacaccccaagataatcaactgacatatgtagtgattgcaattcttactgtcgtagcagccacaatggcaaatgaaatgggatttctcgagaaaactaagaaagatctcgggcttggaagcatcgcaactcaacagccagaaagtaatatacttgacatagatttgagaccagcgtcggcttggactttgtatgcggtggcgacaacattcgtaactccaatgttacgacatagtatagaaaatagtagtgtgaacgtaagtctaacagctattgcgaaccaagctactgtactaatggggctaggaaagggctggcccctaagtaagatggacataggggtacccctattggctataggatgttactcccaagtaaatccaatcacactgacagccgcattattgctattagtggcacattatgctataataggtcctggactacaagcaaaagcgactcgggaagcacaaaagcgcgcagcagcaggcataatgaaaaatcctactgtggacggcataaccgtgattgaccttgacccaataccgtatgatccaaaatttgaaaagcaactaggacaagttatgctacttattttatgtgttacacaagtattaatgatgcgcactacgtgggcactgtgtgaggctttaacactagctacgggtcctatctcgaccttgtgggagggtaatcctgggagattctggaatactaccattgctgtttccatggcgaatatctttcgaggaagttatctagcgggtgctggtctactgttctcaataatgaaaaacaccaccaatacgcggcggggaacgggaaacataggggaaactctcggggaaaagtggaaatctcggctcaactccctaggaaaaagtgaatttcaaatatacaagaaatctggtattcaagaagttgataggaccttagcaaaagaaggaataaaaagaggcgagacagaccatcatgcagtcagcagaggctcagcaaaattacgatggttcgtagaaaggaatatggttactcccgaaggtaaagttgttgacttaggatgtggcagaggaggatggtcttactattgtggaggcctaaaaagcgttcgcgaagttaaaggtttaacaaaaggagggccgggtcatgaagaaccgataccaatgagcacatacggttggaacctagtcaggctgcaatctggagtcgacgtattctttatacctccagaaaagtgtgacacactactatgcgacataggtgaatcgtctcctaatcccacagtcgaagcgggaagaactttaagagttctgaaccttgtcgaaaattggcttaacaacaatactcaattctgcattaaagtattaaatccatatatgccgtctgtaatcgagaaaatggaagctctacagagaaaatatggaggagcactcgtaagaaacccactatcaagaaacagcacccacgaaatgtactgggtatcaaacgcttcaggaaatatcgtatccagtgtaaatatgatttcccgaatgttgatcaatagatttactatgagacataaaaaggcgacttatgaacccgacgtcgacttgggttccggcacaaggaacatagggattgaatccgaaattcctaatttggacataatcggtaaacgtattgaaaagattaaacaagagcatgaaacaagctggcactacgaccaagatcacccctataaaacttgggcttatcatggcagctacgagaccaagcaaactggctccgcatcatcgatggtgaatggtgtggttaggttattaactaaaccctgggatgtacttccgacagttacccaaatggcaatgacagacacaactccatttgggcagcaaagagtttttaaagagaaagtagacacccgaacacaagaaccaaaagaaggtacgaagaaattaatgaaaataaccgcggagtggttatggaaagaactggggaagaagaaaacaccacgtatgtgtacaagagaggaatttacaagaaaagttagaagtaacgcggccctaggtgccattttcacagatgaaaataaatggaaaagtgcgcgagaagctgtggaggatagtcggttctgggaattagtggacaaagaaaggaacttgcatttagaaggaaaatgcgagacttgtgtatacaacatgatgggaaaaagagaaaagaaactgggagagttcggcaaagcgaaaggatcccgagcgatttggtacatgtggctcggagctagatttcttgagttcgaggctttaggattcttaaatgaggatcattggtttagtcgagaaaactctttgagcggggttgaaggcgaaggtctacacaaactcggatacattttacgggatgtaagcaagaaagagggcggcgcaatgtatgccgatgataccgctggctgggatactcgtattacactagaagatctcaaaaatgaggaaatggttactaatcacatggaaggagaacacaagaaacttgctgaagctattttcaagctgacctaccaaaacaaagtagtacgagtacagcgaccgactccacgtggtaccgtgatggatataattagtcggcgtgaccagaggggttctggacaagtaggaacttacggtctgaatacattcacaaacatggaggctcaactgattcgtcagatggagggagaaggagttttcaaaaacattcaacacctaaccgtcacagaagaagtggcggttcagaactggttagctagggtagggcgagagaggttgtcccgcatggcaatatcgggtgacgactgtgtcgtcaaaccacttgacgataggtttgccaacgcccttactgcccttaatgacatgggaaaaataaggaaagacattcaacaatgggaaccgtctaaaggctggaacgactggacccaggtcccgttttgttctcatcatttccatgaactaattatgaaagacgggagggtccttgtagtaccatgcagaaatcaagatgaacttattgggagagcaagaatatcccaaggcgccgggtggagtctgagggagacggcctgtttgggcaaatcatacgcccagatgtggtccctaatgtactttcatagacgggaccttagactagcggcgaatgcaatctgctcagcagtcccatcacactgggttccaacttctagaactacttggagtattcacgccaaacatgaatggatgacgaccgaggacatgttaactgtgtggaacagggtatggattagagagaatccatggatggaagataaaactccagttgagtcttgggaagaaataccttacctcggaaagcgggaagaccaatggtgcgggtccttaatcggattaacaagcagagccacgtgggccaaaaatatacaagcggcaattaaccaggtacgctctttgataggaaacgaagaatacacggattacatgccttcaatgaaaaggttccggcgagaagaagaggaagccggcgtcttgtggtag

SEQ ID NO: 22804 - RNA, 9876 nt, synthetic construct
  misc_feature 1..9876: note = derived and/or modified CDS sequence (opt6) from DENV-2__FM210216__SS-prME
  source 1..9876: mol_type = other RNA
agtgctggcatgataatcatgttaatcccaaccgtaatggcatttcatctcacgactagaaacggggagccccatatgatagtagggattcaagagaaaggtaagtcacttctgttcaaaactgaagatggcgtaaatatgtgcacattaatggcaatggatctaggagaattatgcgaagacactattacttataaatgtccgctcctgagacagaatgaaccagaagatatcgactgctggtgtaactctactagtacatgggtaacctacggcacgtgtacaacaactggggaacatagacgagaaaaaagatcagtagcactagtgccacacgtaggaatgggactagagacaaggaccgaaacttggatgagttctgaaggggcctggaaacatgcgcaacgcatagagacttggattctcagacacccgggcttcacgattatggcggcaattcttgcttatacaataggaactacacactttcaaagagtgctgatatttatattattaacagcagtagccccttccatgacgatgcgttgtatagggatcagcaacagggatttcgtagagggagtatccggggggtcatgggttgacattgttctagaacacggatcgtgtgttaccaccatggccaaaaataaaccaacactcgatttcgaactaataaaaaccgaagccaaacaaccagcgacattaagaaaatactgtatagaagcgaagctcacaaataccacgacagaatcgagatgtccaactcagggcgaaccaagtcttaaggaggaacaggataaacgatttgtgtgcaaacattcaatggtagacagaggttggggaaacggatgcggcttgtttggtaaaggaggtatagtaacttgcgccatgtttacatgtaagaaaaacatggaaggaaagatagtacaaccagaaaatctagaatacacaatcgtagttacacctcactcaggagaagaacatgctgtcggaaatgatacaggtaaacacggaaaagaaattaaggtcacgccacaaagttcaatcaccgaggcagaacttacaggatatggtacagtaacaatggaatgttcacccagaacaggcttagattttaacgaaatggtgctattacaaatggaaaataaagcttggcttgtccacagacaatggttcctggatctaccgttgccgtggcttccaggtgctgataaacaggagtctaactggatacagaaagaaaccttagtgacatttaagaacccgcatgctaaaaagcaagacgtcgtagtactggggagtcaggagggtgccatgcacacagcccttaccggtgccacagagatacagatgagttccggtaatctgctattcacagggcatctaaaatgtaggcttcggatggataaactacaacttaaaggtatgtcgtactcaatgtgcacaggcaaatttaaagtagtgaaagaaatagcagaaacacaacacgggaccatcgttatacgagtgcagtatgaaggagatggtagtccctgtaagatacctttcgaaataatggatcttgaaaagagatacgtactagggagacttattactgttaatccgattgttacagaaaaagatagccccgtcaacattgaggcagaaccaccattcggggactcatatatcatcatcggggttgaaccgggtcaactgaaactaaattggttcaaaaagggaagtagtatcgggcagatgttcgaaaccaccatgcgtggagcaaagcgaatggctatcctaggagatacggcatgggacttcggttccttaggcggggtatttactagcataggaaaagccctccatcaagtatttggtgctatttacggggccgcatttagtggtgtgagttggactatgaaaattctcattggagtcataattacatggattggaatgaactcgcgtagcacatcactttcggtcagcttagtattggtaggaatagtgacactatatttgggtgttatggtacaggctgattcaggctgtgtggtgtcctggaaaaataaggaattaaagtgtggatctggaatttttataactgacaacgttcacacatggactgaacaatacaaattccaacccgaaagtccatcaaagctggcctcagcaatccaaaaagcgcaggaagaggggatatgtgggataaggtcggtaacgcgtttggagaatctaatgtggaaacaaataacgcctgaacttaatcatatccttgcagaaaatgaagtcaaacttaccataatgaccggggatatcaaaggaattatgcaagcggggaagaggtccttacgcccacagcctaccgaactaaaatactcttggaaaacttggggaaaagctaagatgttgagcacagagagttacaaccagaccttcctcatagatgggcccgagacaactgaatgtccaaacaccaatagggcatggaattctctggaggtggaggactatgggtttggtgtattcacgacaaacatatggctcaagcttaaagaaaaacaagacgcgttttgcgatagtaaattaatgagcgcggcaataaaagataatagagcagtccatgctgacatgggatattggattgaatcggcactgaatgacacttggaaaatagaaaaagcatctttcattgaagtaaaaaattgccactggccgaagtcacatactctatggtccaatggagtgttagaatctgaaatgataatcccaaagaacttagcaggccctgtctctcaacataattaccgtccaggataccatacacaaatcgcgggtccatggcacctcggaaaactggagatggacttcgatttttgtgacgggacgaccgtaatagtcacagaagattgcggtaatagagggccaagtcttagaacaactacggcatcaggtaagttaataacagaatggtgctgtagaagttgtactctacctcccttaagatatagaggggaagatggatgctggtacgggatggagatacgaccgctaaaagaaaaagaggaaaacttagtgaatagcctggtaacagcgggacatggtcaggtagataacttttccctaggcgttctaggaatggcgctttttctcgaagaaatgctaagaacgcgcgtaggaacgaaacacgcgatactcttggtagcggtgagttttgtaaccctaataacgggaaatatgtcatttaaagacctcggaagagtggtagtaatggttggagctacaatggctgacgatattggtatgggagttacatatcttgcccttttggcggcattcaaggtaagacctacatttgcggcaggattactacttaggaaactgacatccaaagaactaatgatgactacaataggtatagtccttttaagccaaagtacaataccggaaactgtgctggagctaacagatgcgcttgctttgggtatgatggtgcttaaaatcgtacgaaacatggagaaataccaattggcggtcaccattatggcaatactttgtgtacccaatgccgtgattcttcaaaatgcgtggaaagtctcttgtaccatactagctgttgtttccgtatcccctttattattgactagttcgcaacaaaagacagattggatcccccttgccctcacgattaaagggctgaatcccactgcaatatttttaacgacattatcgagaacgaacaagaaacgatcgtggccgctgaacgaggcaattatggcagttggaatggtctcaattttagcgagtagtctgttgaaaaatgatattccaatgacaggaccattagttgctggtggtttattaactgtatgctatgtattaacagggcgatcggccgatctagagttagaaagagcaactgacgtaaaatgggaagatcaggcagaaatatctggaagcagtccaatcctttccataaccattagcgaagatggctctatgtcgattaaaaacgaagaagaggagcaaaccttaacgatcctgattaggacaggccttttggtaatctcagggctcttccccatatcaattccgataacagcggcggcttggtatctctgggaagtcaagaagcaacgtgctggtgtactatgggacgttccatcacctcctcccatgggaaaagctgaactagaggatggcgcatataggataaaacagaaaggtattttgggttacagccaaataggagcgggggtttataaagaaggcacatttcacacgatgtggcatgtaacccgaggcgccgttcttatgcataaggggaaaaggatagaaccaagttgggcggatgttaagaaagatttaataagctatgggggaggatggaaactagaaggagaatggaaagaaggagaagaagtacaagtgctcgcattagaaccgggcaaaaacccaagagcagttcagaccaaaccaggtttgtttaaaactaacacaggaacgataggtgcggtaagccttgacttttcacctggaacatcaggatctcccataattgataaaaaaggaaaagtagtaggattgtacggtaacggtgttgtaactcgatccggagcttacgtatcagccatcgcacagacggaaaagtccatagaagataaccctgagatagaagatgacatctttcgaaaaagacgcctaacgataatggatctgcatccgggcgcaggaaaaacgaaaagatacctacctgcgatagtaagagaggcgataaaaagaggactacgaacgctcatactcgcgccaacaagagtggtagctgccgaaatggaagaagccctacgtggattaccaataagatatcaaacacctgcaatccgggctgaacacaccggaagggaaattgtggatttaatgtgtcacgccacctttacaatgagattactctcaccggttagagtcccaaactacaacttaatcattatggacgaagcccactttacagatcctgcaagcatcgccgcgagggggtacatatcgacacgagtagagatgggggaagctgcgggaatcttcatgaccgctaccccaccaggcagccgagatccgtttccacaatcaaatgcaccgataatagacgaagaaagggaaataccggaaagaagctggaacagtggtcatgaatgggttacagactttaaaggaaaaacagtatggtttgttccgtctataaaagctggaaatgacatagcagcatgtttacgaaaaaatggaaaaaaagttattcaactatcacgaaaaactttcgatagtgaatatgtgaaaacgaggacaaatgactgggactttgtagtcactactgatatatcagagatgggagctaattttaaggcagaaagagtaatagatcccaggagatgcatgaaacctgttatactcacagacggagaggaacgtgtaatcctagcaggtccgatgccagtcacacatagttcggcggcacagcgcaggggtaggataggaaggaacccgaaaaatgagaatgatcaatatatctatatgggggaaccactagaaaatgatgaggactgcgctcattggaaagaggcaaagatgttgctagataacattaatacaccagaaggtatcataccctcaatgtttgaaccagaacgtgaaaaggtggacgcaatcgacggggaatacagattacggggggaagctcgaaagacattcgtagatctaatgagacggggagatctacctgtttggttggcctataaggttgcggcagaggggataaattacgccgataggaggtggtgttttgatggtattaaaaacaaccagattttagaagaaaatgtagaagttgaaatctggacaaaagagggagaacgcaagaaattaaagcctcgatggctagatgctcgtatttacagcgatccactggcattaaaagaatttaaagaattcgctgccggacgcaaaagcctcaccctaaaccttattacagaaatgggacgtcttcctaccttcatgacacaaaagacgagagacgccttagataatctggctgtgttacatacagcagaagcagggggcagagcctataatcatgctttgtcagaacttccagaaacgttggaaacattgttactacttacacttttagcaaccgtaacaggaggtatatttttgtttttgatgtcagggcgcggaatcggaaaaatgacattaggtatgtgttgcattattactgcatctatcttactatggtatgcacaaatacaaccgcactggatagctgcaagcatcattttagaattttttttgatcgtcctattaatcccagaaccggaaaaacaaagaacaccacaagacaaccagctaacgtacgtagttattgctatactaaccgtagtagccgcaacgatggcgaatgaaatgggatttttagagaagacaaaaaaagatctaggacttggatctatagcaacacaacaacccgaaagtaatattttagatatagatctaagaccggctagtgcttggacactatatgctgtagccacaacattcgtcacacccatgttgcgacactccatagaaaacagctctgtaaacgtatcattaacagccattgctaaccaagccactgtattaatgggtctaggcaagggctggccactctcaaagatggatataggagtcccacttttggccataggatgttatagtcaagttaaccctattacattaaccgcggctctcctgttacttgtagctcactatgcaattattgggccaggcctacaagccaaagcaactagagaagctcagaaacgagcggctgctggaattatgaaaaatccaactgttgatggaattaccgttattgatttagacccaatcccatatgatccaaaattcgaaaaacagttaggtcaagtcatgctattgatactatgcgtaacgcaagtactaatgatgagaaccacatgggccttatgtgaagctttaacgctggcaactggcccaatctcaacattgtgggaaggtaatcctggcagattttggaacacaacgattgcagtctcaatggctaacattttccgaggatcttatctagcgggggctggtttattattctccataatgaagaatacaacaaatacccgcagaggtactgggaatataggagaaacccttggtgaaaaatggaagtccaggctaaatgcattgggtaagtctgaatttcaaatatacaagaaaagtggaatacaggaagtagatagaacgttggcaaaagagggtattaagagaggagaaaccgatcatcacgccgtgagtaggggaagtgccaagctacgatggtttgtcgagagaaacatggtaacacctgagggtaaagttgtagaccttggttgtggacggggagggtggtcttattactgtggtggtttaaaaaatgttagagaggtaaaaggattaactaaaggaggaccaggccacgaagaaccgataccgatgtcgacttatggttggaacttagttcgattacagtcaggtgtggatgtattctttattccaccagaaaaatgtgataccttactatgtgacatcggagaatcttcacctaacccgacggtcgaagcaggaaggaccttaagagtactcaatctagtagaaaactggttgaataacaatacacaattttgtatcaaggttctaaacccgtacatgccatccgtaatagaaaagatggaagcactacaaagaaaatacggaggtgctctcgtaagaaacccactttctaggaattcaactcatgagatgtactgggtctcaaatgcaagcggaaacatagtgagcagtgtaaatatgattagtagaatgctaattaacagattcaccatgagacataaaaaagctacttatgagccagacgtagatcttggttcaggtacgagaaatataggtatcgaaagcgaaattccaaatttagatataattggtaagagaatagaaaaaattaaacaagaacacgagacgtcatggcattatgatcaagatcatccctataagacttgggcttaccatgggagctatgaaacaaagcaaactggatcggcctctagcatggtaaatggagtagtacgattacttacgaaaccgtgggatgtactgcctactgtaacacagatggcaatgacagatacaacacctttcggccaacagagagtatttaaagagaaagtggacacaagaacacaagagcccaaagagggaacgaaaaaattaatgaaaataaccgctgagtggttatggaaggaactcgggaaaaaaaagactccccgaatgtgcacccgggaagaatttacgagaaaggttagaagtaatgccgcattgggagctattttcactgatgaaaataaatggaaatccgctagggaagcagtggaagactctcgattctgggaactagttgataaagaacgtaatttacatttagagggcaaatgcgaaacttgtgtatacaatatgatgggtaaacgggagaaaaaactcggcgaattcggtaaagcgaaaggatcccgcgccatatggtacatgtggttaggtgcgcgtttccttgaatttgaagccttaggttttttaaatgaagaccattggttttctagggagaattcactctctggtgtcgaaggagaaggccttcataagctcgggtatatattaagagatgtctcaaagaaagaaggaggagctatgtatgccgacgacacagcaggttgggatactcgaataactttagaagatcttaaaaatgaagaaatggtaacgaatcatatggaaggagaacataaaaaacttgctgaagcaatattcaaattaacataccaaaacaaagtggtccgagtacaaaggccaactccgagaggcacagtaatggatattataagtcgtcgagatcaaagaggatcaggacaagtaggaacgtacggattaaacacgtttactaacatggaggcacaactgatccgacaaatggaaggtgagggagtttttaagaacattcagcacctgaccgtaaccgaggaagtagcagtacaaaactggctagcacgcgtaggtagggagagattatcaaggatggcgatcagcggagacgactgcgttgtaaaaccgttagacgatcgatttgccaatgcccttacagcactaaacgatatgggaaaaatacgtaaagacatacaacaatgggaaccatctaagggttggaacgattggacacaagtgccattctgttcacatcattttcatgaactgattatgaaagatggaagagtgctcgtagttccatgtaggaatcaggatgaacttataggcagagctagaataagccaaggagcaggatggagtctcagagaaacggcttgtttggggaaaagttacgctcagatgtggtcattaatgtactttcatagacgagacttaagattagccgctaatgcaatttgttctgccgtaccgagccattgggttcccacaagtagaactacttggagcattcatgcgaaacacgaatggatgacaacggaggatatgctaacggtatggaacagagtatggatacgtgagaacccctggatggaagacaaaacaccagttgaatcctgggaagaaataccgtatttaggtaaaagagaagaccaatggtgtggatcgttaatagggctaacatcgagggcaacctgggcgaagaatattcaggctgccatcaatcaagtccgatctttaattggtaatgaggaatatacagattacatgccctctatgaaacgctttaggcgtgaagaagaagaagccggagtgttatggtag

SEQ ID NO: 22805 - RNA, 9876 nt, synthetic construct
  misc_feature 1..9876: note = derived and/or modified CDS sequence (opt6) from DENV-2__FM210217__SS-prME
  source 1..9876: mol_type = other RNA
actgcaggcgtgatcatcatgttaatcccaacagcgatggcatttcacttaacaactcgaaacggagaaccacatatgatagtgggacggcaggaaaaaggaaaaagtttacttttcaaaacagaagatggagtaaatatgtgcacactaatggctattgatttaggtgaactttgtgaagatacgattacatacaaatgtcctttattacgtcaaaatgaacctgaagacattgactgctggtgtaactccacatccacttgggttacgtatggtacctgtacaacaactggtgatcacaggagggagaaaaggtcagtagcattggtaccacatgtgggaatgggattagaaactagaacagaaacatggatgagctcagaaggcgcatggaaacacgcacagcgaatagaaacatggatattacgccacccaggtttcacaataatggctgcaattctagcatatacagtgggaacgacacatttccagagagcattgatatttatattactagctgcagtagcaccttccatgacaatgcgatgcataggcatctcgaatagagattttgtagaaggagttagtggaggatcttgggttgatatcgttttagaacatgggtcatgtgtaacgacgatggccaaaaataaaccaacactggatttcgaactcattaaaacagaagcaaaacaaccagccactttaagaaaatactgtatagaagcaaaactgacaaatactacaacggaatcacggtgccctacccaaggagagccaagcctcaacgaggaacaagataaaagattcgtatgtaaacactctatggtcgatcgcggttggggcaatggatgtggattgtttggtaaaggtggaattgtaacctgcgccatgtttacatgcaagaaaaacatggaagggaaaatcgttcaaccagaaaatcttgagtatacaatagttataactccgcacagtggagaagaacacgctgtgggcaatgataccgggaagcatgggaaagaaattaaaattactccacagagtcctattactgaggcggaattgaccggttatgggaccgtaacaatggaatgcagtccccgcacaggtttggacttcaatgaaatggtgttgttacaaatggaagataaagcatggttggtccataggcaatggttccttgatctaccgttaccctggttaccaggtgcagacacgcaaggaagcaactggatacaaaaggaaaccctagttacatttaaaaatccacacgcgaagaagcaagatgtagtcgtactgggatcacaagaaggggcaatgcatactgcactcacaggagcaacagaaatacaaatgtcaagtgggaacctcttatttactggtcatctaaagtgtcgattgcggatggataaactacagttaaaaggcatgagctacagcatgtgcacaggaaaatttaagattgtcaaagaaattgcggaaacgcagcatggaacaatcgtgataagggtacaatacgaaggggatggttcaccttgcaaaatcccattcgaaatcatggacctagagaaacgacacgtgcttggaaggttaataaccgtaaatcctatagtaactgaaaaagactcgcctgtgaacatagaagcagaacctcctttcggcgattcttacatcataatcggcgttgaaccaggacaactaaaactcaactggtttaagaaaggttcaagtataggccaaatgtttgagactactatgagaggagcaaaacgtatggcaatactaggagatacagcttgggacttcggcagcttgggaggagttttcacctctataggtaaggcactacaccaagtattcggtgcaatatacggggcagcattttctggagtttcatggacaatgaagatattaataggcgtaatcatcacctggatcggaatgaacagtcgcagcacgtctctaagcgtaagtttggttttagttggtgtaataacactttaccttggagcaatggtccaagctgattcaggatgtgtagtaagctggaagaacaaagagctcaaatgtggatctggcatttttataacagataatgtacatacttggacagagcagtacaagttccaacctgaatctccatcaaaactggccagcgcgatccaaaaagcacacgaagaaggaatatgcggcatacgatcagttacacgactagagaacttgatgtggaagcaaataacaccagaacttaatcatattttatccgaaaacgaagtaaaattaactataatgactggggacataaaaggaataatgcaagcagggaaaagatccttacgtccacaaccaactgagcttaaatactcatggaaaacatgggggaaggccaaaatgcttagtacagaatctcacaaccaaactttcttaatagatggcccggaaacagccgaatgcccaaatacaaaccgagcgtggaactccttggaagtagaagattacggatttggggtgtttaccaccaatatatggttaaaattgcgagaaaagcaagatgtcttttgtgacagcaaattgatgagtgccgcaattaaagacaatagagctgtacacgccgatatgggatactggatcgagtccgctttgaacgatacttggaagatggagaaggcttcttttattgaggtcaaatcgtgccattggccaaaaagccacactttgtggtcaaatggggtgcttgaatctgagatgattattcctaaatccttcgcagggccggtatcccaacataactatagaccgggatattatacacaaactgcaggcccatggcatctcgggaaactagagatggacttcgatttctgtgaagggacaacagtggttgtaacagaagactgtgggaaccgagggccgtcattaaggaccacaaccgcttcagggaaactaatcacggaatggtgctgcagatcctgtactttacctccattacgatacagaggtgaagacggttgctggtacgggatggaaataagaccacttaaagaaaaggaagaaaatttagtaaattcgttagtaacagctggacatggtcaaatagacaatttctcgttaggtgttctgggaatggcattattcttggaagaaatgctaaggaccagagtgggaacaaaacatgcgatactattggtggcagtatccttcgtaacactaatcacgggaaacatgtcctttcgagacttaggtcgagttatggtgatggtaggagcagcgatgactgatgatataggtattggtgtaacatacctggctttacttgctgccttcaaagtacggccgacatttgccgctgggctcttacttcgaaaattaacatcaaaagaacttatgatggcaacgattggtatagcgttattatcacaaagcaccattcccgaaacaatacttgagcttactgatgcattggcgctgggaatgatggttctaaagattgtacgcaatatggaaaaataccaactggctgtaacaatcatggcgatctcatgcgttcccaatgccgttatattacaaaatgcttggaaggtatcatgcacaatcctggccacagtgagtgttagccctctattattaacttcgagccaacaaaaggctgactggataccactcgcactaactatcaaggggttgaatccaactgcaatattcttaactacattgtctcggacgagcaagaaacgatcttggcctttaaacgaagccataatggcagtagggatggttagcatcttagctagctcactgctcaaaaatgatatcccaatgacaggccctttagtcgccggtggattactcacagtttgctacgtcttgacgggacgctcagcagacttggaactcgaaagggcaacagatgtcaaatgggaggatcaagcagagatatcagggagtagtcctatattatcaataacgatagccgaagatggcagcatgtctatcaaaaatgaagaagaagaacaaaccctaacaatattgatccgaactggacttctcgtcatctctggcttattccctgtctcaattcctataacggccgctgcttggtatttatgggaagtcaagaaacaaagagctggtgtcttatgggacgtaccatcccctccccctgtaggtaaggcagagctagaggacggagcatatcgtataaaacaaaaaggcatattaggatacagtcagataggcgcgggagtttataaagagggtactttccatacaatgtggcatgttacgagaggagcagttctaatgcacagaggcaagaggatagaaccctcgtgggctgatgtgaaaaaggatttaatttcatatggtggtggttggaaattagaaggagaatggaaggagggcgaggaagtacaggttcttgccctcgagcctggtaaaaaccccagagcagttcagacaaaaccaggactgttcaaaaccaatacagggaccataggagccgtatcacttgactttagcccaggtacgagcggttctcctatcgttgatagaaaaggaaaggttgtgggtctttatggaaacggcgtcgtaacgcgatctggagcatatgtaagcgctattgctcaaaccgaaaaatctatagaggataacccggagattgaggacgatatctttcgtaagaaacgattaacgattatggatctacatcctggcgcaggaaaaacaaaacgctatttacctgccatagtacgagaagcaataaaaaggggtctacgaaccctgattttagcacccacgcgcgttgtagctgcagagatggaagaagcactacgaggtctcccaataagataccaaaccccggcaatacgagcggagcatacaggacgtgaaatcgttgatcttatgtgtcatgctaccttcaccatgaggctactcagcccggttcgtgtcccaaattataacttaataatcatggatgaagcgcattttacagatcccgcatctatagcagctcgtggatacatctcaacaagagtagaaatgggggaagcagcaggaatcttcatgacagccacgcctccgggaagtaaagatccatttccccagtctaacgcaccaattatggacgaggaaagggaaatccccgaacgatcttggaactccggacacgagtgggtaaccgattttaaaggaaaaacggtatggttcgtaccttcgataaaagcaggtaacgacatagcagcatgtcttaggaagaacggaaagaaagtaatacaacttagccgcaaaacttttgattcggagtatgtcaagacaagaactaatgattgggatttcgtagttaccacagacatttcagagatgggtgctaatttcaaagctgagagagtaatagatcccagacgttgtatgaaacccgttattctaacggacggagaggagcgtgttattcttgcgggtccgatgcctgtgacccattcaagcgcagcacaaaggaggggtagaatcggacgcaatcccaaaaatgaaaacgatcaatatatatatatgggcgaacctcttgagaatgacgaagattgcgcacattggaaagaggcgaaaatgttattagacaacatcaacacaccagaaggcattatccccagcatgtttgaacctgaacgtgaaaaagtcgacgcaattgatggcgagtacagattaagaggtgaagcaagaaaaaccttcgttgatttaatgcggagaggagatttaccagtatggctggcatacagagtagctgcagaaggtattaactacgctgaccgtagatggtgctttgatggggtcaaaaataaccaaatattagaagaaaatgtcgaagtagaaatctggaccaaagaaggggaacggaagaaactaaaacctagatggctagatgcgcgaatctattcagatccattagctttaaaagaatttaaagaatttgcagctggtagaaagtcactaacactaaatctaatcacagagatgggaagattgccaactttcatgacacaaaaagcacgtgacgcattagacaatttagctgtactacacacggcggaagccggtggacgagcatataaccacgcactaagtgaattacctgagacattagagaccttgcttctacttacactattagccacggtaacaggcggtatatttttatttctcatgtctgggaagggagttgggaaaatgacattaggcatgtgttgtatcataacagctagtattcttttatggcacgcacaaatacaaccccactggatcgcagctagtataattctagaatttttccttattgtactattgatcccagaacctgaaaagcaacggactccacaagacaatcaacttacgtatgtagttattgcaatcctgacagtagtcgcagcaacgatggcaaatgagatgggtttcttagaaaagactaagaaagacttaggcttgggttccattgcaactcaggagccagaatctaacattctagatattgatctaaggccggcatccgcatggacactatacgccgtagctacaactttcgttacgcctatgctcaggcattcaattgaaaatagtagcgtaaacgtgagtttaacagcaatagcaaaccaagcaacggtattgatggggctaggtaaaggatggcctttgtcaaaaatggatattggagtgcccctactcgctattggatgttacagccaagtcaacccaataacattaacagcagcactattattactcgtagctcattatgcaattatcggtccggggttacaagccaaagcaacaagagaagctcaaaagcgtgcagcggcgggaattatgaaaaatcctacagtagatggcataaccgtaattgatttagatcctataccttatgatcctaaatttgaaaagcaacttggtcaagttatgttgttaattctatgcgttactcaagtcttaatgatgagaaccacatgggctttatgtgaagcacttacattagctacaggaccgattagtactctatgggaaggtaatccgggaagattttggaacacgactatagccgtatctatggctaatatatttagaggatcctatttagccggagcaggattgttatttagtataatgaaaaatactacaaatacgaggagaggtacaggtaatataggagaaacattgggggaaaaatggaaaagcaggctaaatgctcttgggaaatctgagttccagatctacaagaaaagtggaatacaagaagtagatagaaccttagctaaagagggaataaaaagaggagagaccgaccatcacgctgtttctcgcggatccgcaaaattacgttggtttgttgaacgtaacatggttacgccagaaggaaaagtggtcgacctaggatgcgggcgtggcggatggtcatactattgtggaggactaaagaacgtccgagaagtcaaaggattaacaaaaggaggacctggtcacgaagaaccaattccaatgtcaacctacggttggaatctagttcgtctccaaagcggtgtagacgtcttctttacccctcccgaaaagtgcgatacgctactctgtgatataggagagtcatctcccaacccaaccattgaagcagggagaactctacgggtattatcactggtggagaactggcttaataatgacactcaattctgtattaaagttctcaacccgtatatgccatcggttatagaaaagatggaaaccctccaaagaaaatacggtggagcattagttagaaatccactatctagaaattcaacgcacgagatgtattgggtcagcaacgctactggtaatattgttagtagtgtcaatatgatttccagaatgctgattaatcggtttactatgaaacataaaaaggctacgtatgaaccagatgtagacctagggtctgggacaagaaatataggtattgaaagcgaaataccaaatcttgatataataggcaagagaatagaaaagataaaacaggaacatgagacttcgtggcactatgatcaagatcatccttacaaaacctgggcgtatcatggtagctacgaaacaaaacaaacaggtagtgcgtcatcaatggtaaatggggtggtaagacttctaacaaaaccgtgggatgtcgtgccaatggttactcaaatggccatgactgatacaacccctttcggacagcagagagtatttaaggaaaaagtagatactagaacgcaagaaccaaaagaagggactaagaaattaatgaaaataaccgcggaatggctatggaaagaattgggaaagaagaaaacaccaaggatgtgcacaagagaggagttcacacgaaaggtccgttctaatgctgctttaggagcaatttttactgacgaaaacaagtggaaatcagcaagagaggcagttgaagattcaagattctgggagctagttgataaggagcgaaatctacaccttgaaggaaaatgcgagacgtgtgtatacaacatgatggggaaaagagagaagaaattaggggagttcgggaaagccaaaggatctcgagctatatggtacatgtggttaggcgctcgatttctagagttcgaagccttgggatttttaaacgaagaccactggttctcaagggaaaattccctctcgggagtggaaggagaaggactacataaactcggttatatactccgagacgtttcaaagaaggaagggggagctatgtatgcagatgatacagccgggtgggacacgagaataactttagaagatcttaagaacgaggagatggtcaccaatcatatggaaggggaacacaagaaattggcagaggcaatattcaaattgacctatcaaaacaaagtagtaagagtacaacgacctacacctaggggaacagtgatggatataatttcgcgacgagatcagcgtggatcaggtcaggtagggacgtatggcttaaatacatttacgaacatggaagctcagcttattaggcaaatggaaggagaaggaatctttaaaagcattcaacatcttaccgcgactgaggaaatagcggttcaaaattggcttgcgagagttggaagggaacgtttatcgaggatggcaatttcgggtgacgattgtgttgtaaaaccacttgatgaccgatttgcgagcgctttaacagctttaaacgacatgggaaaagtccggaaagatattcaacaatgggaacccagtagaggttggaatgactggacccaggttccattttgttctcatcattttcatgaattgattatgaaagatggacgggttttggtggtgccatgtcgtaatcaggatgaacttataggtcgagcccgtatcagtcaaggggccgggtggtcactaaaggagaccgcgtgtttaggaaagtcatatgctcaaatgtggtctttaatgtactttcatcggagagatcttcgattggctgcgaatgccatttgttcagcagtcccgagtcactgggttcccacaagccgaactacttggtcaatacacgccaaacacgagtggatgacaacagaggatatgttaacagtatggaatagagtttggatacaagaaaacccttggatggaagataaaactccagtagaatcatgggaagaagttccttatttgggaaagagagaggatcaatggtgtgggagccttattggactaacctcacgagcaacatgggcgaaaaacatacagacagcaataaatcaggttcgatcacttataggaaacgaagaatatacagattacatgccctctatgaaacgtttcagacgtgaagaagaagaggcgggtgttctttggtga

SEQ ID NO: 22806 - RNA, 9876 nt, synthetic construct
  misc_feature 1..9876: note = derived and/or modified CDS sequence (opt6) from DENV-2__JX286524__SS-prME
  source 1..9876: mol_type = other RNA
actgcaggggtcattgtgatgttaatacccactgcgatggcattccatctaacgactagaaatggggaaccgcatatgatagtaggtagacaagaaaaaggaaagagcttgttgttcaaaacggaagacggggtaaatatgtgtacactaatggcaatagatcttggcgaattgtgtgaagatacgataacatataaatgccctttattgcgacaaaacgaaccggaagatattgattgttggtgtaactctacaagcacatgggttacatacggaacgtgcaccacaacaggtgaacatagaagagaaaagaggtccgtagcgctggtaccacatgttgggatgggcttagaaacaagaactgaaacctggatgtcgtcagaaggggcctggaaacatgttcagcgaatagaaacatggatcttaagacaccctggtttcacaatcatggccgcgattctagcatatactatagggaccacacatttccagagagcattaatattcatattgctaacggctgttgcaccaagcatgactatgcgatgtatcggcatctctaaccgggattttgtggagggggttagcggcggctcatgggtcgacattgtactggaacatggaagctgcgtgaccactatggccaaaaataaacccacacttgactttgaactaataaaaactgaagcaaaacagccagccacactcagaaaatactgtattgaagcaaaactgacaaatacaactacggaatccagatgtccaacacaaggagaaccttcgctgaatgaagaacaagacaaacgcttcatatgcaaacactcaatggtagaccgcggatggggaaatggctgtggtttattcggtaaaggtgggattgtaacctgcgcgatgttcacgtgtaagaaaaacatggaaggcaaaatagtacagccagagaatctcgaatacacaattgtaataactcctcactcgggtgaagaacatgctgtcggtaacgatacaggcaaacatggcaaagaaattaaaatcacacctcaatctagtacgaccgaagcagagcttacaggatatggcactgtaacaatggaatgcagtcccagaacaggtttagacttcaacgagatggtactcctacaaatggaagacaaagcatggctggttcaccgccaatggtttttagatttacctctaccatggctcccaggagcagatacacaaggttcgaactggatacaaaaagaaacattggtaacatttaaaaacccacacgcgaagaaacaagacgttgtcgtattagggagtcaagagggagcgatgcataccgcactcacgggagccacagagattcaaatgagtagtggtaacctattattcactggacacctaaaatgcagattaaggatggacaaattacaattaaaaggaatgtcatacagtatgtgtacggggaaattcaaaattgtaaaagaaattgcggaaacgcaacatggtacgatagtcattagagtccaatatgaaggggatggaagcccatgtaagataccttttgaaatcacagatttagagaaacgacacgtattaggaagactaataaccgtaaatccaatagttacagaaaaggattctcctgtcaatatcgaagcagagccgccatttggtgattcctatattatagttggagtagaacctggtcagttgaaattgaactggttcaagaaaggatcgtcgattgggcaaatgttcgaaaccacgatgagaggagcaaaacggatggcgattttaggagatacagcctgggacttcggaagcctaggaggagttttcacaagtataggaaaagctctacaccaagtcttcggtgcaatttacggtgcagctttttctggagtaagttggactatgaaaattttgataggagttattattacctggatcggtatgaatagcagatcgacaagtctgtcagtctcgttagtattagtaggagtagtcacgttatatctaggagcgatggtacaagcagactcaggctgtatcgtatcatggaagaacaaagagcttaagtgtggttcaggaatatttatcacagataacgtacatacatggacagagcaatacaagtttcaaccagagtccccaagtaaattagcttccgcaattcagaaagcccacgaagaaggcatctgtggaataagatctgtgactagattagagaatttaatgtggaaacaaataacgccagaattaaatcacatattatccgagaatgaagtgaaattaactataatgacaggtgatattaagggaattatgcaggcaggtaaaagatctcttagaccccaaccgactgagctaaaatattcatggaaaacctggggaaaggcaaaaatgctatccacggaatcccataatcagactttcttaatagatggccccgaaacggctgaatgccccaacacaaacagagcttggaactcacttgaagtggaagactacggcttcggggtattcacaacgaacatatggctcaaacttcgtgaaaaacaagatgtattttgcgattcgaaattaatgagtgcggcaatcaaagacaacagagccgtacatgcagatatggggtattggatagaaagtgcactaaacgacacatggaaaatggaaaaggcttcatttattgaagttaagagttgccactggcccaaatcccatacactatggtcgaacggtgtccttgaatctgaaatgataatacctaagagctttgctgggccagtcagccagcataactaccgaccaggttatcatacccagacagcaggaccatggcatctgggcaaattagaaatggacttcgatttttgcgagggtacaacagtagtagtcacagaagactgtgggaacagaggaccttcgctgagaactacaacagcctcgggtaaattgataactgagtggtgttgtcgatcatgtactctgccaccgctgagatacagaggagaggatggatgctggtacggaatggaaatcagaccattaaaagagaaagaagaaaatctagttaacagcctagtaacagctggacatggacaaatagataatttctcactaggagtgctcggtatggctctatttttagaagaaatgctacgtacccgggtaggcactaagcatgcgatcttattggttgcactctcttttgtgaccctaatcacggggaacatgtcctttagagacttaggtagggtgatggtcatggtaggcgccacgatgaccgatgatattggtatgggagttacatacctagctctactagcggcattcaaagttcgacctaccttcgcagcaggactgctcctgcgaaaattgacctccaaagaattgatgatggccactatcggaatagcattactcagtcaaagcacgctaccagagaccatacttgagctcacagacgcgttagcgttgggtatgatggcactaaaaattgtgcggaatatggagaagtatcaacttgccgtaactattatggctatttcatgcgtgccaaatgcggtcatactccaaaatgcttggaaagtgagttgtactatactggctgcagtatcagtgtctccgctcttgttaacctcaagccaacagaaagcagactggattccattagcgctcacaattaaaggtctcaacccaacagccatattcttaacaaccttatcccgtacctctaaaaagagatcatggccactaaacgaagctataatggcagtaggaatggtgagtatattagcaagttctttactgaagaatgatatacccatgactggacctctggtagcgggaggactcttaacagtttgttacgtactaactggaagaagtgcagacctagaattagaacgggcggcagacgtgaaatgggaagatcaagccgaaataagcggatcctctcccattctatccattacaattagtgaggacggttctatgtcgatcaaaaacgaagaggaagaacaaactcttactattctaattcgtaccggattattggtaatatcaggcgtcttccccgttagtattccgattaccgccgcggcctggtatctatgggaggttaaaaagcaaagggcaggagtattatgggatgtaccttctccacctccagtaggcaaagccgaactagaagacggagcttacagaattaaacaaagaggcatacttggatattcacagataggagcaggggtttacaaagagggcacattccatactatgtggcatgtaacaaggggagcagttttaatgcaccgaggcaaacgaatagaaccctcatgggctgatgttaaaaaggatctaatttcctacggagggggctggaaattagagggtgaatggaaagaaggagaagaggtacaagtactcgcacttgaaccaggcaaaaatcctagggccgttcaaactaaaccaggaatatttaagactaataccggtacaattggggcagtaagtctggatttctcgccgggcacatccggctctccaattgttgatcgaaaaggaaaggttgttgggttatatggaaatggagtcgtcacaagaagtggtgcttacgtatcagcgattgctcaaacagaaaagtccattgaagacaaccccgaaatagaagatgatatatttaggaagaaaagacttactataatggacttacatccaggcgccggcaaaactaaacgatacttacctgcgatagttagagaggccataaagagaggactgcgcactttaatcctcgccccgacccgtgtagtcgcagccgaaatggaagaagcacttagaggcttaccaataaggtatcagacgcctgccataagagccgagcacacgggcagagagatagtcgatctgatgtgccatgctacatttacaatgaggttgttatcgcctgtacgagtacccaattataacctaattatcatggacgaagcacattttacagatcccgcttctatagccgcccgaggttacatatcaactagagtcgaaatgggcgaagcagcgggtatatttatgacagcgacgccacccggatctcgagacccgtttccacaaagcaacgcacccattatggatgaagaaagagagattccagaacgcagttggaactcgggacacgagtgggtaacagacttcaaaggtaaaactgtctggtttgtaccatcaattaaagcgggaaacgatatagcagcatgcctacgtaaaaatggcaaaaaggtaattcaactaagtcgcaagacattcgactctgaatacgtaaaaacaagagcaaacgattgggactttgtggtcacaacggacatcagtgagatgggggccaacttcaaagcagagagggttatagatccaagaaggtgtatgaaacccgttatattaacggatggagaagaacgcgttatactagcaggcccaatgccggtaacccattcaagtgcggcacagcggcgaggaagaattggtaggaatcctaagaatgaaaacgaccaatatatatatatgggggagcctttggaaaacgatgaggattgtgctcattggaaagaagcaaaaatgttgctagacaacataaacacacctgagggtataattcccagcatgtttgaacctgaacgagagaaagtagatgcaatcgacggtgaatatagactgagaggcgaggccagaaaaacgttcgtagatctcatgagaagaggggatctacctgtctggctagcatataaagtagcagccgaaggaatcaactacgccgatcgcaagtggtgttttgatggtatcaaaaataatcaaatactagaagagaacgttgaggtagaaatttggacaaaggaaggggaaagaaagaaactaaaaccacgatggttggacgccagaatttactcagacccactcgctttgaaagaatttaaggagttcgcagcaggtaggaagtcgttaaccttgaatctcattacagaaatgggccgcttgccgacattcatgactcaaaaggccagaaacgctctagacaacttagcagttctacacaccgctgaggtcggtgggaaagcgtacacccacgctctaagtgaactacctgaaacgctggaaacactactcctattgactctcctagctgcagtcacaggaggcatctttttgtttttgatgtcaggcaaaggcatagggaagatgacgttaggaatgtgttgcattatcactgcatcgatattattatggtatgcacaaatccaaccacattggattgccgctagcataattttagagttctttcttatagtattattgataccggaaccagaaaaacaacgaactccacaagataaccaattaacctatgttgttattgccatattgacagtggtagccgcgacaatggcgaacgaaatggggtttctcgaaaagacaaagaaagatctcggtttcggatcgataacaacacaggagtccgaaagcaatatcctggatattgacctgaggcctgcatcggcctggacactttatgctgttgcaacaacattcgtaactcccatgcttagacactcaattgaaaactcttcggtaaacgtctcgttaactgctatagccaatcaagcgacagtattaatgggtcttggtaaaggatggccattgtcaaagatggatattggtgtccccctactagcgattggatgctatagtcaagtcaatccgatcacactaacagccgcgttactcctattagttgcacattacgcaataattggacccggccttcaagccaaagcaactagggaagcacaaaaacgagcggctgccgggataatgaaaaatcctacagtcgatggtattaccgtaatagatttagaaccaataccatatgatccaaaattcgagaaacaattaggccaagtgatgttattaatcctttgcgtaacgcaagtacttatgatgcgaacgacatgggctttatgtgaagcactaacactcgctacaggacctatcagtacattatgggagggaaaccccggccgtttttggaatactacaatcgccgttagtatggctaatatttttagaggatcctacctagcgggagctggcttattgttctccattatgaaaaataccacgaatactcgcaggggaactggcaacgtaggggaaaccctaggagagaaatggaaaagtaggctaaatgccttaggaaagtctgagtttcaaatctataagaaaagtgggatacaagaagtagatcgtacattggcaaaagaggggataaaaagaggagaaactgaccatcacgcagtttctagaggaagcgctaaattaagatggtttgtggaaaggaatatggtaacaccagagggaaaagtagtcgatctaggatgtggtagaggtggatggagttattactgcggaggattgaagaacgttagggaagtaaaaggactcacaaaaggtggtccaggtcacgaagaacccataccaatgtcaacatatggatggaacttagtaaggctgcaatctggggttgacgtattctttaccccaccagagaaatgtgacacattgttatgcgatattggcgaatcatccccaaaccccacgatagaagcaggaagaacattgcgagtattaaatctcgtagaaaactggttgaataacaacacccaattctgcattaaagtcctgaacccctatatgcccagcgttatagagaaaatggagactctacaaagaaagtatggaggcgccttagtcagaaatcccctctcaagaaacagtacccatgaaatgtattgggttagtaacgcgacaggaaacatcgtaagtagcgtaaatatgatctctagaatgttaataaatagatttactatgaagcataagaaggcaacatatgaaccagatgtcgacttaggatcaggcactcgtaatataggaattgaatcagaaattccgaatctagacattatcggcaagagaattgagaaaataaaacaagaacatgaaacatcatggcactacgaccaggatcatccgtacaagacgtgggcttaccacggatcctatgaaacaaagcaaacggggagcgcatcatctatggtaaatggtgtagtaaggctattaactaaaccatgggatgttgtcccaatggtgacacaaatggccatgacggatacgacaccattcgggcaacaaagagtttttaaagaaaaagtagacacacgcacacaagaaccaaaagaaggcacgaaaaagctgatgaaaataacagctgaatggttgtggaaagagttaggaaaggagaaaacgccgaggatgtgtacaagagaagagttcacaagaaaagtacggagtaacgcagcacttggcgcagtatttaccgatgagaataagtggaagagtgcacgcgaggcagtagaagatggtagattttgggagttagtagatcgtgaaagaaacttacacctcgaagggaaatgtgaaacttgtgtatataacatgatgggaaagagggaaaagaaactaggagagttcgggaaagcaaagggatcacgagcaatctggtatatgtggctgggagcaagatttctagaatttgaagccctcggatttttaaatgaagaccactggttttcacgcgggaatagtctatctggggtggagggtgaaggattgcaccggttaggatacattctgagggaagtagggaagaaagagggaggagcaatgtatgcagacgacactgccggttgggatactaggataactttggaggacctgaagaatgaagaaatggtaacaaatcacatgaaaggtgagcacaagaaactagcagaggcaatatttaagctcacctaccaaaacaaggtagtacgtgttcagagacctactccaagaggaacggtaatggacataataagtagaaaagatcaaagaggaagtggccaagttggaacgtatggtctgaatactttcacaaacatggaagctcagttgattaggcaaatggaaggggaaggcatttttaagagcatacaacacctaacagcaacagaagaaatagcggttcagaactggcttgcgagagtaggaagagaacgtttaagcaggatggcaatctcaggtgatgattgcgtcgtgaagccaatagacgacagattcgcatcggcgctaacagctctgaatgacatgggcaaagtacggaaagacattcaacaatgggaaccttcccgcggttggaatgattggacacaggtcccattttgttcacatcacttccatgagctagtaatgaaagacggccgcgtattagtagtgccttgccgaaatcaagacgaactcatcgggagagctcggattagccagggagcaggctggtcgcttaaagaaactgcatgtctaggaaaaagctacgcacaaatgtggacgctcatgtacttccatcgacgggatctgcgattggccgctaatgcaatctgttctgctgttccatcacattgggtacctacttctagaacgacatggagtatacatgcaaaacatgaatggatgactactgaggatatgctagcagtatggaatagggtatggattcaggaaaatccatggatggaggataaaaccccggtcgaaagctgggaagaagtaccatatcttggaaaaagagaagatcaatggtgtggatctttaataggacttactagcagagcgacatgggctaaaaatattcagacagctattaatcaggtacggtctttgataggcaacgaaggctataccgattacatgccctccatgaaaagatttaggcgggaagaagaggaggcaggagtattatggtag

SEQ ID NO: 22807 - RNA, 9876 nt, synthetic construct
  misc_feature 1..9876: note = derived and/or modified CDS sequence (opt6) from DENV-2__JX286520__SS-prME
  source 1..9876: mol_type = other RNA
acggctggggtaatagttatgctaattccaacagcaatggcgttccatcttacaacaagaaacggagaaccacatatgatagtagggcgtcaagaaaaaggaaaatcactactgtttaaaacagaagacggagtgaacatgtgcacactaatggctattgacttaggtgaattgtgtgaagatacaataacttacaaatgtcccctactacgtcaaaatgaacctgaagacatcgattgttggtgcaattcaacatcaacttgggttacatatgggacctgtacaaccactggagaacatagaagagagaaaagaagtgtagcacttgtgccgcacgttggtatgggtttagaaaccagaactgaaacctggatgtctagtgaaggagcttggaaacatgtgcaacggatagaaacatggatactaagacatccaggattcactataatggcagcaatactagcttacacgataggaactacacacttccaacgagccctcatctttatcctgttgacagcagtggctccttcaatgacgatgagatgtatcgggatcagtaatcgcgattttgtcgaaggggtctctggaggttcctgggtcgatatagtattggaacacgggtcatgtgttacaacaatggcgaaaaacaaaccgacgttagattttgaattaatcaaaacagaagctaaacaacctgcgacattaagaaaatattgcattgaagcaaaactaacaaatactactacagaatcaagatgtccgacacaaggagaacctagtttaaatgaagaacaagataaaagattcatttgcaaacatagcatggtagatagaggttggggtaacgggtgcgggctatttggaaaaggtggtattgtaacatgcgcgatgtttacgtgcaaaaagaacatggaaggaaaaatagtacaacccgaaaatctggaatataccatcgtaatcactccgcattcaggtgaagaacatgcagtaggcaatgacacagggaaacacgggaaagaaattaaaatcacaccccagagttcaacaaccgaagcagaactcaccgggtatggaatcgtaacgatggaatgtagcccgcgaacagggctagattttaatgaaatggtacttttacagatggaagacaaagcgtggctagtacacagacaatggtttttggatttaccattgccgtggctacccggggcagatacacagggatcaaactggatccaaaaagaaactttggtgacattcaaaaatccacacgcaaagaaacaggatgtcgttgtgctcgggtcgcaagaaggagcaatgcataccgcccttactggcgcaacggaaattcagatgtcatcaggaaacctcttgttcactggtcatcttaaatgcaggttgagaatggataaacttcaactaaaaggaatgtcttactcaatgtgtacaggaaaatttaaaatagtaaaagaaattgcagaaacccaacatggtaccattgttatacgagtacagtatgaaggtgacggatcaccgtgcaaaatcccatttgaaattaccgatttggagaaaagacatgtcctgggtagactaattacagttaatcccatcgtaacggaaaaagattcaccagtaaacattgaagcagaaccaccattcggagactcatatatcatagtaggtgtagaaccgggtcaactaaaactgaactggtttaagaaaggatcatcaataggtcaaatgtttgaaaccacgatgcgcggggcgaaaaggatggcgatactcggagataccgcttgggacttcggatcacttggtggggtgttcacgtcaatcggaaaagcactacatcaagtatttggcgcgatttacggtgctgcattcagcggcgttagttggactatgaaaatactaataggggtaattatcacatggataggcatgaactcccgatccacaagtctcagtgtttcattagttctggtaggggtcgttaccttatatttaggggcaatggtacaggcagacagtggatgtatcgtttcatggaaaaataaggaacttaaatgtggatctggaatatttataacagacaatgtgcatacatggactgaacaatataagtttcaacctgaatcgcctagtaagttagcgtccgccatccaaaaagcacatgaagaagggatctgcggaatacgatcagtaactagattggagaatctcatgtggaaacagataacgccagagcttaaccacatcctgtctgagaacgaagtgaaattgactattatgaccggtgatatcaaaggcattatgcaggcaggaaaaagatcgctacgtccacaacctactgagctgaaatactcatggaaaacttggggaaaagctaaaatgctaagtacggaatcccataatcaaacgtttttgatagacggtccagagaccgccgaatgcccaaacacaaatcgagcctggaactcactggaagtcgaggattatggtttcggtgtattcactacgaatatatggttaaaacttagagaaaaacaggatgtcttttgtgactctaagttaatgtcggcggcaataaaagataatcgcgctgtacatgccgatatggggtactggatagaaagtgctttaaacgatacgtggaaaatggaaaaggcttcatttatagaggtcaaaagctgtcattggcctaaaagtcacactttgtggagcaatggagtattagaatctgagatgattatcccgaaaaatttcgccggcccagtttctcagcataactacagacctggttatcacacccaaactgcaggaccttggcacttagggaaattagaaatggacttcgatttttgtgaaggcaccactgtagtagtaaccgaggactgtggtaaccgtggacccagcttacgcacgacaacggcatcagggaaactgataaccgaatggtgttgtcgaagttgcactctaccgccgctcagatacaggggcgaggatgggtgttggtatggcatggagattagaccacttaaagaaaaagaggaaaatttagtgaacagtcttgttactgcgggacatggacaaattgacaattttagcttaggggttcttggcatggctttatttcttgaagaaatgcttagaacaagagttggcacaaaacatgcaatattattggtcgcattatcattcgtcacgctaataaccggaaatatgagttttcgagatttagggagggtaatggtgatggttggagcgacgatgactgatgatattggcatgggagtgacataccttgcacttttggcagcatttaaggttagaccaacttttgccgcaggtctattacttagaaaacttacttctaaggagttaatgatggcaacgattggaattgccctgttatcccaatcaacacttcctgaaacaattctcgaacttaccgatgctctagcactggggatgatggcgttaaagatagtcagaaatatggaaaaatatcagctagcggtaactattatggctatatcatgcgtacctaacgcggtcatactccaaaatgcttggaaagtatcctgcacaatcttggcggcggtctcagtgtcacctctactacttacaagctctcaacagaaagcagattggatcccccttgccttgacaattaaaggtcttaaccctaccgccatattcttgactacattaagccgaacatcaaagaagaggtcatggccacttaatgaagctattatggcggtaggaatggttagtatccttgcgtcatctctattaaagaatgacattccaatgacaggtccattagtagccggtgggttactaacggtctgctatgtgctgacaggccgatcggccgatttagagctagagagagccgccgatgtcaaatgggaagatcaggcagaaatctcaggttcatcaccgattctaagtataactatcagcgaagatggtagtatgtctatcaaaaatgaagaagaggaacaaacccttacaatcctaatacgaacagggttattagtcatcagcggagtattcccggtttcaattccaattacagcagccgcatggtatttatgggaagtgaagaaacaaagggccggagtgctatgggacgttccgagtccaccaccggtgggaaaggcagaactcgaggatggtgcatatagaataaaacaaagaggtatcttgggttacagtcagattggtgcaggggtatataaagaaggcacgttccataccatgtggcatgttactcgaggggcagtcctcatgcataggggaaagagaatagaacctagttgggctgacgttaagaaagatctaatctcgtatggaggaggctggaaacttgaaggagagtggaaagaaggggaagaagtacaggtactcgccttagaaccgggaaagaatccgcgagcagtacaaaccaaaccagggatatttaaaaccaatacagggacaattggggcagtctctttagatttcagtccaggtacttcaggcagcccaattgtagaccgcaaaggtaaggttgtcgggttgtacggcaatggcgtagtaactagatcaggagcgtatgtaagcgcaattgctcaaaccgaaaaatctattgaagataatccggaaattgaagatgacatcttcaggaagaaaagacttacgattatggatttacacccgggcgccggtaagacaaagaggtatcttccagcaattgtcagagaagcaataaaacgaggactacgtacattaattttagcacctactcgagtagtagcggcagaaatggaagaagcactgaggggactccctatccgataccaaactccagcaatcagagctgaacataccggccgggagattgtggacctgatgtgtcacgcaacgttcaccatgagactattatctccagttagagtgcccaattataatttgataattatggatgaagcacattttacagatccggccagtattgccgccaggggatatatatctaccagagtagaaatgggagaagccgccggaatatttatgacagcgactccaccaggttcacgagacccgttccctcaatctaatgcaccaatcatggatgaagaaagagaaattccagaaagaagttggaactcagggcatgaatgggttacagacttcaaaggcaaaactgtttggtttgtcccatccataaaagcagggaacgatatagccgcctgtctgaggaaaaatggcaagaaagtaatacaacttagcagaaagacattcgattctgagtatgtaaaaacaagagcaaatgattgggacttcgtagtgactactgatatctcggagatgggggccaactttaaagcggaacgggttatcgaccctcgtcgatgcatgaaaccagttattttgacagacggtgaagaacgagtaatattggctggacccatgccagtaacccatagcagcgctgcacaacgacgaggacgtattgggagaaatcccaagaatgaaaacgatcaatatatatatatgggagagcctttggagaacgacgaagattgtgcccactggaaagaagccaaaatgctactagataacattaatacacccgaaggaataatcccctcaatgttcgaaccggagagagaaaaggttgacgctatagacggtgaatatagattgagaggagaagcacgaaaaacgtttgtggatcttatgaggcggggtgatttgccagtatggcttgcttataaagtagccgcagagggtatcaattacgcagataggaaatggtgttttgatggcattaaaaacaatcagatattagaagaaaacgtcgaagtagaaatatggacaaaggaaggtgaaagaaagaaattgaaaccgagatggctagatgcccgaatatattcagatcccttagcattgaaggaatttaaagaatttgcagccggtagaaagtcgttaactttaaatttgatcactgaaatgggacggctcccaacgttcatgacacaaaaagcgcgcaatgcactggataatctggctgtactccacacagccgaggtcgggggaaaagcatatacacatgcattatccgaactgccggaaaccttagagaccttattactactaactttgttagctgcagtcacaggagggatatttctcttcctaatgagtggtaagggaattggaaaaatgaccctcggtatgtgttgcattattacggcttcaattcttttatggtatgcacagattcaaccacattggatagcagcgtcaatcatattagagtttttcttaatcgtgttactaatacccgaaccagaaaaacaaagaacgccacaggataaccaactaacctacgtagttattgccattttgactgtcgtagcagcaactatggccaacgaaatgggctttctggagaaaaccaagaaagactttggattcggaagcataacgacgcaggaaagtgaatcgaatatactagacatcgatttacgaccggcgagcgcctggacgctatacgcagtagcaactacgttcgtaactcctatgctaagacatagtattgaaaatagttcagtaaacgtttctcttacagccatagcgaaccaagctaccgtccttatgggtttaggaaaaggctggcccctctcaaagatggatatcggtgtgcccctactagctatagggtgctattctcaggtaaatcctatcacactaaccgccgcgttactgctactcgtagctcattacgcaatcataggacctggactgcaagcaaaagcgacccgtgaagcacagaaaagagcagctgctggtattatgaaaaatccaacagtggacggtattacagtcatagatcttgagcctataccatatgatcccaagtttgagaaacaattaggacaggtgatgttactaattttatgcgtaactcaagtacttatgatgcgaaccacatgggcattgtgcgaggctttaacgttagctaccggacccatttcaaccttatgggaaggaaatcctggccgcttttggaacactacaatagctgtgtcaatggcaaacatattccgaggatcttatcttgctggagcaggcctcttattttctataatgaaaaacactacgaatactaggaggggtacaggtaacgtaggagaaaccctaggggaaaaatggaaatcgagactaaatgcactaggtaaatcagaatttcaaatatataagaaatcagggattcaagaagtagatagaacgctcgctaaagagggaattaaaagaggagaaacagaccatcatgcagtaagcaggggatcagccaaattgagatggtttgttgagagaaatatggtcacgcccgaaggaaaggtcgtggacttaggatgtggccgaggcggatggagttactattgtggtggactcaaaaatgtaagagaagtgaaaggacttacgaagggcgggccaggacacgaggaaccgattcccatgagcacatatggatggaaccttgtaagattgcaatctggggttgatgtattctttactcctcctgagaaatgtgatactttgctctgtgatattggtgagagtagtcccaatccaactatagaagcaggcagaaccttgcgagtactaaacctcgtggaaaactggttaaacaataatacgcaattttgtattaaagtgctcaatccttatatgccaagtgtgatcgagaaaatggaaaccctgcaaagaaaatatggtggcgccctagtcaggaacccactttcaagaaacagcacacacgagatgtattgggtgtcgaacgcaacagggaacatagtctcttccgttaacatgatatcaagaatgttaattaacaggttcacaatgaagcataagaaggcaacatatgagccagatgtcgacttagggtcaggtactaggaacattggaatagagtcagaaatccctaacctcgatataataggtaagagaattgagaaaattaaacaggaacatgaaacatcgtggcactacgaccaagatcatccatataaaacctgggcttaccatggctcatatgaaaccaaacaaacaggttctgccagttccatggttaatggagtagttagactcttaaccaaaccatgggacgttgttccaatggtaacacagatggcaatgacagatactacaccattcggccaacaacgtgtattcaaagaaaaagttgataccagaactcaggaacccaaagaaggcactaagaaattaatgaagatcaccgctgagtggttgtggaaggaactaggaaaagagaagactcctcgaatgtgcacaagagaggagttcaccagaaaagtcagaagtaatgccgcactgggcgctgtatttaccgatgagaataaatggaagtccgctagagaagccgtagaggatggtagattctgggaattagtcgatagagaacgtaatttgcatctcgaagggaaatgtgaaacatgtgtctataacatgatgggtaaacgtgagaagaaactcggagagttcggaaaggctaaagggagtcgagctatctggtatatgtggcttggggcaaggtttctagagttcgaggctctaggtttcttaaatgaagatcattggttttcacgcggaaatagcctatccggagtcgaaggcgaggggttacaccggctcgggtacatcttgagggaagtgggcaagaaagaaggaggggcgatgtacgcggacgatacggccggatgggatactcggataacattagaagatctgaaaaacgaagaaatggtaacaaaccatatgaaaggggagcataagaaactagctgaagcaatatttaaactaacttatcagaataaggtagtaagagttcaaagacctacccctagaggcacagtaatggacattataagtagaaaggatcaaagaggaagtggacaagtaggaacatatggattaaacacgtttactaatatggaggcgcaattaattcgacaaatggagggcgaaggtatctttaaatctattcagcacctaactgcgacggaagaaatagctgtccagaattggcttgcaagagtagggcgagaaagactgtctcgcatggctatttcaggcgatgactgtgtagttaaacctatagacgaccggtttgcatctgcacttaccgcattgaacgacatgggaaaagttcgaaaagacatccaacaatgggaaccaagtcgaggttggaatgattggacacaggttccattttgtagccaccattttcacgagttagtaatgaaagacggacgtgtcctagtggttccatgtagaaaccaggatgagctgatcggcagggccagaatatcccaaggggctggatggtcactaaaagaaacggcgtgcctaggcaaatcatacgcacagatgtggacattaatgtatttccatcgtcgagatctacgtttagccgcgaacgctatatgctcagcagttccatctcattgggtaccaacttcgcgaaccacctggagtatccacgcaaagcatgaatggatgacaacagaagatatgctagccgtatggaacagagtatggattcaagaaaacccctggatggaagacaagaccccagtggaatcctgggaggaggttccctatttaggaaagcgtgaagaccaatggtgcggcagcctaattggactcaccagtagagctacctgggcgaaaaatatccaaacagcaataaaccaagtacggtcattaattggaaatgaggggtatacggattatatgccgtcaatgaaaaggtttagaagagaagaagaggaggcaggagtcctctggtaa

SEQ ID NO: 22808 - RNA, 9876 nt, synthetic construct
  misc_feature 1..9876: note = derived and/or modified CDS sequence (opt6) from DENV-2__JX286525__SS-prME
  source 1..9876: mol_type = other RNA
accgcgggtgtaatagtgatgctaataccaactgcaatggcattccaccttactacgaggaatggggaaccacatatgatagtagggagacaagaaaaaggtaaatcactactattcaaaaccgaagacggcgtgaatatgtgtaccttaatggcaatcgacctgggagaactatgtgaagacacgataacatataaatgcccgttattgcggcaaaatgaacctgaagacatagattgctggtgtaatagcacaagcacctgggttacatacgggacatgtacgactaccggagaacaccgacgagagaaaagatccgttgcattagtacctcacgtgggaatgggcctagaaacccgaacagaaacttggatgagttctgaaggggcatggaaacatgtacaaaggattgaaacctggatcctgaggcatccaggatttactataatggcagccatactggcatacaccataggcacaactcacttccaacgcgcgttgatcttcattctactaacagctgttgcgcctagtatgacaatgagatgcataggcatatctaatcgagattttgtagaaggtgtctctggagggtcgtgggtcgatatagtacttgaacacggaagctgtgtaacaacaatggccaaaaataaacccacacttgactttgaactaataaaaactgaagccaaacagcctgcgacacttcgcaaatattgcattgaagctaaactaacgaacacaactacagaaagtagatgtccaacccaaggagaaccttctttaaatgaagaacaagacaaacgatttatttgcaaacattctatggttgatcgcggttggggtaacgggtgcggattgttcggtaaagggggaatagtaacatgtgcgatgtttacgtgtaagaaaaatatggaaggcaaaattgtacaacccgaaaatttagaatataccatagtaattacgccacactctggagaagaacacgcggtgggtaatgacacaggaaaacatggtaaagagattaaaattacgccacaatcttctacgacagaagcagagttaacgggttatggaacagtaactatggaatgcagtccaaggacaggattagacttcaatgagatggtcctattacaaatggaggataaggcttggttagtgcatagacagtggttcttagatttacctctaccatggctgccgggggcagacacgcaaggttcgaattggattcaaaaagagacattagttacttttaaaaacccacatgctaagaaacaggatgtggtagtattgggatcacaagagggagctatgcacacagccttgaccggggccaccgagatccaaatgagttctggtaacttattatttacaggacatctaaaatgcagactacggatggataaactgcaattaaaaggtatgagctattctatgtgcaccggaaaatttaaaattgtaaaagaaatagcagaaacacaacatggaactatcgtcataagagttcagtatgaaggcgacggatcaccatgtaaaataccttttgaaataaccgatctggagaaacgacacgtgctaggaagattgatcacagtcaatccaatagtaacagagaaagactcaccggtgaatatagaagcagagccaccgttcggggatagttatattattgtaggtgtagaacctggacaactgaaacttaactggttcaagaaaggtagttcaattggccaaatgtttgaaactacaatgcgaggcgccaaacgaatggctattttaggcgatactgcatgggattttggctcgcttggaggagtttttacctcaattggaaaggctttacaccaagtgtttggtgcaatttatggggcagcattctccggtgtaagttggacgatgaaaatcttaataggagttatcataacgtggataggtatgaacagtagaagtacgtcattgagtgttagtctagttctggttggagtggtaacactctatctgggggcaatggtgcaagctgacagcgggtgcatagtgtcctggaaaaataaagagctaaaatgtggtagtggcattttcataactgacaacgtccatacatggacagaacaatataaatttcaaccagaatcacccagtaaactggcaagtgcaattcaaaaagctcatgaagaaggcatttgcgggataagaagtgtgaccagattagaaaacttgatgtggaaacagataacacccgaacttaaccatatcctatcagagaacgaagtaaaactcacaatcatgacaggggacataaaaggaattatgcaagctggaaaaagaagtttaagaccacaacctacggaacttaaatactcctggaaaacctggggaaaagccaaaatgctgtctactgaatcacataaccaaacattcctaatcgatggtcctgaaacagcggaatgtcctaatacaaatagggcatggaactctcttgaagttgaagattacggatttggagtatttactactaacatatggctaaaactcagagaaaagcaagacgtgttctgcgattccaaacttatgagtgctgcgattaaagataatcgagcggtacacgcggacatgggatattggatagaatccgccctcaatgatacgtggaaaatggagaaggcatcttttatcgaagtcaaatcgtgtcattggccaaaaagtcatacattgtggtctaacggagtactagaaagcgaaatgatcattccaaagagtttcgcggggccagtgagtcaacacaactatagaccgggatatcatacgcaaacagctgggccatggcatttgggaaaattagagatggacttcgatttttgcgagggaacaacagtagtagttacggaggattgcggtaaccgtggtcctagcttacggacaactacagcatcaggtaaacttattacggaatggtgctgtagatcttgtacgcttcccccacttcgctatcgcggtgaggacggctgttggtacggcatggaaataaggcctcttaaggaaaaggaagaaaacttagtcaatagtctggtcacagcaggacacggtcaaattgacaacttctccttgggggtcttgggtatggccttattcttggaagagatgctacgtaccagagtcggcacaaaacacgcaatactattagtcgcactaagtttcgtgacactaattacaggtaacatgtcgttcagagacctcggcagggttatggtaatggtgggagcaacgatgaccgatgatataggcatgggtgtcacttatctggcacttctagccgcttttaaagtgagacctaccttcgcggctggactgcttttaagaaagctaacaagtaaagaattgatgatggcaacaattggaatagcgttattgagccaatccacacttccggaaaccatattagaattaactgacgcacttgctcttggtatgatggcattaaagatcgtaagaaatatggaaaaataccaactagcagtgacaataatggcaatctcttgtgtgccaaatgcagttattttacaaaatgcttggaaagtatcgtgtactatcttagcagcagtaagcgtgtcacctctcttgctgactagctctcaacaaaaggcagattggattcccctggcattaactataaaagggttaaacccaactgcgatttttctaacaactttgtcgcgaacttctaagaaaagaagctggccactcaacgaagctattatggccgtgggtatggtaagtatactagcttcatcactacttaaaaatgatatacctatgaccggaccgttagtagcaggaggattattaacggtctgttatgtattaactggtagaagcgcagacttggaattagaacgagcagcagatgtaaaatgggaagatcaagcggaaataagcggatcttctcccattttgagtataacgatatcagaagatggctcgatgagtatcaaaaacgaggaagaagaacaaacattgactatcctaataagaacggggctcctagtgatcagtggggtgttccccgtatccataccaatcacagcggccgcctggtatctatgggaggtcaagaaacaaagggcaggcgtgttgtgggacgtcccaagtccaccaccagtcggaaaagcggaactggaagacggagcatataggataaaacaacgtggaatactcggatactcacaaattggtgccggagtttacaaagaaggaacatttcataccatgtggcacgttactcggggtgctgtactaatgcaccgggggaaacgtattgaaccgagttgggcagatgtgaagaaagacctcatttcatatggtggcgggtggaaattagaaggtgaatggaaggaaggggaggaggttcaggtactcgcgttggaaccaggtaagaatccaagagcagtccaaacgaagcctggtatttttaaaactaatacagggacaataggagcggtaagccttgacttctcaccaggaacatctggttcacctatagtagacaggaaaggtaaagtcgttggcctatatggaaacggagtggttactagatcaggtgcatacgttagtgcaatagcacaaactgagaaaagtatagaggacaatcccgaaatcgaagatgatatcttccggaaaaagcggttaacgataatggatctgcatcccggtgcaggaaaaaccaaaaggtacttaccagcaatcgtgagagaagcaatcaaaagaggacttaggacccttatacttgctcctacaagggtagtcgcagccgaaatggaggaggctttacgaggactacccattagataccagactccagccatccgcgctgaacatactggtagggaaattgttgatttaatgtgccatgcaacatttacaatgaggttgctctcacccataagagtgccgaactacaatttgatcataatggatgaagcacacttcacagaccccgcttccatagcagctagaggttacattagtacacgagtcgagatgggggaagcagctggaatatttatgaccgcaacaccacctggctcacgcgatccatttccacagtcaaatgcaccaataatggatgaagaaagagaaatacctgagagatcgtggaatagtggccatgaatgggtcactgattttaaggggaagactgtatggttcgtgccaagcataaaagcaggtaacgacatcgcagcctgtcttcgaaagaatggaaagaaggttatccaattatcacgaaagacctttgactctgaatatgtcaaaacacgtgcaaacgattgggactttgttgtcaccacagatataagcgaaatgggtgctaacttcaaagcagaacgagtcatagatccaagaagatgtatgaaacccgtaatacttacagacggcgaggagagggtaatcctagcaggaccaatgccagtaacacattcaagtgctgctcagcgtagaggaagaataggtagaaaccctaaaaatgagaatgatcaatatatctatatgggagaaccccttgagaacgatgaagactgcgcgcattggaaggaagcgaaaatgttgttagataatatcaacactcctgaagggatcattccaagcatgtttgagcccgagagagaaaaagttgatgcgatagacggagaatataggctaagaggcgaagccaggaagacctttgtagacctaatgaggcgtggtgacctccctgtatggttggcatataaagttgcagcggaaggcataaattacgcagacagaaaatggtgctttgatggaatcaaaaataaccagatactagaggaaaatgtagaggtagaaatatggactaaagagggagagagaaagaaattgaaacctagatggttggacgcaagaatatactcagacccactagcactaaaagagttcaaagagttcgctgcagggaggaaaagtttgactttaaacttaattacagagatgggacgactccctacatttatgacacaaaaagccagaaatgcattagataacttagcagtacttcacaccgcagaagtaggaggcaaggcctacacacatgcactttccgaactaccagaaactttagaaactttactacttcttactttgctagctgcagtcacgggaggaatattcctatttttgatgtcaggtaagggtattggtaagatgaccctaggcatgtgctgtattataacggcgtcaatccttctatggtatgcacaaatacagcctcattggatagcggccagcattatcttagagttctttctgatcgttctgttgatccctgaaccggaaaagcaaagaacacctcaagataatcaactgacctatgtagtcattgcgattttaacagtggtagcagctacaatggcgaatgaaatggggtttttagagaaaaccaagaaagatttggggtttggttcaattacgacccaagaaagcgaatcaaatatcctagatattgacttaaggccagctagcgcatggacattatacgctgtggctacgacgtttgttacaccgatgctgagacacagtatcgaaaatagttctgttaatgtttcacttacagcaatagctaatcaggctacagttttaatgggattggggaaagggtggccattgagcaaaatggatataggtgtaccattgttagccataggctgctactctcaagttaaccccataacgttaaccgcagctcttttactgctagtagctcactacgcaataataggcccagggttacaagcaaaggccacgagagaagctcagaaaagggctgcagctgggataatgaaaaaccccactgtggatggaattacagtaatagatctagaacctataccatacgacccgaagttcgagaaacagctaggtcaagttatgttattaatcctctgcgtcacacaagtattaatgatgagaacaacctgggcattatgcgaagcactcacactagcaacgggtccaataagcaccctgtgggagggaaaccctggtcggttctggaacacaaccattgcagtatcaatggcaaatatctttagaggttcgtacctagcaggcgcaggactattattctccataatgaagaacactacaaatacaagaaggggtacgggaaacgtaggcgaaactctgggagagaagtggaaatcacggctaaacgctcttgggaagtctgagttccaaatatataagaaatcgggaatacaggaagttgaccggacgttagcgaaagaaggtataaagcgtggggaaacagaccatcacgcagtgagccgaggcagtgcaaagctaaggtggtttgtagagaggaacatggtgacaccagagggtaaagtagtagacttaggatgcggaagaggcggttggagttactattgcgggggtttgaaaaatgttagagaagtgaaaggcttaacgaaaggaggaccaggtcatgaagaacctataccgatgtctacatatgggtggaatctagtaaggcttcagagcggagtcgatgtattctttactccaccagagaagtgcgatacattgctttgtgatatcggtgaatcctcacctaatccaacaatagaggcaggcagaaccttacgagtactcaacttagttgaaaattggttaaacaacaatactcaattttgtatcaaagtactaaatccatatatgccaagcgtgatagagaaaatggaaacgttacaacgaaaatatggtggggccctagtcagaaatcctttaagtagaaacagcacacatgagatgtactgggtaagtaacgcaactgggaacatagtaagttcagttaacatgatttctagaatgcttataaaccgatttacaatgaagcacaagaaggctacatatgagccagatgtagacttagggagcggaactagaaacataggcatcgagtccgaaatccccaatttagatattataggaaaacgaattgagaaaattaagcaagaacacgaaacatcatggcattatgatcaagaccatccgtacaaaacatgggcgtaccatgggtcatatgagacaaaacaaaccggatccgcaagcagtatggttaatggtgtggttcgattactgactaagccttgggatgtagtacctatggttactcaaatggccatgaccgataccacgcccttcggacagcaaagggtctttaaagaaaaagtagatacacgaactcaggaacctaaagaagggactaagaaattaatgaaaataactgcagaatggctttggaaagaactaggaaaagagaaaactccaagaatgtgtacaagggaggaatttactcggaaggtacgaagtaacgcggcactcggtgcagttttcacagacgaaaataaatggaaaagcgcgagggaagcggttgaagacggaagattttgggagttagtcgatcgagaacgaaacctccacctagagggaaagtgcgaaacatgtgtttataatatgatgggcaaaagggaaaagaagctcggtgaatttggcaaagcgaaaggatctcgcgccatatggtatatgtggttaggcgcacgatttcttgagttcgaagccctaggatttttaaatgaggatcattggttctcacgaggtaatagcttatcgggcgtagaaggagaaggacttcacagattgggatacatcttgagggaagtgggtaagaaagagggaggggcaatgtacgcagacgataccgcaggatgggatactagaataacgcttgaggatcttaaaaacgaagagatggtcacaaatcacatgaaaggagagcacaagaaacttgcagaggcgatttttaaacttacataccaaaataaggtcgttagggttcaacgacccacaccgcggggaacggttatggatataattagtcgcaaagatcaacgaggctcaggacaggtgggtacctatggtctgaacaccttcacgaatatggaagctcaattaatacgacaaatggaaggcgagggaatattcaaaagcattcagcatttaaccgccactgaagaaatagcagtccagaactggttagcaagggtaggacgagagaggttaagcagaatggcaataagcggcgatgattgtgtcgtaaaaccaatagatgatagattcgcgtcagcattaacagcgcttaatgacatgggaaaggtacgaaaggatattcaacaatgggaaccaagtagaggatggaatgattggacacaagtccctttttgcagtcatcattttcatgagctagtaatgaaagacggaagagtacttgttgttccatgcagaaatcaggacgaactaattgggagagcaagaatcagtcagggggcgggatggtcactcaaagaaaccgcatgcttaggaaaaagttatgcacaaatgtggacgttaatgtacttccatcgacgagacttgagattggccgctaatgcgatatgcagcgccgtaccctcccactgggtgcctacaagtagaactacatggtcaattcatgctaagcacgaatggatgaccacagaggatatgctcgctgtatggaatcgggtatggatccaggagaatccatggatggaagacaaaacacctgtagaatcctgggaggaagttccgtatcttgggaaaagagaggatcaatggtgtgggtcacttatcggattaacttccagagccacatgggcgaagaacatacaaactgcaatcaaccaagtaaggagtttaataggcaacgagggttacactgactatatgccatcaatgaaaagattcagaagagaagaagaagaagcaggagttctctggtga

SEQ ID NO: 22809 - RNA, 9876 nt, synthetic construct
  misc_feature 1..9876: note = derived and/or modified CDS sequence (opt6) from DENV-2__KM279598__SS-prME
  source 1..9876: mol_type = other RNA
actgcaggtatcatcataatgatgataccgaccgttatggcatttcatttaacaacaagaaatggggaaccccatatgatagtatctagacaagaaaaaggaaaaagtttattattcaaaactgaaaatggagtgaatatgtgtacattgatggcaatggatctaggagaattgtgtgaagacacaatcacttacaattgcccactactaagacaaaacgaacctgaagatatagattgctggtgcaattcaacatcgacatgggttacatacggtacctgtacggcaaccggagaacatagacgtgaaaaacgatcggtggcactcgtaccacacgtcggtatgggacttgaaacacgaactgaaacatggatgagcagcgaaggcgcatggaaacacgcgcaaagaatagaaacctggatcctcagacacccaggattcactataatggcagcaatattggcatacactataggaactacatactttcaacgagttttaattttcattttattaactgccgtcacccccagcatggcgatgcgttgcataggcatatcgaatagagattttgtagaaggagttagcggtgggagctgggtggacattgtattagaacacggatcttgtgtcactaccatggccaaaaataaacccacattagattttgaattgattaaaacagaagctaaacacctagcgactctgcgaaaatattgtgttgaagcaaaattaacaaacactactactgcatctcgatgtccaacccaaggagaaccctctttgaacgaagaacaagacaaaagatttgtctgcaaacacagtatggttgatcgaggttggggaaatggttgtggtttgtttgggaaaggcggcatcgtgacgtgtgctatgtttacttgcaagaaaaatatggaaggtaaagtagtacagcccgaaaatttggaatacacgatagtaattaccccgcactcaggggaagaaaatgcggttggaaatgataccgggaaacatggaaaagaaattaaagtaacacctcagtcctcaataacagaagctgaattgactggttacggaacggtgacaatggaatgttctccacgaacgggattagattttaatgaaatggtgttattacaaatggaaaacaaagcatggttagttcacagacaatggtttctagacttgcccttgccatggctccccggagcggacactcaaggaagtaactggatacagaaagaaacactggttacatttaaaaatccacatgctaagaaacaggacgttgtagttctcgggtcgcaagaaggcgccatgcacactgccttaacaggagcaacagagattcagatgtcgtctgggaatttactttttacaggacatctaaaatgtcgcttgagaatggacaaactacaactcaaaggcatgtcttactcaatgtgtacaggaaaattcaaagtcgtcaaagaaatcgcagaaacccaacacgggacaatcgtcataagagtgcaatacgagggagacggatctccgtgtaaaataccgttcgaaataatggatcttgagaaacgacacgtgctcggacgccttatcacagttaacccaatcgtcaccgaaaaagattctccggtaaatatagaggcagaacctccattcggagatagttacataataataggcgtagaaccaggtcaattaaaactaagctggttcaagaaagggagctcaataggtcaaatgtttgagactactatgagaggagctaaaagaatggcgattcttggagataccgcttgggactttggttcattaggaggggtattcacatcaattgggaaagccttgcaccaggtattcggagctatttacggggctgcattctcaggtgtttcatggacaatgaaaatacttataggagtcgtaataacgtggataggcatgaactctcgtagtactagcttatcagtctcacttgttttagtaggagtcgtaacattatacttaggagttatggttcaagcagatagtggatgtgtggttagttggaaaaataaagaactaaaatgtggcagcggtatattcatcaccgacaatgtacacacatggactgaacaatataaattccaaccagaatctccatcaaaactggcatcggccattcagaaagcccacgaggaaggtatctgtggaattagaagtgtgacgagattagaaaatttaatgtggaaacagataacgcccgaactaaatcacatcttaaccgaaaatgaagtaaaattaacaatcatgacaggcgacatcaaaggaattatgcaagcaggtaaaaggacactgcgtccacaaccaacagagctaaaatattcttggaaggcctggggaaaagctaaaatgctatcaactgaactacacaatcatacattcctgattgatggaccggaaacagctgaatgccctaacacaaatagagcatggaactcgcttgaggttgaagactatgggttcggagtctttacgaccaatatctggcttaagttaaaagaacgacaagatgtgttttgtgattccaaattgatgagcgcagcaataaaggataatagagcggtgcatgcagatatgggatattggattgaatcagctttgaatgacacttggaaaatcgaaaaggccagctttattgaggttaaatcctgtcattggccgaaaagccacaccctctggagtaacggagtattagaaagcgaaatgattatacctaaaaactttgccggccctgtttctcaacacaattatcgcccaggataccatactcaaacagctggaccctggcatcttggtaggctagagatggatttcgacttttgcgagggcacgaccgtagttgtcactgaagattgtggtaatcgaggtcctagcttacggaccaccacggcttcaggaaaacttataaccgaatggtgctgccgtagctgtacgctacccccactaagatatagaggagaagatggctgttggtacggaatggagattcgtcctttaaaagagaaggaggaaaacctggtaaatagtctcgtaactgcgggacacggtcaaatagacaactttagtctcggagtgctagggatggcgctatttctcgaggaaatgttaagaacaagggtcggaacaaaacatgctatcttacttgttgcagtgagtttcgtgactttgattacgggtaacatgtctttcagggacgtggggcgagttatggtaatggtaggagcgactatgactgacgatatagggatgggtgttacatatttagccctactggcagcgttcaaaatccggccaacattcgctgctggtttgttactaagaaagttaacaagtaaagaattgatgatgacaactatcggcattgttttattatctcagtcaactattccggagagtatcttggaactgacagatgcactagcacttggtatgatggtacttaaaatcgttcgcaacatggagaaataccagcttgcagtgacaattatggccatcctatgcgtacctaacgccgttattctccaaaacgcttggaaagtttcgtgtacgacgctcgcagtagtatcggtttctccactgcttcttacaagttcacaacagaaggcagattggatcccactagcgctaaccatcaaaggattaaacccgactgctatatttctgacaacactaagcagaacgagcaagaaaagaagctggccactcaacgaagcaataatggccgttggtatggtaagtatattagcaagttcacttctcaaaaatgacattcccatgacgggtccattagtagctggtggattgttaactgtctgttatgttctgactggtcgaagtgccgatctagaattagaaagggctgcagatgtcagatgggaagaacaagccgaaataagcggaagttcccctatattaagcattacgatcagcgaggatggatcaatgtctatcaaaaatgaggaagaagaacaaactctaacaatactaatacgtacaggccttttagttatatctggattatttccagtatctataccaataaccgctgcagcctggtacttatgggaggtaaagaaacaacgggcaggggtactgtgggatgtgccatcaccgccacctgttggaaaagcagaattggaagacggcgcatatagaattaaacaaaaaggaatattaggatatagccaaattggcgccggagtatacaaagaaggcacattccacacaatgtggcacgtgaccagaggggcggtgctgatgcataaaggcaaaaggattgagccttcatgggcagacgtgaaaaaggatttgataagttacggaggcggctggaaattggaaggggagtggaaggaaggggaagaagttcaagtactcgctcttgaacctggcaaaaatcccagagccgtacaaacaaagccaggtctttttaaaactaatacaggaactataggagccgtatctcttgacttttccccaggaacatccggaagccccatcgtagacaagaaaggtaaggtagttggtctttatggtaacggcgtcgtaactagatctgggacttacgtatcagcaattgcccaaactgaaaaatcaattgaagacaacccggaaatagaggatgatatttttagaaagaagaggttaacaatcatggacctgcatcccggagcaggaaaaactaaaaggtacctacccgctatagtaagagaagctataaaaaggggtttgagaacgttaatactggcacccacgcgtgttgtagccgcagaaatggaagaagcattacgtggtcttcccatacgttatcaaacccctgcaataagggcagaacatacaggtcgtgaaatcgtagacttaatgtgtcacgcgaccttcactatgagactactaagcccaattcgagtacccaattataacttaattattatggacgaagctcatttcacagatccagccagtatcgcagcgagaggttacatttccactagagtagagatgggagaggccgccggtatatttatgactgcaacaccacctggcagtagagatccctttccacaaagcaatgcacccattatggacgaagaaaaagaaattccggaacgatcttggaactccgggcatgagtgggtcacggattttaaaggtaaaacggtctggtttgttccatccatcaaagcggggaatgatatcgctgcatgccttcgcaaaaatgggaagaaagtgatacaactctcaagaaaaacctttgactccgaatatatcaaaacgaggacaaacgattgggactttgtggtaactacagatatttctgagatgggcgcaaactttaaggcagagagagtaatcgatccaagaagatgtatgaaacccgttatattaaccgatggtgaagaacgggtaattctggcaggtccaatgcccgtaactcattccagtgcggcccaaaggcgtggtcgtgtcggtaggaatcctaaaaacgaaaacgatcaatacatctatatgggcgaacccttagagaatgatgaggattgtgcccactggaaagaggcaaagatgttattagataatataaatacaccagaagggatcataccgagtatgtttgagcctgaaagagaaaaagttgatgcaattgatggagaatataggctaaggggagaggctcgaaaaacgttcgttgatctaatgagaagaggagatttacctgtatggctcgcatatagagtcgcagccgagggcataaattatgcagatagaagatggtgttttgatggtgtcaaaaataatcaaatactcgaagaaaatgtagaagtagagatctggacaaaagaaggggaaaggaagaaactaaaaccacgttggttggacgccagaatatatagtgacccactagctttaaaggaatttaaggagtttgcagcaggtagaaaatctttgacgttgaatctcataacggaaatgggaaggttgccaacgttcatgacacaaaaagccaaaaatgcccttgataaccttgcagttttacacactgcggaagctggcggacgagcatataatcatgctctatctgagctccctgagacattggaaaccttattattgttgacacttctagccaccgtaaccggtggaatttttctctttctaatgtccggaaaaggtattggcaagatgactcttggaatgtgttgtatcattacggcatcgatactcttatggtatgctcaaatacagccacactggatcgcagctagtattattttagaatttttcttaattgttctgctcatcccagaacccgaaaaacaacgtacaccacaggataaccaattaacatacgtagtcatagcgattttaaccgttgttgctgcaactatggcaaacgaaatgggatttttagaaaagactaagaaagattttggcttaggcagtataaccacacaacaacctgaaagcaacatacttgacattgacctacgacccgccagtgcttggactttatacgccgtagccacgacctttataaccccaatgctgcgtcactcgatagaaaacagttcagttaacgtatcacttactgccatcgcaaatcaggcaactgttctcatgggattgggcaaaggttggccgctaagtaagatggatataggagtgcctttacttgctataggctgctactctcaggtcaaccctattacactaacagctgctttactcctattagtggcacattatgcaattataggcccaggtctacaggctaaagccacccgcgaagcacagaaacgggctgccgctggaattatgaaaaatccaacagttgatggaatgacagtaatagaccttgatccgataccttacgatcctaaatttgaaaaacaactaggacaagtaatgctattagttttatgcgtaacacaggttttaatgatgaggacaacctgggcactttgcgaggctttaacactcgcaacgggtccaatctcaaccttatgggaaggcaaccctggaagattttggaatacaacaatagcggtaagtatggcaaatatattcaggggaagttatcttgctggagcgggcttgttgttctcgataatgaaaaacacagcgaataccaggcgaggaacaggtaataccggagaaacgctcggggaaaaatggaaaaacaggctgaatgccctggggaaatcggagttccagatttataagaaaagtggaatccaagaagtagatcgaactctcgctaaagaaggaatcaaaagaggcgagactgatcatcacgctgtatcgagaggttcagcgaaattacgctggttcgttgaacgaaatttagttacacccgaaggaaaggtagtggaccttggatgtggacgtggaggctggtcttattattgtggtggactcaagaacgttaaagaagtcaaaggactaactaagggtgggccgggacatgaagaacccataccaatgagcacgtatggttggaacttagtaagactacaaagcggcgtagacgtattctttactcctcccgaaaaatgtgatacgctattatgtgatatcggcgaatcatctccaaaccctacggtagaagctggaagaaccttacgagtactaaatctagtcgaaaattggctaaataacaatacgcagttctgcataaaagtattaaatccctacatgccaagtgtaattgagaaaatggaggctttacagaggaaatatgggggagccctagtcagaaatccattgagtcgaaatagtacacatgaaatgtactgggtatcaaacgcatcaggaaacatagtaagctctgtcaacatgatctcacgaatgttaataaatcgatttaccatgaggcataaaaaggctacctacgaacctgacgtcgaccttggaagtggaactcgtaacataggaatagaatcagaaacacctaatcttgatataataggaaaaagaattgagaaaataaaacaggaacatgaaacatcttggcattatgatcaggaccatccttataagacatgggcataccacgggagttacgaaaccaaacaaacaggaagtgcaagttcaatggtcaatggagtggtacgcctactaactaaaccttgggacgtgataccgatggtcacccaaatggctatgactgacacaacgccattcgggcaacagagagtcttcaaagaaaaagttgatacgagaacacaagaaccaaaagagggaactaagaaattaatgaaaataacagctgagtggctgtggaaagagctcggcaagaagaaaacccctaggatgtgcacacgtgaagagtttacaaggaaagtgagaagtaacgcagctcttggtgcaatatttacagacgaaaacaaatggaaaagcgctagagaggcggttgaagactccggtttttgggaactcgtcgataaagagcggaacttacatctggaaggtaaatgtgaaacttgtgtgtataacatgatgggaaaacgagagaagaaactaggcgagttcggaaaggccaaaggaagtcgcgctatctggtatatgtggctcggagcacgatttttagagttcgaggccttaggattcttaaacgaagaccattggtttagtcgcgaaaattcactatctggagttgaaggtgagggattacacaagttaggttatatcttaagagatgtgtcaaagaaggaaggtggagccatgtacgccgatgacacagcaggatgggatacacgtattacattagaggatctcaaaaatgaagagatggtgaccaatcatatggagggcgaacataagaaactagccgaagctattttcaaattaacatatcaaaacaaagtagttcgagtacaaagaccgacgcctagaggtactgttatggatataatatcccgccgggatcaaaggggctcgggtcaagtcgtaacatacggactgaatacatttactaatatggaagcacaactaatacgtcagatggaaggagaaggagtctttaagtccatccaacagttaacggttaaggaagaaattgcagtgaaaaactggctaattagagtagggcgagaaagattatccagaatggcaatatctggcgacgactgcgttgtaaagcctcttgacgatcgctttgcttcggccctcactgcacttaatgatatgggcaaagtacggaaggatatacagcagtgggaaccatcacgaggatggaatgattggacccaagtgccgttttgtagtcatcactttcacgaattaataatgaaagatggacgagttctagtagtcccttgtcgaaaccaagatgagctcataggtcgagcgaggattagtcaaggtgcaggatggtcgttacgagagacggcatgccttggaaaatcctatgcacaaatgtggtcacttatgtatttccaccgtcgagatttacgtcttgctgccaatgctatttgtagtgcagtcccttcgcactggataccaacaagtagaaccacatggagcatacatgcaacccatgaatggatgacaactgaagacatgctaaccgtttggaatcgtgtctggattcaagaaaatccatggatggaagacaaaacgccagtcgaatcatgggaagaaatcccctaccttggaaaaagggaagatcaatggtgcggttcattaatagggttaacctctagagcaacttgggcaaagaacatacaaacagcaatcaatcaagtacgttcactgatcggaaacgaagagtacaccgattatatgccttcaatgaaacgatttcgtagagaagaagaagaggctggggtactttggtag

SEQ ID NO: 22810 - RNA, 9876 nt, synthetic construct
  misc_feature 1..9876: note = derived and/or modified CDS sequence (opt6) from DENV-2__KM279576__SS-prME
  source 1..9876: mol_type = other RNA
accgcagggataataataatgatgatccctactgtaatggcattccatttaactactaggaatggcgaacctcatatgatagtcagccggcaagaaaaaggcaaaagcctactattcaaaacagaaaacggcgtaaatatgtgcaccttaatggctatggatttaggcgaattatgtgaagatacaataacctacaactgtcctctattgaggcaaaatgaacccgaagatattgattgctggtgcaattcaacctctacttgggttacctacggtacttgtactgcgacgggcgaacatcgtcgggagaaacgatcagtagcacttgtaccccacgttggcatgggtttagaaacaagaacagaaacatggatgtcgagcgaaggagcttggaaacatgcacagaggatagaaacatggatccttcgccacccgggttttacaataatggcagcaatattggcttataccataggaacaacctattttcaacgagttcttatatttatactattgactgcagtaaccccctcgatggcgatgagatgtatcggaatctctaatagggacttcgtggaaggcgtctcgggtggttcatgggtcgacattgttctagaacatggatcatgtgttaccacaatggccaaaaacaaaccgacattggatttcgaattaataaaaaccgaagcaaaacatctggctacattacggaaatattgcgtagaagcaaaattaactaatactaccactgctagcagatgtccaacacaaggggaaccgtcactgaacgaagaacaagataaaaggttcgtttgcaaacactctatggtagatagaggatggggaaacgggtgcggactcttcggcaaaggtggcatagttacttgtgccatgtttacatgcaagaaaaatatggagggcaaagttgtacagcccgaaaatctagaatacacaatagtaattacaccacactcgggtgaagaaaatgctgtaggaaacgacactggaaaacatggaaaagaaataaaagtaactccacagagtagcataacagaagcagaattaacaggatatgggacagtaactatggaatgtagtccaagaacaggattagacttcaatgaaatggttttactacaaatggaaaacaaagcctggctagtccatcgacagtggtttctggatttgccactaccatggctcccaggggctgacacgcaagggagcaattggatacaaaaagaaactctagttacattcaaaaatcctcacgccaagaaacaggatgttgtcgttcttgggtctcaagaaggagctatgcacacagctcttaccggtgcaacggagattcaaatgtctagcgggaacttactattcacaggccatctcaaatgtagactccggatggacaaactgcagctaaaagggatgtcctactccatgtgtacaggtaaatttaaagttgtgaaagaaatcgccgagacacagcatggcacaatcgttataagagtgcaatatgaaggagacggttcgccgtgtaaaattccttttgaaataatggatttggagaaaagacatgtcctcggccggttgattactgtgaaccctattgtaacagaaaaagattccccagttaatatcgaagctgaaccacccttcggtgattcttatattataattggcgttgaaccaggtcaattaaaattgagctggttcaagaaaggctcatcaataggccaaatgtttgaaacaacaatgcgtggcgcaaaaagaatggcgatattaggagacactgcttgggactttggatcattaggaggtgtatttacgtcgataggcaaagcgctccaccaagtgtttggcgccatttatggagcagccttttcaggagtatcatggactatgaaaatccttattggagttgttattacatggataggtatgaactcacgtagcaccagccttagtgtatctcttgttctagttggcgtagtaactttgtatctaggagtcatggttcaagcagatagtggctgcgtcgtatcctggaaaaataaagaactaaaatgtggatcagggatctttattactgataatgtacatacgtggacagaacagtacaaattccagccagaatcaccatccaaacttgcaagcgccattcaaaaagctcacgaagaggggatttgcggtatacgtagcgtaacaaggttggaaaatctcatgtggaaacaaataacgccagagttaaatcatatactaaccgagaatgaagtgaaactaacaattatgacaggcgatataaaaggaatcatgcaagcaggcaaaagaacactgagaccccaacctacagaattgaaatattcctggaaagcctggggcaaggctaaaatgttatccacagaactgcataatcatactttcctaatcgatggtcctgaaacagcagaatgtcctaacactaaccgagcctggaactcactcgaagttgaagactatggatttggtgtcttcactaccaatatttggctaaaacttaaggaacgacaagacgtattttgtgatagtaaactgatgagcgcggctataaaagataatcgggcagtgcacgcagatatgggatactggattgaatcagcattaaacgatacgtggaaaattgagaaagcctcctttattgaagttaaatcatgccattggccaaaaagtcacacattatggtctaatggcgttcttgagtctgaaatgatcattcctaaaaattttgcggggccggtttcacaacacaattaccgaccgggatatcacactcaaacggcaggaccatggcacctaggaagactagaaatggattttgacttctgtgaaggaaccacggttgtggttacagaggactgcggaaatagaggccctagtttaagaacaacaacggcgagtggcaaacttattacagaatggtgttgcagatcatgtactctaccacccttacgatatcgaggtgaagatggttgctggtatggtatggaaatacgtcccctaaaggaaaaagaagaaaacttagtaaattctctagtaaccgctggacatgggcaaatagataacttttctctcggtgtcctaggtatggcactctttcttgaagaaatgctacgtacacgggtcggaacaaaacacgcgatacttctcgtagctgttagcttcgtaaccctcataacgggtaacatgtcattccgagacctgggtcgtgtcatggtaatggtaggagccacaatgaccgacgatatagggatgggcgtcacatacttagcgttattagcagcttttaaaataagaccaacttttgcagcgggactacttttaagaaaactcaccagcaaagaactaatgatgactacgattgggatagttttactgagccagtcaacaatcccggaatcaatcctagaattgacagatgctctagcgttaggaatgatggttcttaaaatagtaaggaatatggagaaatatcaacttgccgtcactatcatggccatactatgcgttcccaacgccgttatattgcaaaacgcttggaaagtaagttgcactacactagctgtagtgtcagtaagcccactactgctaacaagttcacaacagaaggcagactggattcccttagcgctcactatcaagggcttaaacccgacagcaatattcctgactaccctttcccgtacgagcaagaaacggtcatggcccttaaatgaagctatcatggccgtaggcatggtaagtatcctagcttcatcattattaaagaacgatataccaatgactggacctttagtagcagggggattgctaacagtgtgttacgttctgactgggagatccgcggacctggagctagaacgtgcggcggatgttaggtgggaagaacaagctgaaattagcggtagcagtcctattttgagcataacgattagcgaagatggaagcatgtcaattaaaaacgaagaagaagaacaaactttaacaatattgatacggacaggacttctggtaatatcaggactcttcccggtaagtatccccattacagcagccgcatggtatttatgggaagtgaagaaacaacgcgcaggggtactttgggacgtaccctcaccaccaccggttgggaaggccgaattggaggatggagcgtaccgtatcaaacaaaaaggaatattaggttatagccagataggtgccggagtgtacaaggagggcacatttcacaccatgtggcatgttacaagaggagctgtcttaatgcacaaaggaaagcgaattgaaccaagctgggcagacgtcaagaaagatctaatatcttatggcggcggatggaaactagagggtgaatggaaagaaggtgaagaagtccaagttttagctttagaacctggtaaaaatccacgtgccgtacaaaccaagcccggactattcaaaacaaacactggaaccatcggcgcggtttcactagatttctcccctggaacaagtggtagcccaatagtggacaagaaaggcaaagtagttggcttatacgggaatggagtagtaacaaggtccggcacatacgtctccgcaattgcgcaaactgagaaaagtatagaagataatccagaaatcgaagatgatatttttagaaagaaacgtcttacaattatggatttgcatccaggagccggcaaaaccaagagatatctccccgcaatcgtcagggaagcaataaaacgggggctaagaacgcttatcttagcaccaacaagagtggtggcagctgaaatggaagaagccttaagaggacttcccatccgatatcagactccagctataagggccgagcataccggaagagagatagtagatttaatgtgccatgcaacctttaccatgcgcttgttatcccccataagagtacccaattataatttaataatcatggacgaagctcatttcacggatcccgcaagcattgcggccagaggctatatatcaacaagagttgaaatgggcgaggcagctggcatatttatgaccgcaacacctccaggctcccgagatccttttcctcaatcgaatgctccaatcatggacgaagaaaaggaaatacctgaacgtagttggaatagtggtcatgaatgggtgacagacttcaaagggaaaacagtctggtttgtgccctcaataaaagctggaaatgacatagcggcatgcttacgtaaaaacggtaagaaagtcatccagctatctcgcaaaacatttgacagcgaatatattaaaacccgtacaaatgattgggacttcgtagtaaccactgacatttcagagatgggcgctaactttaaagcagaaagggtaatagacccaagaagatgcatgaagccggttatacttacagacggagaagaacgtgtcatccttgcaggtccaatgccggtgactcattctagtgcggcgcagagacgagggagagtcggtaggaatcccaagaacgaaaatgatcaatacatatatatgggcgaaccactggagaacgatgaagactgtgcccactggaaagaagcaaaaatgttactagacaatattaatactccggaaggaataatacccagtatgtttgaaccagaaagggagaaagtagacgcaatcgatggagagtacagactaagaggcgaagccagaaagacttttgtagacctaatgaggagaggagatttacccgtatggttagcataccgtgtagcggcagaaggtatcaattatgctgacagaagatggtgtttcgatggagttaaaaacaatcaaatattagaggagaacgtagaagtggaaatctggaccaaagagggagagaggaagaaattaaaaccaagatggcttgatgccagaacatatagtgatccactggcattaaaagagttcaaagagtttgccgcaggcagaaagtctctaacattaaatcttattacagaaatgggaagattaccgacatttatgactcagaaagccaaaaatgcacttgacaaccttgctgtcttacatacagctgaagctgggggtagagcatacaaccacgccctatccgaactcccagaaactttggaaacactactattattaactcttcttgcaacagttaccggtggtatcttcttgtttttaatgagtggcaagggtataggcaaaatgacattgggtatgtgctgtattataacggcaagcatacttttgtggtatgcccaaatacaaccacactggatagcggcgtcaattatcttagagttctttctaatagtccttctcatacctgaaccagaaaagcaaagaacaccccaagataaccagttgacatatgtggtaatagctatattaactgtggttgccgccaccatggcaaatgagatgggctttttggagaaaaccaagaaagactttggtctaggatcaataaccacacagcaaccagagagtaatatacttgatatagatcttcgaccagctagcgcttggacattgtatgccgttgctactacctttatcacccccatgttacgacactcaatagaaaattcttccgttaacgtgtcacttactgcaattgcaaatcaggctacagtattaatgggtttggggaagggatggcccttatcgaagatggatataggcgtcccccttctagcgatcggttgctatagtcaagtcaatcctattaccctcacagcagctctactactgttagtagcacattatgcaataatcggaccagggttacaagcaaaagcaacgcgtgaggctcagaaaagagcagccgctggcattatgaaaaacccgactgtagatggcatgactgttattgatctagaccctataccctatgatcctaagtttgaaaagcaattaggtcaagtaatgttgttggtgctctgcgtgacacaagtattaatgatgagaaccacttgggcactatgtgaagcgttgaccctagcaacagggccaatttcgacattatgggaaggaaaccccggcagattctggaacaccacgatagctgtgtccatggcaaacatctttagggggtcttatctagccggagccggtttattattttcaataatgaaaaacactgcaaacacaagaagaggcacaggtaatacgggtgaaactttgggggaaaaatggaaaaatagacttaacgctctaggaaagtctgagttccaaatctacaagaaatcgggtatacaagaagtggacagaactctcgcaaaagaaggtataaaaaggggtgaaaccgaccaccatgcagtttcacggggatcagctaaattacgatggttcgttgaacgtaatctcgtaactccagaaggaaaagtggtagatctaggctgtggtaggggtggatggtcatactactgtggagggcttaaaaatgtcaaggaagtaaaaggactaactaaaggcggacctggacatgaagaaccaatacccatgagcacgtatggatggaatctcgtccgactccaaagtggggtagatgtatttttcacaccgcctgaaaaatgtgatacgctcttatgcgatattggagagtcatcaccgaacccgacagttgaggcggggcgaacactgagagttctgaatctagtggagaattggttgaacaataatacacaattttgtattaaagtcctcaatccttatatgccctcagtgatcgagaaaatggaggcactgcaacggaaatacggcggcgcattagttaggaaccctttatctagaaatagtacccatgagatgtactgggtctctaatgcctcagggaatatagtaagctcggtaaacatgattagtagaatgttaataaatagattcactatgaggcataagaaggcaacgtacgaacctgacgtagatctaggaagcggcacacgaaacataggaattgaatctgaaacaccaaatctagatattatagggaaaaggatagaaaagatcaaacaagaacacgagacatcatggcactacgaccaagatcacccatacaaaacatgggcataccatggcagttacgagaccaaacaaacaggttccgcctcatctatggtgaatggagttgttaggctcttaacgaaaccctgggatgtaattcctatggtcacacaaatggcaatgactgatacaactccgtttggacaacaaagagtgtttaaagagaaagtggatactcgaacacaagaaccaaaagagggaactaagaaactcatgaaaattaccgcagagtggttatggaaagagttggggaagaagaaaactccaagaatgtgtacaagagaggaatttaccagaaaagtacgctcaaatgccgcacttggcgccatatttaccgacgaaaacaaatggaaaagtgccagagaagcagttgaagatagtgggttttgggaattggtagataaagaacgcaatttacacctcgaaggaaaatgtgagacgtgtgtatataacatgatgggaaagagagagaagaaacttggagagttcggaaaggccaaaggcagtcgtgctatatggtatatgtggctcggagcacgctttctagagttcgaagcgttaggattccttaacgaagatcactggttctcaagagaaaattcgctatcaggcgtagaaggtgaaggactacataagttaggatacatattaagagacgtttctaaaaaggaaggcggtgcgatgtatgctgacgataccgcaggctgggacaccagaattactttggaagacctaaagaatgaggaaatggtgacaaatcatatggagggagaacacaagaagttagctgaagcaatttttaaacttacttaccaaaacaaagtagtaagagtccaaagaccaacgcctcgtggtacagtaatggatattattagtagaagggatcaacgcggatcaggtcaagttgtgacttatggactcaatacattcacaaacatggaggctcagttaatacgccaaatggaaggtgaaggagtgtttaagtcaatccaacagctaacggtaaaagaagaaatagcagttaaaaactggttgatccgagtaggaagagagagactatctcgtatggctatctctggagacgattgtgtagttaaacctttagatgatcgtttcgcatccgctctcactgcgttaaatgatatgggtaaagtccgcaaagacattcaacaatgggaaccctcaaggggttggaatgattggactcaagttccattctgcagtcatcatttccacgaactaattatgaaagacggaagagtattagtcgtgccatgccggaaccaagatgagcttattgggagagctagaatatctcagggcgctggttggtcgttaagagaaacagcgtgcctaggaaaaagttatgcccaaatgtggagtcttatgtattttcatagacgcgacttaagattggccgccaacgcaatatgtagtgcagtaccctcacactggatcccaacaagtcggacaacctggagcatacacgcaacccatgagtggatgacaaccgaagatatgctgaccgtctggaatcgggtctggatccaagagaatccgtggatggaagataaaacacccgttgaatcctgggaggagataccatatttgggtaaaagagaagaccaatggtgcggatcgttgattggactgacatctcgagcaacgtgggctaaaaacattcaaacggctattaatcaagtacgaagtttgataggaaatgaagaatatacagattatatgccaagcatgaaacggtttcgacgtgaagaggaagaagccggtgtactttggtaa

SEQ ID NO: 22811 - RNA, 9876 nt, synthetic construct
  misc_feature 1..9876: note = derived and/or modified CDS sequence (opt6) from DENV-2__KC964095__SS-prME
  source 1..9876: mol_type = other RNA
tcagcgggaatgataattatgcttataccaacagtaatggcattccacttgacgactcgaaacggtgaaccgcacatgattgtgagcatacaggaaaaaggaaaaagtttattgtttaaaacagaagatggagtaaacatgtgcactttaatggccatggatttaggggaactttgtgaagatacaattacatataaatgcccgctacttagacaaaacgaacctgaagacattgatcgctggtgcaactctacaagtacatgggtaacgtatggtacatgtaccactaccggggaacatagacgcgagaaaagatctgtcgcactcgtgccacatgttggaatgggtctagaaactcgaactgaaacatggatgagttctgagggagcttggaaacacgcacaaagaatcgaaacatggattctaagacatccaggctttacaataatggctgcaatcttagcgtataccatcggaaccacgcacttccaaagggctctgatattcatattattgacagcagtcgctcccccaatgacgatgagatgtattggcatctcgaacagggatttcgtggaaggagtttcaggaggaagttgggttgacatagtgctagagcatggatcctgcgtaacaacaatggctaaaaacaaaccaacccttgatttcgagctgataaaaactgaagccaaacaaccggccaccttaagaaaatactgtatagaagctaaattaactaataccacaacagagtcgagatgcccaactcagggtgaaccgtcattaaaagaagaacaagacaaaaggttcgtatgtaaacattcgattgtggataggggatggggtaacggctgtgggagctttggcaaaggagggattgtaacctgtgcaatgtttacatgtaagaaaaatatggagggcaagatagtacagccggaaaatttagaatatacaatagtagtgacaccacatagtggtgaggagcatgcaattggtaacgacacgggcaaacacggcaaagaaattaaagttacgccccaaagttcagttacggaagcggaacttacaggatacggtacagtgacaatcgaatgcagccctcgtactggtttagatttcaacgagatggtgctcctacaaatgggtaataaggcttggctagttcatagacaatggttcttggatttacccttaccctggttaccgggagccgacacacagggttcaaattggatccaaaaagaaacgcttgtaacattcaaaaatcctcacgctaagaaacaagatgttgtcgttctcggttcacaggaaggtgccatgcataccgcattaactggtgctactgaaattcaaatgtcgtctggcaatttactctttacaggacaccttaaatgcggcctacgtatggataaattacaactcaaagggatgtcttatagtatgtgcaccggcaaattcaaagtggtaaaggaaatagcggaaactcagcacggaacaatagtcatacgggtacaatatgaaggcgatggctcaccgtgcaaaataccattcgaaataatggatttagagaagagatacgtactcggaagattaatcacggtcaatcccattgtgacagaaaaggattcacccgtaaacatagaggctgagcccccattcggtgatagttatatcataataggcgtagaaccggggcagttaaaactcaattggttcaagaaaggatcatcaataggccaaatgttcgaaactacaatgagaggagcaaaaagaatggcaatactaggggacacagcgtgggatttcggttctctaggcggagtatttacatccataggtaaagcgcttcatcaagtatttggagcaatctatggggccgccttttcaggtgtatcgtggactatgaaaatactaattggcgttattataacttggatcggtatgaacagtaggtcgaccagtctatctgttagcctggtcctcgttggtatagttaccctatatctgggagttatggttcaggccgattcaggttgcgttgttagctggaaaaataaggaattgaaatgtggaagtggaatattcatcacagacaatgtacgtacatggacagagcaatacaaatttcagccggagtcacctagtaaactagcttcagcgattcaaaaagcccaagaagaagggatttgtggcattcgttcagtgacaaggctagaaaacctaatgtggaaacaaataaccccagaactaaatcatattcttgctgagaacgaagttaaattaacaattatgactggcgacataaaaggaacaatgcaagcgggcaaacgctcgttaaggccacaaccaacagaacttaagtatagttggaaaacatggggcaaggcaaaaatgctatctactgaaagtcataatcagacttttctaatagatggacctgagacggctgaatgtccaaatactaatcgcgcatggaactcattagaagtcgaagattatggattcggaatgttcacgacgaacatatggctacaacttaaagagaaacaggatgcattctgcgattcaaagctaatgtcagcagctattaaggacaatagagcagtgcatgctgacatggggtattggatagaatcagcgctaaacgatacatggaaaatagaaaaggcatcattcatagaggttaagaactgtcattggcccaaaagtcacactctctggtcaaatggggtgttagaaagtgagatgatcattcccaaaaatttggcgggaccagtatctcaacacaactatcgcccaggatatcacacacaaatagctgggccgtggcaccaaggaaaacccgagatggactttgacttttgtgatggtactacagttgtagtaacggaagattgcggtaataggggcccgtcattacgtactacaacagccagcggaaaattgatcacagagtggtgctgtagaagttgcacgctgccgccactcagatatagaggggaagatggatgttggtacgggatggaaataagaccgctcaaagaaaaagaagaaaatctagtaaatagtttagtcacagcaggccatggtcaaatagataatttttcattgggtgtactaggaatggcgcttttccttgaagagatgctacgaactagagtcgggactaaacatgcgatactattagtagcagtaagttttgttacattgatcaccggcaatatgtcatttaaagacctaggccgggtcgtagtcatggtaggagcaactatgacagacgatatcggtatgggcgtcacgtatctagcattgctagctgctttcaaggttagaccaacattcgccgctggtttattattacgaaaattaacttcaaaagagttgatgatgactacaattggtatagttttgctaagccaatccacaatccccgaaactgttttagaattaaccgacgctctcgcactgggtatgatggcacttaaaattgtcagagatatggaaaagtaccaacttgcagtgacaatcatggcaattctttgtgtcccaaacgcggtaattctccaaaacgcatggaaagtaagttgtaccatcctagcagtagtttctgtaagtcctcttctactgacaagcagtcagcagaaaacagattggattccacttgctctaaccatcaaaggacttaatccaacagcgatatttttaacgacgctatctcgaactaacaagaaaaggagttggcctctaaatgaagcaattatggcggtaggcatggtcagcatattggccagtagcctccttaagaatgatattccaatgacaggtcctctggttgcaggaggattacttacagtgtgctatgtactaacagggagatctgccgatttggaattagaaagggcaacggacgttaactgggaagaccaagcggaaataagtgggagctcaccaatactttcaataaccatctcggaagacggaagtatgagcatcaaaaatgaagaagaagaacaaaccctcacgattctaattcgaactggccttttagttatcagcggactctttcctgtgtcaattccgattacagcagcggcctggtatttgtgggaggtgaagaaacagcgggctggtgtactgtgggacgttccgtcaccaccacctatgggaaaagcagaactcgaggatggggcctatagaataaaacaaaaaggagtgttaggttattcacaaataggggcaggggtctataaagaaggaacatttcatacgatgtggcacgttaccagaggggcggttttaatgcataaaggtaaacgtatagagccttcttgggcagatgtcaagaaagatttaatatcgtatggaggagggtggaaattaggcggcgagtggaaggaaggagaagaagtacaggtgttggcacttgagccgggcaaaaacccaagggcagtgcagacgaagcctggactctttaaaacaaacaccggaacaataggcgcagtgtctttagacttttcgcctggcacaagtggctcaccaatcatagacaagaaaggaaaagtagaaggactttatggtaacggagtggttacaagaagtggaacttatgtaagcgcgatagcgcaaacagagaaatctatcgaggacaacccagaaatagaggacgacattttccggaagaaacgattaaccattatggatctgcacccgggagcaggaaagactaagaggtacctcccagccattgttagagaggcaataaagagaggtctccgaactttaattctagctccaacgcgtgtcgtcgcagcggaaatggaagaggcacttcgcggattgccaatacgctatcaaacaccggcaatcagagccgaacatactggcagggaaatcgttgaccttatgtgtcatgcaacatttacaatgcgactgctctctccagtgagagtaccgaattacaatctgataattatggatgaagcccacttcacagacccagcgtctattgcagctagaggttacatatccacgagggtagaaatgggcgaagcagcgggaatatttatgactgctacgccacccggttcacgtgaccccttcccacaatcaaatgcaccaataatagatgaagagagggaaataccagaacgcagttggaactcaggccatgagtgggtaaccgactttaaaggtaagaccgtttggttcgtccccagtataaaagccggaaacgatattgcagcatgcctaaggaaaaatggtaaaaaggtaattcagctatctagaaaaacattcgacagcgaatatgttaagacaagaaccaacgactgggactttgtagtgactactgacattagtgaaatgggcgcgaattttaaggccgaaagagtaatcgatcccaggagatgcatgaagccagtaattcttacagatggagaggaacgggtcatcttagcaggaccaatgccggtaacacattcttccgccgcacaaagaagaggaagaataggtcggaatcctaagaatgaaaatgatcagtatatatatatgggtgaaccactagaaaacgatgaagattgcgcacattggaaagaagccaaaatgttgctggataatataaatacccctgaaggcataataccatccatgttcgagcccgagagggaaaaagtagatgcaatcgatggagagtaccgactaaggggcgaagctaggaaaactttcgtagatctaatgagaagaggtgacttacctgtttggttagcctacaaagtggcagcagaaggaataaattatgctgacagaagatggtgcttcgatggaattaaaaacaatcagatcctagaagaaaatgtagaagtagaaatatggaccaaagaaggagagcggaagaaattgaaaccgcgatggctagatgcccgtatttatagtgatccattagctctaaaagaatttaaagaatttgcagcgggtagaaagagtctaaccttgaacttaattaccgaaatgggacgtctaccgacattcatgactcagaagacacgggatgctctggacaatttagctgtattacataccgcagaggccggaggcagagcatacaatcacgctctatcagagttgccggagacactagaaacactactgctcttgacccttctggcgactgtcactggaggcatatttctctttttaatgtcagggagaggaattgggaaaatgaccctgggaatgtgctgcataattacagcctctatattactatggtatgcccaaattcaaccacactggattgccgcgagcataatacttgagttctttcttattgttttactgattccagaacccgaaaaacaaagaacaccgcaagacaatcaactcacctacgtcgttattgctatactgactgttgtagcagcgacaatggctaacgaaatgggatttctagagaaaaccaagaaagatctaggattagggtctataacaacacaacaaccagaaagtaacatcctagacattgacctacctccagcatctgcttggaccctctatgctgtcgcgacaacatttgtaactccaatgctcagacactcgattgaaaattcctcagtcaacgtgtctttaacggccatcgctaatcaggcaacagtattgatgggactcggcaaggggtggccactttctaaaatggatattggagttcctttacttgccattgggtgctattcacaggtaaatcctatcacccttactgccgctttgttgcttcttgtagcgcattacgcaatcatcggtccaggcttacaagcaaaagcgacaagagaagcacaaaagcgagctgccgctggcataatgaaaaatcctaccgttgatggtattacggtcatcgatctagatcccattccttacgatcccaagttcgagaaacaacttgggcaagtaatgcttctcgtgttgtgtgtaacgcaagtgctaatgatgaggacaacatgggcgctctgtgaggctttaactttagcaacaggacccatctcgacactgtgggagggcaaccctgggcgattttggaacaccacaatagctgtttccatggcaaatatatttagaggctcatatctggctggagccggattgctattttcaataatgaagaataccacgaatactcgacggggtactgggaacattggagagacccttggagaaaaatggaaaagcagattaaacgcactagggaaaagcgaatttcagatatataagaaatcaggaatccaagaagtggaccgaactttagctaaggagggaattaaacgaggtgaaacggatcatcatgcagtatcacgagggagcgcaaaattaagatggtttgtagaaagaaatatggttaccccagaaggaaaagtcgtagaccttgggtgtggcagaggtggctggtcatattattgtggcggattgaaaaacgtccgtgaagttaagggtttaaccaaagggggtccagggcatgaggaaccaataccaatgagcacttatggatggaatcttgtaagattacaaagcggagtagatgtattctttatacccccagaaaaatgtgacacgttactatgtgatatcggagaatggtcgcctaatccgactgttgaagccggtagaactctacgtgtgctcaatcttgtagagaattggttaaacaataacacccaattttgtataaaggttctgaacccgtacatgccaagtgtcatagagaaaatggaaacgttacaaagaaaatacggaggagccttggtaaggaacccactgagcagaaattcaactcacgaaatgtattgggtgagtaacgcatcggggaatattgtaagcagcgtcaatatgatctctagaatgctcatcaatagatttaccatgaggcataagaaagcaacttatgaaccagacgtagatttaggatctggaacaagaaatattggaatcgaatccgaaacgccaaatttagatataataggaaagcgtattggtaagataaaacaagaacacgaaaccagttggcactacgatcaagaccatccatataaaacgtgggcctatcacggttcttatgaaaccaaacaaacagggtcggcaagtagtatggttgatggagtcgtaagactacttacaaagccgtgggacgtcatacctatggtgactcaaatggcaatgacagataccactccttttgggcaacagagagtctttaaggaaaaggttgacactcgcacacaagagccgaaagagggaacaaagaaattaatgaaaattactgcggagtggttgtggaaagaacttggtaagaaagagacccccagaatgtgtacacgggaagagttcactcgaaaagtaaggtctaacgcggcactaggggcaatatttacggatgagaataaatggaaaagtgctcgagaagccgtcgaggattccgggttttgggaactggtcgataaggaaagaaatctacatttagaaggcaagtgtgaaacttgtgtttataacatgatggggaaaagagagaagaaattgggtgaatttggtaaagcaaaaggttcgcgagcaatatggtacatgtggctaggagccaggttcttagaatttgaagctctaggatttttaaatgaagaccactggttttcaagagaaaacagcctaagtggggttgaaggagagggtctacacaaactcggttacatattacgtgatgtctcgaagaaggaaggaggagcaatgtacgcggatgacactgctggatgggacacccgtataacattagaagatctgaaaaatgaggaaatggtaaccaatcatatggaaggagagcataaaaagctagctgaagcaatatttaaattaacgtaccaaaataaagttgttagagtccaacggccgcctccgcgcggtacggtaatggatatcatatcacgaagagatcaaagagggtcaggacaagtcgtcacttatggtcttaatacatttaccaatatggaagcgcaattaataagacagatggaaggagaaggagttttcaaaaatattcaacatcttactgtaacagaagagatagccgtacaaaattggctagcgagagtcggtagagaaaggctaagtcgaatggcaataagtggtgatgattgcgtagtaaagccactagatgatagatttgctagcgcgctcacagctttaaatgacgtcggaaaaatccgaaaggacatccagcaatgggaaccctccagggggtgggatgattggacgcaagtgccattctgtagccaccacagtcatgaactgattatgaaagatggaagagtattggtcgttccatgcagaaatcaggatgaattaattggcagagcaagaatatcacaaggtgccggatggtcgttaagggagacagcatgtctaggtaaaagttacgcccaaatgtggtcattaatgtactttcatagacgtgatctgcgactagcagcgaacgcgatatgttccgcagtaccatcccattgggtacctaccagccgaacaacatggagcatacacgcaaagcatgaatggatgacaacagaggacatgcttacggtttggaatagagtttggatacaagaaaatccatggatggaggacaaaaccccggtagaaagctgggaagaaatcccctacttaggcaaaagagaaggacaatggtgtggatccctgataggtctgacaagcagagcaacctgggccaagaatatccagacggccattaatcaagttagatctttgataggcaacgaagaatatacagattatatgccgagtatgaaacggttcagaagagaagaagaagaagcaggcgtactctggtga

SEQ ID NO: 22812 - RNA, 9876 nt, synthetic construct
  misc_feature 1..9876: note = derived and/or modified CDS sequence (opt6) from DENV-2__KC964094__SS-prME
  source 1..9876: mol_type = other RNA
agtgcagggatgataataatgttaattccgacagttatggcatttcaccttaccacgcgaaatggagaaccgcacatgatagtttcaatacaagaaaaagggaaaagtctgttatttaaaactgaagatggagtaaacatgtgcacgctaatggcgatggacctaggtgaattatgtgaggacacaataacgtacaaatgtcccctactaagacagaacgaaccggaagatatagattgctggtgcaattctacatcaacctgggtgacgtacggaacttgtaccacaacaggagaacacagaagagaaaaacgtagcgtagcattagtgccacacgtggggatgggactggagacacgtactgaaacttggatgtcttccgagggcgcgtggaaacatgctcagcgaattgaaacctgggtacttagacaccctggatttacaataatggcagccatacttgcatatacaatagggaccacttattttcaacgagttcttatctttatattattgacagcagtggcgccatctatgacgatgagatccataggtatctctaatagagactttgtagagggagtctcaggtggtagttgggtcgatgtagttctcgagcatggaagctgtgttacaacaatggccaaaaacaaacctacacttgattttgagttaacgaaaacagaagcaaaacatcctgcaactttacgtaaatattgtatcgaagcgaaacttactaatactaccactgcaagtagatgtccaacgcaaggcgagccttcgctaaatgaagaacaggataaacgctttgtgtgcaaacactctatggtagatagaggctggggaaatggttgtggattatttggaaaaggcgggatcgtgacatgtgcaatgttcacttgtaagaaaaatatggaaggaaaagtagtacagccggaaaatcttgagtataccattgtaattacacctcacagtggcgaggagaatgcagtaggcaatgatactgggaaacatggtaaagaaatcaaagtaactccacaaagttctgtgacggaagccgaacttacgggctatgggaccgttacaatggagtgttcaccacgaactggactagattttaatgagatggtattgttacaaatgaaaaataaagcgtggttagtccataggcaatggttcttagacctaccattaccatggttaccgggagccgacacacaggggtcaaattggatccaaaaagaaaccctagtaacatttaaaaatccccacgcgaagaaacaggacgtggtagtgttggggtcgcaggaaggagccatgcacacagcattaactggagcaaccgaaatccagatgtcctcaggcaatttattgttcaccggccaccttaaatgtagattgagaacagataaattgcaattaaaaggaatgagttacagtatgtgtacaggaaaatttaaggtggtaaaagaaattgcggaaacacaacacggaactatagtaatacgtgtccaatatgaaggtgacggcagtccttgtaaaataccttttgaaataatggatttagaaaaacgacacgtattgggacgactgattacggttaatccgatcgtgacagaaaaggattctcctgttaatatagaagcagaaccaccttttggagactcatacataataattggtgtagaaccaggccagctcaagttaagctggtttaagaaagaatcctccataggtcagatgtttgaaactacgatgagaggggcaaaacgaatggctatactaggtgacaccgcatgggatttcggctcccttggaggggtattcacgtctatcgggaaagcactacaccaagtctttggtgctatttacggggccgcgttttccggtgtttcatggactatgaaaatcttaataggagttgttataacatggataggaatgaactctcgatcgaccagtttgtcagttagcctagtgttggtaggggtggtcacactatacctaggcgtaatggtacaagccgattcaggatgtgtcgttagttggaagaacaaagaattgaaatgcggttccgggatctttgtgacagacaatgtacatacttggactgaacagtataagtttcagccagaaagcccctctaaacttgcatccgcaatacaaaaagcgcatgaggaaggaatatgcggaatcaggtcggtaacaagattagaaaacttaatgtggaaacagatcacgccagagttaaatcatatactatctgaaaacgaagttaaattaacaataatgactggagatatcaagggaattatgcaagctggtaagcgatctttgagaccccaacctaccgagttaaaatattcctggaaagcgtggggaaaagcaaagatgcttagcactgaattacacaaccatacttttctcattgacgggccagagaccgcagaaagaccaaatacaaacagggcttggaactccttagaagtagaagactatggtttcggcgtattcacaaccaatatttggcttaaactaaaagaaagacaagatgttttctgtgattctaaactaatgtcggcggcaataaaggataacagggcggtccacgccgacatggggtattggatcgagagcgctttaaacgacacgtggaaaattgaaaaagcatcgttcatcgaagttaaatcatgtcattggccaaaatcacacacactatggtcgaatggtgtattagagtcagagatgataatacccaaaaattttgctgggcccgtgagccaacataactaccgacctggatatcatacacaaactgcaggcccctggcacctcggaaggttagaaatggattttgacttttgtgaagggactactgtagtggtaacagaagactgtggaaatagggggccatcactccgcacgactacggcatcaggaaagctgataaccgaatggtgttgtagatcatgtacgctgcctccattacgatacagaggagaagacggatgttggtacgggatggagatacgtccgttgaaggaaaaagaagagaatttagtaaatagcctagtaacagcaggtcatgggcaaattgacaatttttcgctgggcgttttaggcatggcgttgtttctagaagaaatgctacggaccagagtcggtacaaagcatgctatattacttgttgcggtatcttttgtaaccctgatcacaggtaacatgagcttccgagatctaggtagagtcatggtaatggtaggcgcaacgatgaccgatgacataggaatgggagtaacatatcttgccctactcgcagcgtttaaagttaggcccacattcgcagccggtcttttgctaaggaaacttacaagtaaggaactcatgatgactacaattggaatagtactactaagtcaatcaacaatacctgaaacaatattagaattaaccgacgctttagccctcggcatgatggttctcaaaatcgtcagaaatatggaaaaatatcagctagcagtaacaattatggcaattttatgcgttcccaatgcagtgatcttacagaatgcttggaaggtaagttgcactacgctagctgtagtgagtgtctcacccctgcttctcacatcgtcgcaacaaaaagccgattggataccacttgcattgactatcaaaggcctaaatcctacagccatcttcttaaccactctctcacgaacgagtaagaagagaagctggccattaaacgaagcaatcatggcagttggcatggtgagtattctagcctcaagtttattaaagaatgacatacctatgacaggtcctttagtagccggtggtttgctaacagtctgctatgtcttagcagggcggtcagcagatttagagttagagagggccgcagacgttcggtgggaagaacaagcagaaattagtggatcaagcccaattttaagtataacgatatctgaagacggtgggatgtccataaagaatgaggaagaagaacaaacgttgacgatactaataagaactggtctgcttgttatctcaggactctttcctgtaagcataccaataacagctgcagcatggtatctctgggaagtaaagaaacagcgtgctggtgtactgtgggatgtaccatcgccgccgcccgtaggcaaagcagagctagaagacggcgcatatagaataaagcaaaaaggaatcttggggtacagtcaaataggcgctggtgtttataaggaaggtaccttccatacaatgtggcatgtgacaagaggggcagtactaatgcataagggaaagcggatagaaccatcttgggcagatgtcaagaaagacttaatatcctacggagggggctggaaacttgaaggagaatggaaagaaggggaggaaattcaagttctagctctagaaccaggaaagaaccctagagcagtccaaacgaaaccaggtttatttaagacaaacacggggactataggagcagtaagtctagatttctcaccaggaacatccgggagccctattgtagataaaaagggtaaagtagtgggcttatatggaaatggagtggtaacgcgaagtggaacctatgtaagcgctattgcacaaacagagaaaagcatagaagacaaccctgaaatagaagacgacacatttaggaagaaacggttgacgataatggacttgcatccaggggccggaaaaaccaagaggtacctacctgctatagtcagagaagcaatcaagagagggctaagaactctaatattggcgcctacacgagtagtagctgcagaaatggaggaggccctgagaggtttaccaatcagataccaaacccctgcaataagagctgaacatacgggaagagaaatagtagacttaatgtgccacgcaacgtttacaatgcggctattgtcacccattagagttcccaactataacctgattataatggatgaagcacatttcacagatcctgcaagtatcgcagcgcgtggatacatctcaaccagggtggagatgggggaagctgcaggtatatttatgacggcaacgcctcccggatccagagatccgtttccccaatctaacgcacctataatggacgaagaaagagaaatacctgaaagaagctggaacagtggacacgaatgggtaactgattttaagggtaaaactgtgtggtttgttcctagtataaaagcaggaaacgatatagcagcgtgtttgagaaagaatggtcgaaaagtaattcaattatcaaggaaaaccagcgattctgaatatattaaaacaagaacaaatgactgggatttcgtagttacaaccgatattagtgagatgggcgcgaatttcaaagccgaaagggtcatagatcctaggcgatgcatgaaaccggtaatactaactgacggagaggaaagagttatacttgctggtccaatgccagtaacccattcatcggcagctcagaggagaggtagagttggcagaaatccgaagaatgaaaacgatcaatatatttatatgggggaaccgctagaaaatgatgaggattgcgcccattggaaggaagcaaaaatgttactagataacataaatactcctgagggaataattccaagtatgttcgaacctgaaagagaaaaagttgatgccatagatggagagtacaggttaagaggagaagcacgaaagacatttgtcgatttaatgcggaggggagatctacccgtttggcttgcatacagagttgccgccgaaggaatcaattacgcagatcgtagatggtgtttcgatggggttaaaaataaccaaatattggaggagaacgtggaagttgaaatttggactaaagaaggagaacgcaagaaattgaaaccaagatggcttgacgccagaatatattcagacccgttagctttaaaggagttcaaggaatttgcagcaggccgaaaaagtctaaccttaaatctaatcacagaaatgggcagattaccaacttttatgacacaaaaagcccgaaatgcattagataaccttgcagtcctacacacagctgaggcgggagggagagcctataaccatgcattaagtgagttacccgaaaccttggaaaccctacttttgttgacacttctagcaacagtaacgggcggcattttcctattcttaatgtcgggaaaaggtataggaaagatgactttggggatgtgttgtataattacggcctccatattattatggtatgcacaaatacaaccgcattggatcgctgcttcaatcatattagaatttttcttaatagttttattgattcctgaacccgaaaagcaaaggacacctcaagataatcaattaacttatgtagtcatagcaatccttaccgttgtagcagccactatggcaaacgaaatgggtttccttgagaaaaccaagaaagactttggattaggctcaattgccacacaacagccagaaagtaatatacttgatatagatttgcggcctgcgtcagcatggacattatatgccgtagcaacaactttcatcaccccaatgttgagacatagtattgaaaactctagtgtgaatgtatccctcactgcaatagctaaccaagcaacagtacttatgggattaggaaaaggctggcccctctcaaaaatggacattggtgtacctttattagcaatcggatgttatagccaagtaaatccaattacattgaccgcagctttgttactcttagtggcacactacgcaatcattggtccgggcttacaggctaaagcaacgagagaagcacaaaagagggctgccgctggaataatgaaaaatcctacagttgatggtattacagttatagatttagaccctattccctacgacccaaaatttgaaaaacaactagggcaggtaatgctactcgtcctctgcgtaacacaagttctaatgatgagaacgacttgggcattatgtgaagctctaactttagccacagggccaattagcacactttgggaaggtaatcctgggcgattctggaatacgacgatagctgtaagtatggctaacatatttcggggaagttatttagccggagcaggtttacttttcagtattatgaagaacactgcaaatactagacgcggaacgggaaataccggagaaacgctgggagaaaagtggaaaaacagacttaacgcgttgggaaaaagtgaatttcaaatttataagaaatcgggtatacaggaagttgataggacactagccaaagagggcattaagagaggcgagacagatcatcatgcagtcagtcgtggaagtgctaaattacgatggtttgtagaacgaaatttagtgacaccagaggggaaggtagttgatctaggctgtggaagaggcggatggtcctattactgtggaggactgaaaaatgtaaaagaagttaaagggctcacgaaaggaggcccaggccacgaggagcctatacccatgtccacttacggatggaatctagtccgtttacaatcaggagtggatgtgttctttacaccaccagaaaaatgtgacacattactttgcgatataggagaatcatcaccgaacccaactgtagaagcagggcgaacattacgagtactgaatctagtagaaaactggttgaataacaacacgcaattctgtataaaagtattaaatccatacatgcccagcgtaatagagaaaatggaggcattgcaaaggaagtacggtggtgcattggtcggtaaccctttatcacgcaactccacccacgaaatgtattgggcgtctaacgctagtggaaacatagtatcatccgtcaatatgatttcaaggatgctaattaataggttcacaatgagacataagaaagcaacatatgagccagatgtagacctagggtcgggtacaagacacataggaatagagtctgaaacccctaatttagatatcataggaaaacgaattgagaaaataaaacaggagcatgaaacatcgtggcactgcgaccaggatcatccttacaaaacatgggcctatcatggcagctatgaagctaaacagactggaagcgcgtcttccatggtaaacggcgtagtaagactactcacaaaaccctgggatgtgataccaatggtaacccaaatggctatgacggatacaaccccattcgggcaacaaagagtatttaaagagaaagtagatactaggacacaagaaccgaaagaaggaacaaagaaattaatgaaaataactgcagaatggctatggaaagagttaggcaaaaagaaagcacccaggatgtgtacgagagaggaatttacgcgaaaagtgaggtccaatgcggccttgggcgctatgtttacggacgaaaataagtggaaatccgcacgcgaagcagtcgaggactcgggattctgggaattagtggataaagagaggaatctgcatcttgaagggaaatgcgaaacttgcgtttataacatgatggggaaaagggagaagaaactgggtgagtttggcaaggcaaaagggtcaagagctatatggtacatgtggttaggggctagatttttggaatttgaagctctcggattcctcaacgaagaccattggttttcaagagaaaacagcttaagcggagtggaaggtgaggggttacataaactaggttatattttgcgagacgtaagcaaaaaggaaggtggtgctatgtatgctgatgatactgccggttgggacacgcgaatcacacttgaagatttaaagaacgaggaaatggttacaaatcacatggagggagaacataagaaactggccgaggcaatattcaaacttacgtaccaaaataaggtcgtcagggtacaacgacctacaccccgtggtacggttatggatattatttctaggagagaccaacgaggtagtgggcaagtagttacatacggcctaaatactttcacgaatatggaagcgcaacttattagacagatggagggagaaggagtgtttaaaagtatacaacacctgacagtaacagaagaaattgcagtgaagaattggttagtacgggtgggtagagagaggctatcacgaatggcaatctcgggtgatgactgcgtagtaaagccgttggatgatcgattcgcttccgcgcttactgctcttaatgacatgggcaaagtgcgtaaggatatacaacagtgggaaccatcacgaggatggaacgattggacacaagtacccttttgctctcatcattttcatgaattaatcatgaaggacggaagggtcctagtggtaccttgcaggaatcaagatgagctcataggcagggcgagaatatcccaaggtgcaggttggagtttacgagaaacagcgtgtctggggaaaagctatgctcaaatgtggagtctaatgtacttccacagacgagaccttcggctagctgcaaacgcaatttgttcggcggtcccgtctcattgggttccgacctcacgtactacatggagtatacacgccacacacgagtggatgacaacagaagacatgctaactgtttggaaccgcgtttggatacaagaaaacccttggatggaggataaaacacctgtggaatcctgggaagagatcccctacttaggaaaaagagaagatcaatggtgtggttccctaataggattaacttcacgagccacttgggccaaaaatatacagacagcaataaatcaagttcgatccttaataggcaacgaagaatatacagattatatgcctagcatgaaaagatttaggagagaagaagaggaagccggtgtactatggtag

SEQ ID NO: 22813 - RNA, 9876 nt, synthetic construct
  misc_feature 1..9876: note = derived and/or modified CDS sequence (opt6) from DENV-2__KC964093__SS-prME
  source 1..9876: mol_type = other RNA
actgcaggagtaattatcatgatgataccaactgtagtggcatttcacctgacaacccgaaatggcgaaccacacatgattgttagtagacaagaaaaaggtaaatcattattgttcaaaacagaaaatggggttaatatgtgtaccctcatggcgatggacttaggcgaactttgtgaagacacaatcacctacaattgtcctcttctacgtcaaaatgaaccggaagatatcgattgctggtgtaatagtacttcaacatgggtcacatacggaacatgtactgcaactggtgaacaccggcgtgagaaaagatccgttgctttagtcccccatgtcggaatgggactggaaactcgaacagaaacgtggatgagcagcgaaggagcatggaaacatgcgcaaaggatcgaaacttgggtacttagacaccctggattcaccataatggcagcgatcctagcttatacaataggtacgacatactttcagagggtgttaattttcattctgctgacggcagttgcaccaagcatgacaatgcgttgcataggcatatccaaccgcgacttcgtcgaaggggtatcaggaggttcctgggtcgacattgtacttgaacatggatcttgtgtaactacaatggccaaaaataaaccaacacttgatttcgaattgacaaaaacagaagcaaaacatccggcaactttacgcaaatactgtattgaagcaaaactcaccaacacaactacggctagtagatgcccaacccaaggggagccttcattaaacgaagaacaggataaacgattcgtatgtaaacattctatggttgaccgggggtggggaaatggctgcggcttatttgggaaagggggcatagtaacttgtgctatgttcacgtgtaagaaaaatatggaaggaaaagtagtacaaccagagaacttggagtacactatagtaataacacctcacagcggagaggaaaacgtggttggcaatgacactggcaaacatggcaaagaaatcaaagtcacccctcaaagctctattacagaagctgaactaacaggatatggaacagtaacaatggaatgcagtccccgaacaggcttagatttcaatgaaatggtattgttgcaaatggaagataaagcatggttagtccatagacagtggtttctagatctaccgttgccatggcttccaggggccgacacacaaggtagcaattggatacaaaaagaaactcttgtaacattcaaaaatccacatgccaagaaacaagacgttgttgtattaggaagtcaggaaggtgccatgcataccgccttgacaggagctactgaaatacaaatgagtagcggaaatcttctatttacaggtcatcttaaatgtagattaagaatggataaacttcaactgaaaggtatgtcctatagcatgtgtactggtaaatttaaagctgttaaagagattgcagaaacacaacacggtacaatcgtaattagagtacaatacgaaggtgatgggtcaccatgtaaaataccatttgagattatggacctagaaaaacgccacgttctgggccgactaatcactgtgaatcccatagtaacggaaaaagactcaccggtgaacatagaagcagaaccaccgtttggtgattcatatataataataggagtagagcccggacaactgaaattgagttggtttaagaaaggatcttcaataggacagatgtttgaaacaacaatgaggggtgcaaaacgaatggcaatattaggagacaccgcttgggattttggttctctaggaggggtttttacctcaattggaaaagctctgcatcaagtatttggagccatctacggtgcggcattcagtggagtgagctggacgatgaaaattctaatcggtgtcgttattacctggatcggcatgaactctagatccacctcgttatcggtatcccttgtcttagtgggcgtagtcaccctctatctcggtgtgatggtacaggctgattctggctgtgtggtatcatggaaaaataaagaactcaaatgcggctcggggattttcattactgacaacgtacatacgtggaccgagcaatacaaatttcaaccagaaagtccatctaaactggcaagcgctattcagaaagcacatgaagaaggaatctgtggaataagatctgtgacacgtctcgagaacctcatgtggaaacagatcaccccagaactaaatcatatattgagtgaaaacgaggtcaaactgactataatgacaggcgatataaaaggcataatgcaagcgggcaaaagatcattgcgcccgcaacctacggagttgaagtatagctggaaggcatggggaaaagccaaaatgctgagtacggagttacacaaccacactttccttattgatggtcctgaaactgcggagtgtccgaatactaatagagcatggaacagcctagaagttgaagattatgggtttggagtatttaccacaaatatctggctaaaacttaaagaacgacaagacgtattttgtgatagtaaactcatgtcagcagcaataaaagataacagggcagtccatgcagatatgggatattggatagaatcggctcttaacgatacttggaaaatagaaaaggccagctttatagaagtcaagtcgtgtcattggccgaagtcgcatactctctggagtaatggagtgctagaaagtgagatgatcatacccaaaaatttcgcaggaccagtatctcaacacaattacagaccagggtatcatacgcagacagcagggccgtggcaccttggtaaactggaaatggattttgatttctgtgaaggaactaccgtcgtggtaactgaagactgtggaaaccggggacctagcttaaggacaacgacagcctcgggaaaattgattacggaatggtgttgcagatcctgtaccctcccaccactacgctaccgaggcgaagatggatgctggtacgggatggagataagaccactaaaggaaaaagaggagaatctagtaaattcccttgttactgctgggcacgggcaaattgataatttctctttaggtgttctaggaatggcattgtttcttgaagaaatgcttagaacgcgtgttggtactaaacatgcaattctcttagttgcggtatcttttgttaccttgatcactggcaatatgagctcaagagacttgggtagagttatggtaatggtaggagcaaccatgaccgacgatattgggatgggagttacataccttgccttactagcggcattcaaagtaaggccaacatttgctgccgggctattgctcagaaaattaacaagtaaggaactaatgatgaccaccataggtattgtattgctttcccagtcctctataccagaaaccatactcgaactaacagatgctcttgctctcggaatgatggtactaaaaattgtacgaaacatggagaagtatcaattagctgttacaataatggcaatcctgtgtgttccgaatgcagtaatattgcaaaacgcatggaaagtatcgtgcactacgttggcagtagtatcagtatcaccactactcctaacttcctcacaacaaaaggcagattggatacccctagcattgacgataaaaggattaaaccccacagctattttcttgacaacactatccagaacaagtaaaaagagatcatggccattaaacgaagcaataatggcggtaggcatggtaagtatcctagcttcatcgcttcttaaaaacgatataccaatgaccggacccctagttgctggtgggctattaacagtatgctatgtccttgcaggccgatcggctgacctagaactggaacgggcagcagatgtaaggtgggaagaacaggcagagattagtggttcatctccaatattatctataactataagtgaagatggaggaatgtcgatcaaaaatgaagaagaagaacaaaccctcactatacttataagaacaggattattggtaatcagtggactgtttccagtctctataccgataactgctgcagcgtggtacctttgggaggtcaagaaacaacgggcgggagtactttgggatgtgcccagtccgcccccggtaggaaaagcagagcttgaagatggtgcttacaggatcaaacaaaagggaatcttaggatactctcaaatcggagcgggtgtatataaagaaggaacattccatacaatgtggcacgtcactcggggagctgttttaatgcacaaaggcaaaagaatcgaaccatcgtgggctgatgtgaaaaaggatctaataagttatggtggcggatggaaattagaaggcgagtggaaagagggagaagaaatacaagtgttagccttggaaccaggaaagaaccctcgagccgtgcaaacgaaaccaggcctatttaaaacgaatacaggaacaattggggcggttagcttggacttttcgccaggaacaagtggtagtccaatagtcgataagaaaggaaaagtcgtaggattatacggaaacggtgtggtgacgagatcaggaacatatgtaagtgcaatagcgcaaacagagaaatcgatcgaagataatccagaaatagaagatgatatatttagaaagaaacgacttacaatcatggatttgcatccaggagcggggaaaacaaaaaggtatctaccagctattgtgagagaagctataaagaggggtttacggacgctgattctagctccaactagagtcgttgcagcagaaatggaagaagctctaagaggtctcccaatacgttatcaaactcctgccattagagcagaacataccggtagagaaattgttgatctcatgtgtcacgcaaccttcacaatgaggttgctttcaccaattcgcgtcccaaactacaacctaataatcatggacgaagcacattttactgatccggcgtcaatagctgcacgcggctacatttcaacccgtgtggaaatgggagaagcagctggaattttcatgacggcaacccctcctgggagccgagaccctttcccccaatcaaacgcaccaatcatggatgaagaaagagagattcctgaacgaagttggaatagtggccatgaatgggtaacagacttcaaaggtaaaaccgtatggtttgtaccatcaataaaagcaggtaacgatatcgcagcgtgtttaaggaaaaatgggaagaaagtcatacagttaagccgcaagacttttgatagcgagtatgtaaaaactagaacaaacgactgggattttgtcgtgacaactgacatcagtgagatgggagcaaattttaaagcggaacgtgtaatcgacccacggagatgtatgaaacctgtcatccttacagacggcgaggagagagtaatcttagccggtccgatgccggtaactcactcgagcgcagcacaacggcgggggagagtcggacggaacccgaagaacgaaaatgaccaatacatctatatgggagaacctttagaaaatgatgaagactgcgcccactggaaagaagcaaaaatgttattggataatataaatactcccgaaggaattatccctagtatgtttgaacctgaaagagaaagagtagatgcaatagatggtgaatatagacttcgaggtgaagcaaggaagacatttgttgatttaatgagacgaggagatcttcctgtctggttagcataccgtgtggcagctgagggcatcaactacgcagacagacgctggtgctttgacggagtgaagaataatcaaatactcgaagaaaatgtcgaagtcgaaatatggactaaggagggtgaacgaaagaaattgaaaccccggtggcttgatgcaagaatttattcggatccacttgcattaaaagaatttaaagagttcgctgcaggaagaaaatcccttacgctcaatttaattaccgagatgggtagacttcccacattcatgacgcaaaaggccagaaatgcattagacgatttagctgtcctacataccgccgaagcaggaggtcgcgcatataatcacgcactctcggagttaccagagacactagaaacgctattgttactaacactgttggctacagtaacgggcggtatatttttgttcttgatgagcggcaaagggataggaaaaatgactctgggcatgtgttgtatcatcacggcctcagttctactatggtacgcacaaatacaacctcattggatcgccgcatcgataatcctggagttctttctcatagttctattgattcctgagcccgaaaaacaacgcacccctcaggataatcaattaacttatgtagctatagctattttaacggttgtagcagctacaatggccaatgaaatgggatttctagagaaaactaagaaagactttggtcttggatcgatcgcaactcaacaaccagaatcgaatattttagatttggacttgcggccagcatcagcctggacattatatgccgtagcaacaacatttatcacgcccatgttaagacactccatcgaaaatagtagcgtcaatgtaagtctaactgctatagcaaaccaagcgactgtcttaatgggcttaggaaagggatggcctttatctaaaatggacattggcgtgccactcctagcaataggctgttattctcaagtgaacccgatcaccttaacagcagcattactacttttggtggcacattacgcaataataggtccagggctacaagcaaaagctacaagagaagcgcagaaacgcgcagcagccggtataatgaagaaccccacagtcgatggaatcactgtaattgatttagacccgatcccttatgacccaaagtttgaaaaacaattaggccaagtaatgcttctcgtactatgtgtaactcaggtactaatgatgagaactacatgggcactatgtgaggcgcttacattagctacaggtccgataagcaccttatgggaaggtaatccaggacgtttttggaatactacaattgcagtgagtatggcaaacattttcagaggatcatatttagctggagttggactattattttcaataatgaaaaatacggcaaatactaggagaggaaccggaaatacaggtgaaactttaggtgaaaaatggaaaaacaggctaaacgcattaggtaagagcgaatttcaaatatacaagaagtcgggcattcaagaagttgataggacattggctaaagaaggaattaagcgtggagaaaccgatcaccacgcagtatcacgtgggagcgcaaaacttcgctggttcgtagagcgaaatttagtgactcccgagggcaaagtcatggatctcgggtgtggaagaggtgggtggtcttactattgcgggggactaaagaacgtaaaagaagtaaaagggcttactaaagggggtccaggacatgaagaaccaatccctatgtcaacctacggctggaacctagtacgcttgcagtcgggtgttgatgtattctttgcacccccagaaaaatgcgatacgctcttatgcgatataggagaatctagtcctaaccccaccgtggaagcaggcagaaccttgagagtgttaaacttagtggaaaattggttaaataataacacccagttctgtataaaggttctcaacccatacatgccaagcgttatagagaaaatggaagcgctccaaagaaaatatggcggagccctagttcgtaacccactaagtagaaattcaactcatgaaatgtattgggtcagtaacgcgtccggtaatattgtatcttccgttaatatgatatcacggatgcttatcaatcgctttactatgagacacaagaaagctacatatgaacctgacgtagacttgggtagtggaacaaggaatatagggatagaatcagaaattccgaatctagacataattggcaaacgaattgagaagattaagcaggaacacgaaacttcgtggcattatgaccaagaccatccctacaaaacctgggcatatcatggttcatacgaaactaaacaaacaggaagcgcatcgagtatggtcaatggagtagtgcgtctgttaactaaaccctgggatgtgattccgatggtcactcaaatggcaatgacagatacaacaccatttggccagcaaagagtttttaaagagaaagttgatacccgtacccaagaaccaaaagagggaacaaagaagctaatgaaaattactgcggaatggttatggaaagaactgggcaagaagaaaaccccacggatgtgtactagagaagagttcacaaggaaagtccgatcgaatgcagcgttaggcgctatatttacagatgaaaataaatggaaaagcgccagagaagctgtagaagatagcgggttttgggagctagtagataaggaacgaaatttacatctcgaagggaaatgcgagacctgtgtatataatatgatgggtaaacgtgagaagaaattgggagagttcggaaaagcaaaaggatctagggccatatggtatatgtggctaggagctagatttttagaatttgaagctctaggattcctaaatgaagaccattggttctcacgcgaaaattcactaagtggggtggaaggggaaggtttgcataaactagggtatatactacgtgaggtatcaaagaaagaaggcggagccatgtacgccgatgacactgctggatgggatacaaggattacactagaagatctaaagaatgaggagatggtcacaaatcacatggaaggagaacataaaaagttagcggaggcaatattcaaactaacgtatcaaaataaagtcgtcagagtacagagaccgacgccacgagggacggttatggatataataagtcggagagatcaacgaggttctgggcaagtagtaacttatggattaaatactttcactaacatggaagcgcaattaataagacagatggaaggagaaggcgtatttaaatcaatacaacacctcactgtcactgaggaaatcgcggtcaaaaattggcttacaagagtaggacgtgagagactaagcagaatggcgatatcaggcgacgattgcgttgtaaaacctctagatgatcgatttgccagcgcgttgacagcactaaacgatatgggaaaggtgagaaaagatatacagcagtgggaaccctcaaggggatggaatgattggacccaagtcccattttgctcccaccattttcacgaactaatcatgaaagacgggagagtattagtagtaccttgcagaaatcaagatgaactaattggcagggcaagaatatcacaaggtgctggatggagcctccgggaaacagcttgtctaggtaagagttacgcgcaaatgtggagcctcatgtatttccacaggcgagacttaagattagccgcaaacgccatatgctctgcggtcccgtctcactgggtcccaacgagcagaactacatggtcaatacatgctacccacgagtggatgacaacggaagacatgctaacagtttggaaccgtgtatggattcaagaaaacccctggatggaagacaaaacaccagtggaaagctgggaagagataccttatcttgggaaaagggaggatcaatggtgcggaagtctaatcggtcttacttcaagggcaacatgggccaaaaacattcagacggccataaaccaagttaggagcctcatagggaatgaagaatatacagattatatgccatcgatgaaacgatttagacgagaagaaggagaagccggagtgctatggtaa

SEQ ID NO: 22814 - RNA, 9876 nt, synthetic construct
  misc_feature 1..9876: note = derived and/or modified CDS sequence (opt6) from DENV-2__DQ448231__SS-prME
  source 1..9876: mol_type = other RNA
acagcgggtgtaattataatgttaattccaacagcaatggcatttcatttgactacccgtaatggtgaaccgcatatgatcgtttcgagacaagaaaaaggaaaaagtcttttgtttaaaaccgaagatggtgtaaacatgtgcactttaatggcaatggacctaggggaattatgtgaagataccattacctataactgtccactattacgacaaaatgaacctgaagacattgattgttggtgtaattcgacatccacttgggtaacttatggaacatgtacagcaacaggtgaacatcgaagagagaaaagatcggttgcattggttccacacgtaggaatgggtttggaaacgagaacggaaacatggatgtcgagtgaaggagcatggaaacatgctcaacgcattgaaacatggatactaagacatccaggatttactataatggcagccatattggcctataccattggcactacttattttcaaagagtcctaatatttattttgctgacagctgtggccccatccatgacaatgaggtgtataggcatttctaacagggattttgtggagggcgtaagtggaggctcttgggtggacatagtcttggaacacggatcatgcgttacaactatggccaaaaataaaccaacgctagatttcgaattaataaaaaccgaagcgaaacagccagctacactaagaaaatattgcatagaggcaaaattaacgaacactacgacagcatctcgttgtcccacgcaaggagagccctcattaaatgaagaacaagataaacgattcgtatgcaaacactcgatggtggataggggatggggtaatggatgcggtctctttggtaaaggtggaattgtcacatgtgcgatgttcacttgtaagaaaaacatggaaggtaaaatagttcaaccagaaaatcttgaatatactattgtcgtaactccacattcaggagaagagaatacggtagggaatgatacaggaaaacacggtaaagaaattaaagtaacaccacaatcaagcataacagaggctgaacttactggttacggcacggtgacaatggaatgttcgccgcggaccgggttggattttaatgaaatggtgcttttgcaaatggagaataaagcgtggttagtccatcggcaatggttcctcgacctaccattgccatggttacctggggcggatactcagggcagcaactggatacaaaaagagacattagtaacattcaaaaatccccatgcgaagaaacaagatgtagtagttctcggttcccaagagggcgccatgcatactgcacttacaggagcaacagaaattcaaatgtcgagtggaaatcttttattcaccgggcatttaaaatgtagacttaggatggataaacttcaactaaaaggcatgagttattccatgtgtactggaaaattcaaagtcgtaaaagaaattgcagagacccagcacggaaccatcgtagttagagtacaatacgaaggagatggctccccatgcaaaattcctttcgaaattatggacttggagaaacgccatgttttgggacgactaataaccgtaaatccgatagttacagagaaagattcaccagtaaatatcgaggcagaacctcctttcggagacagctacataattataggcgtagaaccagggcaacttaaattaagttggttcaagaaaggttcaagcataggacagatgttcgagactaccatgagaggggcaaaacgtatggctatactaggggatacagcatgggactttggatcactaggtggagtttttacaagtataggaaaagcccttcatcaggtatttggagcgatttatggtgcggcatttagcggtgtaagctggacaatgaagatacttattggggtcgtaatcacatggattggaatgaactctagatctacttctctaagtgtatcacttgtcttagttggggttgtcacactatatcttggtgtaatggtacaagcagatagcggctgtgtagtctcctggaagaataaggagttgaaatgcgggtcaggaatttttatcacagacaatgtacatacgtggaccgagcaatataaatttcaaccagagtcaccctcaaagttagcttcagcaatacaaaaggcacatgaggaaggtatatgtgggatacgctcggtaacaagattagaaaatttaatgtggaaacaaatcacacccgaattaaatcatattctctcagaaaatgaagttaaactgactattatgacaggagatataaagggtatcatgcaagctggaaaaagatcactacgaccccaaccaactgaattaaaatatagctggaaaacgtgggggaaagcaaaaatactgtcgaccgaaccacataaccaaacatttttaattgacggcccggaaacagcagagtgtccaaataccaacagggcatggaactcattagaagtcgaggattatggatttggggtatttacaaccaatatttggctaaaacttaaagaaaggcaagatgtattctgtgattccaaactaatgtctgcagcgattaaagataatagagcagtgcacgcagacatggggtactggatagagagtgccttgaatgatacttggaaaatagagaaggcttcctttatagaagttaaatcttgtcactggccaaaatctcacacattatggagtaacggagtactagaaagtgaaatgataataccgaagaattttgctggaccagttagtcaacacaactatagacctggatatcatacacagactgcgggaccgtggcatctaggaaaattggaaatggattttgacttttgcgaaggtacaacagtggtcgtaactgaagattgtgggaatagagggcccagtttgcgtacgacgaccgcttctggcaaacttatcaccgaatggtgttgtcggagctgtactttgccacccctacgttatagaggcgaagatgggtgctggtatggaatggaaatacgaccacttaaggaaaaagaagaaaatctcgtcaattcactcgtcacagccggtcacgggcaaatagataactttagtcttggagttttgggtatggctctattcttagaagaaatgttaaggacaagagttggtacgaagcatgcagtactcctagtagctgttagttttatgactttaataactggtaatatgtctttcagggatctgggtcgagttatggtcatggttggcgcagcaatgaccgatgatattggaatgggtgtgacatacttggcgcttctagcagcgtttaaagtacggcctacctttgcagctgggctattattacgtaaactcacgtccaaagagttaatgatgactactataggaatcgtattattgtcgcaatcaacgattcctgaaacaattttagaactaacagacgcactagctctgggaatgatgatattaaagatcgtgaggaacatggagaaataccaactagcagtaaccatcatggcaattctatgtgtaccgaacgcagtcatacttcaaaacgcgtggaaagtttcatgtacaattctcgctgtagttagtgtttcgccacttctactgacaagtagtcagcaaaaagcagactggataccgttagcattaactataaaaggattgaatcccaccgctatatttttaacaacattatcaagaactaacaagaagagatcatggcctcttaatgaggcaatcatggcagtaggaatggtctcaattcttgcgagcagcttactgaaaaatgacataccaatgacaggaccattagtggcaggcggattgttaacggtatgctacgtcttaaccggaagatcagccgacctagaactcgaacgagccgccgatgttcgatgggaagatcaagcggaaatatcaggcagttctcctatactgtcaataacaatttcagaagacgggtccatgtcgatcaaaaatgaagaagaggagcaaacgttgaccatactaatacgtaccggtttattagtgataagcgggctattcccagttagtataccaataacagcagcggcatggtacctctgggaagtaaagaaacaaagagccggtgtattatgggacgtaccgtcaccacctcccgttggaaaagctgaactagaggacggggcataccgcatcaaacaaaaaggtatattaggttactcacaaataggagccggtgtttataaggagggaacatttcatactatgtggcatgtaaccaggggagcagtcctcatgcacaagggcaaaaggatagagcctagctgggcagacgttcgaaaggatcttatatcttatgggggaggatggaagttagaaggagagtggaaagagggagaagaggtccaagtactagcgttggaacctggcaagaacccccgcgcagtacaaacaaaaccaggtctatttaagactaacacaggtacgataggtgcagtatcactagatttcagtccgggcacttctggatccccaatcgttgacaagaaaggaaaagtggttggattatatggaaacggagtcgtcacacggtctggcacatatgtatcggcgatagctcaaacagaaaagtctattgaggataatcccgagattgaagatgacatttttagaaagaaacggctaacaataatggatcttcatccgggggcgggaaaaacaaaacgatacctcccggcaatagtaagggaagcaataaaaaggggtttaagaactctaatattagcacccacacgagtcgtcgccgcagaaatggaagaggctttacggggacttcctattcgttatcagacaccagcaataagggcagaacatacagggcgagagatagttgacttaatgtgtcatgctacatttacaatgcgtttactatctcccgtcagggtcccaaattataatctgataataatggatgaagcgcatttcactgatcccgcaagtatagctgcccgtggttatatttcaactcgagtagaaatgggagaagctgctggtatttttatgacggccacgccaccaggatctagagatcccttcccacaaagcaatgctcctatcatggacgaagaacgcgaaattccagaaagatcctggaatagtggacatgagtgggtcacggattttaaagggaaaacagtatggttcgtcccatctattaaagcaggaaatgacatagctgcctgtctaaggaaaaatggtaagaaggtaattcaattatcaagaaaaacgttcgattcggagtatattaagacaaggactaacgactgggattttgtagtaactactgacatatcagagatgggggcaaactttaaagccgaacgagttatagacccaaggcgctgtatgaaacccgtaatactaactgacggagaagaaagggtaatactagcaggaccaatgccagtaacacatagttcagccgcacaacgccgtggaaggatcggaagaaatcccaaaaatgaaaacgaccaatatatatacatgggagaaccacttgagaatgatgaggattgcgcccattggaaagaagctaaaatgcttttagacaacatcaacacgcccgaaggaataataccttcaatgttcgagccagaacgcgaaaaagttgatgcaatcgatggcgagtaccgccttcgtggagaagctagaaaaacattcgtagatctaatgagaagaggtgacctacccgtttggctcgcctacagggttgctgcggaaggtatcaactacgcggatcgacgatggtgcttcgacggcataaagaataatcagattttagaagaaaacgttgaagtagaaatttggacgaaagaaggagagaggaagaaattaaaacccagatggttagatgcgagaatatatagtgacccactagcgcttaaggaatttaaagaatttgcagctggacgaaagtctctcacattaaacttaataaccgagatgggacgccttccaactttcatgacacaaaaagcacgcaatgcccttgataacctcgcagtactacatactgcagaagcaggcggacgcgcgtacaaccatgccttaagtgaattacctgaaacactggaaacgctcttgttactaactttattggcaacagtaacgggaggaatctttttattcctaatgagtggaaaaggtattggaaaaatgactttaggcatgtgttgtattataactgcttcaatattactttggtacgctcaaatacaacctcattggattgcagcgagcataatattagaatttttccttatagtgctcctaatcccagaacctgaaaaacaaagaacgcctcaagataaccaactaacatacgtagtaatagctatactaacagttgtagctgctaccatggcaaatgaaatgggctttctcgagaaaaccaagaaagactttggattgggatctatcgctacgcaacagcccgaatcaaatatattggatatagatctacgtcctgctagtgcctggactttatatgctgtggctactacttttataacaccaatgctaagacacagtattgaaaactcatccgtaaatgtctcgttaacagccatagcgaaccaggctaccgttttgatgggactgggcaagggttggccgttaagtaagatggatataggagttcccctacttgctataggttgttattcacaggtaaatcccataactcttacagctgcattacttttgttagtagcacattatgcaattatcggaccaggacttcaagcgaaggccactagagaagcacagaaaagagctgcagcaggtataatgaaaaatcccaccgttgacggtatcactgtcatcgatctcgaccctataccatacgacccaaaattcgaaaaacaactcggccaagtcatgctattagttttgtgtgttactcaggtactaatgatgaggacaacgtgggctttatgcgaagcattaactctcgctaccggtcctatatctacactatgggaaggtaatcccggacgcttttggaacacaacgattgcggtatctatggccaacatttttaggggaagttacttagcaggggcgggtctactatttagtattatgaaaaacacaacaaacacacgtcgtggtacagggaacacaggtgaaacacttggggaaaaatggaagaatcgactaaatagtcttggtaagagtgaatttcagatatacaaaagaagcggtattcaagaagtagacagaacgttggctaaggaaggtataaaaagaggggaaactgaccatcatgcagtatcacgtggctcagcgaagttacgatggttcgtagagaggaacttggtcacacctgaggggaaggtggtagatttaggttgcggtcgaggcggctggagttactactgcggcgggctcaaaaatgtgagagaagttaaaggactaacgaaaggcggaccgggtcacgaggagcctatacctatgagtacctacggatggaatctagtaagattacaatcaggagttgatgtgttctttaccccacccgagaaatgcgacacactcctatgtgatatcggagaatcaagtcctaacccgacagtggaggcaggcagaacactaagagtgttaaatcttgtcgaaaactggctgaataataacacacaattttgcatcaaggtcctgaatccatatatgccttcggtaatcgagaaaatggaaacacttcaaagaaaatatggtggggcgttagtccggaaccccctttcgagaaatagtacacacgaaatgtactgggttagtaatgctagtggaaacatagtaagttcagttaatatgatatcgaggatgctaattaatcgattcaccatgagacacaaaaaggccacttacgaaccagacgtagacttgggatcaggaacgcgtaatatagggattgaaagcgagacacctaatctagacataataggaaaacggatagagaaaataaaacaagaacacgagactagctggcactacgatcaagatcacccttataagacatgggcatatcatggtagctatgaaacaaaacaaacaggatcggcctcgtccatggtcaacggagtagtaagattattgaccaaaccctgggatgtgataccaatggtaactcaaatggcaatgacggataccaccccattcggacaacaaagggtgtttaaagaaaaggtagatactcggacgcaggaaccaaaggagggaaccaagaaacttatgaagatcacagcagaatggctgtggaaggaattgggaaagaagaaaacaccgcggatgtgcacacgggaagaatttacccgtaaagtacgatcaaatgctgcgctcggggcaatattcacagatgaaaataaatggaaatccgcgcgcgaagcagtagaagacagtagattttgggaacttgtcgacaaagaacgcaacctacatctggagggtaaatgcgaaacttgtgtttataatatgatgggaaagcgggaaaagaaaataggcgagtttggtaaagcgaaaggatctcgtgcaatatggtacatgtggctgggcgcgaggtttttagagttcgaagcactagggtttctaaacgaagatcactggttttcaagagagaacagtctaagtggggtagaaggagaaggactacataaattaggttatatcctaagagaagtatccaagaaagaagggggagctatgtatgcagatgacacggctggatgggacacaaggataacattagaagatctcaaaaatgaagaaatggtgacgaatcatatggagggagagcataagaaactagcagaagcaatttttaaattaacgtaccaaaataaggtggtacgagtccagcgtcctacacctcggggaacagttatggatataatatcacggcgagatcaacggggatcaggacaagttggaacgtatggattaaatacgtttactaacatgggagcacaactaattagacaaatggaaggtgaaggtgttttcaaaggcattcaacatttaactgcaactgaagaagtagcagtacaagattggctcgcgcgtgtcggcagagaaagactctcacgaatggcaatatctggcgacgattgtgtagtcaaaccattagacgaccgctttgctagcgctttaacagccttaaatgatatgggaaaaataagaaaagatatccagcaatgggaacctagccggggatggaacgactggactcaggtaccattctgctcacaccattttcatgaattaattatgaaagatgggagagtgttagttgttccttgtagaaaccaagacgaactgattggtagggctagaatttcccaaggggccggttggagtcttagggaaactgcttgcttgggaaaatcttatgcacagatgtggtcattaatgtattttcaccgtagggatttacgtttggcagccaatgccatctgttccgcagtcccatcacactgggtcccaacgtctaggacaacctggagtatccatgcgcgacatgagtggatgacgaccgaagatatgcttacagtatggaatcgtgtatggattcaagaaaatccgtggatggaagacaagacaccggtcgaatcctgggaagagataccttatcttggtaaacgagaagaccaatggtgtggaagtctaataggattgacttcacgagcaacatgggcaaagaacattcaaacagctatcaatcaggtaaggagcttaatcggttctgaagagtacacggattacatgccatcaatgaaacggtttagaagagaagaagaggaggcgggtgtactgtggtaa

SEQ ID NO: 22815 - RNA, 9876 nt, synthetic construct
  misc_feature 1..9876: note = derived and/or modified CDS sequence (opt6) from DENV-2__JX470186__SS-prME
  source 1..9876: mol_type = other RNA
accgcgggtataataataatgatgatacccacggtaatggcatttcacttaactacgagaaatggtgaaccacacatgatagtttcacgacaagaaaaaggtaaatccttactgttcaaaacggaaaacggggtaaatatgtgtaccttgatggctatggatttgggagagttatgcgaagacaccatcacctataactgtccactcctacgacaaaatgaaccagaagacatagactgttggtgtaattcaacatcgacgtgggttacatacggaacgtgtaccgcaactggcgaacacagaagggagaaaagatcggttgcgctagttcctcatgtaggtatggggttggaaactcgaacagaaacttggatgtcttcagaaggagcatggaaacatgcccagagaatcgaaacatgggtattacgccatccaggatttacgattatggctgccatcttagcctacactataggaacaacatacttccaaagagtgttaatattcatacttttaacagctgtagcaccatccatgacaatgaggtgtatcggtatttcaaaccgagattttgtggaaggggttagtgggggatcatgggtagatatcgtattggaacatggtagttgcgttactactatggccaaaaataaacctactctagactttgagttaattaagacagaagccaagcatcccgcgaccttaagaaagtattgtattgaagcaaaacttacaaacacaactaccgcatcaagatgcccaacacagggagaaccctcactcaacgaagaacaagataagagattcgtctgtaaacactcaatggttgacagaggctggggaaacggctgtggactttttggaaagggtggaatagttacttgcgcaatgtttacctgtaaaaagaatatggaaggtaaaattgttcaaccagaaaatttagaatacactatagtaatcacgcctcacagcggagaagaaaatgcagtcggaaacgacacgggcaaacacggcaaagaaataaaagttaccccacaatcatctatcactgaagcagaactaacagggtacggcactgtaaccatggaatgtagtccaaggactggattagattttaacgaaatggttttactacaaatggaaaataaggcctggttagcacatcgccaatggtttctagacctaccactaccttggctacccggagccgatactcagggttcaaattggatacaaaaggaaaccttagttacattcaaaaatccacacgccaagaaacaagatgtcgttgtacttggaagccaagagggggcaatgcacaccgcattaacaggtgccaccgaaattcaaatgagctcagggaatttactatttacgggacacttaaagtgtaggcttaggatggataaacttcaattgaaaggtatgtcttattccatgtgcactggtaaattcaaggtagtaaaagagatagctgaaacccaacacggtaccattgttataagagtgcaatatgaaggagacggatcaccttgtaagataccttttgaaataatggacttagagaaacgccacgtgttaggaagactaattactgtaaatcccatagttacagagaaggatagtcctgtcaatatagaagcagagccaccattcggggatagttatattatcattggggtagaaccaggtcagctaaaattaagttggtttaagaaaggcagttctataggccaaatgttcgaaacaaccatgagaggggcaaaacgtatggctatactcggtgacaccgcatgggattttggctcgttaggaggcgtgttcactagcatcggaaaggcattacaccaggtgttcggagcaatatatggagctgccttctccggtgtttcctggacaatgaaaatcctaattggagtcgttataacttggatcggaatgaactccaggagcacgagtctatcagtttcactcgttttagtaggagtagttactctatatctgggtgtaatggtacaagcagattcgggatgtgttgtgtcatggaaaaataaggagttaaaatgcggaagtggtatttttataaccgacaatgtacacacatggaccgagcaatacaaatttcagcctgaatcgccctcgaaactggcatcagcgatacagaaagctcacgaggaaggtatctgtgggatccggtctgtgacaagattagaaaatttgatgtggaaacaaataacaccggaacttaatcacatcttgtctgaaaatgaagttaaacttacaatcatgaccggagacataaaaggtatcatgcaggcaggaaaacgttcactaagaccgcaacctacggaactaaagtatagttggaaagcatgggggaaagcgaaaatgttatctactgaattgcacaatcatacgttcttgattgatggccctgagactgccgaatgtcccaataccaacagggcttggaatagcctagaagttgaagattatggatttggagttttcacaacgaacatttggttaaagatgaaagaaagacaagatgtgttttgtgactccaagttgatgtctgccgctataaaagactcacgagctgtgcacgctgatatgggttactggatagagagtgccctgaatgatacttggaaaatcgaaaaggcatccttcatagaagtaaagagttgtcattggcccaaaagtcatacattatggtcaaatggcgtgctagaatctgaaatgattatcccgaagaattttgctggacctgtaagccaacataactatagaccaggctatcacacacaaacagcaggcccttggcacttaggacgcttagaaatggatttcgacttttgtgaaggaacgacggtcgttgtgacggaagattgtggtaaccgtggacccagtctgagaacaaccactgcgagtggaaagctaatcacagaatggtgctgtagatcatgtaccttaccacccttaaggtacagaggcgaagacgggtgctggtatggcatggagattagaccacttaaggaaaaagaagaaaatttagtaaatagtttagtaactgcaggacatgggcagatcgataatttttcactgggcgttttaggaatggcactctttcttgaagagatgctacgcaccagagtaggaacaaaacatgctattctgcttgtagcagtttcattcgttacactcattacggggaatatgagctttcgagacttgggtagggttatggtaatggttggtgccacaatgacagatgatataggtatgggagtaacatacctcgcactactcgcagcatttaaagtccgtcccacatttgctgcagggttattgctgagaaaattaacatcgaaggagcttatgatgactaccataggcatagttttattatcacaagctacaattccagagaccatattagaactgaccgatgcattggcgctaggaatgatggtactcaagattgtacgcaacatggaaaaatatcaactagcagttactattatggcaattttatgtgtgccaaatgccgtcatactgcaaaatgcttggaaagttagctgtacaacactggccgtagtaagcgtgtccccactactacttacaagtagtcagcaaaaagcagattggatacctttagcgttaacaattaaaggacttaaccccactgccatattcctcactacactatcacgtactaacaagaaaagatcatggccgttaaatgaagcaattatggcagttggaatggtctctatacttgcgtcgtcattgttaaagaatgatataccaatgacaggaccattagtagccggcggactccttacagtatgttacgtacttacgggcagaagcgcagaccttgaattagaaagggccgcagatgtacgctgggaggagcaagctgaaataagtgggtcgtctccaatactttctataactatatcagaagacggaagtatgagtatcaaaaatgaagaggaggagcaaaccttgacaatactaataaggacaggactcctagtggtatcaggactatttcctgtaagcactcctataacagcagcagcatggtatctatgggaggtcaagaaacagcgggccggagtactgtgggatgtcccctcgccccctccggtcggaaaagcggaactggaggatggggcatatcgcataaaacaaaaaggcattctcggatattcacaaatcggcgccggtgtatataaagaaggcacctttcacactatgtggcatgtaacaagaggtgcggtgctaatgcataaaggcaaaaggatcgaaccatcatgggctgatgtaaagaaagacttaattagttatgggggaggatggaaattggaaggagaatggaaggagggtgaagaagtccaggttctagcacttgagccggggaaaaatccacgagcggtccaaactaaaccgggcttattcaaaacaaacaccggaacaatcggtgcggtatcattagatttctcacccggcacttcaggatcaccaattgtagataaaaagggcaaagttgtcggactatacgggaatggagtagtcacaagatctggaacttacgtttccgcaattgcacaaacggaaaaatctatagaggataatcctgaaattgaagacgacatcttcaggaagaaacgtttaaccatcatggacttgcatccgggtgctggtaaaacaaagcgctatcttcctgcaatagtacgagaggcgatcaaaaggggcttgagaactttaattttagccccaactcgcgtggttgctgctgaaatggaggaagcacttcgtggattacctattagatatcaaactccagctattagggcggaacacactgggagggaaatagtagaccttatgtgccacgcaacattcacaatgagacttttatcacccataagggtgccaaactataacttaattataatggatgaggctcattttactgatccagcatctattgccgcccgaggatacataagcactagagtagagatgggtgaggcagctggcatatttatgacagccacgcccccgggatcaagggatccgttccctcaaagcaatgctcccattatggacgaggaaagggaaatcccggagagatcatggaactctggccatgaatgggtcaccgattttaagggcaaaacagtatggttcgtaccttctattaaagctggaaatgacatagctgcttgtctaaggaaaaatggtaagaaagtaatacaactaagccgaaagacatttgatagcgaatatataaaaactcgaacaaacgattgggattttgtcgtaaccacagatataagcgagatgggtgctaatttcaaagcagaacgtgtaatagatccaagacgatgcatgaaaccggtaatattgacagacggtgaagaaagagttatcttagcaggcccaatgcccgtaacccacagtagcgcagcgcagcgacgaggccgcgtgggaagaaaccctaaaaatgagaatgaccagtacatttacatgggagaacctctagaaaatgacgaagattgcgctcattggaaagaagcgaaaatgttgttggacaacattaatactccagaaggcataatcccgagcatgttcgaaccggaacgagaaaaagtagacgctattgacggagagtatcgactacgcggcgaagcgagaaaaaccttcgttgaccttatgaggcgtggagatttacccgtgtggttagcttatagagtagcagcagagggaataaattacgctgaccgaagatggtgctttgatggtgtcaaaaacaatcaaatccttgaagaaaatgtcgaagtcgagatatggacaaaagagggtgaaagaaagaaactcaaaccacgatggttagacgcaagaatttacagtgaccccctggcgcttaaagaatttaaagagtttgctgccggaagaaagagcttaacattaaatctaattaccgagatgggtcgattaccaacattcatgactcaaaaggcccgcaacgccctagataatctagcggtactacacacagcagaagcaggagggagagcgtacaatcatgcattaagtgaactgcctgaaacattagaaactttattattactcactctattggccacagtaacgggcggaatatttcttttcctaatgtcaggaaaaggaataggtaaaatgacactgggtatgtgctgtatcataaccgcctctattctgctatggtacgcccaaatccaaccacattggatcgcagcatcaataatattggagttctttctaattgttttactgatacctgaacccgaaaagcagaggacaccccaagataatcaactcacttatgtagtaatagccattttaacagtagtcgcagcaacaatggccaatgaaatgggctttttagagaaaactaaaaaggacttcggattaggtagtataactacacaacagcctgaaaataacattctcgatatagatcttagaccggcttccgcatggaccctttatgcggtagcaacaacattcattacaccaatgttgagacatagcatcgaaaatagttccgtcaatgtcagcttgaccgcaattgctaaccaagccacagtcttaatgggtttaggcaagggatggccactcagcaaaatggatataggtgtccccttgctggcaatcgggtgttattcacaggtgaacccaattactctaacggctgccttattactattagttgcgcactacgcgattattggtccaggtttacaagcaaaagcaacaagagaagcacagaaaagagctgcagctggcataatgaaaaacccgacagtagacgggattactgtgatagacctagatccgattccatacgatccgaagtttgaaaaacaactaggccaagttatgttattagtcttgtgtgttacgcaagtactaatgatgagaacaacttgggctctttgtgaagcactcactctagcaactggaccaattagtactttatgggaaggcaatccaggtcgattctggaacaccacgattgcagtctctatggctaatatttttagaggttcatacttagcgggtgccggcctgctgttcagcataatgaaaaacactgccaacacccgaagaggaacaggtaatacaggagaaactttaggcgagaaatggaaaaacagacttaacgctctaggcaaatccgaatttcaaatttacaaaaagtcaggtatacaagaggtggacagaacattagcaaaagaaggaatcaaaagaggtgaaacagaccatcacgcagtatcacgaggcagtgctaaacttcgctggtttgtagaaagaaacttagtaacacccgaaggtaaagtagtggacctcggctgcggcagaggaggctggagttactattgcggtgggttgaaaaacgtcaaggaagtaaaaggacttacaaagggtgggcccggtcatgaagaacccattcctatgtccacgtatggctggaacctcgtcaggcttcagtcgggcgtagacgtatttttcacccctccggaaaaatgtgatacactcctttgcgatatcggtgaatcctcacctaacccaacggtcgaagcgggtaggacattacgcgtactcaatcttgttgaaaattggcttaataacaatacacaattctgtattaaagtcctaaatccttacatgccatctgtaatcgagaaaatggaagcgcttcagaggaaatacggcggcgcactcgtgcgtaacccgctatcgcgaaactcaacacatgaaatgtattgggtaagcaatgcatccggcaatatagtctcttctgtgaacatgatcagtcgaatgctcataaaccgtttcaccatgcgacataagaaagcaacatatgaacctgatgttgatttaggaagtggaacccgaaacatcggaatagaatcggagactcccaatctcgacataatcggaaaaagaatagagaagattaaacaagaacatgaaacaagttggcattatgatcaggatcatccatataaaacatgggcatatcacggaagttatgagacgaaacagaccggatcagccagtagtatggtcaacggggttgtcagactactgacgaagccctgggatgtgatcccaatggtcacgcaaatggctatgaccgacactactcctttcggacaacaaagagtttttaaagaaaaggtcgacactcgtacgcaggaacccaaagaaggaactaagaaactcatgaaaattaccgctgaatggctatggaaagagttagggaaaaagaaaacaccaagaatgtgcaccagagaggaatttacacgcaaagtaaggagcaatgccgccttaggggcgatatttactgatgaaaacaaatggaaaagcgcaagagaagctgtggaggacagtgggttttgggaattagttgataaagaaagaaatctacatctagaaggaaaatgtgaaacatgcgtctataatatgatggggaagagggagaagaaactaggagagtttggaaaagcaaaaggatcaagggccatttggtatatgtggttaggagcacgatttttagagtttgaagcgctgggattcctcaacgaggatcattggttcagtcgggaaaactctttgtctggagttgaaggagagggattacataaattagggtatatactaagagatgtaagtaaaaaggaaggcggcgcaatgtatgcagatgatacagctggatgggacacccgaattactctggaagatctgaaaaatgaggagatggtcacgaatcacatggagggcgaacataagaaactagcagaagcaatctttaaactaacttaccaaaacaaagtcgtaagagtacaacggccaacgcccagaggcacagtcatggatatcatatcacgcagagatcaacgcggctctggtcaggttgttacttacgggcttaacacctttacaaatatggaggcacaacttatacgtcaaatggaaggtgaaggtgtctttaagagcatacaacaactaacagtcactgaagagatagcagtcaaaaactggctagtacgagtaggacgtgaacgcctaagccgaatggcaatttcaggggatgattgtgtagttaaaccccttgacgataggtttgcatctgctctcactgcattaaatgacatgggaaaagtgagaaaagatatacaacagtgggaaccaagtaggggatggaacgattggacacaggtcccattttgttcccatcactttcacgaactaattatgaaggacggacgagtattagtggtaccatgtaggaaccaagatgagcttataggtcgtgcaaggatcagccaaggcgccgggtggtctttaagagagacagcctgtttaggcaagtcatatgcccagatgtggagcttaatgtattttcaccgacgtgatcttcgtctggctgctaatgcgatctgttcagcagtaccctcacattgggttccgacgtccaggaccacttggtcaatacatgcaactcacgagtggatgactacagaggatatgctaactgtatggaaccgagtatggatacaagagaatccatggatggaagataaaacacccgtagaatcatgggaagaaataccatacctaggtaagagggaagaccagtggtgcggcagtttaattggacttacgagtcgtgcaacgtgggctaaaaacatacagactgcaatcaaccaggtcagatcgctaataggaaatgaagagtatactgattacatgcccagcatgaaacgtttcaggcgagaagaagaagaggccggagtcttatggtga

SEQ ID NO: 22816 - RNA, 9876 nt, synthetic construct
  misc_feature 1..9876: note = derived and/or modified CDS sequence (opt6) from DENV-2__KU517846__SS-prME
  source 1..9876: mol_type = other RNA
acggcaggtattataattatgatgattcccacagtgatggcatttcatttaactacgcgcaatggagaaccccacatgattgtgagtagacaagaaaaaggtaaaagtttattatttaaaactgaaaacggagtaaatatgtgtacactaatggcaatggatttgggcgaactttgtgaggacacgataacatataactgcccgcttttgagacagaatgaacctgaagatatagattgttggtgtaatagtaccagtacatgggtaacctatggaacatgtaccgctaccggtgagcatcgtagggagaaacgaagtgtagctctagttccgcatgtaggaatgggtttagagacacgtacggaaacgtggatgtcatccgaaggagcgtggaaacacgcacaacgtatcgagacttgggttctacggcatcccggatttaccataatggcagcaatactagcgtacactattggcacgacatattttcaaagagtattgatattcatccttttaacagcggtagcaccttcaatgacaatgaggtgtattggcatcagtaatcgtgacttcgtggagggagtatctggcggtagctgggtagacatcgtactagagcatggaagctgtgtaacgacaatggctaaaaacaaaccaaccttggatttcgagttgataaaaactgaagcaaaacatccagccacattacgaaaatattgtatagaagcgaaactgacaaatacaactaccgcatcaagatgccctacacaaggcgaaccgagtctaaatgaagaacaagataaaagatttgtatgtaaacacagtatggttgatagaggatggggtaatggttgcggactgtttggtaaaggtggtatcgtgacatgtgcaatgttcacgtgtaagaaaaacatggagggtaaaatagtgcaaccagaaaatctagagtatacaatagtaataaccccacattctggagaagagaatgcagttggcaatgatacaggtaaacatgggaaagaaataaaagtaaccccgcagtccagcataacggaagcggaattaaccggttacggaactgtaacgatggaatgctcgccccggactggcttagattttaatgaaatggtccttttacagatggaaaacaaagcctggttagtccatagacaatggttcttagacctgccactaccttggttacctggagccgatactcagggttccaactggatacaaaaagagactctcgtaacattcaaaaacccccatgccaagaaacaagacgttgtagtgcttggatcacaagagggcgcgatgcacaccgcattaacgggtgcgacagaaatacaaatgtcgtcaggaaatttattatttacaggccatttaaaatgtagacttagaatggacaaattacagctaaaaggaatgtcctactcgatgtgcacaggaaaatttaaagtcgttaaagaaattgccgaaactcaacatggaacaattgtgataagagtccaatatgaaggggatggttcaccgtgcaaaatacctttcgagatcatggatctagagaaaagacatgtgcttggtagacttattacagttaatcctattgtcacagagaaagatagtccggttaacatagaagctgaaccaccctttggggatagttatattataatcggagttgaaccaggccaactcaaactcagttggttcaagaaaggatcatcgattggccagatgttcgaaaccaccatgcgaggtgctaaaaggatggctatacttggggacacagcgtgggatttcggctcattaggaggagtatttacctcaatcggcaaagcactacaccaagtattcggtgcaatatatggcgctgccttttctggtgtttcttggacaatgaaaatcctaataggcgtagtaataacttggattggtatgaatagccgcagtacctccctatcagtaagcctagtattggttggcatagtcaccttatatcttggagtcatggtacaagcggacagcggatgtgtcgttagctggaaaaacaaagaactcaaatgtgggagtggaatattcataacagacaacgtccacacatggacggaacagtacaaatttcaaccagaaagcccgagtaaacttgctagtgcaatccaaaaagcgcacgaagagggaatctgtggtattagatcagttacgcggctcgaaaatctgatgtggaaacaaattacacctgagttaaaccacatattatctgagaatgaagtaaaattaaccataatgacaggagatataaaaggaatcatgcaggctggaaaaaggtcccttcgaccacaacccacggagttgaaatattcgtggaaagcgtggggcaaagccaaaatgctgagcacagaattgcataatcacactttccttatagacggcccagaaacagccgaatgtccaaacacaaatcgagcctggaacagtctagaagttgaggactatggattcggagtctttactacgaacatctggctaaaactgaaagaacggcaagacgtattctgcgatagtaaactgatgtcagcggccatcaaagataatcgtgccgtacacgctgatatgggttattggatcgaaagtgcattaaatgacacttggaagatcgagaaagcaagtttcatagaagtcaaatcttgccactggccaaagtcgcatacattatggtccaatggcgtgttggaatccgaaatgattatccctaaaaacttcgcaggccctgtcagtcaacataattataggccaggttatcatacacaaactgcagggccttggcatttgggcagattggaaatggattttgatttttgtgaaggaacaacggtggtagttacagaagactgcggaaatcggggaccaagtttaagaaccaccacggcaagcggaaagttaatcacggaatggtgctgtagaagttgtacattaccaccgttgcggtatcgtggagaagacggttgctggtacgggatggaaattcgaccactcaaagagaaagaagaaaatctagtaaattccctggtaaccgccggccacggccaaatagataattttagcttaggtgttttagggatggctctatttctggaagaaatgcttaggacccgcgtcggaaccaagcacgccatcctcctagttgcagtatcgtttatgacactaataacaggaaacatgtctttccgcgatttaggaagagtaatggtgatggtcggagcaactatgacagacgacattggtatgggagttacttacttggcacttctagcggcttttaaagtcagaccaacgtttgcggcaggtcttcttcttaggaaattgacaagtaaagagctaatgatgacaactataggcatcgttttactttcacagtcaactataccagaaactatacttgaattaactgatgctctagcattagggatgatggttctcaaaatagtaagaaacatggagaaataccagttagctgtaaccattatggctatactatgtgtaccaaacgcagtgatattgcagaatgcctggaaggtctcgtgtaccatcctcgcagttgttagtgtttcaccactcttattaacctcatctcaacaaaaagcggactggataccactggcgttgaccataaagggacttaatcctactgctatatttctaaccaccttaagtagaaccagtaagaaaagatcatggccattaaacgaagctataatggcagtaggaatggtttcaatattggcttcgagcttgttgaaaaatgacatacctatgacaggtccgctagtcgctggtggtcttttgacagtgtgctatgttttgaccggaagaagtgcagacttagaacttgaacgagcagcggatgtaagatgggaggagcaggcagaaatttccggaagcagcccaatcctctccataactattagcgaagacgggtctatgagcatcaaaaatgaggaagaggagcttacattaactatcctaattcgaaccgggctcttggttatttcaggattattccccgtgagcataccgataacggctgcggcttggtatctctgggaagtgaaaaagcaaagagctggggtattatgggacgtgccatccccacccccagtaggaaaagcagaactagaagacggagcttatcgaataaaacaaaaaggcattctaggctattctcagattggagcaggcgtatataaagaggggacatttcacacgatgtggcacgttactaggggagccgtgttgatgcacaaaggcaaaagaatcgagccatcatgggcagatgtgaagaaagatctcatatcgtatggaggcggatggaaactagaaggagagtggaaagaaggagaagaagttcaagttttagccctggaaccaggtaaaaacccacgagcggtacaaacaaaaccaggtttattcaaaactaataccggaacaataggcgccgtgtccctagatttctctccgggaacgtcaggttctccaatcgtagataagaaagggaaggtggtcggattatatggaaacggagttgttacaaggtcaggcacgtatgtttcagctatagcgcagacagaaaagtccatagaagataatccagagatagaagacgatatctttagaaagaaacgtctgaccataatggacttgcacccaggagctggcaaaacaaaacgttatctaccggctatagttagggaagcaataaaacgtggattacgtactctcatactagcccccacgcgcgtagttgcagcagagatggaagaagcattaagaggactacccataaggtatcagacgccagctataagagcagagcacacgggacgcgaaattgtggatctcatgtgtcatgccacgttcacaatgcgattgctaagcccaataagggtccccaattacaatttaattataatggatgaggcacacttcactgatcctgcatcaatcgcggctcgtggatacatttcaacaagagtagaaatgggcgaggccgcaggtatttttatgaccgcaacaccgccggggtcgagagatccgtttccacaaagcaatgcgccgataatggatgaagaacgagaaatacctgagagatcatggaatagtggtcacgagtgggttactgacttcaaaggtaaaacggtatggtttgtgccgagtataaaggcaggaaatgatatagccgcttgcctaaggaaaaatggcaagaaagtgatacaattatcaagaaaaacttttgattcagaatacattaaaacacgcactaatgattgggatttcgttgtaaccacggacattagtgaaatgggcgcaaattttaaggcagagagagtcattgatccaagaaggtgcatgaaacctgtaatacttactgatggagaagaacgtgtcatactcgctggaccaatgccagttacacattcatctgcggctcaacggaggggtagagttggcagaaatccgaagaatgaaaatgaccaatacatatatatgggtgagcctttggagaatgatgaagactgtgcacattggaaagaagcaaaaatgctattagataatataaacacacctgagggtattatacccagcatgttcgaaccagagcgagaaaaggttgacgctatcgacggtgagtatcgactaagaggtgaggcaaggaagacatttgtggatttaatgagaagaggtgatctacctgtatggctcgcgtatcgcgtagcagcagaaggaataaattatgcagatagacgttggtgttttgatggagtcaaaaataatcaaattcttgaagagaatgtagaggtagaaatatggactaaagagggagaacgaaagaaactaaaaccacgatggctcgacgcccgaatatactcagacccattagcactcaaagaatttaaagaatttgcggctggtcggaaaagtcttacattaaatttaataactgaaatgggtagattaccaacctttatgacacaaaaagcacgaaacgctctggataacctggctgtactacacaccgcagaagcgggaggtcgcgcatataaccatgcgcttagtgaattgcctgaaacactcgaaactttactactcctcactctcttagcgacggttacaggaggtatatttttatttttaatgtccgggaaaggaattggtaaaatgacgctaggcatgtgctgtataataacagcctcaattttactatggtatgcccagatccagccacactggatcgccgcgagcataatattagaatttttcttaatagtactactaatacccgaaccggaaaagcaacgtaccccgcaagataatcaattgacatacgtagtaatcgcaatcttgacggttgttgctgcaactatggccaacgagatggggtttcttgagaaaaccaagaaagactttggcctaggatcaataacaacacaacagcctgagtcaaatatacttgacatcgatttgcgacctgccagcgcttggacactttacgccgtagccacaacttttataacccctatgctgagacattcaatagaaaattcgagcgttaatgtttccttaacagcgatagcaaatcaagcaaccgtattaatgggtttagggaaaggctggccattatcgaaaatggacataggagtgcctcttctggctatcggctgttactcacaagtaaatcctataacattaacagccgcattgttattattggtagcacactatgctataattggaccagggctacaggcaaaagcaacacgtgaagcacaaaagcgagcagcggcgggaataatgaaaaacccgacggtagatgggataactgttatcgatttggatccaataccatatgatccgaaattcgaaaaacaattgggacaggtaatgctattggttttatgtgtgacgcaagtacttatgatgcgaacaacatgggcgttatgcgaggcattaacattagcaacaggcccaatatccactttatgggaaggtaacccaggacgattttggaatacaaccatcgcggtcagcatggcaaatattttccggggtagttatcttgctggtgctggactcctgtttagtataatgaaaaataccgctaatacgagaagaggtactggaaataccggtgagacacttggtgaaaaatggaaaaatcggttaaacgccttgggaaagagtgagtttcaaatttacaaaaagtcaggaatccaggaagttgaccgaactctggccaaagaaggaataaaaaggggtgagacggaccatcacgctgtatctcgaggaagcgcaaagctaaggtggttcgtagaacgtaatctggtcacacccgagggtaaggtagtagacctgggttgtggcaggggaggatggtcatactactgtggtggtttgaagaacgtgaaagaagtcaaaggtctaactaaaggcggtcccgggcacgaagaacctattccgatgtccacatatggttggaatttagtgagattgcaatcaggagtggatgtgttctttacacctccagaaaaatgtgacactttgttatgcgatataggcgagtctagtccaaatcctactgttgaggctggccgaaccctaagagtattaaacctagtcgaaaactggttaaataacaatacccaattctgcataaaagtcttgtctccctatatgccatcggtaatagagaaaatggaagccttacaacgtaaatacggtggagctctggttcgaaacccactatctagaaacagcacccatgaaatgtattgggtcagtaatgctagtggaaatatcgtgtcaagtgtaaacatgatatcaagaatgcttataaatcgatttacgatgagacataagaaagctacatacgaaccagatgttgacttaggtagtggtacgcgaaatattgggattgaatccgaaacaccaaatttggacattattggcaaacgtattgaaaagataaaacaggagcatgaaacgagttggcactatgatcaggaccatccatataaaacatgggcgtatcacggaagctacgaaacaaagcaaacaggtagtgcatcaagcatggtgaacggcgtagtaaggcttttaacgaagccgtgggatgttatcccgatggtgacgcagatggcgatgacagatactacaccatttgggcaacagcgagtctttaaagaaaaagttgatacccgaactcaagaaccaaaagaaggaaccaagaaacttatgaaaataaccgcagaatggctatggaaagaattaggcaagaagaaaacgcctagaatgtgcacgagagaagagtttacgcgcaaagtaagaagcaatgccgcgctaggggcgatctttacagatgaaaataagtggaaaagtgcacgagaagcggtagaagattcaggcttttgggaattagtagacaaagagaggaaccttcatcttgaaggtaaatgcgaaacctgtgtttacaacatgatggggaagagagagaagaaattaggagaatttgggaaagctaagggaagtcgggcaatttggtacatgtggctaggggcaagatttcttgaatttgaagcgctcggatttttgaatgaagatcattggttcagcagggaaaacagcctatctggtgtagagggagaaggattacataaacttggatatatactccgagatgttagtaagaaagagggaggtgcaatgtatgctgatgatacagcaggttgggacacaagaattaccttggaagatctcaaaaacgaagaaatggttacaaatcatatggagggggaacataaaaagttggcagaagctatattcagactgacgtatcaaaacaaggttgtacgagtacaaagaccaacaccacgaggcacagttatggatatcatctcacgacgtgaccagcgcggaagcggacaagtcgtaacctatggattaaatacgtttaccaatatggaagcgcaactaatcaggcagatggaaggagaaggagtttttaaaagcatacaacatttgacagtaaccgaagaaatagcagtcaaaaactggctagaaagagtcggcagggagcgacttagtagaatggcaatctcgggtgatgactgcgtagtaaaacccttggacgatcgcttcgctagcgcacttaccgccctaaatgacatgggaaaaattagaaaagatatacaacaatgggagccttcacgaggttggaatgactggacgcaagtcccattttgctcccatcattttcacgaattgatcatgaaggacggtagagtcctcgtagttccatgtcgaaaccaagatgaactaataggtcgagcccggataagtcaaggagctggatggagtctcagagaaacagcgtgcttaggaaaaagttatgcacaaatgtggtcgttaatgtatttccacagaagagacctcaggctggcggcaaatgctatatgttcagctgtcccttcccactgggtcccgacgtcgcggacaacctggtctatccacgcgactcatgaatggatgacgactgaggacatgcttacggtatggaatagagtatggattcaggaaaatccgtggatggaggacaagactccagtggaaagttgggaagaaataccatatttaggcaaacgcgaagaccagtggtgcggctctttgattggacttacctcaagggcaacttgggccaagaatattcaaaccgctataaatcaggttagaagcctaattggaaacgaagaatatacggattacatgccaagtatgaaaagattcagaagagaagaagaagaagcgggagtattatggtaa

SEQ ID NO: 22817 - RNA, 9876 nt, synthetic construct
  misc_feature 1..9876: note = derived and/or modified CDS sequence (opt6) from DENV-2__KJ830750__SS-prME
  source 1..9876: mol_type = other RNA
acggcaggggtaataataatgttgataccgacagctatggcttttcacctaacaacacggaacggtgaaccccacatgatagtaagtaagcaagagaagggaaagagccttttattcaagaccgaagacggagtaaacatgtgcaccttaatggcaatggacctaggagaactatgtgaagatacaataacatataactgtcctttactccgacagaacgaaccagaagacatagattgctggtgtaactcaacatcaacctgggtaacgtacggtacgtgtacagcgaccggtgaacaccgaagagaaaaacgatcggtagctctcgttccgcatgtaggaatgggattggagacaagaacagaaacatggatgtcaagtgagggggcatggaaacacgcgcaaagaatagaaacctggattctaaggcatcccggattcacaataatggctgcaatactcgcatatactatcggtacaacgtactttcaaagagttctaatatttatattattaactgcagttgcaccaagcatgactatgcgttgtatagggatctcaaacagggattttgtcgaaggagttagtgggggatcttgggttgacattgtcttagaacatggttcttgtgttaccacgatggcaaaaaacaaacccacgctggattttgaacttattaagacagaagctaagcaaccagctacattaagaaaatattgtatagaagccaaactaactaacacgactacggcatcacgatgtccaacacaaggggaaccttcgttaaatgaggagcaagataagcggtttgtatgcaaacatagcatggtggatcggggatggggtaacgggtgcggcctattcggtaaaggagggatcgttacatgtgctatgtttacatgtaaaaaaaatatggaaggcaaaattgtacaacccgagaatttagaatataccatcgtagtgacccctcactccggggaagaaaacgcagtgggcaacgacaccggcaaacacggaaaggaaataaaagtaacacctcaatctagtattactgaagcagaacttacgggatatggaaccgttacaatggaatgtagcccacgaacgggactagactttaatgaaatggtactactacaaatggaaaataaagcttggttagtccatcgacagtggtttctagatctacccctaccgtggctaccgggagcggatatacaaggttcaaactggatacaaaaagaaactttagtaacattcaaaaatcctcatgcaaaaaagcaagacgtcgtagttttgggaagtcaagaaggggcaatgcataccgcactaacaggagcaacagaaatacaaatgagttcaggaaatctattatttacaggacatttaaagtgtaggctcagaatggacaaactacaattaaaaggcatgtcctattctatgtgtacaggaaagtttaaggttgtcaaagagattgcagagacacagcacggtacgatcgtggttagagtccaatacgaaggcgacggatccccttgtaaaataccatttgagattatggacttagagaaaagacacgttcttggccgtctaataaccgtaaatccaatagtcacaggaaaagactctccggtaaatattgaagccgaaccgccattcggcgatagctacatcataataggggttgaacccggacaactaaaactatcatggttcaaaaaagggagttcgattggccagatgtttgaaactactatgaggggtgctaaaaggatggcaatactaggggatacagcttgggattttgggtcccttgggggtgtgtttacatccatcggtaaagctcttcaccaagtattcggagctatatacggagcagcatttagcggagtatcctggaccatgaaaattctaatcggagtagtaataacttggataggaatgaacagcaggagtacttcattatcagtgtcgctcgtactagttggggtagttacattatacctgggggttatggtccaagccgatagcggttgcgtagtgagttggaaaaacaaagagttaaaatgtggatcaggaattttcatcacggataacgtacacacatggacagaacaatataaattccagcctgaaagtccaagcaaacttgccagtgcgattcaaaaagcccatgaggagggcatatgtggaattaggtcagttactagacttgaaaatctaatgtggaaacaaataacccccgaactaaatcacatcctatcagaaaatgaagtaaagttatcaattatgaccggagacataaaaggtataatgcaggcaggaaaaagatccctaagaccacagccgaccgagttaaagtactcatggaaaacatggggcaaagcaaaaatgcttagtacagaacctcataaccaaacgttcttaattgatggaccagaaactgccgagtgccccaataccaatcgagcatggaattccttagaggttgaagactacggtttcggagtgtttactacaaatatctggctaaaactcaaggaacgccaggacgtctcttgcgacagtaaactcatgagcgcagcgattaaagataatcgggcggttcacgccgatatgggatattggatagaatctgcccttaatgatacttggaaaatagagaaagcatcatttatagaagtgaagtcttgccattggccgaaatcccacacattgtggagtaacggagtcctagaaagtgaaatgataataccaaaaaattttgctggtcccgtaagccaacataactacagacccggctatcacacgcaaaccgccgggccatggcacctaggtaaactcgaaatggattttgatttctgcgagggaacgacggtcgtagtgacggaagattgcggcaataggggtcccagtcttcgcaccacaacggccagcggtaagctaatcacggaatggtgttgtagaagctgtaccctaccccctttgagatatagaggtgaggatggatgctggtatggaatggaaataagaccgctaaaagaaaaggaagaaaaccttgtaaacagtttagtaacggcagggcatggccaaatagacaacttttccctaggggtgttaggaatggcgcttttccttgaggaaatgttaaggacaagagttggtaccaagcatgcagttctacttgtagcagtctcattcatgactcttataacgggaaatatgtcatttcgggatttagggagggtaatggtaatggtaggagctgccatgacagatgacatcggcatgggggtaacttatttggcattactcgctgcttttaaagttcggccaacttttgcggccgggctacttctacgaaagttaacgtcaaaggaacttatgatgaccactatcggcatagtgttactttcacagtcaacgacgcccgaatccattctcgaattaactgacgcattggctcttggaatgatgatcctaaaaatagtaagaaatatggaaaaatatcaactggcggtaactataatggcaatcttgtgtgtacctaatgcagttattctgcagaacgcgtggaaagtgtcttgcacaattttagcagcagtcagcgtgtcacctttgttactgacctcaagccaacagaaagctgattggattccattagcattaacgataaagggcctaaacccaacagctatattcttgacaacattaagtcggacgaataaaaaaaggagttggccgttgaatgaagccataatggcagtcggaatggtatccatcttagcatcttcactacttaagaacgacatacccatgacgggacccttagtagccggcggcttactaacggtttgttatgtgcttacaggacgatctgctgatctagagttagaaaaagcagctgacgtccgatgggaagaccaagcagagatctcgggttcaagccccattctctctataaccatatctgaagatggtagcatgtctattaaaaacgaagaagaagaacaaacgctcactatcctaattagaaccggattattagtaataagcggtttgttcccagtaagtatcccaataacagcggctgcctggtatctgtgggaagtcaaaaaacaacgggccggagtattatgggatgttcctagccctccacctgtcggaaaagcagaattagaggatggcgcgtacagaatcaagcaaaaaggaatattagggtatagtcaaataggagctggagtatataaagaaggaacattccataccatgtggcacgtgacgagaggggcggtattgatgcacaagggtaagagaatcgaaccttcgtgggcggatgttcgaaaggacttaatttcttatggcgggggttggaaactagaaggagaatggaaagagggtgaagaagtgcaggtgctcgctttggaacctggcaagaaccctagagctgtacaaactaaaccaggactctttaagaccaacaccggaacaataggagctgttagcttagactttagtcccggaacatcaggcagtccaatagttgataaaaagggtaaagtggtagggctatatgggaacggcgtggttacaaggagtgggacgtatgtatccgcaattgctcaaacagaaaaatcaatagaggataatccggaaatcgaagatgatatcttcagaaaaaaaagactaacgatcatggacttgcatcccggagcaggcaaaaccaaaagatacctacccgcaatcgtacgtgaggcaattaagaggggtctgagaacactcattttggcaccaacccgtgtagtcgcagccgaaatggaagaggcactaagaggattaccaatacggtaccaaacgccagctataagagcagaacatactggtagggaaatagttgacttaatgtgccatgcaacattcaccatgaggcttctttctcctgttcgtgtccctaactataatctgattattatggatgaagctcattttactgaccctgcatctatagctgcacgaggatatattagcactagagtagaaatgggagaggcggcaggaatcttcatgaccgccaccccacctggatccagagatccatttccgcaatcgaatgcaccgatcatggacgaggagcgagaaattcccgaaagatcctggaacagcggacacgagtgggtaacagattttaaagggaagactgtatggtttgtaccgtctataaaagccggaaatgatatcgctgcatgtctacgaaaaaatggaaagaaagtgattcagctatcaagaaaaactttcgatagcgaatatataaaaaccagaaccaatgattgggattttgtagtgacaacagatatatccgagatgggcgcaaattttaaagctgaacgagtcattgatccccgtcgatgtatgaaaccagtaatattgaccgatggagaagaacgagtcatcttagcaggaccaatgccagttacgcatagttcggcagcacaaaggaggggtcgaatcggacggaatccaaaaaacgaaaatgaccaatacatatatatgggggaaccacttgagaatgatgaagactgtgctcactggaaagaagcgaaaatgctgttagacaacataaatactccagaaggtataataccaagtatgttcgaaccggaaagagaaaaagttgacgcaatagacggagaatatagacttagaggtgaggccaggaagacattcgttgatctcatgaggcgaggagatttaccagtgtggctcgcatatcgagtcgccgcagaaggcatcaactatgcagatagaaggtggtgctttgatggtatcaagaataaccaaatactagaagaaaacgtcgaagttgaaatatggactaaagagggagaacgcaaaaagttgaaacccagatggctagacgcaagaatttactccgacccattagcgttgaaggaatttaaagagtttgcagccggtcgaaaaagtcttacattaaacctaattactgagatgggtcgattgcctacgttcatgacacaaaaagccagaaatgccttggataatctagcagtcttacatacagcggaggcaggcggacgggcctataaccacgcactaagtgaattacctgaaactctggagacactactacttttgacattacttgcaactgtgacgggaggaatttttctatttctaatgtcaggaaaaggtattggtaaaatgacgttgggtatgtgttgtattattacggcatcaatccttttatggtatgcgcaaattcaaccacactggatagcggcatccatcatattagaattttttcttatagtattattgatacctgagcccgaaaaacaacgtacgccacaagacaatcaattaacatatgtagtgatcgcaatattgaccgttgttgcagcaacaatggctaacgaaatgggattccttgaaaagaccaaaaaagatttcggactcgggagtatagcaatacaacaacctgagagtaatatattagacatagatctacgaccagcctccgcgtggactctatatgcagttgccacaacctttataacaccaatgctaagacattcgatagaaaattcctccgtaaatgttagtttaactgcaatagctaatcaagcaaccgttttaatgggcctaggcaaagggtggccactgtcaaagatggacataggggtacctctattagcaataggttgctacagccaagtcaatccaataaccttgacggcggcattgttattgctagtagcccactatgcaattattggacctggattacaagctaaagcaactcgagaggcacaaaaacgagcggcagcggggattatgaaaaatccgaccgttgacggcgtaacggtaatagatctagatcctatcccctacgatcccaaattcgaaaagcaactcggtcaagttatgttactggtactctgtgtaacacaagtattaatgatgaggaccacatgggctctatgtgaagctttgactctggctacaggaccgattagcactttgtgggaaggaaatcccggaaggttctggaacacaacgatagctgtaagcatggccaacatcttcaggggatcttatctggctggtgcaggacttttattctcgataatgaaaaacactactaacacaagacggggtacaggaaacactggagagacacttggtgaaaaatggaagaatagactaaattccctcggtaaatcagaattccagatctataagaggtccggtattcaggaagtcgatcgaactctggcaaaggagggtatcaaacggggcgaaactgatcaccacgcagtcagtagaggaagtgcaaaactacgatggttcgttgaacgtaatctcgtcacaccagaaggaaaagttgtagacctaggatgtggcaggggagggtggtcttactactgcggaggcctcaaaaacgtaagagaagtgaaaggcctaacaaaaggtggaccaggtcacgaagaacctattcccatgagcacatatggctggaatctagttcggctacaaagtggtgtagatgttttttttactccacccgaaaaatgtgatacgttactttgtgacattggcgaatcatctccaaatcccacggtcgaagcaggccggacattgagggttttaaatctagtagaaaattggttaaataacaacacacagttttgcataaaggtccttaatccatacatgccttcagtaatagaaaaaatggaaacgttacaacgtaaatacggaggtgcattagtacggaatccgctaagccgaaatagtacacacgaaatgtattgggttagcaatgcatctggaaacatcgttagctctgtgaatatgatatcacggatgttaataaatcgatttactatgcggcacaagaaggctacatatgaacctgacgtggacctgggatcaggcacgagaaacattgggatcgaatcagagactccgaatctcgatattatcggtaaacggatcgagaagataaaacaagaacacgagactagttggcattacgaccaagatcacccatacaaaacatgggcataccatggatcgtacgaaacgaaacagacaggctcagcgagttccatggttaatggggtcgtcagactattaaccaaaccatgggatgttataccgatggtcacccaaatggcgatgacagatacaaccccatttggacaacaaagagtcttcaaggagaaagtagataccagaacacaagaacccaaagaaggtacaaaaaaactaatgaagatcactgcagagtggttatggaaagaattaggaaagaaaaaaactcccagaatgtgcacgagagaagaatttgcacgcaaagtgagaagtaacgcagcccttggcgccattttcacagacgaaaacaagtggaagagtgctagagaagctgtagaagactcacgattctgggaactggtcgataaggagagaaatttacatctcgaaggaaaatgcgaaacgtgtgtctataacatgatggggaaacgggaaaaaaaaataggagaattcgggaaagcaaagggttcacgtgcaatttggtacatgtggcttggtgcaagattcttagagttcgaagcattaggttttttaaacgaagaccattggttttctagggaaaacagtttaagcggggttgaaggagagggactacacaagttagggtatattctaagagaagtctcaaaaaaagaaggcggagcaatgtatgctgatgatacagcagggtgggatacacgtataacattggaagacctgaaaaacgaggagatggttacaaatcacatggagggagaacacaaaaaactagcggaagcaattttcaaactcacatatcaaaacaaagtggttagggtccagagaccgacaccaagagggaccgttatggatataataagcagacgcgaccagcgaggttcaggacaggtaggcacatacggattgaatacattcacaaatatgggtgctcaactcataaggcagatggaaggagaaggggtgtttaaaggaatacagcatctaacggcaactgaggaagtagccgtacaagattggctagcacgagtaggacgcgaaaggttatctaggatggcaatctctggagacgactgtgttgtaaagcctctagatgatcgatttgcatcggcactgactgcgcttaatgatatgggtaaagtaaggaaggatatacaacaatgggagccaagtcgggggtggaatgactggacacaagtcccgttctgctcacatcattttcatgaattaataatgaaagatggaagagtgctagtcgttccatgcagaaatcaagatgaactaatcgggcgggcgagaattagtcaaggcgcaggatggtcattgcgtgaaacagcttgcttgggcaaaagttatgcacaaatgtggtcactcatgtatttccaccggagagatttaaggcttgctgcaaatgcaatatgtagcgcagtaccttcgcattgggtcccaactagtagaactacatggtcgatacacgcagggcatgaatggatgaccactgaagatatgctaacagtgtggaatagggtgtggattcaggaaaatccatggatggaagacaaaacccccgttgaatcgtgggaggagataccgtacctagggaaacgcgaagatcaatggtgtggttcgttaatcggcttgacaagcagagctacatgggcacggaatattcaaactgcaataaaccaggtgagaagtctcattggctctgaagaatatactgactatatgccctcgatgaagaggttccgaagagaggaggaagaagcaggagtgttatggtga

SEQ ID NO: 22818 - RNA, 9876 nt, synthetic construct
  misc_feature 1..9876: note = derived and/or modified CDS sequence (opt6) from DENV-2__FM210231__SS-prME
  source 1..9876: mol_type = other RNA
agtgctgggatgattattatgcttattcctacagtaatggcttttcatttgactacacgtaatggagaaccccacatgatagttggaatacaagaaaaaggcaaatcacttctgtttaaaactgaagatggcgtaaacatgtgtactcttatggcaatggacctaggcgaattatgtgaagacactataacatacaaatgtcccctgctacgacaaaacgaacctgaagacattgactgttggtgcaattcaacgtctacatgggtgacctacggaacctgcacaaccactggggaacatcgaagagaaaaacgtagtgtagccttagtaccccacgtaggaatgggcttggaaacaagaactgaaacgtggatgtcttccgaaggagcatggaaacatgcacaacgaatagaaacctggatattaagacatccagggtttaccataatggctgcaatattggcgtatactataggaacaacgcattttcaacgcgtgttaatattcattctattaactgccgtagccccgtctatgacaatgaggtgcataggaatttcaaatcgagattttgtagaaggtgtatcaggcggctcatgggtagacatagttctagaacatggcagttgtgttaccacaatggccaaaaataaaccaactcttgactttgaattaattaaaaccgaagcaaaacaacccgccactttaagaaaatattgcattgaagcaaaactaacaaacacaacaacagagtctcgatgccctacacaaggtgaaccttctttaaaagaagaacaggacaaacggtttgtatgtaaacacagtatggtagatagaggatggggaaacggatgcggactttttggaaaaggtgggatagtaacatgcgccatgttcacatgcaagaaaaatatggaaggaaaaatcgtgcagcctgaaaacttagagtacacaatagtcgtaacaccacattcgggtgaagaacacgcggtcggaaatgacaccggaaaacatggtaaagaaatcaaagtcactccccaaagttctataactgaagccgaattaaccgggtacggtacagtaactatggaatgtagtccacgcaccggcctggactttaacgaaatggtcctattacagatggaaaataaagcgtggctagtccatagacaatggttcttagacttgccgttaccgtggctgcccggcgccgacaaacaagagtcaaactggattcagaaagaaaccttagtaacttttaaaaatccccatgccaagaaacaagatgtagtagtattaggatcacaagaaggggcgatgcatactgcattgacaggggctacagaaatacaaatgagctccggtaatttattattcacagggcatctgaaatgtagactacgaatggacaaattgcaattaaaggggatgtcttattctatgtgtacaggcaaatttaaagtagttaaagaaattgcggaaactcaacatgggactatagtaattagggtgcaatatgaaggtgacggatctccttgtaaaatcccatttgagataatggaccttgagaaaagatacgtgttaggtagactaataaccgtgaatcctattgtcacggaaaaagattctccagtgaacattgaagcggaacctccattcggagattcatacataattatcggagttgagcccggacaactcaaattaaactggttcaagaaaggaagttctattggtcagatgtttgaaaccacaatgcggggagccaaacgaatggccatactgggtgatacagcttgggattttggttctcttggtggagtctttacgtccatcggtaaggcattacatcaggtctttggtgctatatatggggccgcattttcgggcgtatcgtggactatgaagatacttataggagtaattataacatggataggaatgaactccagaagcacatctctgagtgtatctttggtattggttgggatagtcacattatacttaggcgttatggtacaagcggattcaggttgtgtagtatcgtggaagaataaggaactaaaatgcggttcagggatcttcataacagacaacgtgcacacatggacggaacagtataaatttcaaccggaaagtccaagtaagttggcatcggccatacaaaaagcccaagaagaggggatatgcggaataagatcagttactagattagaaaatcttatgtggaagcaaattacgccggaattaaatcatatactggccgaaaatgaggttaaattaactataatgaccggagatataaagggaatcatgcaggcaggcaagcgcagtctgcgaccacaacccactgaattaaaatatagctggaaaacatggggtaaggcgaaaatgttatctacggaaagttataatcaaactttcctaattgacggccctgaaaccgcggagtgtccaaacacaaatagagcatggaactcgttggaagtcgaggattatggctttggagttttcacaaccaatatttggttaaaacttaaagaaaaacaagatgccttctgcgatagcaaattaatgtctgcagcgataaaagataatagagcagttcatgcggacatgggttattggatcgaaagcgcccttaatgatacatggaaaatagaaaaggcttcattcatagaagtcaaaaattgtcactggccgaaatctcacacgctctggtcaaacggagtccttgagtctgaaatgattataccaaagaacttggccggacctgtaagtcaacacaattatcgcccaggttaccacacccaaatcgcaggaccatggcaccttggcaaactagaaatggattttgatttttgcgacggaactacggtaattgttacggaagactgcggaaatcgcggaccgtccttacgcacgactactgcttccggaaagttaataacagaatggtgctgtagatcatgtacactcccaccgctaagatatcgtggagaagacggatgctggtacggaatggaaatccggcctttgaaggaaaaggaagaaaatcttgtaaactcattggtaactgccgggcacgggcaagttgataacttcagtctgggtgtgctcggaatggccttattcctagaggaaatgctaagaacgagggtaggaacaaaacatgccatacttttagttgctgtatcttttgtaactttgataaccggcaacatgagctttaaggaccttggccgtgtggtcgtaatggttggggcgactatggcggacgacattggaatgggggtaacctatctagcattacttgccgctttcaaagtacgccccacattcgccgcaggattactactcagaaaactaacatccaaggaattaatgatgacgacaatagggattgtactattatcacaatcaactattccagaaaccgttttagaactgacagacgcattagcgctagggatgatggtcctgaaaattgtccgcaatatggaaaagtaccaattagcagtgacaattatggcaattctctgtgttccgaatgcagttgtacttcaaaatgcatggaaggtatcgtgcacaatactagcggtagtaagtgtctctccacttctactgaccagtagtcaacagaaaacagattggattccgttagcacttacaattaaaggactgaaccctaccgcaatcttcttgacaaccctatcgagaacaaacaagaaaagatcgtggccgctgaatgaagcaataatggcagtggggatggtgtctattttagcctccagtctattaaagaatgacatacccatgacaggacctctagtagctggtggattgttaacagtgtgttatgttcttacgggacgcagcgcagatttagagttggaaagagctacagatgtcaaatgggaagaccaggccgaaatttccggatcatctccaattttatcgataaccatatcagaagatgggagcatgtccatcaaaaatgaggaagaggaacagaccttgacaattttaatccgaacagggctattagtaatctctgggctattccctatatctataccgattactgcagcagcatggtacctatgggaggtaaagaaacagagggctggtgtactgtgggatgtaccttcaccgcctcctatgggaaaagcagaacttgaagacggagcttaccgtattaaacagaaaggtatactagggtactctcaaataggggcaggcgtctataaagaagggacttttcatactatgtggcatgtgacaagaggggcagtcctaatgcataaaggaaaacgaatcgaaccgtcttgggcagatgttaagaaggatctcataagctacggtggtggatggaaactagaaggagaatggaaagaaggagaagaagtccaagtcctagctttagaacctgggaaaaaccctcgcgcagtgcaaacaaaacccggcttgttcaaaacaaacacaggcactataggggctgtatcactagattttagtccaggaacaagcggttctcccataatcgataaaaagggtaaggtcgtgggcctatacggcaacggagtcgtcacccgtagcggagcttacgtttctgcaatagcccaaacggaaaagtctattgaagataatccagaaatcgaagatgacatctttcgaaagagaagattgacaataatggacttacaccctggtgctggaaaaaccaaaaggtacttacccgctatcgttagggaggcaataaaacgaggcctcagaacattaatcttagcaccgaccagagtcgtagctgctgagatggaggaagcactaagaggtcttccaattcgttatcagactcccgcaataaaagctgaacacactggcagagagatagtggatctgatgtgccacgcaactttcaccatgcgcttactttctcccgtacgagtacccaactacaatctcataattatggacgaagcccatttcacggatccggctagtatagccgctagaggatacatatctacgcgcgtagaaatgggagaggcggctggaattttcatgactgcaacaccaccggggagtagggacccatttccccagtctaacgcccctattattgatgaggagagagaaattcctgaacgatcctggaactcggggcacgaatgggtaacagactttaaaggaaaaacagtttggtttgttccaagcattaaagccggaaatgacatagctgcatgcctacggaagaatggcaaaaaggtgatacaactctcaagaaaaacatttgatagtgaatacgtaaaaacgcgcacaaatgattgggatttcgtagttacaacagatatctccgaaatgggcgctaattttaaagctgagagagtgatagatccacgaagatgtatgaaacccgtaattctaaccgatggagaagagagggtaattttggcgggacctatgccggtaacccactcttcggccgctcagcgtagaggtcgaatcggacgtaatccgaaaaatgagaacgaccaatatatctacatgggagaaccactagagaacgatgaagattgtgcacactggaaagaggctaaaatgttattggacaacatcaacaccccagaaggaataattccatcaatgtttgaacctgaaagggaaaaagtcgacgccattgatggagaatataggttgagaggagaggctaggaagacatttgtagatttaatgagacgaggcgatttaccagtttggcttgcatacaaggtcgctgcagaaggaattaattatgccgaccgacgatggtgttttgatggaattaaaaataatcaaattctagaagaaaatgtggaggtagagatatggaccaaagaaggagaacgtaaaaagctcaagcctcgttggcttgacgcccgcatatattccgacccattggctttaaaggaatttaaagagttcgcagcaggcagaaagagccttacacttaacctgattactgaaatgggaagactgccaacctttatgacacagaaaactagagatgcactcgacaatttagccgttttgcatacagcagaggctggagggcgggcctacaatcacgcactgagcgagttaccggaaacactagaaacactacttcttcttacgttattagcaactgtcacgggcgggatatttctttttctaatgtctggaaggggaataggcaaaatgacacttgggatgtgctgcatcataacggcatctatattattgtggtacgcacaaatacaaccacattggattgcggcgtcaataattttggaatttttcctaatcgttctgttaataccagaaccagaaaagcaaagaacaccacaagataaccaattaacatatgttgtgatagcaatattaactgtagtagctgcgacaatggctaatgaaatgggcttcttagagaaaaccaagaaagatcttgggctcggaagtatagtaacccaacaaccagagtcaaacatactcgacatagatctaaggcccgcttccgcatggaccttatatgctgtagctactacttttgttacacctatgctcaggcattccatcgaaaattctagtgtaaacgtcagtcttacagctatagctaaccaagccacagtccttatgggactaggcaagggatggcctctttctaagatggacataggagtcccgctattggcaataggttgctatagtcaagttaacccaatcacactaactgcagcgctattattacttgtggcccattacgcgataatcggtcccgggcttcaagctaaagcaacccgagaagcacaaaaacgagcggcagccggaataatgaaaaatcccaccgtagatgggattaccgttattgatctggatccgattccgtacgaccctaaatttgaaaaacaactgggccaagttatgcttttgatactatgtgtgacgcaagtattaatgatgcgaacaacttgggctctatgtgaagctctaaccctggctactggccccatatcaacactatgggaaggaaaccctgggcgtttctggaacaccaccatcgcggtatcaatggcaaacatattcaggggtagctatctagcaggagccggtctactatttagcattatgaaaaacactacgaatacacggagaggtacaggtaatataggagaaactttaggagaaaaatggaagagtaggttaaacgcattaggaaagtcagagttccaaatatataagaaatcaggaatacaagaagtagatagaacattagccaaagaaggcatcaagaggggcgaaacggatcaccacgcggtttcgcgtggctctgcaaaattgagatggttcgttgaaaggaatatggtaacgcctgaaggaaaggttgtcgatctaggatgtggccgaggtggctggtcctactactgtggagggttaaaatccgtccgagaagtaaaagggctaacgaaaggtggtccaggacacgaagaacccataccgatgtctacatacggttggaatctggtgagactacagagcggtgtagacgttttctttataccacccgaaaagtgtgatacgctgttatgtgacataggagagtcgtcccctaatccgacggttgaggcaggaaggactctccgggtccttaatctagtcgagaattggcttaataacaacactcagttttgtataaaagtacttaacccatacatgccttccgtaatagagaaaatggaggctttgcagagaaaatacggaggtgctctagtcaggaaccctttaagtagaaattccactcatgagatgtactgggtgagcaacgcatcgggaaatattgttagtagcgtgaatatgatttcacgtatgcttattaataggttcacaatgagacacaagaaagcgacatacgaaccagacgtagatctcgggagtgggactcggaatattggtattgaaagcgagatacccaatctcgacataataggtaaaagaatagagaaaattaaacaagaacatgaaacctcatggcactatgaccaagaccatccatataaaacttgggcataccatggatcttatgaaacaaaacaaactggctccgcatcttcaatggtcaacggtgttgttaggttattaactaaaccttgggatgtattgcctactgtcacacaaatggccatgacagacaccacacctttcggtcaacaaagagtttttaaagaaaaagttgatacacgaacccaagaacccaaggaaggtacaaagaaactaatgaagataacagctgaatggctctggaaagaactcggcaagaagaaaacccctcgcatgtgtactagagaagaatttacacgtaaagtaaggtctaacgcagctcttggcgccatatttaccgatgaaaacaagtggaagtctgcaagggaagcagtggaagattcgcgtttttgggaattagttgataaagaaagaaacttacacctagaggggaagtgcgaaacgtgtgtttacaatatgatgggcaaacgggagaagaaactgggggagttcggaaaagcaaaaggatccagagcaatttggtatatgtggctaggcgccagatttctagagttcgaagctcttggcttcctaaatgaagaccattggttcagccgcgaaaatagtctatctggagtagaaggcgaaggtcttcataaacttgggtacattctaagggatgtaagcaagaaagaagggggcgccatgtatgctgatgacacggctggttgggatacccgtattacactggaggacctcaaaaatgaagaaatggtaacaaaccatatggagggtgagcataagaaattagcagaagccatattcaaactcacataccaaaacaaggttgtcagagtgcaacgtccaacacctagaggaacagtcatggatataatctcaagacgtgaccaacgtggctcgggtcaagtcggaacttacggccttaacacatttacaaacatggaagcgcagcttataagacaaatggaaggtgaaggggtttttaagaacatacaacatctaaccgtcacagaggaagtagcagttcaaaactggctcgcaagagttggtagagaaagacttagtcgaatggcgatttcaggagacgattgcgtagtaaaaccgttagacgatagatttgctaacgcactcactgcactaaatgatatgggaaaaatccgtaaggatatacagcaatgggaaccatctaaaggttggaacgactggacacaagtgcccttttgttcgcatcactttcacgaactaataatgaaggacggcagagtacttgttgtgccatgccgtaaccaggatgaattaataggcagagctcgtatttctcaaggggcaggatggtcactcagagaaacggcatgtctaggtaaaagttatgcacaaatgtggtcgctaatgtatttccatagaagagatttaagactagccgcaaatgcaatatgctctgctgtaccaagtcattgggtccctacaagcagaacaacatggagcatacatgcgaaacacgaatggatgactacggaagacatgctaacggtttggaatcgggtctggataagagaaaatccatggatggaagacaaaaccccagtggaatcatgggaagaaataccatatctgggaaaaagagaagaccaatggtgtggtagccttataggattaacatctcgggcaacttgggctaagaatatacaagcagcaataaatcaggtgagatcattaataggcaacgaagaatataccgactacatgccaagcatgaaacgattcagacgtgaagaagaggaagctggagtattgtggtaa

SEQ ID NO: 22819 - RNA, 9876 nt, synthetic construct
  misc_feature 1..9876: note = derived and/or modified CDS sequence (opt6) from DENV-2__FM210239__SS-prME
  source 1..9876: mol_type = other RNA
actgctggtgtaatcatcatgttaatacctaccgcgatggcatttcatctgactactagaaatggggaaccgcatatgattgtggggagacaggaaaaaggtaaatctctactctttaaaactgaagacggtgtaaacatgtgtacactcatggcaatagatttaggagaactctgcgaagatacgattacatataaatgtccactattgagacagaatgaacccgaagatatagactgctggtgcaactcaaccagtacttgggttacgtatgggacgtgtaccactactggagaacatagaagagaaaaacgtagtgtagccctagtaccacatgtgggaatgggattagaaacgcgcacggaaacgtggatgtctagtgaaggggcttggaaacatgcacagagaatcgaaacgtggatccttagacatccaggtttcacgattatggcagcgattctagcatatactgtcggtacgactcactttcagagagccttaatctttatactgctggccgcagtggctccatctatgacaatgcgatgtatcggaataagtaatagggacttcgtagaaggcgtaagtggcggttcttgggtggatatagtccttgaacacggaagctgcgtgacaacaatggccaaaaataaaccgactctagacttcgaattaataaaaaccgaagcaaaacagcctgctaccttaagaaaatattgcatagaagccaaacttacgaataccacgacggaatccagatgccctactcaaggagaaccttctctaaatgaagaacaagataaacggtttgtctgtaaacactcaatggttgacagagggtgggggaacggatgtgggctatttggtaaaggtggcatagtaacttgtgctatgtttacttgcaagaaaaatatggaaggcaaaatagtacaacctgaaaatctggaatacacaatagtcataactccgcatagtggtgaagaacatgctgtaggcaacgatactggtaaacatgggaaagaaataaaaattacgccacaaagcccaatcactgaagcagaattgacaggttatggaacagttacaatggaatgctcgccccgaacagggctagattttaatgaaatggtactactacaaatggaagataaagcatggcttgtgcatcgacaatggtttctggacttaccactaccctggctaccaggagcagacacacagggaagtaattggatacaaaaagaaacattggtaacattcaaaaatcctcatgccaagaaacaagacgttgtagtcttgggatcgcaagaaggggccatgcatacagctttaactggagcaactgaaattcaaatgtccagcggcaatctgctatttactggtcatctaaaatgtagattaagaatggacaaacttcagctaaaaggaatgagctattcaatgtgtacgggcaaattcaaaatagtcaaagaaattgccgaaacacaacatggaactatcgtgatacgagttcaatacgagggggacggatcgccatgcaaaataccttttgaaattatggaccttgagaaaagacacgtcctaggtaggttaataacagttaaccccatcgtgacggaaaaagatagtcctgttaatatagaagcagaaccaccatttggggactcttatataattattggggtcgagccaggtcagttaaaactgaactggtttaagaaagggtcttcaattggacagatgttcgagactactatgagaggtgccaaaagaatggccatattgggggacaccgcgtgggacttcgggtctcttggcggagtcttcacatcaataggaaaagccttacaccaggtctttggggcaatatacggagccgccttctccggggtgagctggactatgaaaattctaataggagtcataataacatggataggaatgaactccagatcaacaagtctatctgttagcctggttttagtaggtgtgataacattatatcttggagcaatggtccaggcggacagcggatgtgtagtaagttggaagaataaagagcttaaatgtggctcaggtatatttattacggataacgtgcatacgtggacagagcagtataagttccagccagaatcaccaagtaaacttgcgagcgctatacaaaaagctcatgaggagggaatttgcggtataagatctgtgacaaggttggaaaacctaatgtggaaacaaattacaccagagctaaatcacattttatcagaaaatgaagtaaaattaacgattatgacaggagatataaaaggaatcatgcaggcaggaaaaagatcgcttcggcctcagccgacagaattaaaatactcatggaaaacatggggtaaagcgaaaatgttaagcaccgaaagtcacaatcaaacgtttcttattgatggaccggagacagcggaatgtcctaatacaaatagggcatggaacagcttggaagtagaagattatggcttcggagtatttacaacgaatatctggttaaagctaagagaaaagcaagacgtattttgcgactcaaaactaatgtctgccgccataaaagacaacagggccgttcacgcagatatgggatactggattgaaagcgcgctcaatgatacatggaaaatggaaaaggcttcatttattgaagttaagtcatgtcattggccaaagtcacacaccttgtggtcgaacggggtcctcgaatccgaaatgatcataccaaaatcatttgcggggcctgtgtctcaacataattataggcccggatattatacccagaccgccggtccctggcacctcggcaagttggaaatggattttgatttttgcgaaggaacaactgtcgtcgttacggaagattgcgggaacagaggaccctcgttgcgcacaacaactgcctcaggtaaattgataacagaatggtgttgtcgaagttgtaccctgccaccacttagatacagaggcgaggacggctgctggtacggaatggaaataagaccacttaaggaaaaagaggaaaatctagtaaattcactcgtcactgcagggcatggtcaaatagacaattttagtcttggtgttctgggaatggccttgttcttagaagagatgttaagaaccagggtgggtacgaaacacgctatattattagttaccgtatcttttgttacacttattacgggaaatatgagttttcgagatctgggaagagttatggtgatggtcggcgccgcaatgaccgatgacataggaatgggagtaacatacttagcgctcttagctgcatttaaagtccgacccacatttgcagcgggattactacttaggaaacttacaagtaaagaattaatgatggcaacaataggcatcgctctattatcccaatctacaatacctgaaactatcttagaactcacagatgccctagcattaggtatgatggtgttaaaaatagtaagaaatatggaaaaatatcaacttgcagtgaccattatggccataagttgtgtacccaatgctgtaatcttgcagaatgcgtggaaagtttcatgtaccattctagctgctgtaagtgtatctccattgcttctaacctcgtcacagcaaaaggccgactggatacccctggccctcactattaaggggctaaacccaactgctattttcttaactacattgagcagaacaagcaagaaacgctcgtggcctttgaatgaggcaattatggcagtagggatggtttctatcctcgcctcgagtttgcttaaaaatgatatcccaatgacaggaccactggttgcaggaggactcctaaccgtttgttacgttctgactggccgtagcgcagatcttgaactagaacgagctacagatgtcaaatgggaagatcaggctgagatttcagggagttcacctatacttagcattactatagctgaagatggaagcatgagtattaaaaacgaggaagaagaacaaactttaactatactcatacgaacagggttattggtaatctcaggtttatttccggtaagtatcccgataacggcagccgcatggtacctttgggaagttaagaaacagcgtgctggggttttatgggatgtaccctcacccccgccggtcggaaaagccgaactagaagatggagcatatcgcattaaacagaaaggcattcttggatactcgcaaattggagcaggagtatataaagaaggtacttttcatacgatgtggcatgtgacacgaggcgctgtactaatgcatcgaggaaaaagaatagagcctagctgggcagatgttaagaaagacctgatttcatatggaggaggttggaaacttgaaggagaatggaaagaaggagaagaagttcaagtgttagcgctcgaacctgggaaaaaccctcgagctgtacagaccaagccaggactctttaaaacaaatacaggaacgataggagcagtatcattagatttctcaccaggcaccagtggttcaccaatagtcgaccgaaaaggaaaagtcgtaggtctttatggcaatggagtagttacaagatcaggggcatatgtgtcggcaattgcacagacagagaaaagtatcgaagataatccggagatcgaagatgatatattccgaaagaaaagactcacaataatggatctccacccaggggcaggcaaaacaaaaagatatctaccagcgatcgtcagagaagcaataaaaagagggttaagaaccctaattctggctccaactagagtagtagcagctgaaatggaagaagcactcagggggttacccattcgataccaaacaccagccattagagccgaacatacgggccgggaaatagtcgatttaatgtgtcatgccacgtttactatgcgtttgttatccccagtgcgtgtcccgaactataacttaatcataatggatgaagctcattttacagacccagcaagcattgctgcaagaggttacatttcaacacgggtagaaatgggagaggcagctgggatctttatgaccgcaacgccaccaggatctcgagatccatttccccaatcaaacgcaccaattatggacgaagaaagagaaattccagaaaggagttggaactccggacacgagtgggtaacagattttaaaggaaaaactgtttggttcgtgccatccattaaagctggaaatgacatagcagcatgtttgaggaaaaatggcaagaaagttattcaattgtcgcgaaaaacatttgattccgaatacgtaaaaacgaggacgaatgactgggacttcgtcgtcacgactgatatatcagaaatgggggccaactttaaagcagaaagggtaatcgatcctcggagatgtatgaaaccggtaattttaactgatggagaagaacgagtcatattggctggtccaatgccagttacgcactcctcagccgcccaaaggagggggcgaattggacgtaatcctaaaaatgaaaatgaccaatatatatatatgggggaaccattagaaaatgatgaagactgtgctcattggaaagaagcaaagatgcttcttgataatataaacacaccagaaggcataataccgagtatgttcgaaccagagcgggaaaaagtagatgctatagatggagagtacagattacggggagaggccagaagaacgttcgttgatttaatgagaagaggtgatctgcctgtatggttggcatacagagttgcagctgagggaataaactatgctgatcggagatggtgttttgacggcgtgaagaacaatcaaatcctagaagagaacgttgaagtcgaaatctggacaaaagagggtgagaggaaaaagctgaaaccaagatggcttgacgccagaatatacagtgacccgttagcactgaaagagttcaaagaatttgccgctggaagaaagtcactcaccctaaatctaatcaccgagatgggacggctaccaacattcatgacccaaaaagctagagatgccctagataatttggctgtattgcacacggctgaggcgggtggtagagcatacaaccatgcattatcggaactccccgaaacattagaaacgttacttttactcacgttacttgccacagttactggcggaatatttctgttcctcatgtctggaaaaggagtaggaaaaatgaccttaggaatgtgctgtataatcacagccagtatactcctctggtatgctcagatacagccccattggattgcagcaagcataatattggagttctttttgattgtccttttgatcccagaaccggaaaagcaaagaaccccacaggataatcaacttacgtatgtagtgattgcaatacttactgtggtagcggccacaatggccaacgagatgggtttcctagagaaaacgaagaaggacctggggttaggaagtatagcaacacaagaaccggaatcaaatattttagatattgacttgagacccgcgtctgcctggacgctgtacgccgtagcaaccacattcgttacgccaatgttaagacatagcattgaaaacagttccgttaatgtatcactaactgcaatcgcgaaccaggcgactgttttaatgggattaggcaagggctggccactttccaaaatggatataggggtcccactgttagctatcggatgttattctcaagttaaccctattactttgactgccgcattactactcctagtagctcactacgctataataggaccaggtctgcaagctaaagctacacgagaggcacaaaaacgagcagcagctgggatcatgaaaaaccccactgtagatggcgtaactgtgatagatttggatcccattccttatgaccctaaatttgaaaaacaactcggtcaagtaatgttattaattctttgtgtgactcaagtactgatgatgcggactacctgggcactatgcgaggctctaacccttgctacaggacccatctctacgctatgggaggggaacccaggtaggttttggaacactacaatagcagtctcaatggcgaatatattcagaggatcttacttagccggtgctggtctactcttcagtataatgaagaatactactaacacacgtcgaggcactggtaatataggcgaaacattaggggaaaaatggaaatctagactaaatgcattaggtaagtcagaatttcaaatatataagaaaagcggcatccaggaagttgatcgaacattggctaaggaaggcattaaacggggagagacggaccaccatgcagtctccagaggcagcgccaaactaagatggtttgtagagcgtaacatggtaaccccggagggaaaggttgtggaccttggttgcggaagaggtggatggagctactactgtggaggactgaaggatgtaagagaagtcaaaggattaaccaaaggaggccctggacacgaagaacctattccgatgtccacgtacgggtggaacctcgtacgattacaatcaggagtagatgtattctttacaccgcctgaaaaatgtgataccttgttatgtgatataggcgagtcttcccccaatccgacaatagaagcgggaagaacattaagagtactctctttagtagagaattggctcaataatgatactcaattttgcattaaagtattaaatccttacatgccttccgtaatagagaaaatggaaacactacaaagaaaatatggaggtgcactggtacgaaatccattatcgagaaactcaacacatgaaatgtattgggtctcaaatgcgactggaaatattgtttcatcagtaaatatgataagccgaatgttaatcaaccggtttacaatgaaacacaagaaagcaacatacgaacccgacgtagatttaggaagtggtacgagaaatattggaatagaaagtgagatacctaatcttgatataataggtaaacgtattgagaaaatcaaacaggagcacgaaacatcgtggcactatgaccaagaccatccatacaaaacgtgggcctatcatggttcttatgagacaaaacagaccggaagtgctagttctatggtgaacggagtggtccgattgttaactaaaccatgggatgtagtacctatggttactcagatggcaatgaccgatacaaccccttttggacagcaaagagtttttaaagaaaaggtagacacacgaacacaggaaccaaaggagggaactaaaaagttaatgaaaataacagccgaatggctatggaaggagctagggaagaagaaaactccgcgaatgtgcacaagggaagagttcactaggaaggtaaggtcgaatgctgctctgggtgccatattcaccgacgaaaacaagtggaaatccgcacgagaggcagttgaagactcaagattttgggagttagtcgataaagaaagaaatttacatcttgagggaaagtgtgagacgtgcgtctacaacatgatgggcaaaagagagaagaaattaggagaatttggcaaagctaagggttcgagagcaatatggtatatgtggctaggagcaagatttttagagttcgaagcattaggttttctgaacgaagatcattggttctcacgggaaaattccttatcaggagtcgaaggagaaggacttcataaattgggttacatactacgagacgtctccaagaaagaaggaggggcaatgtatgcagacgatacggcagggtgggatacgagaattacattagaagatctcaaaaatgaggagatggttactaatcatatggaaggcgaacataagaaactggctgaagcaatatttaagctaacatatcaaaataaagttgtaagagttcaaagacctacaccaagaggaacggtgatggacatcataagtaggagagaccaacgtggctcaggccaggtaggcacttatggtctaaatacatttacaaatatggaggcccagcttataagacaaatggaaggcgaaggcgttttcaaatcaatacaacgtttaactgtaacagaggagattgcggttcaaaattggttagctcgtgtcgggcgcgaacgattatcaaggatggcaataagtggtgatgactgcgtcgtaaagcctttagatgaccgatttgcttccgctctgactgcattaaacgatatgggcaaagtgcgtaaggatattcaacaatgggaaccttctaggggatggaatgactggactcaagttccattttgttcccatcactttcatgagctaatcatgaaagacggtagagtattagtggtcccttgccgaaatcaggatgaactcatcggcagggccagaattagccagggggccggttggagccttaaagaaacagcttgcttggggaaaagctacgcacaaatgtggtcattaatgtactttcatcggagagatctacggctagcagcaaacgctatatgctccgcggtgccatcgcattgggtgcccaccagtcgtacaacttggtccatacacgcaaaacatgaatggatgacaacagaggatatgttaacggtttggaatagagtgtggatacaagaaaacccatggatggaagataaaacaccagtggaatcatgggaagaagtaccctatctaggtaagagagaggaccaatggtgtggatcactaatagggctaacgtcgcgtgccacctgggcaaagaatatacaaaccgccattaatcaagtacggtcgcttattggaaatgaagaatatactgattacatgccaagcatgaaacgttttagacgagaggaagaagaagccggtgtgttgtggtag

SEQ ID NO: 22820 - RNA, 9876 nt, synthetic construct
  misc_feature 1..9876: note = derived and/or modified CDS sequence (opt6) from DENV-2__FM210232__SS-prME
  source 1..9876: mol_type = other RNA
actgcaggggtaataattatgttaattcctactgcgatggcatttcacctaaccactcgtaatggagaaccacatatgatagtaggaagacaggaaaaagggaaatcattgttattcaaaaccgaagatggtgttaatatgtgtactcttatggcaatagatttgggagaattatgtgaggatacaataacatataaatgtcctctactaagacaaaacgaaccagaagatatagactgttggtgtaatagcacgtccacatgggtaacgtatggaacgtgcacgacgaccggagaacatagacgcgagaaaagaagcgtggctctagttccacacgttggtatgggactagaaacacgtaccgagacatggatgtcgtcagaaggagcatggaaacatgcacaaagaattgagacatggattctcagacacccgggatttaccataatggcagcgatacttgcttatacagtaggtacaactcatttccaacgggctttaatttttatattgttagcagctgttgctccgtctatgacgatgaggtgtataggtataagcaaccgtgattttgtagagggagtttcaggaggatcgtgggttgatattgtacttgagcacgggagctgtgttaccaccatggctaaaaacaaaccaacactagactttgaattaataaaaactgaagctaaacagccagcaacgctaagaaaatattgcatagaagctaaattgacaaataccacaacggagagcagatgcccgactcaaggagagccatccttaaacgaagaacaagataaaaggttcgtgtgtaaacattccatggtggatagagggtggggaaacggatgtggattattcgggaaaggaggaattgtaacttgtgctatgttcacatgcaaaaagaatatggaaggtaaaatcgtacagccagaaaatcttgaatatacgatagttataacgccacatagcggagaagaacatgcagtagggaatgatactgggaaacatggtaaagagatcaaaatcacaccacagtctcctatcactgaagcagaactgacagggtatggaaccgtgactatggagtgttccccaagaacaggcttagattttaatgagatggtactactgcagatggaagataaggcatggttagtacatcggcaatggtttttggacttaccactgccatggttgccaggagcggacacacaagggagtaactggatacaaaaagaaactctagttactttcaaaaatccacatgccaagaaacaagacgtagttgtcctaggctcccaggaaggagcaatgcacacagcattaacaggcgcaacagaaatacagatgagttcgggaaatttactatttacggggcatttaaaatgtcgtctcagaatggacaaactgcaattaaaaggaatgagctattcaatgtgcaccggcaaattcaaaattgtaaaggaaattgcagaaactcaacacgggactatagtaattagagttcagtacgaaggagacggaagtccctgcaaaatcccgtttgagataatggatcttgagaaaagacatgtattaggacgactaataacagtgaacccaattgtaacagaaaaagattcgccagttaacattgaagcagaacctccatttggggatagctacatcataataggagttgagcccggacaactaaagctaaattggtttaagaaaggatcttctattggtcaaatgtttgaaactacaatgagaggagcaaaacgcatggcaattctcggagatacagcttgggacttcgggagtctagggggagtttttacttcaatcgggaaggctttacatcaagtattcggagcaatttacggagcagcattttctggcgtatcatggaccatgaaaatactaattggtgtaataataacctggatcggaatgaactcaagatccacatcgttgtcagttagtttagtattagtaggggtaattacgctatatctgggcgcgatggtccaagccgatagtgggtgtgtagtatcttggaaaaataaagagttaaagtgtggtagtggaatatttattacggataacgtacacacatggacggaacagtacaaatttcaacccgagagtccatctaaactagcatccgccattcagaaagcacatgaagaaggtatatgtgggatccgaagtgtaaccaggcttgaaaatctaatgtggaaacaaataacaccggaattgaatcatatcttgtcggaaaatgaagttaaacttactattatgactggagacattaaagggataatgcaggcgggcaaaaggagcttaagaccgcagcccacggaattaaagtattcatggaagacctggggaaaagcgaaaatgctaagtacggagtcacataaccaaacatttttaattgatggcccagagacagccgaatgcccgaatacaaacagagcctggaacagtttggaggtagaagactatgggttcggagtttttacaaccaatatttggctaaaactgagggaaaaacaggatgtattttgtgatagtaaactaatgtcagctgcaattaaagacaatagggctgtgcatgctgacatgggatactggatagaaagtgctctaaatgacacatggaaaatggaaaaagcctcttttatagaggtgaaatcatgccattggcctaaatcacacacgttatggagcaatggtgtcttagagtccgaaatgatcatacccaaaagttttgcaggtcctgtaagccaacacaactaccgtccaggatattacacccaaacagccggtccatggcatttgggtaaacttgaaatggattttgatttttgtgaaggcacgacagtggtagtcacagaggcatgtggaaatagaggaccatcacttagaacaaccacggcctctggaaaacttattactgagtggtgctgtcggagttgcacattaccgcctttgcgatatagaggggaagatggttgctggtatggaatggaaattaggcccctcaaggaaaaagaagaaaacctagtgaactctttagtgacggcgggacatggacagattgataacttttcgctaggcgtattaggaatggccttgtttttggaagaaatgctacgaaccagagtaggcacgaaacacgccatactcttggtaactgtatcattcgtaacgcttattactggtaacatgtctttccgagacctcggacgtgtaatggttatggtcggagccgcgatgactgatgatataggtatgggtgtgacgtatttagcacttctagcggccttcaaagtacgccctacatttgctgcaggacttctacttcggaaactaacatcaaaggagctcatgatggcgaccataggaatagcactactgagtcagagcactataccagaaaccatcttagagttaacagacgcgctcgctttaggcatgatggttttaaaaatagtacgtaatatggagaaataccaactggcagtgaccatcatggctataagttgcgtaccaaacgcggtaatcctacaaaatgcctggaaagtatcatgtacaatactagctgcggttagcgttagtcctttacttctaacttcatcccaacaaaaagcggactggatacctctagccttaacaataaaaggcttaaatccaacggcaatatttctgacgacattaagtcgaacaagtaaaaagagatcctggcctctgaacgaagctattatggcggtaggaatggtgtcaatattagcaagtagtttattgaaaaatgatattccgatgaccggaccgttggtagcagggggattacttactgtatgctacgttcttaccggcagatctgcagatctagagttagaacgggcaaccgacgtaaaatgggaggaccaagcagaaatcagtggaagctcgcccattctgagtattactatagccgaggacggaagcatgtctatcaaaaacgaagaagaagaacaaacattaacgatcttaataagaacggggctcctagtgataagtggtctattcccagtgagtattcctattacagccgctgcgtggtatctctgggaagttaaaaagcaaagagccggcgtcttgtgggacgtaccttctcctccacctgtcgggaaagccgaactagaagacggcgcctatcgaattaaacaaaagggcatattaggttattcacaaataggagctggagtatacaaagaagggacttttcatacaatgtggcacgtaacaagaggcgcggttctcatgcatcgagggaaacggatcgaaccaagttgggcggatgttaaaaaggaccttatatcttatggcggagggtggaaattagaaggcgaatggaaagaaggcgaagaagtccaagtattagctctcgagcctggcaaaaatccaagagcagtacagacaaaaccgggactgttcaagacgaatacaggaactataggggccgtttcacttgattttagtcctggaacttctggaagcccaattgtagatagaaagggaaaagtggtaggtttgtacggaaacggggtagtcacacgaagcggagcttatgtctcagcaattgcacaaaccgagaaatcaattgaggacaaccccgagattgaggatgatatttttaggaagaaaagacttaccattatggatctccaccccggagctgggaaaactaaacgttatctaccagccattgtgagagaggctataaaacgtgggttaagaacgctgattctggctcctacacgcgtggttgctgcagagatggaagaagcattaaggggccttcctatacgataccaaactccagcaatacgagcagaacatacaggacgggaaattgtcgatcttatgtgccatgcaacgtttacaatgagacttctatctcctgttagagtaccgaactataatttaatcataatggacgaggcccatttcactgacccagcttcaatagcagctagaggctatatttccactagagtcgagatgggcgaagcggctggaatcttcatgacagcaacaccacccggatcaagagatccattcccacagtctaacgctccaattatggatgaagagagagagataccagaaagaagctggaatagcggacacgagtgggttaccgactttaaaggaaaaacggtctggttcgttccatccataaaagctggaaatgatatagctgcgtgtttgaggaaaaacggtaagaaagtaatacagttgtcacgtaaaacgttcgactctgaatacgtgaaaaccagaaccaacgattgggactttgttgtcactactgatatatccgaaatgggcgccaatttcaaagcagaaagagtaatagacccacgaagatgcatgaaaccagtaatactcacggacggagaggaacgcgtgattttggcgggaccaatgccggtgacacactcaagtgctgcacaacggcgtggaaggataggaagaaaccccaaaaacgaaaatgaccagtatatttacatgggcgagcccctcgagaatgacgaggactgtgcacactggaaagaggctaaaatgctactagataatataaacacacccgagggaatcattccaagtatgttcgagccggagcgtgaaaaagtcgatgcaattgacggtgaatacaggttaaggggagaagcgaggaaaacttttgtagacctaatgagaagaggcgacttgccggtatggctggcctacagggtcgctgcggaaggaataaattatgctgatcgacgatggtgtttcgatggggtcaaaaataatcaaatactagaagaaaatgtagaggtagaaatctggacgaaagaaggagaaagaaagaaacttaaaccgagatggctagacgcgaggatatactctgacccattagcgttaaaagagtttaaggaatttgcagcaggtaggaaatccctaactcttaaccttattacagagatgggtaggttaccaacattcatgacacagaaagcgcgagatgcacttgacaatttggcagtcctacacacagccgaagcaggaggcagagcttataatcacgcgttaagtgaacttccagaaacacttgaaacattattattattaacgttgcttgcgacggtcacaggaggcattttccttttcctgatgagtgggaaaggagtgggaaaaatgacattaggtatgtgttgtatcataacagcatcaatacttttgtggtatgcgcaaatccagcctcattggatagctgcaagtatcatattagagttctttctgatagttttgcttatcccggaacccgagaaacaaagaacaccccaggataatcagttgacatatgtagtaatagcaattcttacagtagtagcagcaacaatggctaatgaaatggggttcttagagaaaaccaagaaagacttaggtttaggttccatcgctacacaagagccggagtctaacatactcgacattgacttaagacctgcgagtgcatggacattatatgcagtagcgactacatttgtaacaccaatgctaagacatagtattgagaacagtagtgttaacgtaagtttaaccgcaatagctaaccaagccacagtactgatgggacttggaaaaggctggcccctaagtaagatggatatcggtgtaccattattagcaataggctgttacagtcaagtgaatcctataacgttgaccgcagctttactacttctagttgcacactacgctataattggacccggccttcaggcaaaagctaccagagaggcgcaaaagagagcagctgctggcattatgaaaaacccgacggtagacggtgtgacggtaattgatctggaccccataccatacgaccctaaatttgagaaacagctcggtcaagtgatgctactaattctttgtgtaacacaggtattgatgatgagaacgacatgggcactatgtgaagcattgacgctagcaactggtccaatatcaaccttatgggaaggaaaccctggcagattctggaatacgacgatcgccgtgtcgatggctaatattttcagaggatcttatttggctggtgctggattactctttagtataatgaagaacactactaacacaagacgaggtacaggcaatataggagaaactctaggtgagaaatggaaaagccggctaaatgccctaggtaagtcggagttccagatatacaagaaatctggcatacaagaagtggacagaactttggcaaaagaaggcataaaacgcggcgaaacagaccaccacgcagtgtctagggggtctgcgaaactgagatggttcgtggaacgaaatatggttacacctgaaggaaaagtcgtcgatttaggatgtggtaggggtggatggtcttattattgcggaggattaaaagatgtacgggaagtaaaaggattgacgaagggagggccgggacatgaggaaccaataccaatgtccacttatggatggaatcttgtaagattacaatctggagtagacgttttcttcacgcctcctgaaaaatgcgacacgttactctgtgatattggtgaaagctctccgaatcccactattgaagcaggtagaacacttagagtactatcgcttgtcgaaaattggttaaataatgatactcaattttgtataaaagtccttaacccctatatgccaagtgtgatagagaaaatggaaacactgcaacggaaatacgggggagctttggttagaaatcccttatcgagaaacagtactcatgagatgtattgggtgtcgaacgcaacgggaaatattgtctcatcagttaatatgatcagtcgaatgctaatcaatagatttacaatgaaacacaagaaagcgacttatgaaccggatgtcgatttggggtctggtacgaggaatatagggatcgaaagtgaaatacccaatttagatattatagggaaacgaattgagaaaatcaagcaagaacacgaaacatcctggcattacgatcaagatcacccgtacaagacatgggcctatcacggctcatacgagacaaagcaaactggctctgcatcgtcaatggttaatggagtagtaagattactgaccaaaccctgggatgtggtgcctatggtcactcaaatggctatgaccgacacaacgccatttggacaacagagagtatttaaagagaaggtagacactaggacgcaagaacccaaggaaggaaccaagaaactcatgaaaataacagccgaatggttgtggaaagaactaggcaagaagaaaactccccgcatgtgtacgcgcgaagagtttacccgaaaggtaagatcaaatgccgcactcggtgccatttttactgacgagaacaaatggaaatcagcgagagaagccgttgaagactcgcgattctgggaattggtagataaagagagaaacttacatttggaaggtaagtgcgaaacttgtgtatacaacatgatggggaagcgcgagaagaaactgggtgagttcggaaaagcaaaaggttcaagagcaatatggtatatgtggttaggtgctcgatttttagaatttgaagcgctaggctttcttaacgaagaccactggttttcaagggaaaatagtttgagtggagtggaaggcgaaggtctgcataaattaggatatatcctacgagacgtctccaaaaaggaagggggtgccatgtatgcagacgacacagcgggatgggacacaaggataacgctagaagatctgaaaaatgaagaaatggtaacaaatcatatggagggtgagcacaagaaattagccgaagcaatttttaaactgacgtaccaaaataaggtagtaagagttcaaagaccaacacctcgaggtacagtaatggatatcatttctagaagggaccagagaggatcaggacaagtcgggacctatggattgaacaccttcaccaatatggaagcacaactaattcgtcaaatggaaggagaaggagtttttaagtcgatacagcatctcacggttacagaagaaattgctgtgcaaaactggttggcacgcgtggggagagagaggttgtctcgaatggcgatctcaggggatgattgtgtagtgaaaccattagatgacaggtttgctagtgcgttaaccgccttaaacgatatgggtaaagtacgaaaggatatacagcaatgggaaccaagtcgtggatggaatgactggacccaggtacccttttgttcccaccattttcatgaactcataatgaaagatggaagagtcctagtagtgccatgtagaaatcaagacgaattaatcggtagagcgagaattagccaaggtgcgggctggtccctcaaagaaactgcctgtctcggaaaaagttatgcccaaatgtggagtcttatgtacttccaccgtcgggatttacgtctcgctgctaatgcgatatgcagcgcagttccatcacactgggtacctacttcacgaaccacctggtcgatacatgctaagcatgagtggatgacaacagaagacatgctgaccgtatggaatagagtatggattcaggaaaacccttggatggaagataaaactccagtggaatcatgggaagaagttccatacctaggaaaaagagaggaccaatggtgcggcagtttaattggcttgacgtcaagagccacgtgggccaaaaacattcaaacagctattaaccaagtacgttccctaataggaaatgaagaatatacagactatatgcctagcatgaaaagattccggcgcgaagaggaagaagcaggggtactgtggtaa

SEQ ID NO: 22821 - RNA, 9876 nt, synthetic construct
  misc_feature 1..9876: note = derived and/or modified CDS sequence (opt6) from DENV-2__FM210233__SS-prME
  source 1..9876: mol_type = other RNA
tctgcagggatgataatcatgttgataccgaccgttatggccttccacttaacaacaaggaatggcgaacctcatatgatagtcggaatacaggagaaaggaaaaagcctgttatttaaaaccgaggatggagtaaatatgtgtacactcatggcaatggatcttggagaactctgcgaggatacaattacttacaaatgcccattgctacgtcaaaatgaaccggaagacattgattgttggtgtaatagcacttccacttgggtaacgtacggtacatgcacaacgacaggggaacacagaagagaaaaaagatcagtcgcattagtaccccacgtgggtatgggtctggaaacgcggactgaaacgtggatgtcttcggaaggggcatggaagcatgcccaaaggatagaaacttggatcctcaggcatccaggtttcacaattatggccgccatattagcttatactataggaacaacccattttcagagggtattaattttcattctgctgacagctgtggcaccaagcatgacgatgcgatgtataggaatatcaaaccgtgactttgtagaaggtgtaagtggtggatcatgggtggacatagtactcgaacatggaagctgcgtaactacaatggccaaaaataagcctaccctagattttgagttgataaagacagaagcaaaacagccagctaccctaaggaaatattgtatagaagcgaagctaactaatacaacaacagaatctcgttgccctacgcaaggtgaaccatcattaaaggaagagcaagataaacgatttgtgtgcaaacattcaatggtagatcgcggatggggcaatggatgtgggttattcggtaaaggcggaatcgtaacatgtgcaatgtttacatgcaaaaaaaatatggaaggaaagatcgtgcaaccggaaaacctagagtataccatagtggtaacgccacacagtggagaggaacatgcagttggtaatgacactggaaagcatgggaaagaaataaaagttacccctcagtcaagcataacggaggcagagctgacagggtatggcacagtcactatggaatgtagcccaagaactggacttgattttaacgaaatggtgctgctgcaaatggagaacaaggcatggttagtacacagacaatggtttctggacctgccattaccatggctgcccggcgccgacaaacaagaaagtaactggattcagaaagaaacccttgtcactttcaaaaatccccatgctaaaaagcaagacgttgtcgtacttggcagtcaagagggtgcaatgcatacggccttaactggagcaactgaaattcaaatgagtagtggtaatttattatttacgggtcacttaaagtgccgccttcgtatggacaaactgcaattaaaaggtatgtcgtattctatgtgcacgggtaaattcaaagttgtaaaagaaatagcagaaactcaacatggaacgatagtcataagggtacaatacgaaggtgatggttcaccatgtaaaataccattcgaaataatggatttagaaaagagatatgttttgggtaggctgataacagtaaatccgatagtgaccgaaaaagattcaccagtgaacatagaggcagaacctccctttggggatagctacataattattggggttgaacccgggcaactgaagttaaattggtttaagaaaggttctagtataggccaaatgttcgaaacaacgatgaggggggccaaaagaatggctatactaggcgatacagcatgggatttcggtagtctaggtggggtattcacgtctattggcaaggctcttcatcaagtgtttggcgctatatatggagcagcatttagtggcgtaagctggactatgaaaatcttaataggtgtaataattacttggatagggatgaattcgcgatcaacgtcactaagcgtctctctcgttttagtcggtatcgtaaccctatacttaggagtgatggtacaggccgacagtggctgtgtagtatcgtggaaaaacaaggagttaaaatgcggatctgggattttcataaccgataatgtacatacctggaccgagcaatataaatttcagccagagtcaccaagtaaactagccagtgctatacagaaggcacaagaggaagggatctgtggaattcgatctgtaactagactagagaacttaatgtggaaacagatcacacctgaactaaatcatatactggcagaaaacgaagttaaactaacaataatgactggtgatatacgaggtataatgcaagctgggaaacgtagcttacgtccacagccgacagaacttaagtactcatggaaaacctggggaaaagcgaagatgttaagtacagaatcctataatcagacgtttttaatagatggtccagaaacggctgagtgtcccaacacaaaccgagcatggaatagcttagaagtagaagattacggatttggggtttttaccacgaacatttggttaaaactgaaagagaaacaggatgccttttgcgatagcaaactaatgagtgctgcgataaaagataacagagctgttcatgccgatatgggctactggatggaatcagcactaaatgatacttggaaaatagaaaaagcgtcatttatagaagtgaaaaactgtcattggccaaaaagtcataccttatggtcaaatggggtattagaatcagaaatgatcattccgaaaaatttagcgggtccagtaagtcaacataactaccgaccaggctatcacactcagatcgccggaccgtggcatttgggtaaattagaaatggatttcgacttttgtgatggaaccaccgttattgtaactgaagactgcggcaatcgagggccttcacttcgcacgactacagcatcgggcaaactaataaccgagtggtgttgtcggagctgtacactgcccccattaagatatcggggcgaggacggttgttggtacggaatggagatacgccctttaaaagaaaaagaggaaaatcttgtaaattctttagttacggctggccacggacaagtggacaacttttcattaggcgtacttggaatggctttgttcttagaggaaatgttacgaaccagagttggtacgaaacatgcaatattacttgttgcagtatcctttgtcacattgataacaggaaatatgagctttaaggacttaggcagagtagtggtaatggttggcgcgaccatggcagatgatattggaatgggagttacatatttagctttgttagctgcgtttaaagtcagaccaacatttgctgccggtctgctgctaaggaaactaacaagtaaagaactaatgatgacgacaatcgggattgtattactttcccaatcaaccatccctgaaactgtattagaactaaccgatgccttagcattaggtatgatggttttaaaaatagtaagaaatatggaaaagtatcaattagcagtaacgataatggccatattatgcgtacctaacgcggtcatactccagaatgcatggaaagtatcgtgcacaatactagcagttgtatctgtgtctcctttgctactcacttcttcgcaacagaaaactgattggataccactagccttgacgatcaagggccttaatccgaccgccatatttctaacaacgctctcaaggactaataaaaaaagatcctggcctcttaacgaggcaataatggctgttggaatggtttcgatattagccagctcattgttaaagaatgacataccgatgacaggtcctctagtcgcaggggggttactcaccgtctgctacgtactgacaggtagaagtgcggacttggagcttgagagagccaccgatgttaaatgggaggaccaagcagaaatatctggaagttcgccgatattatcaatcacgataagtgaggatggtagcatgtcaattaaaaatgaagaagaggaacaaacattaacaatcttaataagaacgggtttactagtcataagcgggctattccctataagtatccccataactgcagcagcatggtacctctgggaggtcaaaaaacagagggccggcgtcctgtgggatgtaccgtcgccgccccctatgggaaaagctgaattggaggatggcgcttatagaattaaacagaaaggtatcctcggttattctcaaattggagcgggagtatacaaagaagggacttttcataccatgtggcacgtgacaagaggagcagttctcatgcataagggtaaacggatagaaccatcttgggctgacgtaaaaaaagatttgatttcatatggcggaggttggaaactagaaggcgagtggaaagaaggagaggaagtccaggtattagcacttgaaccaggtaaaaaccccagagcagttcaaacaaaaccgggactcttcaaaacaaatacaggcacaatcggagcagtttccttagatttctcacctggaacgtccgggtcaccaattattgataaaaaaggaaaagttgttggactttatgggaatggggtcgtgacgcgttcaggagcgtatgtctcagctattgctcaaacagaaaaatcaatagaagataatccagagattgaggacgatatattccgaaaaagacggttaacaataatggacctacatccgggggctggaaaaacgaagcgatacctaccagccatagtacgagaagcgataaaacgaggcttacgaactttaatactggcgccaacacgtgtggtagctgcagaaatggaagaagccctcaggggcttacccatacgctatcaaacaccagccatacgagcagaacatactggccgagaaatagtagatcttatgtgtcacgcaacatttacaatgagattgctctcacctgtcagagtgccgaattataatcttataataatggatgaagcacatttcaccgacccagcatcaatcgctgctcggggctatataagtacccgagtagaaatgggagaagcagcagggattttcatgactgcgactccaccgggatcgagggacccatttccacaatcaaatgctccaattatagatgaagaacgagaaattcccgaacgatcatggaattcgggacatgaatgggtaacggatttcaaaggtaaaaccgtgtggtttgttccatcgattaaagcaggtaacgatatagctgcatgtttaagaaaaaacgggaaaaaagtgattcaactcagccggaaaaccttcgatagtgagtatgtcaagacacgtactaatgactgggatttcgttgtaactaccgacataagcgagatgggtgcaaacttcaaagctgaaagagtaatagatccgagaagatgtatgaaacctgtaattctaacagacggcgaagaacgcgttatcctcgcaggcccaatgccagttactcactcgtcagctgcacagcgacgagggcgaataggaagaaatcccaaaaatgagaacgaccaatacatatatatgggagaacctttagaaaatgacgaagattgtgcgcactggaaagaggcaaaaatgctattagataacattaataccccggaaggtatcatcccgtcaatgtttgaacccgagcgagaaaaggttgacgccatagatggagaatatagattacgaggtgaagcccgcaaaacatttgttgatttgatgagaagaggagacctaccggtatggttagcatataaagtcgctgctgaaggaattaactatgcggatcgtcgatggtgctttgatgggattaaaaataatcagattttagaagaaaacgttgaggtcgaaatatggactaaagagggtgagcgaaaaaagttaaaacctcgatggttagatgctagaatatattcagacccattggctcttaaagagtttaaggaattcgcggcggggcgaaagtcgctaacccttaatttaatcacggaaatgggtagattgcccacatttatgacacagaaaacgagagacgctctagacaatcttgccgtactccatacagcagaagctggtggcagggcatacaatcatgcgttatctgagttaccggaaacacttgaaacccttttgttgttaacgcttttagctacagtaactggaggaattttcctgtttctcatgagtggcagaggaattgggaaaatgacacttggtatgtgctgtattattactgcttcaatattactatggtacgctcaaattcaaccgcattggatagcagcctccattatattagagttttttctgatagtcctactgattccagaacccgaaaagcaacgtacaccacaagataaccagttaacgtacgtagttatagctatattgaccgtggtcgcggccacaatggcgaacgagatgggttttctagaaaaaacaaaacgcgacttaggactagggtcgatagcgacacaacagcccgaaagcaatatattagatatcgatcttagaccagcatccgcatggacgctttacgcagttgcgactacatttgtcaccccaatgcttcgccacagtatagaaaacagttcggtaaatgtttccctaactgccatcgcaaaccaggctaccgtgctaatgggacttgggaagggctggccattatcgaaaatggatattggcgtgcctttattggccataggatgttattcacaagtaaatccaatcaccttaactgcggcgttattgttactggtagctcactacgcaataatcgggccaggtcttcaagcaaaagctacacgagaggcacaaaagagagcggccgcgggcattatgaaaaacccaactgtagacggaatcaccgtaatagacctcgatcccataccttacgacccaaaatttgaaaaacaactcggccaagtcatgttgctaatcttatgtgttactcaagtcttaatgatgaggaccacatgggcactatgcgaagcactaacgctggctacgggacccattagcacactctgggaaggaaacccaggcaggttctggaacactaccattgcagtgtcaatggctaacattttcagaggttcatatttggcgggcgctgggctgttattcagtatcatgaaaaatacaacaaacactcgcagaggaacaggcaatataggagagacgcttggcgaaaaatggaagtcaagactaaatgcactaggcaaatcagagtttcaaatctataagaagtcaggaattcaagaagttgacagaacgctagccaaagaaggaataaaaaggggagagacagatcaccacgcagtgagccgtggcagtgcaaaactaagatggtttgtagaaaggaacatggtaacaccagaaggcaaagtagtagatctagggtgtggtagaggtggatggtcatattattgcggaggcttgaagaatgtaagggaagtgaaaggattaactaagggaggaccaggacacgaagaacctataccaatgtctacatacgggtggaacttagtaaggcttcaaagtggtgttgacgtattcttcataccacctgaaaagtgcgataccctattatgcgacataggtgaatcttcaccaaatccaaccgtagaagcgggccgtactcttcgagtactcaatcttgttgaaaattggctcaacaataacactcaattttgtattaaagtcctcaacccttatatgccttcggttatagaaaagatggaagcccttcaacgaaaatatggcggagctttagtaagaaacccattatctaggaactcgacacatgaaatgtattgggtgtccaatgcatcaggaaatatagtatcttcagttaatatgatatcaagaatgttgataaatagattcactatgaggcataaaaaagcgacatacgagccagatgtagacctcggtagcggcacgagaaacataggcattgaatcagaaatcccaaatttagatattattggcaaacgtattgaaaagataaagcaggagcatgaaacctcatggcactacgaccaagaccacccatataaaacgtgggcctaccatggtagctacgagaccaagcaaacaggcagcgcatcatcaatggttaacggagtcgtacgcttattaaccaagccgtgggacgtattgccgaccgtaactcaaatggctatgacggatactaccccatttggtcagcagagggtgttcaaagaaaaagttgatacacgaactcaagagccgaaagaagggacaaaaaaactaatgaaaattaccgctgaatggctctggaaggaactaggcaaaaaaaagacacctagaatgtgtacgcgagaagaatttacgcgcaaagttagatctaatgcagctctcggggcaatttttacagatgaaaataagtggaaaagcgcgcgagaagcagttgaagactcacgcttttgggaactcgttgataaagaacgaaatttgcacttagaaggaaagtgcgagacttgtgtatataatatgatgggaaaacgagaaaaaaagctaggagaattcggaaaggcaaaaggttcaagagccatttggtatatgtggttaggcgctcgatttctcgaatttgaagctttaggtttcctaaatgaggatcactggttttcaagagaaaattccctgtcaggagtagagggagagggattacataaactagggtatatattgcgcgacgtgagtaaaaaagaaggtggtgccatgtacgcagatgatacagcaggatgggatacaagaatcacacttgaagacttaaaaaacgaagaaatggtaaccaatcatatggaaggtgaacacaaaaaactagctgaagcaatattcaagttaacctatcagaacaaagtcgtaagagttcagcgacctacaccacgaggtactgtgatggacattatttctaggcgtgatcaacgcggatcggggcaagtaggcacatatgggctaaatacatttaccaatatggaggctcaattgattcgtcagatggaaggtgagggtgtattcaaaaatattcaacatttaactgtcacagaagaggttgctgtacataactggctagcgagggttggaagagagcggttatcacgcatggcaatctcaggagacgactgcgtggttaaacctttagatgacagatttgcaaatgctttaacagcactaaacgatatgggaaaaatacgcaaagacatccaacagtgggaaccatcaaaaggttggaatgactggacacaagtaccattctgctcacaccactttcatgaattaatcatgaaagacggaagggtattagtcgtgccctgccgaaaccaggacgaactaattggacgggcgagaattagccagggcgcaggatggtcacttagagaaactgcatgcctcggaaaaagttacgcacaaatgtggtcgttaatgtacttccataggagggatctgagacttgcagctaacgcaatatgctctgcggttccgtcacattgggttccaaccagtagaacaacatggtcaatacatgcaaaacacgagtggatgacaacagaggatatgctaacagtatggaatagagtatggatacgagaaaatccctggatggaggacaaaacccctgttgaatcctgggaagagataccatacctaggaaaaagagaagatcaatggtgcggaagcctaataggtttaacttcaagagcaacttgggcaaaaaatattcaagcagcaattaatcaagttcgaagtcttatcggaaatgaagagtatactgactatatgccaagcatgaaaagattcagaagagaagaagaagaagcaggagtactatggtga

SEQ ID NO: 22822 - RNA, 9876 nt, synthetic construct
  misc_feature 1..9876: note = derived and/or modified CDS sequence (opt6) from DENV-2__FM210241__SS-prME
  source 1..9876: mol_type = other RNA
acagcaggagttattattatgttaatacctacagcaatggcatttcaccttactacgagaaatggcgaaccccatatgattgtagggagacaagaaaaaggaaaatcgctactgtttaaaacggaagatggtgtgaacatgtgcaccttgatggccatagacttaggagaattatgcgaagatacaataacttataaatgcccattattacgtcaaaatgaaccagaagatatagactgttggtgtaattctacatctacatgggtgacgtatgggacatgtacaacgacaggagaacaccggcgcgagaaaagaagtgtagctctagtcccacatgttggtatggggctagaaacaaggacggaaacttggatgtcttcagaaggcgcatggaaacacgcacagaggattgagacatggattctaagacaccctggatttacgataatggctgccattctagcgtacacaattgggacaacacacttccagagggcactaatatttatcttacttactgctgtagctccctcaatgacaatgagatgtataggtatatcgaacagagactttgtagagggagtttcaggtggaagctgggttgacatagtcctagaacacggttcatgcgtgacaacaatggccaaaaacaaaccaacattagatttcgaactaataaaaacagaggctaaacagccagcaacgttgcgaaaatactgtatcgaagcaaaattaacaaatacaacaacagagtctcgatgtcccactcagggagaaccgtcacttaacgaagaacaagataaaaggtttgtgtgcaaacactctatggttgacaggggatggggcaacggatgtggattatttgggaaaggtggaatagttacttgtgccatgtttacgtgtaagaaaaacatggaaggcaaaatagtacagccagaaaatttagaatatactatagtaatcacaccccactcaggagaagaacacgctgtcggcaatgacaccggtaaacacggaaaagaaattaaaatcacccctcaatcaagtataacagaagcggaactaacaggttatgggacggtcacaatggaatgttcacctaggacgggattagactttaatgaaatggtgctattgcaaatggaggataaagcatggcttgtacatagacagtggttcctagacctaccattgccctggttgcccggagcagatacacaaggcagtaactggatacaaaaagaaacattagtcactttcaaaaacccacacgccaagaaacaagacgtagttgtactaggatcgcaagaaggggcgatgcatacagcgctcactggagcgactgaaatacagatgagttcgggcaatttactatttacaggtcacctaaaatgtcgactacgcatggacaaactacagctaaaaggaatgtcgtattcgatgtgtactggtaaattcaaaatagtgaaagagatcgctgaaacacagcatgggacaatagtcataagggtgcagtacgagggggatggatcgccatgcaaaataccctttgagatcatggatctagaaaagaggcatgtactgggtcgattaatcacagtaaatcccatagtaaccgaaaaagattcaccagttaatatagaagcggaaccgccgtttggagacagctacatcataataggcgttgagccaggacaactgaaacttaactggttcaagaagggatcttccattggacaaatgtttgaaacaacgatgagaggagctaagaggatggccatactaggcgacactgcatgggacttcgggtccctgggaggagttttcacatccattgggaaagcattacatcaagtcttcggtgctatctatggtgccgcgttcagcggggtatcgtggaccatgaagatcttaataggcgctataattacatggattggcatgaactcaagatctacgagtttaagcgtaagcctcgtgctagtaggagtaataaccttatatctaggcgcgatggtacaggcggatagtggatgcgtggtatcctggaaaaacaaagagttaaaatgcggatcagggatttttataaccgataacgtgcacacatggaccgaacaatacaagtttcaaccagaaagcccgagtaaactggcatcggcgatacagaaagctcatgaagaaggaatatgcggaataagatcagtaacaaggctagaaaacctcatgtggaagcaaataacaccagagctaaatcatatactatctgaaaatgaagtaaaactgacaatcatgactggcgatataaaaggaatcatgcaggctgggaaaagatcattacgtcctcagccaacagaactaaaatattcttggaaaacttggggcaaagcaaaaatgctcagcaccgagtcgcataaccaaacttttctaatagacggacctgaaactgcagaatgtccaaatacgaaccgcgcttggaatagtttagaggtggaagattatgggtttggggtctttacgactaatatttggctcaaattacgagaaaaacaagatgtcttttgcgacagtaaacttatgtcagcggccataaaagacaacagagctgtgcacgctgacatgggatattggattgagtcggccttgaacgacacatggaaaatggaaaaagcatcattcatcgaagtaaaaagttgccattggccaaaatctcacaccctgtggagtaatggtgtattggaatcggaaatgattataccgaaatcatttgcgggacctgtcagccaacacaattatcgtccaggttactatacacaaacagcaggtccttggcacttgggaaaattagaaatggattttgacttttgcgaaggtacaactgttgtggttacagaagactgcgggaaccgtggtcctagcttacgaactacaaccgcatccggaaaattaattacggagtggtgctgtcggagctgtacacttccacccttacgatatagaggagaagacgggtgctggtatggtatggaaatacggcctttaaaagaaaaagaggaaaatttagtaaatagtctcgtaacagccggacacggccaaatcgataatttttcattaggggtactaggtatggcgttattcctagaagaaatgctacgaacaagagtgggaaccaaacatgcgattcttttagtagcagttagctttgtgacccttataactggaaatatgtccttcagagatttaggtagggtaatggtaatggttggagctacgatgaccgacgatataggtatgggagtaacctatctcgctttgttggcagctttcaaggttaggccaacatttgcagctggattattgctacggaaacttacttccaaagaattaatgatggcgactatagggatcgcattattatctcaatcaacaatacccgaaaccatattggaactaacagacgcactagccttaggaatgatggtcttaaaaatagtacgaaacatggaaaagtatcaactagcagttactataatggctatatcctgcgttccgaatgcagttattttacaaaatgcctggaaagtctcctgcacaatattggccgctgtctcggtctctccactgctgttgacaagctcacagcaaaaagcggactggattccactagccttaacgataaaaggtcttaacccaacggcaatattcctaacaactctatcaagaacgagcaagaaaaggtcgtggccgctgaacgaggcgattatggctgtaggtatggtctcaatcctggcaagtagtctgttgaaaaatgatatccctatgacgggacctcttgtcgctggtggtctactaacagtttgctacgtattaacaggacgctcagcagacttggagttagaaagagcaaccgatgtcaagtgggaggatcaagcagaaatttctggatctagccctattctaagtattacaatcagtgaagatgggtccatgtccatcaaaaacgaggaagaagaacagacattaacaattttaatacgtactggtttattagtcataagcggattgtttcccgtcagcatcccaattactgcagcagcatggtacctttgggaagtgaagaaacaacgagcaggggtgttgtgggacgtcccatccccacctcctgtgggaaaggctgaacttgaagatggcgcttataggataaagcaaaaagggatactgggatattcgcagataggagcaggagtatataaagaaggaactttccatactatgtggcatgtaacacgcggcgcggtactcatgcacagaggaaaaagaattgaaccaagttgggccgacgttaagaaagacttaatatcttacggtggtgggtggaaattagaaggcgaatggaaggaaggagaagaagtgcaagtattagctctagagcctggcaaaaacccaagagcagtacaaacaaaacctggcttatttaaaacgaatacaggtactattggtgcggtaagcctagatttcagcccagggacaagcggatcgccaatagttgatcgcaaaggaaaagtggtgggcttatatggcaatggtgtggtcaccagatcgggggcgtacgtcagcgcaatcgcccaaacagagaaaagcatagaagataacccagaaatagaagatgatatattcagaaagaaacgattaacaattatggacctacatcctggtgcaggtaaaaccaagcgatatctacctgccatcgtgagagaggcgataaaaagaggtctgagaaccttaatattagcaccaacaagagtagttgcggccgaaatggaagaagcattaagaggtcttccaatccgataccaaactcctgcaataagagcagaacatacgggaagggagatcgtagacttgatgtgtcatgcaacgtttactatgcgtttattatcccccgtcagggtaccaaactacaaccttatcatcatggatgaagcccatttcacagatccagcgtccatagcagcgcgaggatacatttccactagagtggagatgggagaagctgcaggaatttttatgacggcaacgcccccgggttcacgggacccgtttccccaaagtaatgcaccaataatcgacgaagaacgagagataccagaacgcagctggaactctggccacgaatgggtgaccgattttaaagggaaaactgtatggttcgtgccttcaatcaaggcaggtaacgacatagcagcgtgtctacgtaaaaatgggaagaaagtcatccaattgagtcgaaagacattcgattcagaatacgttaaaactaggacaaatgattgggattttgttgtaactacagatattagcgaaatgggcgctaattttaaggccgagcgcgtaatcgatcctcgccgatgcatgaagccagtcatacttacagatggagaagaaagagttatccttgcaggtccaatgcccgttactcatagctcggcggcccaaagaagaggtagaataggaagaaatcccaaaaatgaaaacgatcaatacatctatatgggagaaccattagaaaatgacgaagactgtgcacactggaaagaggcaaagatgttattagataatatcaatacacctgaaggcataattccttcgatgtttgaaccagaacgggaaaaagtagacgccatcgatggagagtatcggcttaggggagaggcccgcaagacctttgtagatcttatgagaagaggagacttacctgtgtggctagcctatcgcgtcgcagcagaaggcattaattacgcagacagaagatggtgctttgatggggttaaaaacaatcaaatactcgaagaaaatgttgaagtggaaatatggactaaagagggagaaaggaagaaattaaagcctagatggttggatgcaagaatatattcggatcctttagcgctgaaggagttcaaagagttcgcggcgggaagaaaaagcctcactttaaacctgatcacagaaatggggcgtttgcccacctttatgacacaaaaagctagggatgcattagataacctagcagtcctccacacagctgaagccggtgggagagcctacaatcatgccttgtctgaactccctgagacactagaaacactgctactactcacactattggccaccgtaacaggaggaatatttttatttcttatgtcaggtaaaggagtaggaaaaatgaccctgggcatgtgttgtataattacagctagcatactcctctggtatgcgcagattcagcctcactggatagcagcgagtattattttggagttctttctaatagtattattgattcctgaaccagaaaagcaacgaactcctcaagacaaccaattaacttacgttgtcattgccatattaaccgtagttgcagcaacgatggccaatgaaatgggattcttagaaaagaccaagaaagacctaggattggggtcgattgcaacccaagaaccagagtctaatatactagatatagatttacgacctgcatctgcctggacattgtatgctgtagctacaacattcgtcaccccgatgttacgtcactcaatcgaaaactcctctgttaatgtgagcctaacggctattgcaaaccaagcgaccgtcttaatgggcttaggtaaaggctggccactttccaaaatggacattggggtgccactcttagccattggctgctatagtcaggttaatcctataacacttaccgcagcgttattatcgctaattgcacactacgctattataggacccggactacaagcgaaagccaccagagaagcacaaaagcgagccgcagccggcataatgaagaacccaacggtcgatgggattactgtaattgacttagacccaataccttacgatcccaaattcgaaaaacaactcggtcaagtgatgctactcatattatgtgtgacacaagtcctaatgatgaggacaacatgggccttatgtgaagcactaaccctagcaacgggtccaatctctaccctctgggagggtaatcccggaaggttttggaatacgacgattgctgtatcgatggctaatatattccgagggtcctacttagcaggggctgggctcctattttccattatgaaaaatacaacaaatactagaagaggaaccggaaacataggagaaactcttggtgaaaaatggaagtctaggctaaatgcccttggaaaaagtgaatttcaaatttataaaaagagtggtatacaagaagtagatcggactctagccaaagaaggaatcaaacgcggagaaactgaccaccacgccgtatctcgtgggtcggcaaagctaaggtggttcgtcgagaggaatatggtaacgcctgaaggaaaagtagtagacttaggatgcggtcgcgggggatggagctactattgtggaggtctgaagaacgtccgagaagttaaaggtcttactaaaggtggccctggacatgaagaaccaatacccatgtcgacatatggatggaacctagtaaggctgcagagtggtgtcgacgtatttttcactcccccggaaaaatgcgatactctcctttgcgatataggagaaagttctccaaatcccacgatcgaagcaggcagaaccttaagggtcctcagcctagtagagaactggctgaacaacgatacacaattctgtataaaagttttaaatccatatatgcccagtgtcattgagaagatggaaacattacaaagaaagtacggcggagcattagttagaaatcctctaagcagaaacagcacccatgaaatgtattgggtcagtaacgcaacaggaaacatcgttagttcagttaatatgatttcgagaatgttgatcaacaggtttacaatgaaacataagaaagctacatatgaaccagatgtagacttaggcagcggtacaagaaatataggtatagaatcggaaatccccaacctcgatataattggcaaacgcatcgagaaaataaaacaagaacatgaaacaagttggcactatgatcaagatcatccatataaaacatgggcataccatggttcatatgaaaccaaacaaacaggatctgctagttcaatggtcaacggcgtcgtgagactattgacaaagccttgggacgtagtcccaatggttacgcaaatggcgatgacagataccacaccgtttggacaacagcgagtctttaaagagaaggtcgacacaagaacacaggagccaaaagaagggaccaaaaagttaatgaaaatcacagcagagtggctatggaaagaactaggtaagaagaaaacaccacgaatgtgtactcgcgaagaatttaccaggaaagtaaggagcaatgctgcgttaggagcaatttttactgatgaaaacaagtggaaaagcgcacgagaagcagttgaagattcacgtttctgggaactggttgacaaggagcgaaaccttcaccttgaaggcaaatgtgaaacttgcgtatacaacatgatgggaaagagagagaagaaacttggagagttcggaaaggccaagggatcacgagccatatggtacatgtggctgggagcacgctttttggagttcgaagcattaggatttcttaacgaggaccattggttttcacgcgaaaattcgctatcaggagtagaaggagaaggattgcataagttaggatatatattacgtgatgtttctaagaaagaaggtggggccatgtacgcggatgatactgcaggttgggacaccagaataactcttgaagacctcaaaaatgaagagatggttacaaatcatatggaaggcgaacacaaaagattggctgaagcaatatttaaacttacttaccaaaataaagtagtaagagtccaacgacctactccacgcggaacagtgatggacattatatcacgccgagaccaaagagggtcagggcaagtaggtacatacggccttaatacattcacaaatatggaagcacaatttataagacagatggagggcgaaggaattttcaagagcatacaacacctaacagttaccgaggagattgccgtccaaaattggcttgctcgagtaggacgtgaaagattaagtagaatggcaattagcggtgatgactgtgttgtaaaaccgctagacgatcgtttcgcttcggcccttactgctctaaacgatatgggcaaagttaggaaggacatacaacaatgggagcctagtaaaggatggaacgattggacacaagtgccattctgttcacatcattttcacgagctaataatgaaagatgggagagttttagtggttccttgtaggaatcaggacgaactgattggaagggcgcgaatatctcaaggcgcgggatggagtcttaaggaaacagcgtgcctaggaaaatcgtacgcacaaatgtggtcattaatgtacttccaccgaagggatttgcggcttgccgcgaacgccatctgttcagcagtgcccagccattgggttcccacaagtcgaacgacgtggtctattcacgctaaacacgagtggatgaccacagaggacatgcttactgtctggaatagggtttggatccaagagaacccatggatggaagataaaacccctgtcgaatcttgggaagaagtaccatacctaggaaagagagaggatcaatggtgtggatccttgataggactcacaagtcgggctacatgggctaaaaatatccaaacagctatcaatcaggtgagaagcctcatcgggaatgaagaatacactgactatatgccatctatgaaaagattcagacgagaagaagaagaggctggggtattgtggtaa

SEQ ID NO: 22823 - RNA, 9876 nt, synthetic construct
  misc_feature 1..9876: note = derived and/or modified CDS sequence (opt6) from DENV-2__FM210242__SS-prME
  source 1..9876: mol_type = other RNA
agcgcggggatgattataatgctaataccaaccgttatggcttttcacctgaccacacgaaatggcgaaccgcacatgattgtaggaatacaagaaaaaggtaaatcccttttatttaaaacagaagatggtgtaaatatgtgtacgctaatggctatggatttgggagaattatgtgaagatacaataacttataaatgtccactattacgacaaaatgaacccgaagatatagattgttggtgcaatagtacttccacctgggttacatacgggacatgtacgactacgggagaacatagacgggagaaaagatcggttgcacttgtgccacacgtaggaatgggactcgaaacgcgcactgaaacctggatgagttcagaaggtgcatggaaacatgctcagagaatagaaacatggatactaagacatcctggatttacaattatggcggcaattttggcttatacaatcggaacgactcattttcaaagagtccttatatttatactattaacggcagtcgcgccaagcatgaccatgagatgtattggaatatccaatcgggactttgttgaaggcgtatctgggggttcatgggtagacatcgttttggaacatggtagttgtgtaactaccatggccaaaaataaacccacactagattttgaactaattaaaaccgaagcaaaacaaccagctaccctgcgcaaatactgtattgaagcaaagctaactaacactacgactgaatctagatgtccaacccaaggcgagccgagtctaaaagaggagcaagataagaggttcgtttgtaaacatagcatggtagacagaggatggggaaacggatgcggactatttggtaaagggggaatagtcacatgcgcaatgttcacatgcaagaaaaacatggaaggaaaaatcgttcaaccagaaaacttggagtatactatagtggtcactccacattcaggcgaggaacacgcagttggtaatgacacgggaaaacatggcaaagaaataaaagtcactccacaatcatcgataacagaagcagaactaaccggttatggaactgtcacaatggaatgttctccgcgaacaggtctagacttcaacgaaatggtcctgttacagatggaaaacaaggcttggttagttcatcgacaatggttcctcgatttacctctcccctggctccctggcgctgataaacaggagagtaattggatacaaaaagaaacacttgtgacatttaagaatccgcatgcaaagaaacaggacgtagtagtcttaggatcgcaagagggtgcaatgcatacagcgctgacaggcgcgacagaaatacaaatgtcatcgggcaatcttctttttacaggacatttgaaatgcaggttgcgtatggataagttacaacttaaaggaatgtcttatagcatgtgtacaggaaaattcaaggtggtaaaagagattgctgagacacagcatggaactattgttatacgtgttcagtatgagggagatggcagtccatgtaaaataccattcgaaataatggacttagaaaaacgatatgtactaggtaggctcatcacagtaaatccaatcgtaacagagaaagattctcctgttaacatagaagcggaaccaccattcggagacagttatataataatcggagtagaaccaggtcaacttaaacttaattggtttaaaaaggggagtagtattggtcaaatgttcgagactacgatgcggggagcaaaaaggatggcaatcctaggagatacagcatgggattttggtagtctaggtggcgtgttcacttcaataggtaaagcactgcaccaagtgtttggtgctatatatggagcagcattcagtggagtaagttggacaatgaaaatactgataggcgtcataatcacctggataggaatgaactctagaagtaccagcctgagtgttagccttgtcttagtgggaatcgttacgctatatttaggtgtcatggtacaagctgattcaggatgcgtagtgtcctggaaaaataaggaattaaagtgtggatctggaatttttataacagacaatgtacatacgtggacagaacagtacaaattccaaccagaaagcccgagtaaattggcatcagcgatacaaaaggcccaagaggagggcatatgtggtatccgttcagtaacaaggttagagaacctgatgtggaaacaaatcacacctgaattaaaccacatcctagctgagaatgaagttaaacttactatcatgacaggagacataaaaggaatcatgcaagcaggaaaacgaagtctccgacctcaaccaacagaattgaaatattcatggaaaacatgggggaaagcaaagatgctaagtacagaatcttacaaccaaacgttcttaatcgatggacccgaaacagcagaatgtccaaatacaaacagagcctggaactcactggaagtagaagactatggattcggagtttttacgacaaatatatggctaaaattaaaagaaaaacaagatgcattttgcgattcaaaactaatgagcgcagcgatcaaagataacagggctgtccatgcagatatgggttactggatagaatctgcacttaatgatacctggaaaattgaaaaagccagcttcatagaagtgaaaaattgtcactggccaaaatcgcacacgctgtggagtaatggcgtactcgaatcggagatgataataccgaagaacttagctgggccggtgagtcagcataactatcgtcctgggtatcatactcagatcgcgggaccctggcacctcggtaaactagaaatggattttgacttctgcgatggaaccactgtgatagtaacagaagattgtggaaataggggaccttcattacgtactacaaccgcaagcggaaaacttataacagaatggtgttgccgaagttgcacattaccacctttgcgttatcggggtgaagacggctgctggtatggaatggaaataagaccgctcaaagagaaggaagaaaatctcgtaaattctttagtaaccgcaggtcatggacaagtagataattttagtttaggagtactcggcatggcactattcttggaagaaatgttaaggaccagggttggaacaaaacacgcgatcttgctagtggcagtctcttttgttactctaataactggaaatatgtcctttaaggacctaggtagggtagttgttatggtgggtgcaacgatggccgatgatattggaatgggagttacttatcttgcattgttagctgcttttaaagtgcgtccgacattcgcagccggattgttactaaggaagctgacaagcaaagaattaatgatgacaacaatcggaatagttttgttaagtcaaagcactatccccgagacggtgttggaattaaccgatgcgctagcattagggatgatggttttgaaaattgttagaaacatggaaaaatatcaacttgccgtaacaattatggctatcctatgtgtacccaatgcagtagtcttacaaaatgcttggaaagtatcctgcacaattttagccgtagtatcagtaagcccgctactacttacaagttcccagcagaaaactgactggattccgctagcattaactattaaaggtttaaaccctactgcaatatttctaacaacactcagcagaacaaataagaaacgtagctggcctctaaatgaggccataatggctgtcggaatggtatccatcctggctagcagcttactgaaaaatgatattcctatgacaggacccctagtagctggaggtttactaacagtatgctatgtgctgacaggaagaagcgctgatctagaactggagagggcgactgacgtaaaatgggaagatcaagcagaaatctcagggagcagtcctatcctttcgatcacaataagcgaagacggatcaatgtcgatcaaaaatgaagaagaagaacaaacattaacaatactaattagaactggtttattagtaataagtggacttttccccataagtattccgatcactgctgccgcttggtacctgtgggaagtaaagaaacaacgagctggggtcctgtgggatgtaccgtcaccaccaccaatgggcaaagctgagctagaagacggggcataccgaatcaaacaaaaagggatacttgggtattcgcaaattggagcgggagtgtacaaggaaggtacatttcatacaatgtggcacgtcacaagaggagccgtattgatgcataaaggaaaaagaattgagcctagttgggcagacgtcaagaaagacttgataagttacggcggaggttggaaattggagggagaatggaaggaaggagaagaagtacaggtcttggctctggaacccggcaagaacccgcgtgcagtacaaacaaaaccaggattattcaagacaaatacaggtacaataggagccgtatctcttgatttctcaccaggaacctcaggaagtccaataatagataagaaaggtaaagtggtaggtttatatggtaatggtgtagtcactagaagtggagcctatgtctctgcaatcgcccagacggaaaaatcaatagaggataaccccgagatcgaagatgacatctttaggaaaagacgtctcacaattatggatcttcatcctggagccggcaagacgaaaaggtacttgcctgccattgttagagaagcaataaaacgcggactaagaactctaatattagctcctacaagagtggtggccgcggagatggaggaggcacttcgaggtctccccataagatatcaaacaccagctatcaaggctgaacacaccggtagagaaattgtagacttaatgtgccacgctacatttacaatgcgattacttagtccagttagggttccaaattataatttaataataatggacgaagctcatttcaccgatcccgcatcaatagccgcaagaggttacatcagtacacgagtagaaatgggggaggccgcaggtatcttcatgacagctacacccccagggtccagagatccatttccacaaagcaatgccccaataattgacgaagaaagagagatccctgaacgaagctggaactcaggtcatgaatgggttacggattttaaaggaaaaacggtctggttcgtccccagtatcaaagccggtaacgacatagcggcatgcttacgtaaaaacggaaagaaagttattcaactatccagaaaaacgtttgactcagaatacgtcaaaacgcgaacgaatgattgggatttcgtggtaaccacagacattagcgaaatgggagcgaatttcaaggcagaacgtgttattgatcctagacgatgtatgaagcctgtaatactaaccgatggagaagaacgagtcatattggctggacctatgccagtcacacactcttcagcagcccaaagacgagggcggattggtagaaaccccaaaaatgaaaatgatcaatacatctatatgggggaaccactggaaaatgatgaagattgtgctcactggaaagaagcgaagatgcttcttgataatataaacactccggaagggattatcccgagcatgttcgaacctgagagagaaaaagtagacgcgattgatggcgagtatagactccgcggggaggcacgaaaaacattcgttgacctaatgagaaggggagacctacctgtatggctagcgtataaggtagcagctgaagggatcaactatgccgatagacggtggtgcttcgacggaatcaaaaataaccaaatactagaagaaaatgtagaagtagaaatatggacgaaagaaggtgaaaggaagaaattaaaaccacgatggttagacgctaggatctatagtgatcctctggcactaaaagagtttaaggagttcgccgccggacgcaaatcgttgacattaaatctcataacagaaatgggaagattaccaacatttatgacgcagaaaactagggacgcgctcgataatctcgcagttttacataccgccgaggcaggcgggcgagcatataatcatgctttgagcgagttgccagagacattagaaactcttttattgttgactctacttgcaaccgtgacgggtgggatttttcttttcttaatgtcaggcagaggaatcgggaagatgaccttaggcatgtgctgtatcataactgccagcattttgttgtggtacgcgcaaatacaacctcattggattgcagcatccataatactagagttctttctaattgtactactaattccagaacctgagaaacagcggactccacaagataatcaattaacttatgtcgttatagctatattaacagtagtagcagcaaccatggcgaatgaaatggggttcttagagaaaacaaagaaggacttgggcctaggaagtatagcaacacaacaaccagagagcaacatcctggacatcgacttacgaccggcatcggcatggaccctttacgcggtggctacaactttcgttacaccaatgctgagacacagcatagaaaattcaagtgtaaacgtctcactaacggcaatagcgaaccaagcaactgtacttatggggctgggcaaaggctggccactgtcgaaaatggacataggtgttcctttattggctatcggctgttattcccaagtaaatcctataacgctcactgctgccctattattactcgttgcgcattatgcgataattgggcccggtctacaagcgaaagctacgagagaagcccagaagagagcggcagccggaataatgaaaaatcccacagtggatggtattacggtaatagatttagaccccatcccatacgaccctaaatttgagaaacaactaggacaggtaatgctattaatcttatgtgtgacacaagtactcatgatgaggactacctgggcactctgcgaggccctgacgttagccaccgggccaatctcgacactttgggaaggaaacccgggtcgcttttggaatacgacaatcgccgtttcaatggcaaatatatttcgtggatcgtacctcgctggtgctggccttctattcagcatcatgaaaaatacaacgaacacgaggcgtggaacaggcaatataggcgaaacgctaggtgagaagtggaaatccaggttaaacgcactgggaaagagtgaatttcaaatatataagaaatcaggaatacaagaagtagatagaacactagccaaagaaggtataaaaaggggagaaaccgaccatcatgcagtttctcgagggtcagcaaaactgcgatggtttgtagagcgaaacatggttactccagagggaaaggtggtagatttgggatgcggtagaggcggctggtcatattactgtgggggactaaaatcggttcgagaggtaaaggggttgacaaaagggggaccgggtcatgaagaaccaataccaatgtcaacttatgggtggaatctcgtaagattacagagtggtgtcgacgttttcttcataccacccgagaaatgtgatactctattatgtgatatcggagagtcatcaccaaatccaactgtagaagcaggccgcaccttaagagtattaaatttagtcgaaaattggttaaacaataatacccaattttgcatcaaagtattaaatccttacatgccctcagtcatcgagaaaatggaagcacttcaacgaaaatatggcggagcgttggtaagaaatcccttaagccgaaattcgactcatgagatgtactgggtatcaaacgcgtcaggaaatatagtaagctctgtcaacatgatatcacgaatgctaattaatagattcacaatgaggcacaagaaagcgacatatgaaccagatgtagacttaggctcgggaacgcgaaatattggcattgaatcggagattcccaacttagatattattggaaagagaatcgagaaaattaaacaagagcatgaaacgtcgtggcattacgaccaggatcacccttacaagacgtgggcctatcatggctcctacgagactaagcaaacaggtagcgcatcgtcaatggttaatggcgttgtaaggttactaacgaaaccttgggacgtactcccaacggtcacgcaaatggcaatgacagatacaaccccatttggacaacagcgagtgtttaaagagaaagtagacacccgaactcaggaaccaaaggaaggcacaaagaaattgatgaaaataacggcggaatggctttggaaggaactgggtaagaagaaaacaccacgaatgtgtacgcgggaagagttcacaagaaaagtacgatcaaacgcagctcttggggcaatattcaccgacgaaaataaatggaaaagtgcacgtgaagcagtcgaagacagccggttttgggagctagttgacaaagaaagaaacctacatcttgaaggtaaatgtgagacatgcgtttacaatatgatgggcaaacgagagaagaaattaggagagttcgggaaggcaaaaggaagtagagcaatctggtatatgtggttaggtgcacgatttctggaatttgaggccctgggatttttaaatgaggaccattggttctctagagaaaattctctaagcggagtagaaggagaagggcttcacaaactggggtacatacttagggatgtgtcaaagaaggaaggtggggcaatgtacgctgatgatactgctggttgggataccagaataacattggaagatctcaaaaatgaggaaatggtaaccaatcacatggagggtgagcacaagaagctagccgaggcaatctttaaactaacatatcaaaataaagtagttcgagtgcaacgtcctacgccaaggggaaccgtaatggatatcatctcaagacgtgaccagcgaggtagtgggcaagtagggacatatggattaaatactttcacaaatatggaagcgcagttaataagacaaatggagggagaaggggtttttaagaacatacagcatttgacagtaacagaagaagttgctgtgcaaaactggctagcccgtgtagggagagaacgtttatctagaatggctatcagtggtgacgattgtgtagtgaaaccgctggatgacagattcgcaaatgcactaacagcactaaacgacatgggcaagatcaggaaggacattcaacagtgggagccttccaaaggttggaacgattggacacaggtaccattttgttctcatcactttcatgaactaataatgaaagacgggagagtactcgtagtcccctgcagaaatcaagatgaattgatagggagggcacgtattagtcaaggcgcaggttggtctctcagagagactgcctgcttaggaaaaagttacgcacaaatgtggtcactaatgtattttcatcggagagatctacgactagcagcaaatgcgatatgcagtgcggtaccaagccattgggtaccaacctcacgaacaacttggagcatacatgcaaaacatgaatggatgacaactgaagacatgctcacagtttggaatagagtatggatacgagaaaatccctggatggaagataagacaccagtggaaagttgggaagaaataccttacttaggtaaacgagaagaccaatggtgtggatcattaataggacttacttcaagagcaacgtgggccaaaaatatacaagcggcaattaaccaagtccgtagcttgataggtaatgaagaatacaccgattacatgccctcgatgaaacgatttcgtcgagaagaagaagaagctggtgttctttggtag

SEQ ID NO: 22824 - RNA, 9876 nt, synthetic construct
  misc_feature 1..9876: note = derived and/or modified CDS sequence (opt6) from DENV-2__FM210243__SS-prME
  source 1..9876: mol_type = other RNA
actgcaggagtcattataatgttaatacctacagcaatggctttccatctgaccacacgaaacggcgaacctcacatgatagtaggacgccaagaaaaaggcaaatcattgctattcaaaactgaagatggggtgaacatgtgtacattaatggcaatagacctaggagaattatgcgaagatacgatcacatacaaatgtccgctactccggcaaaatgaacctgaagacatcgattgttggtgtaactcgacaagtacatgggttacatatggaacctgcacaacgacgggcgaacatcggagagaaaagagaagtgtggcgctagtaccacatgtggggatggggctagaaactagaacagaaacatggatgagttcagaaggcgcatggaaacatgcacagcgtatagaaacctggatattaagacatccagggtttactataatggcagcaattttggcatatactgtcggtacaacacactttcaaagggcattaatttttatactgttagctgcagtagcaccatccatgacgatgagatgcataggcatcagtaatcgagattttgtcgaaggcgtttccgggggatcatgggtcgatattgtactagaacatgggagttgtgttaccacaatggccaaaaataaacctacacttgattttgaacttattaaaacagaagcaaaacaaccagcaactttgcgaaaatactgcattgaagcaaaactaaccaatactacgacggaatcgcgatgccccacccagggcgagccatcacttaacgaggaacaagacaaaagatttgtctgtaaacattcaatggtcgatagaggatggggtaatgggtgtggacttttcggtaaagggggaattgtaacttgtgcgatgtttacatgcaagaaaaacatggaaggaaaaattgttcaacctgaaaatctcgaatacactatagtaataactccacatagcggagaggaacatgctgtgggcaacgacactggcaaacacgggaaagagataaaaattacaccccaatcatcaataactgaagcagagctcacaggttacggaactgtaacgatggagtgtagtccaaggacgggccttgatttcaatgaaatggtcttactccaaatggaagacaaagcgtggttagtccaccgccaatggtttctagacttgccactaccatggttaccaggcgcagatacacagggaagtaactggattcaaaaagaaaccctagttacattcaaaaatccacatgcgaagaaacaagacgtagttgtattaggttcacaagaaggggcaatgcatactgcgctgacaggggcaacggagattcaaatgtcctcaggcaatttgttgtttacaggtcatttaaaatgccgcttgagaatggacaaactccaactgaaaggaatgagctacagtatgtgcactggaaaattcaaaattgtaaaagagatcgccgaaactcaacatggaacaattgtaattagagtccagtacgaaggtgatggatccccttgcaaaataccgttcgaaataatggatctagagaaaaggcatgtcctcggaagactaataacagtaaatccaattgtcacggaaaaagactctcccgtaaatatcgaagcagaacctccgttcggagatagctatattatcataggcgtagaaccaggtcagctgaaacttaattggttcaagaaaggtagttcgatcggacagatgtttgaaacaacgatgagaggtgcgaaacgaatggctatattaggggatacggcatgggacttcggatcactcggaggtgttttcactagcattggtaaagccttgcatcaagtatttggagccatatatggagctgcattctctggcgtctcatggactatgaaaatattgattggtgtaattatcacctggattgggatgaactctcgttccaccagcctatcagtcagtttagttctggtgggcataataaccctttatcttggagcaatggtccaagccgattccggatgcgttgtaagctggaaaaataaagaactcaaatgtggttctggaatattcataacggacaatgtgcatacttggaccgaacagtacaagtttcaaccagaatccccgtcaaaattagcaagcgcaattcaaaaggcacatgaggaagggatctgtgggattagatccgtgacacggttagaaaacctaatgtggaaacaaatcacaccagaactaaatcacatcctttcagaaaatgaggtaaagttaaccataatgacaggcgatataaaaggtattatgcaggcaggtaaaagatcattgcgcccgcagccgacagaactaaaatactcatggaagacatggggaaaagcgaaaatgttatctactgaatctcataaccaaacatttttgatcgacggacccgaaaccgccgaatgtcctaatactaatagagcttggaactcgctcgaagttgaagactacggatttggagtcttcacaacaaacatatggctaaaactcagagaaaaacaagacgtattctgcgattccaagttaatgagcgcagcaataaaagacaatagagccgtacatgcggatatggggtactggattgaatctgctttaaacgatacatggaaaatggaaaaggcttcattcattgaagtgaaatcgtgtcactggcccaagtctcatacactatggtcaaacggagtcttggaaagtgaaatgataataccaaaaagttttgcaggcccggttagccaacataactacaggccgggttactacacacaaacagcggggccatggcatcttgggaaactggaaatggattttgatttctgcgaaggtacaacggtggttgtaaccgaagattgcggcaatagaggtccctcattaaggacaactactgctagcggcaagttgattaccgagtggtgctgtcgatcatgtacattacctccgttacgttatcgaggtgaggatggttgctggtatgggatggaaattaggccattaaaagaaaaagaggaaaatttagtaaattcgctcgttacggctggccatggtcaaatcgacaatttcagtctgggtgtgctaggaatggccctattcctagaggaaatgttacggactagagtaggtacgaaacacgccatcctcctagtgaccgtcagctttgtaacattgatcacgggtaacatgtcgtttagagatttaggtagggtcatggtcatggttggtgcagcgatgactgacgacatagggatgggggtaacttacttagcattactagcggcgttcaaggtacgacccactttcgctgcggggctcttactcagaaagttgaccagtaaagaactgatgatggctacaattgggattgccctactatcgcaatcaacaataccagagacaattctagaactcacagacgcgctagcactaggaatgatggtattgaaaattgtccgcaacatggaaaagtaccaattagctgtaacaataatggcgattagttgcgtgccaaatgccgtaattcttcaaaacgcttggaaagtgagttgcaccatcctggctgcagtatcagtttttccattattgctaacgagcagtcagcaaaaagcagactggattcccctcgctttaacaatcaagggactcaatccaacggccatttttctaacaacattatctcgaacgagtaagaaaagatcttggccactaaatgaggcaataatggcagtaggcatggtttcaattctcgcaagctcactactcaaaaatgacataccaatgactgggcccttggtagcaggaggacttctaacggtatgctacgtattaactggacggtcggcagacttagagctcgaacgtgctactgacgtaaaatgggaagatcaggctgaaatatcaggatcatcccctatattgtctataacaatagccgaagatggctcaatgtctatcaaaaatgaggaggaagaacaaacattaactattctaataagaactggactgctagttatatccgggctgttcccagtatcgatacctataacagcagccgcgtggtacctctgggaggtcaagaaacaacgagccggagtattatgggatgtaccttccccaccacccgttggcaaagctgaactggaagacggagcataccggatcaagcagaagggtatccttggttattctcaaataggcgcgggtgtatacaaagaggggacattccataccatgtggcacgtaactcgcggcgcagtattaatgcatcggggtaaacgaatagaacctagttgggcagacgtaaagaaggatttaatatcctatggcggtggatggaaattagagggagaatggaaagaaggtgaagaggtacaagtattagcactcgaacccggcaagaacccaagggcagtccaaacgaagccaggtttgttcaagacaaacacaggtaccataggtgcggtgtcgcttgattttagcccgggaacaagtggatctccaattgtagacagaaaagggaaagtagttggtctatacggtaatggtgtggtaactaggtccggagcatatgtatctgcaatcgcacaaacagagaaaagtatcgaagataatccagaaatagaagatgatatatttaggaagaaacggctgacaataatggacctacatccaggggccggcaaaacgaaaaggtacctccctgcaatcgtacgagaagctattaaacggggactacgcactctcatattggctccaacgagagtagttgcggctgagatggaagaagccctcaggggtctgcccataagatatcagactcctgcaattagagcagaacacacaggtcgagaaatagttgatctaatgtgccatgctactttcacaatgcgattactttcaccggtgagagtacctaattacaaccttataatcatggacgaagctcactttactgatccagcgagtatcgcggcaaggggttatattagtaccagggtggagatgggggaagcagcaggaatttttatgacagctacgccacccggtagcagggacccgtttcctcaatctaatgcacccattatggatgaagaaagggaaattcctgaaagaagttggaatagtggtcacgagtgggtaaccgattttaaaggaaaaacagtttggttcgttccatccataaaagcaggtaacgatatcgccgcgtgtctaaggaagaacggcaaaaaggtaatccagcttagcaggaagacattcgacagtgaatatgttaaaacaagaactaacgattgggattttgtcgtaactacggatatatcggagatgggtgccaatttcaaagcggaacgcgttattgatccccgacgctgcatgaaaccagtcatcctcacagatggtgaagaacgtgttatattagcgggcccaatgcccgtaacgcacagttcggcagcacaacgaagaggtcggataggtagaaaccctaagaatgaaaatgatcaatacatttatatgggggagcccctagaaaatgatgaagactgtgcgcactggaaagaagccaaaatgttattggataacattaatacccccgaaggaattataccctcaatgttcgaacccgaaagggaaaaagtagatgcgattgacggggagtatagattaagaggagaagcaagaaaaacattcgtagatcttatgagaagaggggatttacccgtctggttagcatatcgagttgcagctgaaggtataaactacgcagatagacgttggtgcttcgatggagttaaaaataatcaaatactagaggaaaacgtagaagtagaaatctggacaaaggaaggggagaggaagaaattgaaaccacgatggttagacgccaggatatactcagatccacttgcattaaaagagttcaaagaatttgcggccggaagaaaaagtttaactctcaaccttataacagaaatgggcagactaccaacgtttatgactcaaaaggcacgtgacgcactagacaatttagcagttttacatacagcagaagccggtggcagagcttataatcacgcgttgagcgagctacctgaaaccctcgaaacgttacttctcctaactttattggccacagtaactggtggaatatttctattcttaatgtctggaaaaggtgtcggcaaaatgacattgggaatgtgttgcataataactgcctcaattttactatggtatgcacaaatccagccccattggattgcagcaagtatcattttggagttctttttaattgtactattaattccagaaccagaaaaacaaagaacaccacaagataatcaattgacttacgtggtaattgcaattttaacagtagtagctgctactatggcaaatgaaatgggattcttagagaaaacgaagaaagaccttggattagggtcaatagcgacccaagagcctgaatcaaatatactagacatagatttacggccggccagtgcttggacactgtatgcggttgcgaccacgtttgtgacaccaatgctacggcatagtatcgagaatagcagtgtgaatgtttcccttactgctatcgccaatcaagctaccgtattgatgggtcttggcaaaggctggccactatccaaaatggacattggtgtgccacttcttgcgataggctgctattcccaagtaaacccaattacgctaactgcagcattgctgctattggtagcgcattatgctatcattggtcccgggcttcaagcaaaagcaactagagaagcacaaaagcgagccgcggccggcataatgaaaaacccaactgtagacggaataactgttatagacctcgatcctatcccttacgatccaaaatttgaaaaacaactaggacaagtgatgctcttaatactgtgcgtgactcaagtattaatgatgaggaccacatgggcattatgcgaggctctaacgctcgcaacaggaccaataagtactctgtgggagggaaatccaggaagattttggaataccacgattgcagtatccatggcgaatatatttagaggtagctatctagccggtgcaggattgctattctctataatgaaaaataccactaatacgaggcgcggtactggaaacataggagaaacactcggtgaaaaatggaagagtagactaaatgcactgggaaaaagtgagttccaaatctataagaaatctggcatacaagaggtggacagaaccttagctaaagaagggataaaaagaggtgaaactgaccatcacgccgtgagccgaggttctgcgaaattacgatggtttgtcgaaagaaatatggttaccccagaaggaaaagtagtggacttaggatgtgggagaggaggttggtcatactattgcggcggtcttaaaaacgtacgcgaagtaaaaggacttacaaaaggaggccccgggcacgaagaacctataccaatgtctacatatggatggaatcttgttagacttcaaagtggggtggatgtatttttcactcccccggaaaaatgtgatacactactctgtgacataggagaaagttcccccaaccctacgattgaggcaggaagaacactgagagttttaagcctagtagaaaactggttaaacaatgacacccaattttgtatcaaggtattaaatccgtatatgccaagcgtcatagagaaaatggagacgctccaaagaaagtacggaggagcactcgttaggaacccactatcgagaaattcaactcacgaaatgtattgggtatcaaatgcaacaggaaatattgtctctagtgtgaatatgatttcacgaatgttaattaacagatttaccatgaagcataagaaagctacatatgagccggatgtagatctcggtagtggaacacgcaacattggtatagaaagtgaaataccgaatttggatatcattggaaagagaatagaaaagatcaagcaagaacacgaaaccagctggcattacgatcaggaccacccgtataagacttgggcctatcatggatcctacgaaacaaagcaaacgggcagcgccagttcaatggttaacggagtagttagattactaacgaaaccgtgggatgtagtcccaatggtaacccaaatggcaatgactgacacaacaccattcggacagcaacgagtcttcaaagaaaaggttgatacacgcacgcaagaacccaaggagggtaccaagaaacttatgaagataaccgcggagtggctttggaaagaattgggcaagaagaaaacgccacgtatgtgcacacgcgaagaatttacacggaaggtcagatccaacgccgcgctaggcgcgatattcacagatgaaaataagtggaaaagcgcacgggaagctgtcgaagactccagattctgggaactcgtggataaggaaagaaatctacatctggagggcaagtgtgaaacttgtgtatataatatgatgggtaaacgggaaaagaaattgggtgagtttgggaaggcgaaaggttctcgtgccatatggtacatgtggttaggagcacgtttcttggaatttgaggctttaggattcttaaatgaagatcattggttttcgagagaaaattcactgagtggagtcgaaggagaaggactacacaaactgggatacatattacgagatgtaagcaagaaagaagggggagcaatgtacgcagatgatactgctgggtgggatactagaattaccttggaagatctgaaaaatgaagaaatggtaacaaatcatatggaaggagaacacaagaaattagcagaagcaatattcaaattgacttatcaaaacaaagttgtacgagtacaacggccaactccaaggggtacggtaatggacattatatcgagaagagaccaacgaggatcaggccaggttggtacctacgggttaaacacatttacaaatatggaagctcaattaattcgacagatggagggggaaggtatatttaaaagtatacaacatttgactgtgacagaggaaattgcagtacaaaattggttagcaagagttggcagggaacgtcttagtcggatggctatatccggggacgattgcgtagtaaaacctctagatgatagatttgcatcagcgttaacggcccttaatgatatgggaaaagtaaggaaggatatacagcagtgggaaccgagcagaggatggaatgattggactcaggtcccattttgttcccatcattttcacgaattgattatgaaagatggaagagtattagttgttccgtgtaggaatcaagatgaactaattggcagagcgagaatatctcaaggagccggttggagcttaaaggaaacagcgtgtcttggtaagtcttacgcacaaatgtggagcttaatgtattttcaccgaagggacctcagattagcagcaaacgcgatatgctctgccgttccatcacattgggtccctacgtccagaacaacttggtcaatacatgctaaacatgaatggatgactactgaggatatgctgacagtttggaaccgagtatggatccaagagaacccatggatggaagataaaactccagtagagtcatgggaggaagtcccatacctagggaaaagggaagatcaatggtgcgggtctctaattgggctcacttccagagcaacgtgggccaaaaatatacaaacagctataaatcaagtccgatcactaataggaaacgaagagtatacggactatatgcctagcatgaaacgatttagaagagaagaagaagaagcaggcgtattatggtaa

SEQ ID NO: 22825 - RNA, 9876 nt, synthetic construct
  misc_feature 1..9876: note = derived and/or modified CDS sequence (opt6) from DENV-2__FM210244__SS-prME
  source 1..9876: mol_type = other RNA
accgcgggagtgataataatgttaattccgacggctatggcctttcacctgactactagaaatggggaaccacacatgatagtaggaagacaggaaaaaggtaaatcactactcttcaaaactgaagatggtgttaatatgtgcaccttaatggcaatagacttgggagaattatgtgaagatacgataacttataaatgtccgttgctaagacagaacgaaccagaagatatcgactgttggtgtaacagtaccagcacatgggttacctacggaacatgtaccacaacaggcgaacatagaagagaaaaacgaagtgttgctctagtaccgcatgttggaatgggactagaaacgaggaccgaaacttggatgagctcggagggcgcttggaaacacgcccaaaggattgaaacatggattctaagacacccaggatttactataatggcagcaattcttgcatatacagtaggaaccactcactttcaacgcgccttaatctttatactcctcgccgctgtagccccaagtatgacgatgagatgcatcggtatatctaaccgggattttgtagaaggggtatcagggggaagttgggtagatattgtattagaacatggatcatgcgtaacgacaatggccaaaaataaacctacgttggatttcgaactaatcaaaacggaggcgaaacaacctgcgacactgagaaaatactgtatagaagcgaaacttactaatactactaccgagtcgagatgcccaacacaaggtgaaccttctctgaacgaagaacaagataaaagattcgtatgtaaacacagtatggttgaccgaggctggggaaatggatgcgggttatttggaaaaggcgggatcgtcacgtgtgccatgtttacatgtaagaaaaatatggaaggaaaaatcgtccaacctgaaaacttagaatatactatagtaataactccacactcgggtgaagaacacgcggtgggtaatgataccgggaaacacggtaaagaaataaaaataacaccacaaagtccaataacagaagcagaacttacgggctatggaaccgtaactatggaatgcagcccaagaactggtttagattttaacgaaatggtgctgctccaaatggaagataaagcatggctcgtacacaggcaatggtttctagacttacccctaccatggttgccgggagctgacacgcaaggatcaaattggatacaaaaagagacattggttacattcaaaaatcctcatgctaagaaacaagacgttgttgttctaggaagccaagaaggcgccatgcatactgcactaacaggggctacagaaattcaaatgagcagtggtaatttattgtttacgggtcacctaaaatgccgattacgaatggataaattacaattgaaaggtatgtcatacagtatgtgtacaggtaaattcaaaatcgtaaaagaaatagcagaaactcaacacggaactatcgtgatacgtgttcaatatgaaggtgacggatcgccatgcaaaattccattcgaaataatggaccttgaaaaacgacatgttcttggaagactaattacagtaaatcccatagtaacagaaaaagattctcctgttaacatagaagctgagccccctttcggtgacagctatataattataggggtagaaccaggtcagctaaaattgaactggttcaagaaaggaagttccataggacagatgtttgagacaacaatgcgcggagcaaaacggatggctatacttggagatactgcatgggatttcggttcgttaggtggagtctttacatcgataggtaaagcgctgcatcaggtattcggagcaatttatggtgcagccttttctggagtctcgtggacaatgaaaattctgattggcgtaattataacatggataggaatgaactctagatcaacgtccttatcagtcagtttggtcctagtaggtgttatcaccctttacctaggtgccatggtccaggcagattctggctgcgtggtctcatggaaaaataaagaacttaaatgcggcagtggtatatttataacagacaacgttcacacctggacagaacaatacaaattccaacccgaaagccctagtaaattagcatctgcaatacaaaaagctcatgaagaaggcatctgcggtattagatccgtaactagattagaaaatctaatgtggaaacagataactccagagttaaatcatatcctatctgagaatgaagtcaagttaacaattatgacaggagatataaagggtataatgcaagcaggcaagcgatcactacgaccccaaccaactgaactaaaatacagttggaaaacttggggaaaagctaagatgttatcaaccgaatcacataatcagacatttttgatcgatggacccgaaacagctgagtgcccaaacacaaaccgggcatggaactcgttagaagtagaggattacggattcggtgtgttcacaacaaatatctggctaaagctaagagaaaagcaagacgtcttttgtgattcaaaacttatgagtgctgcaataaaagacaatagagctgttcatgctgatatggggtactggatcgagtcggcgctaaatgatacatggaaaatggaaaaggcttcgtttattgaagtaaaatcatgccactggcccaaatcacatacactatggagcaacggggtcctcgaaagtgagatgataatacctaagagctttgctgggccagtatcgcagcataactacagaccaggttattacacacaaactgcgggaccgtggcatttaggtaaattggaaatggatttcgatttttgtgaaggaacaactgttgtggtaactgaagactgtggcaacagaggaccgagcttaaggactacaaccgcgagcggcaaactaataacggaatggtgttgccgatcttgtacattacctcccttaaggtaccgaggagaagatggttgctggtacggtatggaaatcagacctcttaaggaaaaggaggaaaacctagtaaatagtctagtgactgccggacatggtcagatagacaacttctcattaggagtactgggcatggctttgtttctggaggaaatgttaaggactagggtcggaacaaaacatgcaatactattagtagccgtaagttttgtaactctcattacaggaaacatgtcatttcgtgacttaggtcgcgttatggtgatggtgggcgcagccatgacggatgacatcggcattggagtgacatacttagcgttgttagcagcatttaaagtacgacctacttttgcagcaggccttctattaaggaaattaacatcaaaagagttaatgatggctacgataggtatcgcactattaagtcaaagcacgattccagaaaccatactcgaacttacagacgcccttgcactcggaatgatggtgcttaaaattgtgaggaacatggaaaaatatcaactagctgtcacaataatggctataagttgcgttccaaacgcagtgatactacaaaacgcgtggaaagtttcctgtactatattagcaacagtatccgtaagccctttactcttaacatcaagccaacaaaaagccgattggatcccgctagcactaacaatcaaaggtctgaaccccactgccatatttctgacaacgctatctagaaccagtaagaaacggtcttggccattaaatgaagcaataatggcagtagggatggtatcgatccttgcaagtagcctcttaaagaacgatataccaatgacgggacctttagtggctggagggttgttaacagtatgttatgttctcacgggccgttcagcggacttggaattagaaagggctacagacgtcaaatgggaggatcaggcagagataagcggttcttctcctatcctttcaataacaattgcagaagacggttcaatgtcgatcaaaaatgaggaagaagaacaaacattaacaattctgataaggaccggcttattggtaatatcgggccttttccctgtaagtattccaataacagctgcagcgtggtatttgtgggaagttaaaaagcagagagcaggcgtactttgggatgtaccgtctccacctcccgtgggaaaagcagaactcgaagatggtgcataccgtataaagcaaaagggtatacttggatattcccaaatcggcgcaggagtatacaaagaaggcacatttcatacgatgtggcacgtaacaagaggggctgtgttgatgcatagaggtaaaaggatcgaaccatcgtgggctgacgtgaagaaagacttaataagctatgggggagggtggaaattagaaggtgaatggaaagaaggcgaagaagtgcaagtacttgctcttgaacccgggaaaaaccccagagctgtccaaactaaaccaggactattcaaaactaacacaggaacaataggtgccgtcagcttagatttctcacccggaacgtcaggatcacctatagtagatcggaaagggaaagtagtcggactgtatggtaatggggttgtaaccagaagcggagcgtatgtcagtgccattgcacagacggaaaagtcaattgaggataacccagagatagaagacgatattttcaggaagaaacgactaactattatggacctacacccgggcgcaggaaaaactaaaagatacctacccgcaatcgttcgagaagccataaagaggggtttaagaacactaatactagcaccaacccgggtagttgccgctgaaatggaagaggctttaaggggattaccaattcggtaccaaactcctgcaatccgagcagaacacacaggccgagaaatagtagatttaatgtgtcacgccactttcactatgcggttactgagtccagtacgcgtaccaaattataatctaattatcatggatgaagcccattttactgatccagcttcaatagcagcaagagggtatataagtacccgagtagagatgggagaagcagcgggaatattcatgacggcgacaccgcctgggtcgaaagatccattcccacaatcaaatgcaccaattatggatgaagaaagagaaatcccagaaagatcatggaatagcggccatgagtgggttaccgatttcaaaggcaaaactgtttggtttgtaccctcgataaaagctgggaacgacatcgctgcctgtctaaggaaaaatggcaagaaggtgatacaactcagtagaaaaacttttgattcagaatacgtaaagacgcgaactaatgactgggatttcgttgttacaacagatattagtgagatgggcgctaacttcaaagcagagagagttattgatcctaggagatgtatgaaacctgtcatattgacggatggtgaagaacgggttatactagccggtccaatgcctgtaacacacagctctgcagcgcaaagacgcggccgaattggacgtaaccctaaaaatgagaatgatcagtatatttatatgggagaaccccttgaaaatgatgaagattgtgcacattggaaagaagcaaaaatgttactagacaatataaacacccctgaagggatcattcccagtatgttcgaaccagagcgtgaaaaagtcgacgctatcgatggagagtataggttgagaggagaagcgagaaagacatttgtagatttaatgagacgaggagatctgccagtctggctcgcataccgtgtggcagcagaaggaataaactacgcggaccgaagatggtgtttcgacggcgttaaaaacaaccaaattttagaagaaaatgtggaggttgaaatatggacaaaagaaggagaaaggaaaaagctgaaaccacgctggctagatgcacgtatatacagtgaccctctcgcactgaaagaatttaaagaatttgcagccggacgaaaaagtctgactcttaatcttataacagaaatgggtagattacctactttcatgactcaaaaggcaagagacgcactagataacttagcagtccttcacacggctgaggcgggcggaaaagcctataatcatgcactatcagagcttcccgaaacccttgaaacactattactgctcacgttattggcaactgtcactggcggcatttttctatttcttatgagtggaaaaggtgtgggcaagatgactctcggcatgtgctgcatcatcacagccagtatattgctctggcatgcacaaattcaaccgcattggatagcagctagtataatactggaatttttcttgattgttcttttaataccagaaccagaaaaacaacgcactccacaggacaatcaactgacttacgtagttatcgcaattttgacagttgttgccgctaccatggctaacgaaatgggatttctggagaaaaccaagaaagacttaggcttaggatcgattgcaacgcaagaaccagaatcaaatatactagacattgatttaagacctgcctcagcctggaccctctatgctgtggccacaacgtttgtaactcctatgttaagacactcaattgaaaattcatccgtaaatgtgagcctaactgcaatagcaaatcaggcaactgtattaatgggcttgggaaaggggtggccattatctaagatggatatcggtgttccactactcgcgattggttgttacagtcaagtaaatccaataacgttaacagcagctctattattattggttgcacactatgccattataggtcctggacttcaagcaaaagctacgagagaagcgcaaaaacgcgcagctgctggaattatgaaaaatcccacagtagatggaattacagtaatagatttggatccgataccttacgacccgaaatttgaaaaacaattaggacaagtaatgctgttaatcctatgcgtaacacaagttcttatgatgcgaacaacatgggctttgtgcgaggcattaacattagctaccggtcctataagcacactttgggagggtaatccaggacgattttggaatactacaatagctgtctcaatggcaaatatcttcagaggctcttaccttgccggtgcgggtctattgtttagcatcatgaaaaataccactaatacaaggaggggtactggtaatataggtgagacgctaggcgagaagtggaaaagtcgattaaatgctctgggtaaatcagagtttcaaatctataagaaaagcggcatacaggaggtcgatcgaactctcgcaaaagaaggaataaaaaggggtgaaacagaccatcacgcagtatccagaggttctgctaagttgcgatggtttgtcgaacggaatatggtcactcctgaaggaaaggtagtagatcttggttgcgggaggggagggtggtcatactactgtggcggcctcaaaaatgtgagagaggtaaagggactgaccaagggagggccagggcacgaagaacccatccctatgagtacatatggttggaatttagtccgacttcaaagtggagttgatgtcttctttactccacccgaaaaatgtgacacgttgctctgtgatataggagagagctcaccgaaccctacaattgaagcgggtagaacactgagagtgcttagtctggttgaaaattggctaaataatgatacacaattctgtataaaggtccttaatccgtatatgccgagcgtaattgagaaaatggaaacgcttcaacgcaagtacggtggtgcattagtacggaatccattgtcaagaaattcaacccatgaaatgtattgggtaagcaacgcgactggaaacatagtctcatccgtcaatatgataagtagaatgctcattaatagattcacaatgaaacataagaaagcaacgtatgaaccagatgtagacttaggctctggtacaaggaatataggaatagagagcgagatgcctaacttggacatcataggtaaacgaatcgagaaaataaaacaggaacatgaaacgagctggcattatgatcaagatcatccttataaaacttgggcctatcacggatcctacgaaactaaacaaaccggatctgcttcttcaatggtgaatggtgtggtacgactgttaacaaaaccttgggatgtcgtgccaatggtgacacaaatggcaatgactgatactacgcccttcggacaacaacgtgttttcaaagaaaaggtagatactagaacgcaagaaccaaaagaaggtaccaagaaattaatgaaaataacagcagaatggctgtggaaggaattaggcaagaagaaaacacctaggatgtgcactagggaagaatttacccgcaaggttcgaagtaatgctgccttgggtgcaatatttacagatgagaataaatggaagtccgcaagagaagcggttgaggacagtagattctgggagctagttgataaagaacgtaacttacatctagaaggcaagtgcgaaacgtgtgtatataacatgatgggaaagcgtgagaagaaactaggtgaatttggtaaagcgaaaggaagcagagcgatatggtacatgtggctaggagctagattcctcgagttcgaagcacttggcttcctaaacgaagatcactggttctcaagagagaactcactcagtggggtagaaggggaaggcctccataagttggggtacatacttagagatgtatctaagaaagaaggtggagcaatgtacgcagacgacacagcaggatgggatacaagaataactttggaagatcttaaaaatgaagaaatggtcaccaaccatatggagggagagcataagaaattagcagaggccatatttaaacttacctaccaaaataaggttgtgagagtacaacggcctactccgcgaggtacagtgatggatataatctcaagacgagatcagcgtggtagtggacaagttggaacgtatggactaaacacgttcacaaacatggaagctcaattaatcagacaaatggagggcgaaggaatatttaagagtatacaacaccttaccgtaactgaagaaatagccgtacaaaactggcttgcccgagtaggaagggaacgactgtcaagaatggcgatcagtggtgacgactgtgttgtaaaacctctcgacgaccgattcgcatcagcgcttacggcactaaacgacatgggtaaggtcaggaaagacatacaacaatgggaaccgtcccgaggttggaacgattggacacaagtacccttttgctcgcatcatttccacgaactcattatgaaggatggacgtgtactcgtggtgccatgcagaaatcaagatgaattaataggcagagcacggatctcacaaggagcaggctggtcgttaaaggagactgcttgtctgggaaaaagttacgcacagatgtggagccttatgtactttcatagaagagacctgcgcttagccgccaatgcaatatgttctgcggtgcctagccattgggtcccgacaagtagaacaacctggtcgatacacgccaagcatgagtggatgacaacagaagatatgttaacagtctggaacagggtttggatacaagaaaatccgtggatggaggacaaaaccccggtagagtcgtgggaagaagtcccgtatttaggaaagagagaagaccaatggtgtggttcattaatcggattgacatcccgcgcaacatgggctaaaaacatccaaacagcaataaaccaagtgcgatcgttaatcggaaatgaagagtacactgattacatgccatcaatgaaaagatttaggcgcgaggaagaagaggcaggcgtactgtggtag

SEQ ID NO: 22826 - RNA, 9876 nt, synthetic construct
  misc_feature 1..9876: note = derived and/or modified CDS sequence (opt6) from DENV-2__FM210234__SS-prME
  source 1..9876: mol_type = other RNA
actgctggagtaataattatgttgatccccaccgccatggcatttcatctgactacacgaaatggcgaacctcacatgattgtaggaagacaagaaaaaggcaaaagtttgttatttaaaacagaagacggagttaatatgtgcacgcttatggccatagatcttggcgaactgtgcgaagatacaatcacgtataaatgcccattgttacgacaaaacgaacctgaagacatcgattgctggtgcaacagtacgtcgacttgggtaacgtatggaacgtgcaccacaacaggcgaacacagaagagagaaaaggtctgtagcacttgtacctcatgtagggatggggcttgaaacgcgcacagaaacgtggatgtcatcagaaggagcatggaaacatgcccagagaattgaaacctggattttgcgacaccccggtttcacgattatggcggcgatcttagcatatactgtaggcacaactcattttcagagagccttaatatttatattattagcagcagttgctccttccatgacaatgcgctgcataggcatttccaacagagattttgtagaaggagtgtcaggagggagctgggtggacattgtattagaacatggatcctgtgtcaccactatggccaaaaacaaacctacactagatttcgaattaataaaaactgaggcgaaacaacccgcgaccttaagaaaatactgcatagaagcgaaattaactaacaccacgacggagagcagatgtcctacgcaaggtgaacctagtctgaacgaggaacaggataaacgattcgtgtgcaaacatagcatggtagacagaggatggggaaatgggtgtggcctattcggtaaagggggaatagtaacgtgtgcaatgtttacatgtaagaaaaacatggagggcaaaatagtccagccggaaaatttggaatacacaattgtgattacaccgcattcaggagaagaacacgcagtaggaaatgacactggaaaacacggcaaggagatcaaaattacaccgcaatcccccattactgaagcagaactaacaggatacggaacggtgaccatggaatgttcacctagaaccggtttagattttaatgaaatggtcttactacaaatggaagataaggcttggttagtgcacagacaatggtttctggatttacctctgccatggctcccaggtgccgatacacaagggagtaactggatacaaaaagaaaccttggttacttttaagaaccctcatgcgaagaaacaagatgtagttgtgctaggatcacaagaaggagcaatgcatactgcactcactggtgctacagaaatccagatgagttccggaaatcttctttttacagggcacttaaaatgtagacttcgaatggataaactacaacttaagggtatgagttactcaatgtgcacgggtaagttcaaaatagtgaaagaaatagcagaaacgcaacacggtacgatagttatacgagttcaatatgaaggtgatggctcaccatgtaaaattccgttcgaaatcatggatttagaaaagcgtcacgtattagggagattaataactgtaaatcccatagtcacggggaaggattctccggttaatattgaagccgaaccaccctttggcgacagttatatcataataggtgtggaaccaggccaactgaagttgaactggtttaagaaaggtagttccataggtcaaatgtttgaaacaactatgcgaggtgcaaagaggatggcaatattgggcgatacggcgtgggacttcgggtccttaggtggagtctttacatccataggtaaggcattacaccaagtgtttggtgctatatatggtgctgcgttctccggcgttagttggactatgaaaattttaatcggagtgattattacgtggattgggatgaatagtagaagcacatctttaagtgtatcactggtcttagttggagtaattacactctacctaggggctatggtgcaagcagattccggatgtgtagtatcgtggaagaataaagaactaaagtgtggatctggcattttcattacagacaacgtacatacctggaccgaacaatacaaattccaaccagaatcaccatcaaaactagcgagcgctatacaaaaagctcatgaagagggtatttgcggcattagatcagttacaagacttgaaaacctaatgtggaaacagataacaccagaattgaaccatatcttgagcgaaaacgaagttaagttgaccataatgacaggcgacattaaaggcataatgcaagccggtaagcgctcgttacgtccacaaccaacggaattaaagtatagctggaaaacttggggtaaagccaagatgctatcaacagagagccataatcaaacctttttaatagacggtccagaaacagctgaatgccctaacaccaatagagcgtggaatagcttagaggttgaagattacggattcggagtgtttactactaacatatggctgaaattaagggaaaagcaagatgtcttctgtgattcaaagctcatgagtgcggcaataaaggacaatagagcggttcatgcagatatgggctactggatcgaatcagccctaaatgacacatggaagatggaaaaagcatcattcatcgaagtcaaaagctgtcattggccaaaatctcatacgctatggagtaacggtgttctggaatcggaaatgataatacccaaaagtttcgcgggcccagtatcacaacataattataggccaggttactacacgcagactgcaggaccatggcatcttgggaaattagaaatggactttgatttttgcgaaggaacaaccgtagtagtgaccgaggattgtggaaataggggaccaagtctgcggacgacaactgcatctggcaaattaatcactgagtggtgttgccgaagctgtaccctacctcctctgagatatagaggggaggacgggtgttggtacggtatggagattagacccttaaaagaaaaggaagaaaatctagttaacagtctagtaacagctggacatgggcaaatagataacttctcattgggcgttcttggtatcgcgttattcctcgaagaaatgctacgaaccagagtagggaccaaacacgcaattttattagtagctgtaagttttgtaaccctaataacgggtaatatgtcctttagagacctcggtcgagttatggttatggtaggagcagcgatgacagatgatataggtatgggtgtaacctatctcgctttattagcagcatttaaggtacgacccacattcgcagcaggattattattaagaaaattaacttcaaaggagcttatgatggcgacaatcggaatagcgctattaagtcaatccactatacccgagaccatcctcgagctaacagatgccctagcgcttggcatgatggtcctaaaaatagtacgaaacatggaaaaatatcaacttgcagttaccataatggcaatatcctgtgtgcctaatgctgtaattttgcagaatgcttggaaggttagttgtactatcttagccacggttagcgtaagtcccttactcctcaccagttcacaacaaaaggcagattggattccgttggctttgacgattaaaggactaaaccctacagccatatttttaacaacactttcccggaccagcaagaaaaggagttggccattaaatgaggcaatcatggctgtgggtatggttagtattttggcatcaagtttgttgaaaaatgatatacccatgacaggtcctctagtggctggaggtctattgacagtatgttatgtcttaactggaaggtcagctgatctcgaattagaaagagctacagacgttaagtgggaagaccaggcagagatttcgggttccagtccgatactttcgattactatagcagaagacggatcgatgtctataaagaatgaagaagaagaacaaacattaactatactcattcgaactggactcttagtcatttcaggactatttccagtgagcataccaattacagcagcggcatggtatctatgggaggtaaagaaacagagagcaggcgttttgtgggatgttccatcaccaccacctgtcggaaaagcagaattagaagatggagcttaccgcattaagcaaaaggggattctaggttacagtcaaataggagccggcgtatacaaagagggaacctttcatacaatgtggcatgtaactagaggagcggtgttgatgcatcgcggtaagagaatcgagccctcatgggcggacgttaagaaagacttgatcagttacgggggtggatggaaactcgaaggcgaatggaaagagggagaagaagtacaggtcctagccctggaacccggcaaaaatccacgagccgtccaaaccaaacccgggctttttaaaacgaatacagggactataggcgctgtaagtctcgacttctcccccggtacaagtggatctcccattgtggaccgtaaaggaaaggttgtcggattgtacggcaatggagtggtgacaagatcaggagcttatgtatcagctatagcacaaactgagaaatcgatagaagataaccccgaaatagaagacgacatattcagaaagaaaagattgactatcatggatcttcatccaggcgcaggaaaaaccaagagatacttaccagctatagttagagaagccataaaacgaggtctaagaactctcatccttgcaccaacaagagtcgtggcagctgaaatggaagaagcgttaagaggtctaccgattaggtaccaaacgcccgctatacgagcagaacatacaggcagagaaattgtagacttaatgtgtcatgcaacatttacaatgcgcttactatctccagtaagagtacctaactataatcttataatcatggacgaagcacattttacggatcctgctagtattgccgcgaggggctatatctccacaagagtggagatgggcgaagcagcgggtatattcatgacagcaaccccgccaggaagcagggaccctttccctcagtctaacgcgccaatcatggacgaggaacgagagatcccagaaagaagttggaactctgggcatgaatgggtaacagattttaaaggaaagacagtgtggttcgttccaagtatcaaagcaggcaatgatattgccgcatgtctacggaaaaatggaaagaaagtaatccaattatcacgaaaaacgtttgattcagaatatgttaagacaaggacaaatgactgggattttgtcgtaacaactgacatttccgaaatgggggctaatttcaaagccgaacgagtgatagatccgcgacgttgtatgaagccagttattttaacagacggagaagaacgagttattctagcaggtccaatgcccgtaactcattcatccgcagcacaaagaagaggacgaattggaagaaaccccaagaacgagaatgaccagtacatttatatgggcgaacccctagaaaatgatgaagactgtgcccactggaaagaggcgaagatgttattggataatattaatactccagaaggaataataccaagcatgtttgaacctgaaagggagaaggtagatgcgatagacggagaatacaggctacgcggtgaagcccgaaagacgtttgtggatctaatgagaagaggtgatctgcctgtctggttagcttatcgtgtagctgccgaaggaataaactatgctgataggcgatggtgttttgatggagtcaaaaacaaccagatattagaagaaaatgtagaggtagaaatctggaccaaagaaggtgaaagaaagaaattaaaacctcgatggcttgacgctaggatttacagtgatccacttgctctaaaagaatttaaggagtttgcagcgggccgtaaatcactcacattgaatttgattacagagatgggtagattaccgactttcatgacacaaaaagcaagagacgcactagataatctagcagtcctacacactgccgaagctggtggacgcgcatacaatcatgctttatcggaattacccgaaaccttagaaacactgttattattaactctacttgcaactgtaacgggaggaatattcctatttcttatgagcggaaaaggggtaggaaagatgacactaggtatgtgttgtataataactgcctctattctcttatggcatgctcaaatccaaccccactggatcgcagcttctattattctagagttctttcttattgttctactgattccagagccagaaaagcagcgaactccacaagataatcaactaacatatgtagttatcgctattctcacagttgtggccgctactatggcaaacgaaatgggttttctagagaaaactaagaaggatctaggccttgggtcaatagcaacacaagaacccgaaagtaacattcttgatattgacctgagacccgcatcagcttggacactttatgcggtggcaacgacatttgtaacacctatgctccggcactcaattgaaaacagtagtgttaatgtatcattaacggcgattgctaatcaagctaccgtcctcatggggttagggaagggatggcctttaagtaaaatggatataggagttcccttactggcaattggctgttacagtcaagtgaatccaataaccctaactgcagcactactcctccttgtagcgcattacgctatcattggacctggattacaagctaaagcaacgcgggaagctcagaaaagagccgcagcaggaataatgaagaatccgacagtagatggtattacagtgatagatttagatccaataccatatgatccaaaatttgaaaaacaactaggccaagtcatgctactcattttatgcgtgacacaggtactaatgatgaggaccacctgggcactctgcgaagccctaacactggcaaccggaccgataagtaccttgtgggaaggaaatcccggtagattctggaacacaacgattgcagtgagcatggcaaatatcttcagaggctcatatttagcgggggcaggtctactcttttctataatgaagaacactacaaatacacgccgaggaactggtaatataggcgaaacacttggagaaaaatggaaaagccgcctgaatgcattaggcaaatccgaatttcagatttacaagaaatccggtatccaggaagtggaccggacgttggccaaggaaggtattaaacgcggtgaaacggaccaccatgccgtgtcaagaggatccgctaaacttcgatggttcgtagaaagaaacatggtgacgcccgaaggtaaggtagttgacctgggctgcggaagaggaggttggtcttattattgcggtggcttgaaaaacgttagagaggttaaaggactaactaaaggaggaccaggacatgaagaacctattccgatgtcaacttacggatggaatctagtacggttacagagcggagtcgatgttttctttacacctcccgagaaatgtgacaccttactttgcgacattggagaatctagtcctaatccaaccatcgaagcaggcagaacccttagggtcttatcacttgttgaaaattggttgaataacgatacacaattttgcataaaggtattaaacccatatatgccatcagttatagagaaaatggaaacacttcaaagaaaatatggaggggctcttgtacggaatcctctttcccgaaacagcacgcacgaaatgtactgggttagcaatgctactggaaatattgttagcagtgtgaacatgattagtagaatgctcataaaccgcttcaccatgaagcataagaaagccacgtatgaacctgatgtagatcttggatctggaacgaggaacataggaatagagtctgagataccgaacttagacatcataggaaaacgaatagagaaaatcaaacaggaacatgagacatcatggcattatgatcaagaccacccatataaaacctgggcatatcatggaagctacgaaacaaaacaaacgggaagcgcatcatcgatggtaaatggagttgtgcgactccttacgaaaccgtgggacgttgtaccaatggttacacaaatggcaatgaccgatacaactcccttcggtcaacaaagggtttttaaagaaaaagttgacacaagaacgcaggaaccgaaggaaggaacaaagaaactaatgaaaataactgcagaatggttatggaaagaactaggtaaaaagaaaacaccacgaatgtgtaccagagaagaatttaccagaaaagttagaagtaatgcagctctgggagcaatctttacagatgaaaacaaatggaaatcagcccgagaagctgtagaagatagtcgattctgggagctagttgacaaagaaagaaatctccatttggaaggtaaatgtgaaacatgtgtatataacatgatgggaaagagggagaagaaactcggtgagtttggaaaagccaaagggtcacgggcaatttggtacatgtggttaggtgcgcgttttctagagttcgaagcgctaggattcctaaatgaagatcactggtttagtcgtgaaaattctttgtctggagttgagggcgaaggtctacacaaacttggttatatattacgggatgtatccaagaaagagggaggtgccatgtacgcggacgacacagcaggttgggatacaagaataaccttagaagatctaaagaatgaagaaatggttaccaaccacatggaaggtgaacacaagaaattggcagaagccatattcaaacttacatatcagaacaaagttgtgcgggttcaaagaccgacgccccgaggaactgtcatggatatcattagcagacgcgaccaacggggatcggggcaggtcggtacttatggtttaaatacttttactaacatggaagcacagctaataagacaaatggagggtgaaggtatcttcaaaagtatacaacacttaacagtcacggaggaaattgctgtgcaaaattggctggcaagggttggaagagagagattaagtcggatggccatatctggagatgactgcgtagtaaaaccactggacgatcgctttgctagtgctttaacagcgctgaacgatatgggcaaagtccgtaaggacatacaacagtgggaacctagtcgaggttggaatgattggacacaggttcccttctgctcacatcatttccatgaattaatcatgaaggacggaagagtactggtagtcccatgccgaaatcaagatgagttaatagggagggcaagaatatcacagggagctggttggagcttaaaagaaacagcctgtctcggaaaatcatacgctcaaatgtggagtcttatgtattttcatagacgtgatttgaggttagcagctaatgctatatgttcagccgttccaagtcattgggtccctacatcaagaaccacatggagtatccatgctaaacatgagtggatgacaacagaagatatgctaacagtctggaacagagtatggatacaagaaaatccctggatggaagataagacaccggtagaaagctgggaagaggtaccatacctaggcaaaagagaagaccaatggtgtggtagcctcataggattaaccagtagagctacgtgggcaaagaatatacaaactgctataaatcaagtgcgatcgttaatagggaatgaggagtatactgactatatgccatctatgaaaaggttcagaagggaagaagaagaagctggtgtattatggtag

SEQ ID NO: 22827 - RNA, 9876 nt, synthetic construct
  misc_feature 1..9876: note = derived and/or modified CDS sequence (opt6) from DENV-2__FM210213__SS-prME
  source 1..9876: mol_type = other RNA
actgcaggagtcataataatgctaattcctactgcgatggcatttcacttaactaccaggaatggagaaccccacatgatcgtgggaagacaagaaaaaggtaaatctcttcttttcaaaacggaagatggagttaacatgtgcaccctaatggctattgatctaggcgaactgtgcgaagacactataacctataaatgtcccctactacgacaaaatgaaccagaagacattgattgctggtgtaacagtacaagtacctgggtaacctatggaacatgcactacaactggagaacatcggcgagagaaaagaagtgtagctcttgtgccacatgtaggcatggggttggagacgcgaacggaaacgtggatgagcagtgaaggtgcatggaaacatgcccaacgaatagaaacttggattttgcgacatccgggatttacgataatggcagccatattggcttatacagttggtactacccatttccaaagagcattaatatttattttgctagcggctgtggcaccaagcatgacaatgcgctgcattggtatttcaaacagagattttgtggaaggagtgtctggtggtagctgggtagatattgttttggaacacggaagctgtgtaacaacaatggctaaaaataaaccaacattagatttcgaactaataaaaacggaagcgaaacagccggcaaccttaaggaaatactgtatagaggcaaaattaacaaatacgacaacggagtcacgatgtcccacgcagggtgaaccctcacttaacgaagaacaggacaaacgttttgtatgcaaacacagtatggtagatcgcggatggggcaatggctgcggtttatttggcaaaggaggaatagtaacctgcgcgatgtttacatgcaagaaaaatatggaaggaaaaatcgtccagccggagaacttagaatataccatagtgattacaccgcatagtggagaagaacatgcagtcggaaatgacacaggcaaacatggcaaagagatcaaaattacaccacaaagtcctataaccgaagctgaattaacagggtatggaaccgtgactatggaatgttcaccgcgtacaggattagattttaatgaaatggtcttacttcaaatggaggacaaggcttggttagtccatcggcaatggttcctagacctaccgctcccttggcttccgggggccgatacacaaggatcgaattggatccaaaaagaaacactggttacattcaaaaatccacatgccaagaaacaagacgtcgtggtattaggaagccaagaaggagcaatgcatacagcgctaaccggtgctacagaaattcagatgagttcgggaaacctactcttcaccggacatttaaaatgccgattgcgtatggataaacttcaattaaaaggaatgagttatagtatgtgcacgggcaaattcaaaatagtcaaagagatagctgagacacagcacggaacgattgtgatcagagtgcaatatgaaggagatggaagcccttgtaaaatcccatttgagataatggatcttgagaaaagacacgtgctcggtagactcataacagtcaaccctatagtaacggaaaaagacagtccagtaaacattgaagcagaaccgccattcggggatagctatattataataggagttgaaccgggtcaactaaaacttaactggttcaagaaaggtagtagtattggccaaatgtttgaaacgacaatgcgcggtgctaaaagaatggcgatcctgggagatactgcatgggattttggctccctgggtggagtatttacatcaatagggaaagcgctccaccaagttttcggagcaatctatggagccgccttttcaggagtaagttggacgatgaaaatactaattggagtcatcataacatggataggaatgaatagccgaagcaccagtttaagtgtctccttagtacttgtgggtgtaatcacactatacctgggcgcaatggttcaagcagatagtggatgtgtagtgtcttggaaaaacaaagaattaaaatgtggatcggggatctttataaccgacaatgtccatacatggacagagcagtataaatttcaaccagagagcccttccaaattggcaagcgctatccagaaagctcacgaagaaggaatatgtggtattcgcagtgtcacaagattagaaaacttgatgtggaaacagattacaccggaactcaatcacatactaagtgagaacgaagtgaagctaacaataatgacgggcgacataaaaggaataatgcaggccggcaagagatcattacggcctcaacccacagaattaaagtactcatggaagacatggggtaaggcaaaaatgttaagcacggaaagccacaatcaaaccttcttgatcgatggaccagaaacagcggaatgtccaaataccaatcgagcttggaactcattagaggtcgaagactatggtttcggagtattcacaacgaatatatggctaaaattacgtgaaaaacaagatgtattctgcgactcaaagctaatgtctgctgccataaaggacaaccgcgcagttcacgcggatatgggctattggattgaatccgcgttaaatgacacttggaaaatggaaaaggcttcttttattgaagttaagagctgtcactggccaaaatcccatacactctggtcaaatggagtcctggaaagtgaaatgataatacccaaatcattcgctggccctgttagtcaacacaactatcgtcccgggtattatacccaaacagcaggtccatggcacctaggcaaacttgaaatggacttcgatttctgcgaggggactacagtcgtcgttacggaagactgtggtaatcgtggaccatcattacgaacgacgacagcctcgggaaaactaattacagagtggtgttgccgaagttgtaccttgcctccattacggtataggggcgaagacggttgttggtacggtatggagatcaggccacttaaggaaaaagaagagaacctcgtcaatagcctagtaactgctggacatggacagatagacaattttagtctaggagtactaggtatggcactcttcttagaagagatgctaagaaccagagtgggtacaaaacacgccattctattagtcgcagttagtttcgtgaccttgataaccgggaatatgagcttcagagatttagggagagttatggtgatggttggtgctgcaatgactgacgatatcggtatgggggttacatacttagcattattggcagctttcaaagtgaggccgactttcgctgcaggtttattattacgcaaactaacttcaaaagagctaatgatggctacaatagggatagcactactttcccaatcaacgattccagaaacaattttggaattaacggatgctctagccctcggaatgatggtgttgaaaatagtacgaaatatggaaaaataccaactggcggtcacgattatggcaataagctgcgtaccaaacgctgtaattttacaaaatgcctggaaagtatcatgcacaatcttggcaaccgtgtcagtcagtccgttattgctgactagctcacaacaaaaagctgattggataccgctagcactaactatcaaaggcttaaaccccactgcgatattcctaacaacactatctcgcacttcaaagaaaaggagttggcctcttaatgaagccataatggcagtcggtatggtgtcaatattagcttcgagtctcctaaagaatgacatcccaatgactggacctttagtagcaggcgggttgcttacggtttgttacgtcttaacggggcgatcagctgatttagaattagaacgagccactgacgtgaaatgggaagaccaggctgaaataagcgggagcagtccaatactttcgattacaatagctgaggatgggtctatgagtatcaaaaatgaggaagaagaacaaacgttaacaattctcataagaacaggattattagtgatatcaggactatttccggtatcaattcccatcaccgcagcagcatggtatctgtgggaggtcaagaaacaaagagcgggtgttttatgggatgttccttcacccccacctgtaggaaaagcagaactcgaagacggagcatataggataaagcagaaaggaatactaggttacagtcaaattggggcaggagtgtacaaagaaggtacatttcatacaatgtggcatgttacacgtggtgctgttctaatgcacagaggaaagcgaatagaaccctcgtgggcagatgtaaagaaagacttaatctcgtacggaggcggatggaagttagagggagaatggaaagaaggggaagaagtacaagtactagcacttgaaccaggcaaaaatccacgggcagttcaaacaaaaccggggttgttcaagacgaatacaggtacaattggagcagtaagccttgacttttcacccggaaccagcggatcgccaattgtagatagaaaaggaaaggttgtcggcctctatgggaatggagtagtcacaagaagcggagcttatgtcagtgctatagcacaaactgagaaaagtatagaagataatcccgaaatagaagatgatatcttcaggaagaaaagattaacaatcatggatcttcacccaggcgcaggaaaaacgaaaagatatctacccgcaattgtacgtgaagctataaagcgaggactaaggaccctcatcctagcacctacaagggtggtagcggcagagatggaggaagcattacgcggactacccattagataccaaactccagcaataagggcagaacatacgggacgcgaaatagtcgacctaatgtgccatgcaacatttaccatgaggcttttgagtccagtaagggtcccaaattacaatttaataataatggacgaagcccacttcactgacccagcaagtattgcagctcgcggctacatatctacacgcgtagaaatgggagaagctgctggaatatttatgactgctacaccacccggtagtcgagacccttttccccaatccaatgcacctattatggatgaagaaagagagatacccgaaagaagttggaactctggacatgaatgggttacagattttaaaggtaaaactgtttggtttgtcccgtctataaaagctggtaatgacatagcagcatgcttacggaaaaatggaaagaaggtgatacaactatctagaaagacgttcgacagcgaatacgtgaagactcgaacgaatgactgggatttcgttgtgactacagatatttccgaaatgggagcgaattttaaagccgaacgggtaatagacccaaggagatgcatgaagcccgtaatattgacggacggagaggagcgagttatacttgctggaccaatgcctgtcactcactctagtgcggcccaaaggagggggagaataggaagaaatcctaagaacgagaacgatcaatacatatatatgggtgaacctctagagaacgatgaggactgcgcccattggaaggaagcgaaaatgttactagacaacataaataccccagaaggaattataccaagtatgttcgagccggagcgagaaaaggtagatgctatcgatggtgaatatagactaagaggggaagcacgtaaaacgtttgtagatttaatgaggcgaggagatctcccagtgtggctggcatatagggtcgcagcggaaggaataaattatgccgaccgacgatggtgttttgatggcgtcaaaaataaccaaatcctagaagagaatgtggaggtagagatctggacaaaagaaggtgaaaggaagaaattaaaaccacgatggttagatgcaagaatctactcagatccattggcgcttaaagagtttaaagaatttgccgcaggtcgaaaatccttaacccttaatttaatcacagagatggggagactgccgacttttatgactcagaaagcacgtaacgccctagataatctggcagttctccataccgcggaagctggagggcgagcttacaatcatgcgctatctgaactacccgaaactctagaaactttgttactactaactcttctagccacagtaactggaggaatattcctatttttaatgagtggaaaaggtgttggtaaaatgactttaggaatgtgctgtattattaccgcttcaatcctattatggcatgctcagatacaaccacattggatcgctgcttcaataatattagaatttttccttatcgttcttttaattccagaacctgaaaaacagcgtactccacaagataatcagttgacatatgtggtaatagccatattaacagttgtagctgcaacaatggcaaacgaaatgggatttctagaaaagactaagaaagaccttggcttaggatccatcgctacccaagaaccagagtcaaacattctcgatatagatctcagaccagcatcagcatggaccctctatgcagtcgccacaacgttcgttacaccaatgttaagacactctatcgagaatagctcggtaaatgtttcactaactgccatagcgaatcaagctacggtactcatgggtctagggaagggttggccactgtccaaaatggacattggggtaccactcctagcgataggatgctacagtcaagttaatccaataacccttaccgctgccctacttttgttagtggcgcattacgcgattattggaccaggcctccaggcaaaagcgactagggaagcgcagaaaagggcagcagcaggaataatgaaaaatccaacggtagatggaatcacagtaattgatctcgacccgataccgtatgaccctaaatttgaaaaacagttaggccaggtaatgcttttaatactttgtgtcactcaagtacttatgatgcgaaccacttgggctctatgcgaagctctcacactagcaacaggcccaatcagcacactttgggagggcaatcctggacgattttggaataccaccatagcggtaagtatggccaacatatttagggggtcatatttggcaggcgctggtcttctattttcaataatgaagaatacaactaatactcgtagggggacaggaaatataggtgaaactctaggggaaaaatggaaaagcaggctcaatgcattagggaaatctgagtttcaaatatataagaaatcagggatccaagaagttgatagaacactagctaaagaaggaattaagcgaggagaaacagatcatcatgccgtgagcagaggcagtgccaaacttagatggtttgtggaaagaaatatggtaaccccagaagggaaagtagtagatttgggatgcggtaggggtgggtggagctattattgcggaggtcttaaaaacgttagggaagtaaaaggcttaacaaaaggaggaccaggtcacgaagaacctataccaatgtctacgtatggctggaatcttgtcagattacaatccggtgtagatgtattctttacacctcccgagaaatgcgatacacttctttgtgatataggtgaatcatcgcccaacccaactatagaagcagggagaaccctcagggtgttgagcctggttgaaaactggctaaataatgacacgcaattttgtataaaggtattaaatccatatatgcccagcgtcattgagaaaatggaaacattacaacgcaagtacggaggagccctagtaagaaatcccttatcccgcaatagcacccatgaaatgtattgggttagcaacgcaactggaaatattgtcagttcagtaaatatgataagtaggatgttaattaatcggtttaccatgaagcacaagaaagcgacttatgaacccgatgttgatctaggttccgggacgcgaaacatcgggattgagtcagaaataccaaatctagatatcattggaaaaagaattgaaaagataaagcaagagcatgagacttcttggcattacgaccaggaccacccctataaaacatgggcgtaccacggttcgtatgaaaccaagcaaacagggtctgccagttctatggttaatggcgtagttagattacttacaaagccatgggacgtcgtgccaatggtcactcagatggcaatgactgacaccacaccctttggacagcaacgtgtcttcaaggagaaagtggacacacggacacaagagcctaaagaaggcactaaaaagttaatgaagataactgccgaatggctatggaaagaattgggtaagaagaaaacgccaaggatgtgtactagagaagaatttacgagaaaagttcgctcaaacgctgcgctaggcgcaattttcacagacgaaaataaatggaaaagtgctagggaagcagtagaagattcacgcttttgggagcttgttgataaagagagaaacctacatctcgaaggaaagtgtgaaacatgtgtatacaatatgatggggaagcgagaaaagaagttgggcgagtttgggaaagctaaaggctctcgtgcaatttggtacatgtggttaggtgcacgatttcttgaatttgaggccttaggatttttaaatgaagatcactggtttagccgtgaaaatagtctttctggcgtagaaggagaaggattacataagttgggttatattcttcgcgacgtaagcaagaaagaaggcggtgcaatgtacgctgacgacacagcaggatgggatacacgaataaccctagaagatcttaaaaatgaagaaatggttacaaatcatatggaaggggaacataagaaactggcagaggctatattcaagctaacatatcagaataaagttgttagagttcaaaggccaacacctagaggaactgtgatggacataatatcaagaagagaccaaagagggagtggacaagtgggaacttatggccttaacacatttactaatatggaagctcagttaataagacaaatggaaggtgaaggaatctttaagagtattcaacatctgactgtaacagaagagattgcagtacaaaactggctcgcaagagttggacgtgaaaggttaagcagaatggcaataagtggagacgattgtgttgtaaaacctttagatgacagattcgccagcgcccttacagcactaaacgacatgggtaaggtaaggaaagacatacaacaatgggaaccgtcacggggatggaacgattggactcaggtacccttttgtagtcaccatttccacgagttaataatgaaggatggacgagtccttgtcgtgccatgtaggaatcaagatgaactaataggtagggcaagaataagtcagggggcaggatggtccttgaaagaaacggcatgcctcggtaaatcatatgcacaaatgtggtctttaatgtatttccatcggcgcgatctaaggctagccgctaatgccatatgctcagccgtcccatcccattgggtccctacttccagaacaacctggtctatacatgcaaaacatgaatggatgacgacagaagacatgcttaccgtatggaatcgcgtatggatacaagagaatccatggatggaggataaaacaccagtagaatcttgggaggaagtaccctatctaggaaagagagaggatcagtggtgcggaagtctaatcggactaacaagtagagcaacatgggccaaaaacatccaaacagcaataaaccaagttaggtccttaataggaaatgaagaatataccgattatatgccatcgatgaagaggtttagaagggaagaagaagaagcgggggtactctggtaa

SEQ ID NO: 22828 - RNA, 9876 nt, synthetic construct
  misc_feature 1..9876: note = derived and/or modified CDS sequence (opt6) from DENV-2__FM210235__SS-prME
  source 1..9876: mol_type = other RNA
actgcgggtgttatcatcatgctcatccctacggctatggcatttcacctaacaacccgcaatggcgagccccacatgatagttgggagacaagaaaagggaaagtccttgcttttcaaaaccgaagatggtgtgaacatgtgcacacttatggctatcgacctaggagaactctgtgaagacacgataacatataaatgtccgttattaagacaaaacgaaccggaagacatagattgttggtgcaatagtacctcaacgtgggtaacatacggaacatgtacgacaacaggggaacatcgtagagagaaaagatcagtagcactagtgccacacgttgggatgggtcttgaaactcgtacagaaacatggatgtccagtgaaggcgcatggaaacatgcgcaaagaatcgaaacatggatcctaagacatccgggctttacaattatggcggcgatccttgcatatacggtgggaacgacacattttcaacgagctcttatctttatattactcgctgctgtcgctccttcgatgactatgagatgcatcgggatatcaaaccgagatttcgtcgaaggcgtatcagggggaagctgggtcgatatagtgctagagcatgggtcgtgcgtcacgacaatggcaaaaaataagccaacattggatttcgaattaatcaaaacagaagcaaaacagcccgctactctaagaaagtattgtatcgaggccaaactaacgaataccaccacggaaagtcgatgtcctacacaaggagagccttcattaaacgaagaacaggacaaaagatttgtatgtcgacattccatggtcgacagaggatggggtaatggttgcggtctattcggaaaagggggaatcgttacttgcgcaatgttcacatgcaaaaaaaatatggaaggaaaaatagtccaacctgaaaacctagagtatactatagttataactccacatagtggggaggagcatgcagtaggtaatgacaccggaaagcatggtaaagaaataaaaataacgccccagtctcctataacagaggctgaactaacgggatacggaactgtaactatggaatgtagccctagaacaggccttgatttcaatgaaatggtactacttcagatggaggacaaagcttggttggtccataggcaatggtttctggacttacccctaccatggctccctggagccgatacccagggatcgaattggatacaaaaagaaactctcgtgacattcaaaaacccgcatgcaaaaaaacaagacgtggtcgttctaggctcacaggaaggagccatgcatacggcattgactggagcaaccgaaatccaaatgtctagtggaaacctgttattcactggacatctaaaatgtagacttcgcatggataagctgcaactaaaaggaatgtcctacagtatgtgtacaggaaaatttaagatagtgaaggaaatcgctgaaacacaacacggaactatcgtaattagagtacagtatgagggtgatggaagcccgtgcaaaataccattcgaaataatggatttagaaaaaaggcatgtgttagggcgacttatcacagtaaatccaatcgtgaccgaaaaggattcaccagtaaatatagaagctgaacccccattcggagattcgtatattatcataggagtagaaccgggacagctaaaactcaactggtttaaaaaaggctcgtcaatcggacaaatgtttgaaacaacaatgaggggggcaaaaagaatggcaattcttggagacacagcatgggattttggaagcttaggaggagtgttcacatccataggaaaagcccttcatcaggtcttcggagcaatatatggagcggcattttccggcgtttcttggacgatgaaaatattaataggcgttattataacctggatcggtatgaactcaagatccactagtttaagtgtttccttagtgttagtaggtgtcatcaccttatatttgggcgccatggttcaggcagatagtggatgtgtagttagttggaagaataaagaacttaagtgtgggtccggcatatttatcacagataacgtacacacatggactgagcaatacaaattccaaccggaaagcccctcgaaattagcatccgctatacaaaaagcacatgaagaaggaatttgcgggattagaagcgttaccagactagaaaacttgatgtggaaacaaataactcctgaattaaatcacatcttaagtgaaaatgaggtgaagcttacgataatgacaggcgacattaaaggaatcatgcaggccggaaaacgatcccttagaccacaaccgactgagttaaaatactcctggaagacctggggaaaagcaaaaatgttgtccaccgaaagtcacaaccaaactttcttaatcgatggacctgaaacagccgaatgccccaacaccaacagagcgtggaacagtttagaagtcgaggattatggatttggtgtattcacgaccaatatctggttaaagctacgggaaaaacaagacgtattttgcgactctaaattaatgagcgctgcaataaaggataaccgggcggtacatgcagacatgggatattggatagagagtgcgcttaatgatacttggaaaatggaaaaagcttcgtttatcgaagttaaaagttgtcattggccaaagtctcatacactttggtcaaatggagtgctagagtctgaaatgataattccgaaaagctttgcgggtccagtgtcccagcacaattatcgcccaggttactatacccagacagctggaccgtggcatctggggaaattggagatggatttcgacttttgtgaagggacaacggtggtagtaactgaagattgcggtaatagaggtccatcgttgagaacaacaaccgctagcggcaaattaataactgaatggtgttgcagatcctgcaccctaccacccctgcgatacagaggcgaagatggatgctggtatggaatggaaataagaccattgaaagaaaaagaagaaaatctagttaattctcttgtcacagctgggcatggccaaatagataactttagtctaggagtcttaggaatggctctatttcttgaagagatgttaagaacaagagtaggtaccaaacacgcaatattactggtcacagtcagttttgttactctaataactggaaacatgagttttcgtgacttagggagagtaatggtaatggtaggtgcagccatgaccgacgatataggaatgggcgtaacttacttagctttattggctgctttcaaggtgagacccacttttgcagctgggcttctattaaggaaactaactagtaaagaactaatgatggcgactatagggatagcactcctcagtcagagtactataccggaaacaatcttggaattaactgacgcgttagcattgggaatgatggtattaaaaattgtacgaaatatggaaaaataccaactagcagttaccattatggctattagttgtgtacctaatgctgtgatcttacaaaacgcctggaaagtaagctgtaccatactagctgcagtttcagtttctccactgcttctaacgagttcacaacaaaaagccgactggataccactggaatggtctatcaaaggactaaacccaactgcgatatttctaactacgctgagtagaacaagcaaaaaaaggagttggccattgaatgaggcaatcatggcagtgggcatggtctccatactcgcgagtagtctactgaaaaatgacataccaatgaccggacctttagttgcgggaggactgttgactgtgtgctatgtccttacaggacgaagtgccgacctggagctagaacgcgcaaccgatgtaaaatgggaggaccaagcagaaatttctggctccagtcctatattatctatcacgatcgccgaagatggttccatgagcataaaaaatgaagaggaagaacaaacgctgactatattaattcggacaggacttttagtcatcagtggcctgtttcctgtatccatcccaataaccgctgcggcatggtacctatgggaagtaaaaaagcaaagggcaggagtgttatgggacgtcccatcaccgcccccggtaggaaaggcggagttagaagatggagcctacagaattaaacagaaaggaattttaggatattctcagatcggagcaggagtatacaaagaaggaacattccacactatgtggcacgtaacccgaggcgcagtgcttatgcacaggggtaaaagaattgaaccttcttgggcagatgtgaaaaaagatttaatttcatatggaggaggatggaaattagaaggagagtggaaagaaggagaagaagttcaggtcttagcacttgaacctggtaaaaatccccgcgcagttcaaactaaacccggactcttcaaaacaaatactggaaccatcggtgctgtaagcctcgacttctcaccgggtacatcgggttcaccgatagtagatcgtaaaggaaaagtagtgggtttatatgggaacggggttgtaacaagaagtggagcgtatgtttccgctattgctcaaacagaaaaatcaatagaggacaacccagaaatagaagacgacatatttcgcaaaaaacgcctgacaataatggatttacaccctggagcaggaaaaacgaaaagatatcttcctgcaattgtaagagaagcgataaaaaggggattaagaacactcattttagcacctacgcgtgtggttgctgcggaaatggaagaagctttacgaggtcttcccatacgatatcaaactccagcaatcagagccgaacacaccgggagagaaatagtggatctcatgtgccatgcaacatttacaatgaggctcctttcacccgttcgtgttccgaactataacctcattataatggatgaggcacactttactgatccggcgtccatcgcagcacgaggttacattagtactagggttgaaatgggtgaagcggcaggaatatttatgactgcaactcctcctggcagtagagatccatttcctcaatcgaacgcacctattatggacgaggaaagagaaataccggagcgctcatggaactctgggcatgaatgggttacggactttaaaggaaaaacagtctggtttgtaccatctatcaaggcgggtaatgatatagccgcgtgcttgagaaagaatggaaaaaaagtaatacagttatcaagaaagacgtttgattcagaatacgtcaaaacacggacaaacgattgggatttcgttgtcacaacggatatatcagagatgggtgccaatttcaaagcggagagggtaatagatccaaggcgatgcatgaaaccggttatacttacagatggggaagaacgggtcatacttgccggaccaatgcccgtaactcattctagcgccgcacaacgaagaggaagaatcggcaggaaccctaagaacgaaaatgaccaatacatctacatgggagagccattagagaacgacgaagactgtgcgcattggaaagaagcaaagatgctattagataatataaatacgcccgaaggaataataccatcaatgttcgaaccagaacgggagaaagtcgatgcgatagacggagagtatagattacgcggggaagcacgtaaaactttcgtagacttaatgagaaggggtgatctaccagtatggttagcgtacagagtcgcagccgaagggataaattacgcagacaggcgatggtgtttcgatggagtcaagaacaatcagatactggaagagaatgtggaggtggaaatatggacaaaggaaggagaacgtaaaaaactcaaaccccgttggctggatgcacgaatctatagcgatcccttagctttgaaagaatttaaagaattcgcagcaggtagaaaatctttaacattaaatctaatcacggaaatgggacggttacctacatttatgacacaaaaagcccgagacgcgttagataacttagcagtgttacacacagcagaggcaggtgggagggcctacaatcatgctttaagcgagttgcccgaaacccttgaaacacttttgttgctaactttacttgcgacagtcacaggggggatattcctattcttgatgtccgggaagggagtaggcaaaatgacactaggaatgtgttgtataattacagctagcattctattgtggtatgcacaaatacaaccacactggatcgctgcgagcatcattcttgaattttttctaatcgtcttgttaattccagaacctgaaaaacagagaaccccacaagataatcaactgacatacgtagttattgccatcttaacagtcgtagctgctacaatggccaacgaaatgggatttctagaaaagacaaaaaaggacctcggattaggtagtattgcgacgagagagccagaaagtaatatcttagacattgacttacgcccagctagtgcatggactctctacgccgtagccacgacctttgtaacgcctatgttgcgtcatagtatagaaaatagctctgtaaatgtaagtttgactgcaatcgccaatcaagcaaccgtgctaatgggtctgggtaaagggtggcctttatctaaaatggatataggcgttccattgttagcgataggctgctactcacaagtaaacccaatcactctaacggccgcactcttacttctcgtagcgcattacgcgataataggaccaggtcttcaagccaaagcaactagagaagctcaaaaaagagccgcagctggaattatgaaaaaccccacagtagacggagtaactgtgatagatttagacccgattccgtacgaccccaaatttgaaaagcaacttggacaagtaatgctactaatcctatgtgtcacacaggtattgatgatgcgaacgacttgggccttatgcgaagcattaacacttgcaactggtccgatatctacattatgggagggtaatccaggaagattctggaatacaaccatagctgtatcgatggcgaacatattccgtggatcctatttagcgggtgcaggattgttattctcaataatgaaaaataccacgaacactcgaagaggcactggaaatataggtgaaacgttgggagagaaatggaaaagtaggttaaacgccttaggaaaaagcgagttccaaatttacaaaaaatccgggatacaggaggtcgaccggacactagctaaggaagggataaaacggggagaaactgaccaccacgcagtttcacgaggaagcgctaaattacgatggttcgtagaaagaaatatggtcacaccagagggcaaagtggtagatctcggatgtggtcgtggaggatggtcatattattgtggcggattgaaaaacgtcagggaagtaaaaggattaactaaaggcggacctggacacgaagaaccaattccgatgagcacatacggttggaacttagtaaggttgcaatcaggtgtagatgttttctttacgccacccgaaaagtgtgacaccttattatgtgacattggggaaagtagtccaaatcccaccatagaagcagggagaacattacgagttttatcattagtagagaactggttgaacaatgatacacaattctgcattaaagttttgaacccatatatgccctcggttattgagaaaatggaaacactgcaaagaaaatacggcggcgcacttgttagaaaccctttaagccgaaactcgacacatgagatgtattgggtttcgaatgcgaccgggaatatagtaagttcagtaaatatgataagtcgaatgttgatcaatagattcacaatgaaacataaaaaggcaacttatgaaccagatgtcgatctaggctctgggactagaaatataggtatagaaagtgaaattcctaatctagatatcatagggaaacgaatagaaaaaattaaacaggaacacgagacaagctggcactacgatcaggatcatccttataaaacctgggcataccatggatcttatgaaacgaaacaaacaggtagtgcgtcgtcaatggttaacggggtagtccgtttattgactaaaccatgggatgtcgtaccaatggtcacacaaatggctatgacagacactacaccgttcggccagcaaagggtgtttaaggagaaagttgatacaagaacccaagaacctaaagagggaacgaaaaagttaatgaaaattactgctgaatggctatggaaagagttgggtaaaaaaaaaacgccccgaatgtgtacacgagaggaatttacccgcaaagtgcgaagtaacgcagcactgggagcaatatttaccgatgagaataaatggaaatctgcacgtgaagcagtagaagactcccgattttgggagctagtggataaggaaagaaaccttcatctagaaggtaagtgtgaaacctgcgtttataatatgatggggaaaagggaaaaaaaattaggtgaattcggtaaagcaaagggatctagggctatttggtacatgtggctcggtgcaagatttctagaattcgaggcattaggattcctaaatgaagaccattggttttccagagaaaattcattatcgggagtggaaggagaaggtttgcataaattagggtacatcttgcgcgatgtaagcaaaaaggagggtggagcaatgtacgcggacgatacggctgggtgggacactcgcattacattagaggacttaaaaaatgaggaaatggttacaaaccatatggaaggcgaacataaaaaactagctgaagctattttcaaattaacctaccaaaacaaggtagtgcgtgtgcaacgaccaactcccagggggacagtaatggatatcataagtagaagggatcaacgaggaagcggtcaagtagggacatatggattaaacacattcaccaatatggaagcccagttaatacgacaaatggaaggagaaggcgtgttcaaaagtatacaaagattaacagtaactgaggaaatagcagtacaaaattggctggcgagggtagggcgggaaaggctatcacgaatggctataagtggggacgactgtgtcgtaaagccactagacgacagatttgccagcgccttgacagctttgaacgacatggggaaagtcagaaaagatattcaacaatgggaaccaagtcgtggatggaatgactggacccaagttccattttgttcacatcactttcatgaattgattatgaaagatggacgagtgttggtagtaccatgtagaaaccaagatgaactaataggaagagctagaataagtcaaggagcgggctggagtcttaaggaaacggcttgtctaggtaaatcatacgctcaaatgtggtcactaatgtatttccataggagggatctgcgactggcggctaacgctatttgttcagcggttccgagtcattgggttccaacttctagaaccacatggtcgatccacgccaaacatgaatggatgacgactgaagatatgctaacagtatggaatagagtttggattcaagagaatccttggatggaagataaaacaccagtggagagttgggaagaagtaccttatcttggaaaacgagaagaccaatggtgcggctcactgattggtctaacttccagagctacttgggccaaaaatatacagaccgctatcaatcaagtacgctctttaataggaaatgaagagtacacagattatatgccaagtatgaaaaggtttcgtagggaagaagaagaagctggagtcctttggtaa

SEQ ID NO: 22829 - RNA, 9876 nt, synthetic construct
  misc_feature 1..9876: note = derived and/or modified CDS sequence (opt6) from DENV-2__FM210205__SS-prME
  source 1..9876: mol_type = other RNA
tcagcaggaatgattattatgttaataccgaccgtaatggcttttcatctaactaccaggaacggagaaccacacatgatagtaggtatacaagaaaaaggaaaatctctactattcaaaactgaagacggtgtgaatatgtgcacgttgatggcaatggatctcggagaactctgtgaagataccattacttataaatgtccacttctccgacaaaacgaaccggaagatatagactgctggtgcaacagcacaagtacttgggtaacatatggaacctgcaccacaactggtgagcacaggcgggagaaacgatcggttgcattagtgccacatgtggggatgggacttgaaacacgaactgaaacatggatgagtagtgaaggtgcttggaaacacgctcaacggatagaaacatggatattgaggcatcctggatttacaattatggctgcaatattagcatatactattggaacgacacacttccaacgagtactaatttttattctcttaacagcagtagcaccaagcatgactatgagatgtattggtatctcgaatcgagatttcgtagaaggcgttagtggtgggtcttgggttgacatagtactggaacacggcagttgcgtgactactatggccaaaaataaaccaacattagatttcgaattaattaaaacagaagcgaaacaaccagcaacactccgcaaatactgcattgaagcaaaacttactaatacgactacagagtcgcgatgcccaactcaaggagagccaagtctgaaagaggaacaagacaaaagatttgtgtgcaaacacagcatggttgatcgggggtggggtaacggttgtggcctatttggcaaaggaggcatagtaacttgtgctatgtttacatgcaagaaaaatatggaagggaaaatcgtacaaccagaaaatcttgaatacactatagtagttacacctcattcaggcgaagaacacgccgtcggaaacgacactggaaaacatggtaaagaaataaaagtgacaccacaaagctctataacggaagccgaattaacaggttatggcacggtgactatggaatgttcaccgcgcaccggattagactttaacgagatggtacttctgcaaatggaaaacaaagcctggttggttcatcgtcaatggtttttagacctgccacttccatggcttccaggggctgataaacaggaaagcaattggattcaaaaagaaacgctcgtgacgttcaaaaatccacatgccaagaaacaagatgttgtagtgttaggctcacaagaaggcgctatgcatacagccctaacaggtgctacagaaatacaaatgtcttcaggaaatttactattcacaggtcatcttaaatgcaggttgcgcatggataagctgcagctcaaaggcatgtcttactcaatgtgcacgggtaaattcaaagttgtcaaagaaatagcagaaacacagcatggaacaatagtgataagagtacaatatgaaggagacgggtctccatgtaaaattcctttcgaaataatggacttagagaaacgatacgtactaggaagactaatcactgttaatcccatagtcactgaaaaagacagtccggtcaatatcgaggcggagcctccctttggcgatagctatataattataggggtagaaccaggacaactaaaactaaactggttcaagaaaggtagttctatagggcagatgttcgaaactacgatgagaggagccaaaagaatggctatactaggagacaccgcttgggatttcggctctctaggaggtgttttcacgtcgattggtaaagcgctacaccaagtatttggtgccatatatggagctgctttcagcggtgtatcttggacaatgaaaattctaattggagtcataataacttggataggtatgaacagtagatcaacgagcctatccgtatctctagtactcgtaggtatagtaactttatatctcggagtaatggtacaggcagattccggatgcgtagtttcttggaagaataaagagctcaagtgtggttcaggaatattcatcaccgataacgttcacacatggactgaacaatataaatttcaaccagaaagtccatccaaattagcgtccgctatccaaaaagcacaagaagagggtatatgcggaataaggtcggtgactcgactagagaatttaatgtggaagcaaattacaccagaattaaaccacatattggccgagaatgaagtaaaattaactataatgaccggggacataaaaggtattatgcaagcaggtaaacgatcactcagaccacaaccaactgagctcaagtacagttggaaaacttggggaaaagcaaagatgctttctacagaatcttataaccaaacttttctaatagatggacccgaaacagcggagtgtcctaacactaatcgcgcctggaacagtttagaggttgaagattacggttttggtgtatttactactaacatatggttgaaattgaaggaaaaacaggacgcattttgcgactcaaaattaatgagtgcagcgataaaagacaacagagccgtccatgcggatatgggttattggatcgagagcgcattgaacgacacatggaaaatagaaaaggcgtcatttatagaagtcaaaaattgccactggcctaaaagtcatacactctggtcaaatggtgtactagagagcgaaatgattatacccaaaaacctagcggggcccgtctcacaacacaattatagacccgggtatcatacgcaaatagcagggccgtggcatctaggaaaattagaaatggattttgacttctgcgatggtacgaccgtgattgttacagaagactgtggcaatagaggaccatcattgcgaaccacaacggcatctggaaaattaataacagaatggtgctgtaggtcttgtactcttccgccattaaggtacaggggagaagatggatgctggtatggaatggagattcgaccgctaaaagaaaaagaagaaaatttagttaattctctagttactgccggacacggccaggtcgacaacttttcgttaggggtgctaggcatggccctgttcctagaggaaatgttacgaactagggtaggaactaaacatgcaatcttactggtagcagtgagtttcgtaactcttattaccggaaatatgtcatttaaagacttaggtagagtagtagttatggttggtgccacaatggcggacgatataggaatgggtgtaacatatctagcactgctcgccgctttcaaggtacgtcccaccttcgcagcaggacttctgttaaagaaactaacaagtaaagaattgatgatgaccacgattggtattgtgttactttcacagagcacaattcctgaaactgtcttagaattgacagatgcgttagccttgggaatgatggttctaaaaatagtccgaaacatggaaaaataccaattagcagtcacaattatggctatactttgcgtgccgaatgcagtcatcttgcaaaacgcctggaaagtatcctgtaccatcctagctgtagtaagcgtatccccacttctacttacgagttcccaacagaaaacggattggattcccctggctctgactataaaggggctaaaccccaccgcgatatttttaacgacattatcacgcacaaataaaaagaggagttggccccttaatgaagcaatcatggcggtaggtatggtttcaattcttgcttccagtcttctcaaaaacgatattcctatgacaggcccattagtggctggtggtctccttaccgtatgttacgtattgacgggaagatcagcagatttagagttagaacgtgcaacggacgtaaaatgggaagaccaagcggaaataagcggttcgagtccaatactatccataaccatatccgaagatgggtcaatgagcatcaaaaacgaagaggaagaacaaactttaacaattttaatccgtacaggtttattagttataagcggtctatttcctatcagtatacctattacagcggcagcatggtatctatgggaggtgaagaaacaaagagctggagtcctatgggatgtaccgtcaccacccccaatgggaaaagcggaactagaggacggtgcatatagaattaaacaaaaaggaattttaggatacagccaaataggtgcaggcgtttacaaagaagggacattccacaccatgtggcatgttacacgaggcgcagttttgatgcacaaaggcaagagaatagagccgtcttgggcagacgtcaagaaagatttgatatcttatggagggggttggaaacttgaaggcgaatggaaggaaggtgaagaagtacaagtcctggcacttgaaccgggcaaaaaccctagagctgtccagacaaaaccaggcctttttaaaaccaatacgggaactataggcgcagtgagtttagattttagcccaggcacttctggctcacccataatagacaagaaaggtaaagttgttggactatatggaaacggagtagttactcgaagtggcgcttatgtaagcgcaatcgcccaaactgagaaaagtatagaggacaaccctgaaatcgaggatgatatatttaggaaacgcagacttaccattatggatttacatccaggagcgggtaaaacaaaacgttatctacccgctatagttcgagaagcaataaaaagaggtctgagaacattgatcctggcaccgacaagagttgtggccgctgaaatggaagaagcattaagggggctacctataagatatcaaactccagccatacgagcggagcacacaggacgtgaaatagtagacctaatgtgccatgctaccttcacaatgagactgttaagccctgtaagggtaccgaactataacttgattattatggatgaagcgcattttacagacccagctagcatagctgcgagaggttacatatcgacaagagtggaaatgggagaggcggctggaatattcatgacagccaccccaccaggaagccgggatccttttcctcaatctaatgctcccataatagatgaggaaagagagataccggaaagatcctggaacagcggacatgaatgggtaaccgattttaaaggaaaaacagtatggtttgttcctagcataaaagcagggaatgacatagccgcttgcttgcgcaaaaatgggaagaaagttatacagcttagtagaaaaacatttgattcggaatacgtaaagacgagaactaatgactgggacttcgttgtaactacggatataagtgagatgggagcaaatttcaaagcggaaagagtgattgatccgagacgttgtatgaaacctgtaattttaactgatggtgaagagagggtaattctcgcaggtccaatgccagttactcatagttcggcagctcaacgacgtggacgcataggtagaaaccccaaaaatgaaaatgatcaatacatatacatgggtgaaccgctcgaaaatgatgaagactgcgctcattggaaagaggctaaaatgttactcgacaatatcaacacaccagaaggaattatcccctcaatgttcgaaccggagcgtgaaaaagttgatgcaatagatggagaataccgattacgtggcgaggcgagaaaaacattcgttgatttaatgagacgtggagatttgccggtttggctagcatataaggtagcggccgagggcatcaattacgcagataggagatggtgttttgacggaatcaaaaacaaccaaattctggaagaaaatgtggaagtagaaatatggacgaaagaaggtgaacgcaagaaactgaagcccagatggctagatgctagaatatattctgatccacttgcactgaaggaatttaaagagttcgcagcaggcaggaaatccttgaccctcaatttgataaccgaaatgggaagattaccaacattcatgacacagaaaacaagggatgctcttgataaccttgcagtattgcatacggcagaagccggagggagagcttataaccatgctctgagtgagttaccagagacccttgaaactttgttgttattgacattacttgcaacagttacagggggtatatttctattcttgatgtcggggaggggtatagggaaaatgactcttggcatgtgctgcataatcacggcatcgatacttttatggtacgctcaaatccaaccacactggattgcagcatccatcatactagagtttttcctgatagtacttttaataccagaacccgagaaacagaggacaccacaagacaatcaattaacttatgtagtcattgcaattctaaccgtcgtcgcagcaacgatggctaatgaaatgggatttcttgagaagaccaagaaagattttgggctaggttccatagcaacccaacaaccagaatccaacatactagacattgatttgcgacccgcttccgcatggacattatacgccgtagctacaacgttcgttacgccgatgctaaggcattcaatagaaaatagtagcgtcaacgttagcctaacagcgattgcgaaccaagcaacagtcctaatggggctagggaagggatggccactctctaaaatggacattggagttcctctactggcaataggttgttattcacaggttaaccccataacactaactgccgcactcctgttgttggtagcacattatgcaatcataggtccagggctccaagccaaggctacgagagaagcacagaaaagagcagccgctggtataatgaaaaaccctacagtagacggtataacagtaattgatctggacccaattccgtatgaccctaaattcgagaagcagttagggcaagtaatgctgttgattttgtgcgtgacacaggtacttatgatgcgaacaacatgggcgctttgtgaagcattaacccttgctacaggtcctataagtactctctgggagggtaatccaggacggttttggaatactacaatagccgtttcaatggcaaatatttttaggggaagttacttagccggcgcaggcttactattttctatcatgaagaataccacaaacacgcgccggggcacgggtaacataggagaaacactcggagaaaaatggaaatcaagattaaatgcgctaggtaaaagtgagttccaaatttataagaaatctggtatacaagaagttgatcgtacgttagctaaagaaggcataaaaagaggagaaaccgatcatcacgccgtctctcgcggctccgcaaaactccgatggttcgttgagaggaacatggtaacaccggaaggtaaagtagtggatttgggttgcggaaggggcggatggtcatactattgtggaggactcaaaaacgtaagagaggtaaaaggattaactaaaggagggcctggacacgaagaaccaattcctatgtcgacatatgggtggaatttagtccgtcttcaaagtggcgttgacgttttctttataccaccagagaaatgtgataccctactatgcgacatcggagagtcatccccaaaccccaccgttgaagcggggagaaccctaagggttctcaatttagtcgaaaattggctaaacaacaatactcaattttgcattaaagttttaaatccatatatgccaagtgtcatagagaaaatggaagccttacaaaggaaatatggcggagctttagtaagaaacccccttagcaggaatagtacgcatgaaatgtattgggtttcaaacgctagtggaaacatagtatcttccgttaatatgattagtcggatgcttataaaccgatttacaatgcgtcataagaaagccacttatgaaccagatgttgacttgggtagtggcacacgtaatatagggatagaatccgaaataccaaaccttgatataataggaaaaagaatcgagaaaataaaacaagagcacgaaacaagctggcattacgatcaagatcatccgtacaaaacctgggcttaccatggctcttacgaaacaaaacagacgggctcagcatcatcaatggttaatggagtagtcaggctattaacgaaaccgtgggacgtactaccgacggtaacgcaaatggcaatgaccgacactacccccttcggacaacaacgggtatttaaggaaaaagtggataccagaacacaagaaccaaaagagggaacaaagaaattgatgaaaatcacggctgaatggttatggaaagagttgggcaagaagaaaaccccaagaatgtgtacaagggaagagttcacccgcaaagttagatcaaatgcagcactcggagccatattcaccgacgaaaataaatggaaatccgcgagagaagctgtagaagactcgaggttttgggagttagtagataaggaaagaaatctccatttagaaggtaaatgtgaaacatgcgtatataacatgatgggcaagagagagaagaaacttggagagtttggtaaagcaaaaggatctagagctatatggtatatgtggttgggggcaagattcctagaatttgaggcactcgggtttctaaacgaagaccattggttcagcagagaaaacagtttatccggcgtagaaggtgaaggcctccataaattgggctatatattacgagatgtatcgaagaaagaaggaggggcaatgtatgcagacgacacagctgggtgggatacgagaataaccttagaagacctaaagaatgaagaaatggtgaccaaccatatggaaggggaacacaagaaactagctgaagcgatatttaaactaacctaccaaaacaaagtggtacgagtacaaaggccgaccccgagggggaccgtaatggacattattagccgtcgggatcagcgaggttctggccaggtaggaacctatggcttaaatacgttcactaatatggaggctcagcttataagacaaatggaaggcgaaggagtatttaaaaatatccaacatttaacagttactgaggaagttgctgtccaaaattggcttgcacgcgttggacgagaaagattaagcaggatggccatatcaggtgatgactgtgtagttaaaccacttgacgatagatttgcgaatgccttaaccgcacttaacgatatgggcaaaataagaaaagacatacaacaatgggagccgagtaagggatggaatgactggacacaggtcccgttctgtagtcaccatttccacgaacttattatgaaagatggacgcgtcttagttgtgccatgcagaaatcaagatgaattgatcggccgtgctagaataagtcaaggagctgggtggtcgttgcgagaaaccgcgtgtttaggcaagtcatatgctcagatgtggtctttgatgtactttcatagacgcgacttacgcttagcagccaatgcaatctgcagcgcggtgcctagccattgggtcccaacttctcgaacaacatggtccatacacgcgaaacatgaatggatgacgacagaagacatgttaactgtttggaatcgggtttggataagggaaaacccgtggatggaagacaaaactccagtagaatcatgggaagaaatcccatacttaggtaagagagaggaccagtggtgtggcagcttaattggtctaacaagtagggcaacatgggccaagaatatacaagcagccataaatcaagtacgtagtctaataggtaacgaagaatatactgattatatgcccagtatgaaacgtttcagacgtgaggaagaagaagcaggggtcctatggtaa

SEQ ID NO: 22830 - RNA, 9876 nt, synthetic construct
  misc_feature 1..9876: note = derived and/or modified CDS sequence (opt6) from DENV-2__FM210206__SS-prME
  source 1..9876: mol_type = other RNA
agtgcgggaatgattataatgttaatacctactgttatggcattccacttaacaactagaaatggtgaaccgcatatgatagtgggaatccaagaaaaaggaaaatctctgctgttcaaaacagaagatggtgtaaatatgtgtacgctaatggcgatggatttaggagagttgtgtgaggataccataacttacaaatgtcccctgttgagacaaaacgaaccggaagacatagattgctggtgtaatagtacgtcgacttgggtaacttacggaacatgtacaactacaggggaacatagacgggaaaaacgttcggtagctctcgtgcctcacgtaggaatgggtttagaaacaagaacggaaacgtggatgagtagcgaaggcgcttggaaacatgcacaaagaatagaaacatggatccttaggcatcccggatttacgctgatggctgcaattttagcttatactattggaactactcattttcagagagtcctcatatttatacttcttacagcagtcgctccgtcaatgaccatgagatgcataggaatctcaaaccgagattttgtggagggtgtatcgggcggatcttgggtggatatagtattggagcatggtagctgcgtcacgactatggccaaaaataaacccacattagattttgaactaataaaaaccgaagcaaaacaacctgcaacattaaggaaatactgcatagaggcaaaattgacaaataccaccacagaatctcgatgcccgacccagggagaaccaagtcttaaagaagaacaggataaacgtttcgtgtgcaaacattcaatggttgatagaggatggggtaacggatgtggtttatttgggaaaggaggaatcgttacatgtgcgatgttcacttgcaagaaaaatatggagggaaaaatagtacagccagaaaatctagaatatacaatagttgttaccccacattctggtgaagaacatgcagtaggaaacgacactggaaaacacggaaaagagattaaagttacacctcagtcgagcatcactgaagccgaactgacaggctatggtacagttacaatggaatgttcaccgcgcacaggtttagactttaatgagatggtactattgcagatggaaaacaaggcttggctcgtccacagacaatggttcctagacctgccgttaccgtggctacctggggcagataaacaggaaagcaattggatacaaaaagagacattggttaccttcaaaaacccacacgcgaagaaacaagatgttgttgttcttgggtcacaagagggagctatgcacacagcgctaacgggtgcaactgagatccagatgtcatcggggaacttacttttcaccggccaccttaaatgtcgcctacgaatggataaacttcaattaaaaggaatgtcatatagtatgtgtacagggaagttcaaggtcgtaaaagaaattgcagaaacgcagcatggcacaatcgtgattagggtacagtacgaaggagacggatccccctgtaaaataccttttgaaataatggatttagaaaaacgatatgtacttggacgattaattactgtgaaccccattgttacagaaaaagattcacctgtaaacatcgaagcggaaccaccattcggtgattcatacataataattggtgtggaacctggacagctcaagttaaactggtttaaaaagggaagttcaataggtcaaatgtttgaaactacaatgagaggagcaaaaagaatggcaatacttggtgatacagcatgggattttgggtctttaggtggagtattcacatctataggtaaggccttacatcaagtattcggtgctatttacggtgcagcctttagtggggtaagctggacgatgaaaattcttataggagtaataataacctggatcggaatgaactcccgatccacaagcctgtcagtttcgctagtacttgtcgggatagttaccttatatttaggcgtgatggtacaagcggactctggatgcgtagtgtcctggaaaaataaagaactcaaatgcggatctggtatatttattacggataacgttcatacatggacagaacaatataagtttcaacctgaatcaccaagtaagttagcctcagcaatccaaaaggcgcaagaagaaggcatatgcggaatacgaagcgttacgcgtctagagaatttaatgtggaaacaaattactccagagttgaaccatattttagcggaaaatgaggtcaaactaacaataatgactggagatattaaaggtatcatgcaagcaggaaagcggtcccttagaccacaaccaacagaattgaaatactcttggaaaacctggggaaaagcaaaaatgttatccattgaatcgtataatcaaacattcctgatcgacgggccggagactgctgaatgccctaatactaacagagcatggaactccttagaggtagaagattacggtttcggggtctttactacaaacatttggttaaaacttaaagaaaaacaagacgcattctgtgacagcaaactcatgagcgcagctatcaaagacaatagagcagtccatgctgatatgggttattggattgagagtgctctgaacgatacatggaagatagagaaagcatcgtttatagaggtcaagaattgccactggccaaaatcacacacgctatggtcgaatggcgtgttggaatcagaaatgataattcctaagaatctagctggacccgtaagtcaacataattataggcccgggtaccacacacaaatagccgggccgtggcatctagggaaactagagatggatttcgatttctgtgacggaacaactgtaatagtgacggaagattgcggaaatcggggtcccagcctacgcacgactacggcatctggaaagttaatcactgagtggtgctgcaggagctgcacgttacccccgttgcgttatcgaggagaagatgggtgttggtatggcatggagatacgaccactaaaagaaaaagaagaaaatctcgtcaattcattggtcacggcaggccatggacaagtcgataatttttccttgggagtcttaggtatggcattattcttggaggaaatgctcagaaccagagtcgggacaaaacatgccattcttttagttgctgtcagttttgtgacactaattactggcaatatgagcttcaaagacctaggtagagtcgtcgtaatggttggtgctaccatggcagacgatatcggtatgggagtaacctacctagctttacttgctgcattcaaagttcgtcccacgttcgcagccggtcttctactgcgcaaattgactagcaaagagttgatgatgacaacgatcggaatagtacttctcagccagtcaacaataccagagacagttctagagctaacagacgcccttgctctaggcatgatggtattaaaaatagttagaaacatggagaaataccaactggctgtaaccatcatggcgatattgtgcgtgcctaacgctgttatactacaaaatgcatggaaagttagctgcacaattctagctgtagtgagtgtatcacctctacttttaacgagctcgcagcagaaaactgattggattccattagcacttacaatcaaaggcttaaatccgacagcaatttttctcacaaccttatcaaggacaaacaagaaacggagttggccattaaatgaggcaatcatggctgttggaatggtcagtatattagcatcgtccctactgaaaaacgatataccaatgaccgggcccttagtagcaggaggattattgactgtgtgttatgttctaacggggcgatcggctgatctagaactagaacgagccaccgatgtaaaatgggaggatcaagcagagattagtggcagcagtcccattctaagtatcacaatatccgaagatggctcaatgagcattaagaacgaagaagaagaacaaacgttgactattttgattagaacaggtttgctagtcatctccggtttattccctatttccatccctataaccgccgctgcttggtatttatgggaagtcaaaaagcagagagccggtgttctgtgggatgtaccgagtccaccccctatgggaaaagccgaactagaggacggtgcatacagaataaaacaaaaaggcatcttgggttacagtcagatcggtgcgggggtctacaaggaaggaacattccatacgatgtggcatgttacacgaggtgctgtccttatgcataagggcaagaggatagaaccctcatgggctgatgtaaagaaagatcttatatcctacggtggtggctggaaattagaaggtgagtggaaagaaggtgaagaagttcaagttttggcattggaacctgggaaaaatccgagagctgtgcagacaaaacctggcttattcaagacgaatacgggaactataggagccgtctcattggacttcagtcctggaacatcgggcagccccataatagataagaaaggaaaggtcgtcggactctatgggaatggtgtagtcacgagatcaggagcgtacgtctcagcaatagctcaaacagaaaagagcatagaagacaatccagaaatagaagatgatatattccgcaaaaggagattaacaattatggacctacaccctggcgctggaaagacaaaacgatacctaccagctattgtcagagaagcaatcaaaagaggactgcgcactctaattctcgcgccgacgagagtggtcgcagcagagatggaagaggccctacgaggattaccgatcagatatcaaacaccagcaatacgagccgaacacacgggacgtgaaatcgtagaccttatgtgtcacgcaacctttacaatgcgattgctcagcccagttagagttcccaattataatctaataattatggatgaagcgcactttacagatcccgcctccattgcagccagggggtatataagcactagagtcgaaatgggagaagcggcagggatattcatgacagccactcccccgggatcaagagatccattcccacaaagtaatgctccaattatagatgaagaacgtgaaattcctgaaagatcctggaatagtggacacgaatgggttactgatttcaagggcaaaacagtctggttcgtaccaagtatcaaagccggtaatgacattgcagcttgtcttcggaaaaatgggaagaaggtaatccaattaagccgaaaaacctttgactctgagtatgtcaagacaagaaccaatgattgggatttcgttgtcacaacggatatttccgagatgggggctaatttcaaagctgaaagagtcatagacccaagaagatgtatgaagccggtaatactcacagacggggaagaaagggtaatattagctggacctatgcccgtaacacactcaagtgcggcacagaggcgtgggcgaatagggagaaacccgaaaaatgagaatgaccaatacatttatatgggtgagccgctagaaaatgatgaagattgtgcacattggaaagaggcaaaaatgttattagacaatataaacacaccagaaggaataataccaagtatgtttgaacccgaacgagaaaaagttgatgccatagacggagaatacaggttaagaggagaagcaagaaagacatttgttgatttgatgcgcagaggagacctaccagtctggttagcttacaaagtagcagcagaaggtataaactacgcagacagacggtggtgctttgacggtattaaaaataaccaaatattggaagaaaacgtagaagtagaaatatggactaaggaaggtgaaaggaaaaagttaaaaccaaggtggctggacgcgcgtatctactccgacccactcgctttaaaggaatttaaagagtttgctgctggcagaaagtcactgaccctaaaccttatcacagagatgggaaggttaccgacatttatgactcaaaagacgagggatgcattagataatttagcggtgttacatacagctgaagcgggtggtagagcatacaatcacgccttgtctgagttacctgaaactctggaaacgttattacttttgactttgctagcaacagtaacaggagggatatttctgttcctcatgagtgggcgtggtattggaaaaatgactcttggtatgtgttgtataattaccgcatctatcttgttatggtatgcccaaattcaacctcattggatagccgcttcgataattcttgagttctttctaatagtactcttaatcccagaaccagaaaaacaacggactcctcaggacaatcagctaacatatgttgttattgctatcctaacggtagtagcagcaacaatggcaaatgaaatgggatttctcgaaaagactaagaaagatcttggcctgggctccatcgcaacgcaacaaccagaaagtaatatccttgatatagacctgaggccagcctctgcctggaccctctatgcagtcgcaacaactttcgtaacaccgatgctccgacattctatcgaaaattcctcagttaacgtatctcttactgctatagctaaccaagcaacagtattaatgggcctgggcaaagggtggcctttatccaaaatggatattggagtgccacttttagcaataggatgttacagtcaagtcaatccgatcacgcttacagcagcccttctattgcttgtcgcacattatgcaatcataggtcctggactacaagcaaaagcaacgcgagaagcccagaaaagagcggctgccggaataatgaaaaaccctacagtagatgggataaccgtcatagaccttgacccaattccatacgatccaaagtttgaaaagcagctgggacaggttatgctgttaattttatgtgtaacccaggtattaatgatgcgcacaacctgggccttatgcgaagctctaacactagctactggacctatttctacactttgggaaggtaatcctggaaggttttggaacacaacaattgcagtctcgatggcaaacatatttcgaggtagctatctagcgggtgctggacttttattctctataatgaaaaacacaactaatacgagaagagggacgggcaacatgggagaaacgttgggagaaaaatggaaaagtaggctaaatgcactgggaaaatcggaatttcagatatacaagaaatcgggtatacaagaagttgacaggacacttgctaaggaagggataaaacgcggtgaaactgatcatcatgcagtgtcaagaggtagtgcaaagctacgttggtttgttgaaagaaatatggtgacacctgaaggcaaagtagttgatctaggttgcgggcgcggaggctggtcgtattattgtgggggcttgaaaaatgtaagagaagttaagggcctaactaaaggaggtcctggccacgaggaaccaatacccatgtcaacatatggatggaacctagtaagattacaaagtggagtagatgtgtttttcattccaccagaaaaatgcgacacattattgtgcgatattggtgaatccagccccaatcctacggtagaagcgggtcgtaccttaagagtattgaatttagtcgagaattggcttaataataacactcagttctgtataaaggtgttaaacccatacatgccgtctgtaattgagaaaatggaagcattacaaagaaaatacggaggcgcacttgttcgaaaccctctatcacggaatagcacacacgagatgtattgggtgtccaatgcaagtggtaacatagttagtagtgtgaatatgatttcgcgaatgctaattaacagattcacgatgcgacataaaaaggctacgtacgaacctgacgtggatctaggcagtggcaccagaaacataggaattgaaagcgaaataccaaacctagatataataggcaagcgaattgagaaaataaaacaagagcatgaaacatcttggcactacgatcaagatcacccatataaaacttgggcgtatcatggtagctacgaaacgaaacaaacaggatcagctagtagtatggtgaatggggtagtgaggctactgaccaaaccatgggacgtactaccaactgtgactcagatggccatgaccgataccactccgttcggtcaacaaagagtgtttaaagaaaaagtcgacacacggacacaagaaccgaaggagggaaccaagaaactaatgaagataacagccgagtggttatggaaggaattaggcaagaagaaaaccccacgcatgtgcacgcgtgaagaatttacaagaaaagtcagatctaatgcggcattaggagccatattcacagacgaaaataaatggaaatcagcgcgggaggccgttgaagattcaaggttttgggaactcgttgataaagaacgaaatctccaccttgaagggaaatgtgaaacatgcgtttacaatatgatggggaagagagagaagaaacttggcgaatttggaaaagcgaaggggagtcgcgcaatatggtatatgtggttaggcgccaggttcttagagttcgaggctttaggcttcctaaacgaagatcactggttcagccgagaaaattcacttagtggagtggaaggcgaaggactgcacaagctaggatatatattaagagacgtatctaagaaagagggaggcgccatgtacgccgatgacactgcaggttgggacacaagaataactctagaagatttgaaaaatgaagaaatggtcacaaatcatatggaaggagagcacaagaaactagctgaagctattttcaaactaacatatcaaaacaaggtagtccgcgttcaacggccaactcccagaggcacagtaatggacataatatcaaggagagaccaacgaggtagtggacaagttggtacctatggccttaacacattcacaaatatggaagcccaactcatacgtcaaatggagggagaaggagtctttaaaaacattcagcatctgaccgttacggaggaagtggctgtacaaaattggttggctagggttggaagagaacggctatctagaatggcaataagtggtgatgattgtgtagtaaaacccctagatgacaggttcgcgaacgcactaactgctttaaatgatatgggaaaaatacgaaaggatatacaacaatgggaacctagcaagggttggaacgactggacacaagttccattctgctcacaccattttcatgaactaataatgaaagacggcagagtcctagtcgtcccttgtcgtaaccaagacgaactgattgggagagcaagaatatcacagggtgctggatggtccctaagagaaactgcatgtctgggaaaaagttacgcacaaatgtggtcactaatgtattttcatcggagagacttacgcctagctgctaatgcaatttgcagtgccgtaccctctcattgggtacctacgagtagaacgacgtggtcaattcacgcaaagcatgaatggatgactacagaagatatgttaacagtatggaatagggtatggataagagagaatccctggatggaagataaaacaccagtagaatcatgggaagaaattccgtaccttgggaaaagagaggaccaatggtgtggttctttaatcggtctaacaagtagagcaacatgggccaaaaacatacaagcagcaataaaccaggttcgttctctaataggcaatgaagaatatactgattatatgccatcaatgaagagattccgacgggaagaagaagaggccggtgtattgtggtga

SEQ ID NO: 22831 - RNA, 9876 nt, synthetic construct
  misc_feature 1..9876: note = derived and/or modified CDS sequence (opt6) from DENV-2__FM210246__SS-prME
  source 1..9876: mol_type = other RNA
agtgctggtatgattattatgctgataccaactgtaatggcatttcaccttactacaagaaatggagaaccacacatgatagtagggattcaagaaaaaggtaaaagtttactatttaaaaccgaagacggagtaaatatgtgtacccttatggcaatggacttgggagaattgtgcgaggatacaataacatacaaatgccctctactgcgccagaatgaacctgaggatatagactgctggtgtaattcgacttccacatgggttacctatggaacctgcacgactacaggcgagcaccgtcgagagaaacgctccgtggcgttggtgccacacgtaggaatgggattggaaactagaacagagacgtggatgagttctgaaggggcatggaaacacgcacaaagaatagaaacatggatactaagacatcccggatttaccattatggcagctattttagcatacacgattggtacgactcattttcagcgcgtgctaattttcatactactaacagctgtagcgccgtcaatgacaatgaggtgtataggaatctcaaacagagattttgtagaaggcgtgagcggtggtagttgggttgatattgtattagaacatgggagctgcgtaaccactatggcgaaaaataaaccaaccttggattttgaactcataaaaacagaagcaaaacaaccggcaacattaaggaaatactgtattgaggccaaattaaccaacactacaacggaatcgcgatgcccaacacaaggggagccttcactaaaagaagaacaagataaacgatttgtatgtaaacattcaatggtagataggggatggggcaacggatgtggtttattcggcaaaggaggtatagtaacatgcgctatgtttacttgcaagaaaaatatggaaggaaaaattgtacaaccagagaacttagaatacactattgtagtaaccccgcatagcggtgaagaacatgcagttggtaacgatacaggaaaacatggaaaagaaataaaagtaacaccacaaagttcaatcaccgaagccgagttaacgggatacggaacagtaactatggaatgtagcccaagaaccggtcttgattttaatgaaatggtcttactacaaatggaaaataaggcttggctagttcatagacaatggttcctagaccttccgttgccgtggcttccaggtgcagataaacaagagagtaattggatacaaaaagagacattagtaacattcaaaaatccgcatgctaagaaacaagacgtagttgttctaggatcacaagagggtgccatgcacacagcactgacgggtgcgactgagattcaaatgtcaagcgggaatttgttgttcactggacacttaaaatgcagattgagaatggataaacttcagttaaaagggatgagttatagcatgtgtacaggaaaattcaaagtagtaaaagaaattgctgaaacacaacatggcactatagtgataagagtacaatatgagggagatggaagtccgtgtaaaattccttttgaaattatggatcttgaaaaacgttatgtattgggtcgattgattacagttaatcccatagtcacagagaaagatagccccgtaaatatcgaggctgaacccccatttggtgactcatatataattattggcgtcgaacccgggcaattaaaattaaattggttcaagaaaggatcaagcattgggcagatgtttgaaacaaccatgcgaggtgcaaaacgcatggccatcctaggagatacagcttgggactttggcagcttaggaggagtgttcacgagtataggaaaagcattacatcaagtgttcggcgcgatctacggtgctgcttttagtggagtctcatggacaatgaagattcttataggggtcataatcacctggatcggtatgaactcaagatccacctcgctaagcgtatcactcgtattagtaggtatagtcacgctatatctaggcgtaatggtccaagcagatagtgggtgcgtagtaagctggaaaaataaagaattaaagtgcggatcaggaattttcataacggataacgtacatacatggactgaacagtacaaattccagccagaatccccgtctaagctcgcgtcagcaattcagaaagcacaagaagagggcatatgcgggatacgatcagtaactcggctagaaaatctaatgtggaaacaaataacgccggaattaaatcatatcctagcagaaaatgaagtaaaacttacaattatgacaggagatataaaaggaataatgcaagcaggaaaacgttcattacgaccccaacctactgagttaaaatatagctggaaaacttgggggaaggctaaaatgctgagcacagagagctttaaccaaacattccttatagatggtccggaaacggccgagtgtccgaatactaatagggcatggaatagtctagaagtggaagactatggattcggagttttcacaaccaacatctggctaaagttgaaagaaaaacaagatgcgttctgtgattccaaattgatgtcagcggcgataaaagataatagggcagtgcacgcagatatgggctattggatcgagagtgccttgaacgacacttggaaaatagagaaagcctcgtttatagaagttaaaaactgtcactggcccaagtcacatacattatggtcgaacggagtattagaatcagaaatgataataccaaagaacctagcaggaccagtcagtcaacataattacagaccaggatatcacacacaaattgctgggccatggcacttgggtaaactcgaaatggatttcgacttttgtgacggaaccaccgtaatagtaacggaagactgcggtaatagaggacctagcctccgcactactacagctagcgggaagttaataactgaatggtgctgtagaagttgcacactcccaccattacgataccgaggagaagatggatgttggtacggaatggaaatacgtccactaaaagaaaaagaagaaaacctcgtcaattcgctcgttaccgcaggacatggccaggttgacaacttttctctcggagtactaggaatggctctgttcttggaagaaatgttgagaacccgagtaggtactaaacatgcgatactgttagtagccgtatctttcgtgactttgataaccggaaacatgtcattcaaggacttagggagagtggtcgtaatggtaggagctactatggccgacgatattggtatgggggttacttatctagctttactagcagcattcaaagtccgacccactttcgcagcggggctcttactcagaaaattaacatcaaaagaattaatgatgacaacaattgggatcgttctgctaagccaatccacgatacccgaaactgtacttgaactcactgatgcactagcccttggtatgatggtcctgaaaatagtgagaaacatggaaaaataccagttggcagtaacaatcatggcaatcctatgcgttcctaatgcggtaattttacaaaatgcatggaaggttagttgtactatcctagctgttgtatccgtttcgcctctattattaacctcatctcaacagaaaacagactggatcccattagctcttacaataaaggggctaaatccaacggccatattcttgaccacattaagtagaacaaataagaaacgatcatggcctttaaacgaagctataatggctgtgggaatggtatcaattctagcaagctctcttctcaaaaatgatattccaatgactgggcctctcgtagcagggggactgcttaccgtgtgctatgttttaacaggaagatccgcagatttggaactcgaaagagcaacagacgttaaatgggaagatcaggctgaaatcagtggttcctcgcctatcctatcgattaccataagtgaagacggcagcatgagcatcaaaaacgaagaagaagaacaaacattgacaattctaatacgaactggattgctagtaatatcgggattgttccccatctctatacctatcacagctgccgcatggtatttatgggaggtcaagaaacaacgcgctggtgtactctgggatgtaccttctccaccgcccatgggcaaagcggaactagaagatggggcctatagaataaagcaaaaggggatattagggtacagccaaataggagcaggcgtatataaagaaggaacctttcatacgatgtggcatgtgacccgtggagcagtattaatgcataaggggaagcgaattgaacctagttgggcggacgtcaagaaagaccttatctcgtatggtggcggatggaaacttgagggagagtggaaagaaggcgaggaagtacaagtacttgccttagaacccggcaaaaatcctagagctgtacaaactaaacctgggttattcaaaacgaacactggcaccatcggagcagtatctttggacttttctccagggacgtctggttcgccgataatagacaagaaaggcaaagtggtaggactttatggaaacggagtggttacacgatcgggagcttatgtctcagcaatagcccaaacagagaaatctattgaagataatccggaaatagaagacgacatttttcgtaaaagacgtctcacaatcatggacttacacccaggagccgggaaaactaaacggtacttacctgcaatagtacgggaagcgattaagcgcggtttaagaaccctgatattagcccccacccgagtggttgcggccgagatggaggaagccctacggggacttcctataagataccaaaccccagccattagggctgaacacactggaagagaaatcgtagatcttatgtgccatgctacatttacaatgcgcttactatcaccagtcagagtaccaaactataacctaataatcatggacgaagctcacttcacggaccctgcctccatagcagcgcgcggatacattagcacacgagttgagatgggtgaggccgcgggcatttttatgaccgcaacgcctccaggctccagagacccgttcccacagtcaaacgcaccaataatagatgaagaaagggaaataccagaaagaagctggaactcgggacatgaatgggtaacagactttaaaggaaagaccgtttggtttgtaccctcaataaaagccggtaacgatatagctgcttgcctaaggaaaaatggcaaaaaggtcattcaattatcgagaaaaacatttgattcagaatatgttaaaactagaacgaatgactgggattttgttgttactactgacatatctgaaatgggtgcaaacttcaaagcggaacgtgtaatagatcctagaagatgcatgaaaccagttattctcactgacggggaggaacgagttattttggcaggtccaatgcccgtaacacactcgtctgctgcccaaagacgtggaagaattggaagaaatcccaaaaatgaaaacgaccaatatatctatatgggagaacctcttgaaaacgacgaagattgcgctcactggaaggaggctaagatgttgttggacaacataaacactcccgaaggaataataccttcgatgtttgaaccagaacgtgagaaagtagacgccattgacggcgaataccgtttaagaggagaagcccgtaagacctttgttgatcttatgcgaagaggagatttacccgtgtggttggcctacaaggtagctgctgaaggtatcaactacgcagatagaaggtggtgctttgatggtatcaaaaataatcaaatattagaagagaatgtagaagtggaaatctggacaaaagaaggggaaaggaagaaattgaaacctcgttggctcgatgcaagaatttattctgacccattagcactaaaagaatttaaggaatttgctgctggaagaaagagcttaaccttaaacctaataacggaaatgggaagactgccaacctttatgacgcagaaaaccagggatgcattggataacctagcagttttacatactgcggaagcagggggacgtgcgtataaccatgcgcttagcgaattaccggaaactttagaaactcttttgttacttacgttgctggcaactgtaacaggtggtatatttctatttttgatgtctgggcgtggaatcgggaagatgacgttaggcatgtgttgtattattaccgcgagcatactactatggtatgcgcagatccaaccccactggattgcggcatccataatattggagttctttttgatcgtactattaattccagaaccagaaaagcaaagaacaccacaagacaatcaattaacatatgtagtaatagcaatactgactgtcgtagccgccaccatggcaaacgaaatgggttttctggagaaaactaaaaaggacctcggactcggtagcatagcaacacagcagcctgaatctaacatattggatatcgatctgagaccagctagcgcatggactctttatgcagtagccactacctttgtaacacctatgttaagacatagtattgaaaattcaagtgtcaatgtcagcttgacggctatagctaaccaagcgactgttttaatggggctaggaaaaggttggccgttgagtaaaatggatattggagtccctttgcttgctatcggatgctacagtcaggtaaatcccatcacactaactgcagctcttttattgcttgttgcgcattatgctattataggcccaggattgcaagcaaaggcaacgagagaggctcaaaaacgagcagctgccggaataatgaaaaatccaacagtagatggaatcacagtgattgatctagatccaatcccttacgatcccaaattcgaaaaacagttgggacaagttatgcttctaattttgtgtgttacccaagttttaatgatgaggaccacatgggctctgtgtgaagcattgacattagctacaggtccaatatcgacattatgggagggtaacccaggccgattttggaatactacaatagctgtatcaatggcaaatatctttcgtggtagctatcttgcaggggctggtcttctattcagcatcatgaaaaatacaacaaatacgagacgaggtacagggaatatgggagaaactttaggagaaaagtggaaatcaaggctaaatgctctcggaaaaagtgaatttcaaatatacaaaaagtccggcattcaggaggtggatcgaaccttagctaaagaaggtattaagcgtggcgaaacagatcatcatgcggtgagcagaggttcggccaagttgcgttggttcgtcgaacgaaatatggtaacaccagagggtaaagtcgtagacttgggctgcgggaggggcgggtggtcgtactattgtgggggactcaaaaatgtaagagaagttaaagggttgactaaagggggtcccggacatgaagaaccaatccctatgtcgacatacggttggaatctggtacgtctccagtctggggttgacgtcttctttataccgccggaaaagtgcgacacgttattgtgtgatatcggtgagagctccccaaatccgaccgtcgaagccggaagaactttaagggtattaaatctagtagagaattggcttaacaacaatacacaattctgtatcaaagttctaaatccgtacatgccgtcggtaatcgagaaaatggaagcattacaaagaaaatatggaggagcgcttgtacgaaaccctctttctcgtaattctactcacgagatgtactgggtatccaacgcatcgggaaacattgtaagctcagtgaatatgatatccagaatgttaattaatagatttacaatgagacacaagaaagctacatacgaacctgatgttgatctcggatctgggacgcgaaatataggaatcgaatccgaaataccgaatttagacataataggcaaacgaatagagaaaataaaacaagagcatgaaacaagttggcactatgatcaagatcatccctacaaaacctgggcgtaccatgggtcatacgaaacaaaacaaacaggttccgcgtcgtcaatggtaaatggtgtagtccgactgttaactaaaccctgggatgtcctacctacagtcacacaaatggctatgacggacactaccccttttggacagcaacgagtcttcaaggaaaaagtagataccagaactcaagagcccaaagaaggtacgaagaagttgatgaaaataacagcagaatggctttggaaagaactaggtaagaagaagacgccaaggatgtgtacaagagaagaatttacaaggaaagttagaagcaatgcggcattgggcgctatattcacagatgaaaataaatggaaaagtgctagagaggcggtagaagactcccgattctgggaattagttgataaggaaagaaatttgcatctagaaggtaagtgcgaaacatgtgtatataatatgatgggtaaaagagagaagaaactaggcgagttcgggaaggcaaaaggatcacgagcaatatggtacatgtggttgggtgctagatttttggaatttgaggcactgggtttcttgaatgaagaccactggttctcacgagaaaatagcttatctggtgtagaaggggagggactacacaaactgggttacattctaagggatgttagcaagaaagagggcggagcaatgtacgctgatgacacagctggatgggataccaggataacacttgaggacttgaaaaatgaagagatggtcactaatcatatggaaggtgagcataagaaactagccgaagctatatttaaactaacatatcaaaataaagtagtaagagtacaacgtccgacaccccgaggaacagtgatggatataatcagcagacgggaccaaagaggtagtggacaagtaggaacatacggcctcaatacctttacgaatatggaagcgcaattgataagacaaatggaaggggagggagtttttaaaaatatacaacacctaacagtgacagaggaagtcgctgtaaagaactggctagctcgtgtgggtagggagagactaagcagaatggcaattagcggggacgactgtgtagtaaaaccactcgatgatagattcgctaatgctttgactgctttaaatgatatggggaaaatcagaaaggatatacagcaatgggaaccttcgaaaggttggaatgattggacccaagttcctttttgttcgcaccattttcatgaattaataatgaaagatgggagagtcctagtagtcccctgtagaaatcaagatgaattaataggcagagcacgcatatcacagggtgcaggttggagtttgagagaaactgcctgccttggcaaaagctacgcccagatgtggtcacttatgtattttcatcggagggacttacgccttgcagctaatgctatatgctctgcagtgccgtctcactgggtaccaacctcaagaactacgtggtcaattcacgcaaagcacgaatggatgactacagaggacatgttaactgtatggaaccgagtttggataagagagaacccgtggatggaagacaagacaccagtagaaagctgggaggaaataccgtaccttggtaaaagagaagaccaatggtgcggatcgttaatcggcttaacttcacgcgccacatgggcgaagaatatacaagccgctattaatcaggttagaagtttaataggtaacgaggaatatactgattatatgccatcaatgaagagatttaggcgagaagaggaagaggccggtgtactctggtga

SEQ ID NO: 22832 - RNA, 9876 nt, synthetic construct
  misc_feature 1..9876: note = derived and/or modified CDS sequence (opt6) from DENV-2__FM210207__SS-prME
  source 1..9876: mol_type = other RNA
tcggccggaatgataattatgctgataccgacggttatggcattccacttaactacaaggaatggagaaccacatatgatcgtaggaatacaagagaaaggaaaatcacttctcttcaaaacagaagatggggtaaacatgtgcactctaatggctatggatttaggtgagctttgtgaggatacaataacctataaatgtcctttattgaggcagaatgaaccagaagacatagactgttggtgtaattcaacatcgacctgggttacctatggaacatgtacaaccacaggggaacatagacgcgaaaaaagaagtgttgcattagtcccgcacgtaggtatgggacttgagactaggacagaaacttggatgagtagtgaaggtgcatggaaacacgctcaaaggatcgagacatggattttaagacatcccggttttaccatcatggcagcaatattagcatacacaataggaacgactcatttccaaagagtgttgatctttatactcctaacagccgttgcaccatctatgacaatgcggtgtattggtatatccaatagagatttcgtagagggtgtaagcggcgggtcatgggtcgacatagttctagagcacggctcgtgtgtcactacaatggcgaagaacaaacccactcttgacttcgaactgattaagacagaagcgaaacaaccagcaaccttgagaaaatattgcattgaagccaaacttaccaacacaaccacagaaagcagatgcccgacgcagggagaaccgtctctgaaggaagaacaagacaaaagatttgtgtgcaagcacagcatggtcgaccgtggatggggcaacggctgcgggttattcggcaaaggtggcattgtaacttgcgcaatgtttacgtgcaaaaaaaacatggagggaaagatagtgcaacccgaaaacctagaatatacgatagttgttacgccgcattccggcgaagaacacgctgtgggaaatgacactggcaaacacggtaaagagataaaggtcactccacaatccagcataactgaagcagaacttactggctatggaacggttacaatggaatgttcgcctcgcacagggctagactttaacgaaatggttctgctacaaatggagaataaagcttggttagtgcatagacaatggtttctagatttacctctaccttggttacctggagcagataagcaagaaagcaattggatacaaaaggagacattggttacatttaaaaatccacacgcgaagaaacaggacgtcgttgtcctaggttcgcaagaaggggccatgcacacagctctcacaggtgctacagaaattcaaatgtccagcggcaatcttttattcacgggccatctaaaatgcagattaagaatggataaactgcaattaaaaggaatgtcatatagcatgtgtacaggaaaatttaaggtggtaaaagagattgcagaaacacaacatgggaccatagttataagagtacaatatgaaggagatgggtcaccctgtaagataccatttgaaataatggacttagagaaacgctacgtattaggaagactaataaccgtaaacccgatagtaacagagaaagattcgccggtaaatatagaagcagagcctccgtttggcgattcttacataattatcggtgttgagccagggcaacttaaactgaattggtttaaaaaaggaagcagtataggccaaatgtttgagactacaatgaggggcgcaaaacggatggccatactaggagatacggcatgggatttcgggtcgttaggcggcgtgttcacttcgataggaaaggctttacatcaggtattcggagccatctacggagcagcttttagtggagtcagttggaccatgaagattctgataggagtgatcatcacatggataggaatgaactctagaagtacaagcctttcagttagcctagtattagtcggaatagtgaccctatatctaggtgtaatggttcaggctgattctggttgcgtagtatcgtggaaaaacaaggaattaaaatgtggatccggcatttttataacggataatgtacatacatggactgaacaatataaatttcagccggaaagcccatctaagctagcatcagctatacaaaaggcacaggaagaaggaatatgtggaataagatcagtaacgaggctggagaacctaatgtggaaacaaataactccagaattaaaccatattttagccgagaatgaagtaaaactaacgataatgaccggtgacataaaaggcattatgcaggctggtaaaaggtcactacggccacaaccgaccgagctgaagtattcatggaaaacgtggggcaaggcaaagatgctttccacagagtcttataaccaaaccttcttaatagatgggcctgaaacggcagaatgtccaaatacaaatagagcttggaacagtctggaggtagaagactacggttttggggtgtttacaacaaacatatggttaaagttaaaagaaaaacaggacgcattctgtgacagcaaattaatgtctgctgccataaaggataatagagcggttcatgcagacatgggctactggatagaaagtgcactaaatgacacatggaaaatcgagaaagcatcattcatagaagttaagaactgccattggcctaagtcacacacattatggtctaatggcgtccttgaaagtgaaatgataataccaaaaaatctagcgggcccagtctcacaacataactatcggccgggataccacacacagatagctggaccatggcaccttggaaaactagaaatggatttcgatttttgtgatggcacaacggtaattgtaactgaagactgcgggaatagaggacctagcttaagaactacaacggcttccggaaaattaataaccgagtggtgttgcagatcttgcacactacccccattgaggtatcgtggtgaggatggttgttggtatggcatggagattagaccgttaaaagaaaaagaagaaaatttggtcaattcactagtaacagcaggtcacggtcaagttgataattttagtcttggagtactcggaatggccctcttcttagaggagatgcttagaactagggtcggtacaaaacacgcaatccttttagtggctgtgtcattcgtgacactaatcacgggcaacatgagttttaaggacctcggacgggtagtcgtaatggtgggcgctacaatggcggacgacataggaatgggcgtaacgtacttagctctactggccgcttttaaggtaagacctacttttgcagcaggcctattattaagaaagctcacaagtaaagaactaatgatgacgactatcggaatagtgctcttatcccagagtacaatacctgaaacagtcttagaattaacagacgcgttagcattaggaatgatggttctgaaaatagtaagaaacatggaaaaataccaactggcagtgactataatggcaatactatgtgtacctaacgcagtgattctacaaaacgcttggaaagtttcctgtacgatactggcggttgtatccgtatccccactactattaacatcgtctcaacaaaagaccgactggataccacttgcgctaactataaaaggtcttaatccaaccgctattttcttaacaacactttcaaggacaaacaaaaaaagaagttggcctctaaatgaagctattatggcggtgggaatggtttcaatcttagcatcttccctactaaaaaatgatattccaatgacaggaccgttagtcgcaggtggattattaacagtttgttacgtattaactgggagaagtgctgacctggaattggaaagggcgacggacgtaaaatgggaagatcaagcagagatatctgggagctctcccatattaagtataacgatttcagaggatggatccatgagcataaagaacgaagaagaagaacaaacactaacaatccttattcgcacagggctattagtaatctcaggcctgtttccaataagcatacctatcacggctgcagcatggtatctatgggaagttaaaaaacaaagagcaggagttttatgggatgtaccctcgccaccaccaatgggaaaagctgaactagaggacggagcatatagaattaaacaaaaaggtatcttgggatactcacagataggcgcgggagtgtataaggaaggcacttttcatacgatgtggcatgttaccagaggagccgtacttatgcacaaaggtaaaagaattgaaccctcctgggcagatgttaaaaaagatttaatatcttatggaggcggatggaaattagaaggagaatggaaggaaggagaggaggtgcaagtgttagccttggagccaggaaaaaacccccgagcagttcaaacaaaaccgggattgtttaagacaaacacagggacaatcggggccgtaagcctagatttttcacctggtacgagcggaagtccgatcatagataaaaagggtaaagtggttggactgtatggaaacggagttgtaacccgatcaggtgcatatgtgtcagcaatcgcacaaactgagaaatctatagaagacaacccagaaatagaagatgacatcttcagaaaaaggagattaacaattatggatttacaccccggagcaggtaagacgaagcgatatttaccagcgatagtaagagaggcgataaagcgtggcttaaggacattaattttagctcctacaagagtagtcgcagcagaaatggaagaagcgttacgaggactgcccataaggtaccaaacgccggctattagggcggaacatacgggacgtgaaattgttgatctgatgtgtcatgcaacgtttacaatgaggcttctatcgccagtacgcgtcccaaattataatttaatcatcatggatgaagcacatttcacagatcctgcctccatagcagcaagggggtatatatcaactagagttgaaatgggtgaagccgctgggatctttatgactgcaacaccacccggttccagagaccctttcccacaatcaaatgccccgatcatcgacgaagaaagggagatcccagaacggtcctggaattcaggtcacgagtgggtgaccgactttaaaggcaagactgtttggtttgttccatccataaaagctggaaatgacatcgctgcctgtcttaggaaaaatggcaaaaaggttatacaactgtctagaaaaacatttgacagcgaatatgtaaaaacccgaaccaatgactgggactttgtggtaactaccgacatatctgaaatgggagcgaatttcaaagcagaacgcgtaattgaccctcgaagatgcatgaaaccagttatactaactgacggcgaggaaagggtgatactggcaggacctatgccggtgactcattccagcgcagctcaaagaagaggcagaataggtagaaaccctaaaaatgaaaacgaccaatacatatacatgggagaacctctagagaatgatgaggattgcgcgcactggaaggaagcaaagatgctcctggataacattaatacacctgaagggataattccctcaatgttcgaaccagaacgagaaaaagtggacgctattgacggtgagtaccggctaaggggagaggccagaaaaacctttgttgatttgatgaggcgtggtgatttaccagtctggctcgcctataaagtagctgcggagggtattaattatgccgaccggagatggtgcttcgatggaatcaaaaacaatcaaatcctagaggagaatgtggaagtcgaaatatggactaaagaaggagaaagaaagaaactaaaaccaagatggctagacgcacgaatatattcggaccctctggcgttgaaggaatttaaggaatttgcggctggtagaaaatcgctcaccttaaatttgataaccgagatgggacgactaccaacatttatgacccagaagactcgagacgcgcttgataatctcgctgtactacacactgccgaagctgggggaagagcatataatcatgcattgtcagaacttccggaaacattggaaaccttgctacttttgactttactagccacagttaccggaggaatctttctatttttaatgagtgggagaggtattggaaaaatgactttaggcatgtgctgtataataacagcaagtatcctgttatggtacgctcaaatacagcctcactggattgcagcaagcattatcctagagttttttctgatagtattactaatacctgaacccgaaaagcaaagaacaccccaagataaccaattaacatatgttgtaatagcgatattaacagttgtagccgccacaatggctaatgaaatgggctttttagaaaaaactaaaaaggacttgggactagggagcattgcaacccagcagcccgagtcaaatatcctggatatagaccttcggccagcttcagcatggaccttgtatgcggtagcaactaccttcgttactccaatgttacgacatagtatcgaaaatagttccgtaaatgtatcactaacagcaatagcaaatcaagcaacagtgttaatggggttaggaaagggatggccgttgagtaaaatggatatcggcgtaccactattagcaatcggttgctattctcaggtcaaccctatcactttaacagcagccctattgttgttggtcgcacactatgctattatcggtcccggcttgcaagcaaaagcgacccgagaagcgcaaaaaagagcagccgcgggaatcatgaaaaatcccacggttgacggcattaccgttatcgaccttgaccccatcccttatgatccaaagttcgagaagcagctaggacaagtaatgttacttatactatgtgtcacgcaggtgctcatgatgcgtactacgtgggcattatgtgaggcacttactttagcgacgggaccgatctcaaccttgtgggaaggcaatcccggtagattttggaacacgacaatagcagtatccatggcgaatatttttcgagggtcttatttggccggggctgggttattattctcaattatgaaaaacacaacgaacacccgtagaggaacgggtaatatgggggagactttaggagaaaagtggaaaagcaggcttaacgcactaggaaagaacgaatttcagatctacaaaaagagtggtatacaagaagttgatcgaaccctagccaaggaaggaattaaaaggggtgagacggatcatcatgccgtaagtagaggaagtgcgaaactaagatggtttgtggagcgcaacatggtcaccccagaaggaaaagtagtggacttaggctgcgggagaggtggctggagctattattgtggaggtcttaaaaacgtgcgggaagtaaagggtctaaccaaaggaggacccgggcatgaagagccgattcccatgagcacatacgggtggaatcttgttcgcttacaaagtggagtagacgtattttttattccaccggaaaagtgtgataccctgttgtgtgacattggcgaaagcagccccaatccaactgttgaagcggggaggacattaagagtactaaatctagtggaaaattggctaaataataacacgcaattttgcataaaggttttaaacccgtatatgccttcagtgatagaaaagatggaagcattacaaaggaaatacggtggagccctggtaagaaatccgttgtcacggaactcgacacatgaaatgtactgggtatcgaatgcaagcggtaacattgtatcttcggtgaatatgataagccggatgctgattaatcgatttacgatgagacataaaaaagctacatatgagccggatgttgacctgggcagtggtacaagaaacatcggcattgaatctgaaataccgaacttagacataattgggaagcgaatagaaaagataaagcaagaacatgaaacatcctggcattatgaccaggaccacccatataaaacatgggcctatcatggttcatatgagacaaaacaaacagggtcagcaagcagcatggtaaatggtgttgtacgcctactaacaaaaccttgggacgttttacccactgtaactcaaatggctatgactgatacaaccccattcggacagcaaagagtatttaaagaaaaagtagacacaagaactcaagagcccaaagagggaacaaaaaaattaatgaaaattacagccgaatggctatggaaagaattgggcaaaaaaaaaactccccgcatgtgtacgcgcgaagaatttacacgaaaagtgcgatctaacgcggcattaggtgcaatatttaccgatgaaaataaatggaaatccgcaagagaggcagtagaagacagcaggttctgggaattagtggataaagaacgaaacttgcacctcgaaggaaagtgtgaaacttgcgtgtataatatgatgggaaaaagagagaagaaactcggagaatttggaaaagcgaaaggctctcgagccatatggtatatgtggctaggagcgagatttttagaattcgaagctttaggctttctaaatgaggatcattggttttcgcgagaaaactcactatctggggtcgagggagaaggattacacaaattaggttatatattacgagatgttagtaaaaaagaaggtggtgcgatgtacgccgacgatacagcaggttgggatactagaataaccctggaagacttaaaaaatgaagaaatggtcacgaatcacatggaaggtgaacacaaaaaattagccgaagctatttttaagttgacgtaccaaaataaagtagtcagggtacagcgtcctaccccacgagggacagtgatggatataataagccgtagagaccaacgagggagtggacaggtgggtacttatgggcttaacactttcaccaacatggaagcacaattaataagacaaatggagggagaaggtgtttttaagaatatacaacatctgacagttactgaagaagtggccgtacaaaactggctagcaagagtaggtcgagaacgcctatcaaggatggcaatctccggggacgactgcgttgtaaaacctttagacgatagattcgcgaacgcactaactgcattaaacgatatgggtaaaataagaaaagacattcaacagtgggaaccaagcaaaggatggaatgactggacacaagtaccattttgcagccatcatttccacgagcttatcatgaaagatggcagagttttagtagtgccctgtagaaatcaagatgaactcattggccgagcgcgcataagtcaaggagcagggtggtcgctcagggaaacagcatgtttgggtaaaagttatgctcaaatgtggagtctaatgtattttcatcgtcgtgacctaagactagcagccaatgccatctgcagtgcggtaccatcacattgggtaccaacatcaagaacaacgtggtccatgcatgccaagcatgagtggatgactacggaggatatgttaactgtctggaaccgagtctggattagggaaaatccgtggatggaagataagacgccagtagaatcgtgggaagaaattccatatctaggaaaacgagaggatcaatggtgtggtagtctcataggtttaacaagtagagcaacttgggcaaaaaacatacaagcggcaatcaatcaagtccgaagtcttattggaaacgaagaatacacggattacatgccttcaatgaaacggttcagacgcgaggaagaagaagcgggtgttttatggtag

SEQ ID NO: 22833 - RNA, 9876 nt, synthetic construct
  misc_feature 1..9876: note = derived and/or modified CDS sequence (opt6) from DENV-2__FM210238__SS-prME
  source 1..9876: mol_type = other RNA
acggcaggaatgataataatgcttatacccacagcgatggcatttcacttgaccacacgcaatggggaaccgcatatgattgtagggcgacaagaaaaaggcaaaagtctgttatttaaaacagaagatggagttaatatgtgcacattaatggcaatagacttgggagaactgtgtgaagacactataacctataaatgcccactactaagacaaaatgaaccagaagatatagactgttggtgtaattcaacctcaacgtgggtgacttatggcacctgtacgacaaccggtgaacatcgaagagagaaaagaagcgttgctctagttcctcatgtaggaatggggctagaaacaagaacagaaacatggatgtcaagtgaaggagcttggaaacatgcgcagagaatagaaacctggatattacgtcacccaggatttacaataatggcagccattctggcatatacagtaggtacaactcacttccaacgggcactcatatttattttgctcgcagccgtcgctccatccatgacgatgcgttgtataggaatttcaaatagagacttcgtagaaggggtgagtggcggatcttgggtagacatagtcttggaacatggaagttgtgtgacaaccatggctaaaaacaaacctactttagattttgaactaataaaaacagaagctaaacaacctgcgacattacgcaaatactgcattgaagcgaaactaacgaatactacgacagaatcaagatgtccaacgcaaggagaaccgtcacttaatgaagaacaagataaaaggtttgtgtgtaaacactcaatggtagatagaggttggggaaacggatgtggactattcgggaaagggggcattgtaacatgtgcaatgtttacatgcaagaagaatatggagggaaaaatcgtacagccagaaaacttagaatacacaatcgtgattacaccacattcaggcgaggaacatgctgttggaaatgacacgggaaaacacggtaaagaaatcaaaataacaccccaaagtcctataacagaagcagaattaacagggtatggcacagtaaccatggagtgttcccccaggactggcttagattttaacgagatggtcttattacaaatggaagacaaagcctggctagtccatcggcagtggtttttagatttacctctgccctggctacccggagcggatacacaaggaagtaactggatacagaaagaaacattagtaaccttcaaaaatccacacgccaagaaacaggacgtcgtagtattaggtagccaggagggcgccatgcatacagctctcactggagccacagaaatacaaatgtcatcaggaaacctcctatttacagggcatttgaaatgccgcttgagaatggataaactacaactaaaaggaatgtcctattccatgtgtacagggaaatttaaaattgtcaaagaaatagcagaaacccaacatggcacgatcgtaatccgcgtacaatatgaaggtgacggatcaccatgtaaaattccattcgaaatcatggatttagagaaaagacatgtgctaggtcgtttaataacagtaaaccccatagttacagaaaaagattcccccgtcaatatcgaagctgagcctccgtttggggacagctatataattatcggagtagaacctgggcaattaaaactaaattggttcaagaaaggaagtagtattggtcagatgttcgaaacgactatgaggggagcaaaaagaatggcaatactgggagatactgcatgggattttggtagccttggtggcgtgtttactagcattggcaaggctctgcatcaagttttcggggctatatatggagcagcattcagcggcgtaagctggacgatgaaaatcttaattggagttataattacatggataggaatgaactcaagaagcaccagcttaagtgtaagtcttgtattggttggcgtcataacgctatacttaggagcaatggttcaagctgacagtgggtgtgttgtatcatggaaaaacaaagaacttaaatgtggctccggaattttcatcacagataacgtccatacatggactgagcaatacaagtttcaaccggagtcaccatctaaactagcatcagctatccagaaggcccatgaggaaggtatatgtggtataagatctgtcacacgcctagagaacctgatgtggaaacaaataactcccgagctaaatcatatactctctgaaaacgaagtaaaactgactattatgacaggggatattaaaggaattatgcaggcgggtaaaaggagcttaagacctcagcccaccgaactgaaatactcatggaaaacttggggcaaagcaaaaatgttgtcgacagaaagccacaaccaaacgtttctgatcgatggtcctgaaacagcagaatgtccaaacacgaatagagcatggaacagcttagaggtagaggactacggatttggagtttttactaccaatatttggttaaagttaagagagaagcaggatgtcttctgcgattcaaaacttatgtccgcggctattaaagataatagagcagtgcacgcagacatgggatattggatcgaaagcgccttaaacgatacatggaaaatggaaaaagcatcattcatagaagtgaaaagctgtcattggccgaaaagtcataccctatggtcgaacggcgtactcgaatctgagatgatcataccaaaatcctttgctggtcccgtcagtcaacacaactacaggcctggatattatacacaaacggcaggcccctggcatctaggcaaacttgaaatggatttcgacttctgtgaaggaactacagtggtagttaccgaagactgcggaaaccgaggaccaagccttcgcacgacaacggcctcagggaaattaattacagaatggtgttgtagatcatgcaccctcccaccactaagataccggggcgaagatggctgctggtacggaatggagattaggccattgaaagaaaaagaagaaaatttggtaaactcattagtaacagcaggacatgggcaaattgataacttttcattaggggttttaggcatggctttgtttcttgaagaaatgcttagaactcgagtaggaacgaaacacgcgattctcctcgtcactgtgtccttcgtcacactaataactgggaatatgtcctttagagacttaggcagagtaatggttatggtaggagccgcgatgacagacgatataggaatgggtgtgacttacttagcattgttagccgcatttaaagttcgaccaacatttgctgcaggtctattgctaagaaaattaacatcaaaagagctaatgatggctacaataggtatagctttactatctcaatcaacaataccggaaaccatactagagttaaccgatgcactagccctagggatgatggtgctaaaaatagtccggaacatggagaaatatcaattggccgttaccattatggctatctcctgcgtgcctaatgcagttattttgcaaaatgcgtggaaagtctcttgtacaatattagccgcagtttcagtgtctccactgctactaacatcctcacaacaaaaagcggattggataccactcgcgttaacaatcaaaggtctaaatcctaccgcgatttttctaaccacgctatcacgaacaagtaagaaacgctcttggcccctgaacgaagccattatggccgttggcatggtaagtatccttgcctcgtcgctactcaaaaatgatattccaatgacgggtcctttagttgctggcggattactaactgtatgttacgtactaacaggtcgtagtgcagatctagagcttgaacgtgctacagatgttaaatgggaagatcaagctgagatctcaggctctagtcccatactttcaataacaatagcggaagatggtagcatgagcattaaaaacgaggaggaagaacaaacacttactattctaataagaactggtttgttagttatttccggactattccctgtatccatcccaataacagctgctgcatggtacctctgggaagtgaagaaacaacgcgcaggggtcttgtgggatgttcccagtcctccacccgttggcaaagcagaactcgaggacggcgcatataggattaaacaaaagggtatattaggatactcgcaaatcggcgccggagtttataaagaaggtacatttcacacaatgtggcatgtaacaagaggcgctgtcttaatgcatagaggtaaacgtatcgagccgagttgggcagacgttaagaaagacttaattagctatggcggaggttggaaacttgaaggagaatggaaagaaggtgaagaagttcaagttttagctttagagcctggcaaaaacccccgagcagttcaaaccaaacctgggctattcaaaacaaatactggaacaataggcgccgtatcgttagacttttcgccaggcacctctggaagtcccatcgtagatagaaagggtaaggtagttggattatacggaaatggcgtcgtaacccgtagtggggcatatgtgtcagctatagcgcaaacggaaaaatcaatcgaagataatcccgagatagaagatgacatttttaggaaaaagcgtttaactataatggatcttcatcccggtgcaggaaagacaaaacgataccttcccgcaattgtccgagaagcgataaaaagaggacttcgtaccttaatattagcgccaacaagagttgtcgccgcagaaatggaagaagcacttaggggtttacctattcgatatcaaacgccggcgatcagagctgagcatactgggcgagaaatcgtagacctaatgtgccatgcaacgttcactatgagattactaagtcctgtgagggtacctaattacaacctgattattatggatgaagcccatttcacagatcctgctagcattgcggccaggggttacatatcaacaagggtagaaatgggcgaagcagcaggaatttttatgactgccacgcctcccggttcacgtgacccatttccgcaatcgaatgcaccaatcatggacgaggagcgtgaaatacccgaacgaagttggaatagcggtcatgaatgggtaacggacttcaaggggaagacagtgtggtttgtaccttcaataaaggcgggaaatgatattgcggcttgcctaaggaaaaacggtaagaaagtaatacaattgtcgcgtaaaaccttcgacagtgaatacgtaaagactcgtacaaatgattgggattttgttgtaaccaccgatatttccgagatgggtgctaattttaaagcagaaagagtaattgacccaagacgatgtatgaagccagtaatattaacagatggcgaagaaagagtaattttagcaggaccgatgcctgtaacacacagttccgctgcccaacgtcgcggtagaatcgggagaaatcccaaaaacgaaaatgatcaatatatatatatgggcgaaccccttgaaaacgacgaagattgcgcacattggaaggaggctaaaatgctcctggataacataaatacaccagagggtattattccgtctatgtttgaaccagagagagaaaaagttgatgccatcgatggtgaatacaggctccgcggcgaggctagaaaaacattcgtggatttaatgagaagaggggatttacccgtatggttagcatacagagtagctgcagaaggtattaattatgcggatcgacggtggtgtttcgatggtgtcaaaaatgaccaaatactagaggaaaacgttgaagtagagatctggactaaagaaggggaaagaaagaaactgaaaccacggtggttagatgcaaggatttattcagatccactcgcactcaaagagttcaaagaatttgccgcagggagaaaaagtctgacattaaatctaataacggaaatgggccggctaccgacatttatgactcaaaaagcgagagatgctttggacaatctagcagtcctgcacactgcagaagccggtgggagagcatacaaccacgcattatcggaactacctgaaacacttgaaactctcttacttcttactttgcttgcgacagtaacgggaggcatatttttatttctgatgagcggtaaaggggtgggaaaaatgactttagggatgtgttgtatcattacagcatcaattttactctggtacgctcaaatacaaccacattggatagctgcatcaattattttagagttctttctaatagtattactcatacccgaaccggagaagcaaagaacacctcaggataaccaattaacatatgtagtaattgcaatattgacagtcgtcgcagcgacaatggccaatgaaatgggcttcttagagaaaactaagaaagatttaggcttaggatcaatcgctacacaagagcccgaaagcaacatactggacatcgacttacggccggctagtgcatggacattatatgccgtcgctacaacatttgtgacccccatgctgcgccactcgatcgaaaatagttccgtaaatgttagtttgactgctatagcaaaccaagctactgtcttgatgggattaggtaagggatggcctcttagcaaaatggacataggagttccattactcgcgatcggttgttatagccaagtaaatccgattactttaacggccgccctattgctacttgtagctcattacgccattatcgggccgggattacaagctaaggcaactcgggaagctcaaaagagggctgcggcaggaataatgaaaaatcccactgtagacggtattactgtaatagatcttgacccgatcccttacgaccctaaatttgaaaaacaactaggacaagtgatgcttttaatcttgtgcgttacgcaagtgcttatgatgagaactacctgggcattatgcgaagcattaacattagccacaggaccaatatctacactttgggaaggtaatccaggtagattttggaacactactattgcagtaagcatggcgaacatcttcagggggtcgtatttagcaggggcgggtcttttattcagtatcatgaaaaatactactaatacccgacgagggacgggaaacataggagaaacattgggagaaaaatggaaaagcagattgaacgcactcgggaaatctgaatttcaaatatacaaaaagtccggtatccaagaagtggacaggacgctcgcaaaagaaggaataaaacgcggggagacagaccatcatgcagtgtcaaggggatcggcaaaattaagatggttcgttgaacgtaatatggtaaccccagagggcaaagttgttgaccttggatgtggacgtggaggatggtcgtattattgtgggggactaaagaatgtgagagaagtaaaaggattgacaaaaggaggaccaggacacgaagaaccaataccgatgtcgacttatgggtggaacttggtcaggcttcagtcaggcgtagacgtattctttacaccaccagagaagtgcgatacccttttgtgtgatataggagaatcctcaccgaacccgacaatagaggcgggtcgaaccctccgcgtcttatctctagttgaaaactggctaaacaatgacacgcaattctgtataaaggtactaaacccttatatgccaagtgtaattgagaaaatggaaactttacagagaaaatatggaggagcattggttcgaaatccactatctaggaatagcacacacgagatgtactgggtgtctaacgcgactggtaacatagttagcagtgtgaatatgatatcacgcatgcttataaacagatttacgatgaaacacaaaaaggcaacatatgagcctgatgtggacctcggttcaggtacacgaaacatcgggattgagtctgagataccaaacctagatatcatcggaaaaagaatagagaaaattaaacaagaacatgaaacgagttggcactacgatcaagatcatccttataaaacatgggcatatcacggttcttacgaaacaaaacagacagggtctgcctcctcaatggtaaatggtgttgtacgtcttttaaccaaaccgtgggatgtagtcccaatggtaactcaaatggctatgactgatactactcctttcggtcaacaaagagtcttcaaggaaaaagtagatacccgcacgcaagagcctaaagaaggtacaaagaaactcatgaaaataacagcggaatggttatggaaagagctaggcaaaaagaaaacaccacggatgtgtacacgtgaagaatttacgcggaaagtacgtagtaacgctgcattgggagcaatatttacagacgaaaataaatggaaaagcgcacgggaagccgtcgaagatagcagattctgggaattagttgacaaagaacgaaatctacatttagaaggtaaatgtgaaacctgtgtctacaatatgatgggaaaacgcgagaagaaactaggtgagttcggaaaggcaaaaggctcccgcgccatatggtatatgtggctaggcgctcggttcctagaatttgaagctctaggattcctaaacgaggaccactggtttagccgcgaaaattcactctcaggagtcgagggagaaggattacacaaattgggttacatacttagggatgttagtaagaaagaagggggcgcaatgtatgcagatgatacagctgggtgggatactagaataacattagaagatctgaagaatgaggaaatggttacaaatcacatggaaggagaacataagaaactggctgaagcaatattcaaactcacataccaaaataaagtagtcagagtacaaagaccaactccaagggggacggtaatggacataataagtagacgagaccaaagaggatcaggacaagttggcacttacggcctcaatacctttacaaatatggaggcacaactgatacgacaaatggaaggcgaaggagtattcaaaagcatacaacgattgactgttactgaagaaatagcggtacaaaattggctagcgcgtgttggaagagaacgcctttcaagaatggctataagcggggatgactgcgttgtaaagcctttggatgacaggtttgcgtcagcgttaacggcattaaacgacatgggcaaagttcgaaaggacatacaacaatgggagccatctaggggatggaatgactggactcaggtacctttttgttcacaccattttcacgaattgataatgaaagacggaagagtgcttgttgttccatgtcgaaaccaagacgaacttataggccgagctcgtattagtcaaggggcaggttggtccctaaaagaaacagcttgtctcggaaagtcatatgcgcaaatgtggagtctaatgtactttcatcgacgtgatctgagactagcagcaaacgctatttgcagtgctgttcccagtcattgggtgcctactagcaggacaacatggagcattcacgcaaagcacgaatggatgacgacagaagatatgctaacagtttggaaccgagtgtggattcaagaaaacccctggatggaggataaaactcctgtcgagtcgtgggaagaagtaccttacttagggaagagggaagatcagtggtgcgggtcactgattggtcttacgagccgagctacatgggctaaaaatatccaaacagcaatcaaccaggttagaagcctcatcggaaatgaagagtatacagattacatgccttccatgaaaaggtttagacgcgaagaagaggaagctggtgtcttgtggtaa

SEQ ID NO: 22834 - RNA, 9876 nt, synthetic construct
  misc_feature 1..9876: note = derived and/or modified CDS sequence (opt6) from DENV-2__FM210224__SS-prME
  source 1..9876: mol_type = other RNA
acggcaggagttataattatgttaatccctacagcaatggcctttcatttaacgacaagaaatggagaaccacacatgatagtaggaagacaagaaaaaggcaaaagcctgctttttaaaactgaagatggggttaatatgtgcacattaatggctatcgatcttggggaactttgcgaagacacaataacttataaatgtcctcttttgagacaaaatgaaccagaagatatcgactgttggtgtaatagtacatctacatgggtgacctatggcacatgtacgacaacaggagaacacaggcgcgagaaaaggagtgtggcattagttccgcacgtaggaatgggccttgagacaagaaccgagacttggatgtcaagtgaaggcgcgtggaaacacgcgcaaaggatagaaacatggatactaaggcatcccggttttacaataatggcagccatacttgcctacactataggtacaacgcactttcaacgcgctttgatattcatacttcttacagctgtcgctccatcaatgacaatgcgttgtataggaatatctaatagggacttcgtagagggagtatcagggggttcatgggtagatatcgtcctagaacatgggagttgtgttacaacaatggccaaaaataaacccacactagactttgaattaataaaaacagaagcgaaacaacccgccaccttgaggaaatactgtatcgaagcaaaattgacgaatacaactaccgaatcccgatgccctacacaaggtgaaccatcattaaatgaagaacaagataaaagatttgtatgcaaacactccatggtagatcgaggatgggggaatgggtgtggcctatttggaaaagggggcatcgttacgtgtgcaatgtttacgtgtaagaaaaacatggagggaaaaatagttcaaccagaaaatttagaatatacaattgtaatcacaccacattcgggcgaagaacacgctgtaggtaatgacacaggaaaacatggtaaagagattaaaattacgccgcaaagctctataaccgaagcagaactaacagggtacgggacagtaactatggaatgtagtccccgaacaggtctagatttcaacgaaatggtccttttacaaatggaagacaaagcatggttagtacaccgacaatggttcttagacctaccactcccttggttgcctggtgcagacactcagggaagtaattggatccaaaaagaaaccttagtaacgttcaaaaatccacacgccaagaaacaagacgtagtagttcttggttcgcaagaaggagcaatgcacaccgcgctcaccggagcaacagagatccaaatgtcatcagggaatctgctatttactggtcatttaaaatgtcgtctgagaatggacaaattacaattgaaaggcatgagttacagtatgtgtacggggaaatttaaaattgtaaaagagatagcagaaactcaacatggtacaatcgtaatacgagtacagtatgaaggagatggcagtccatgcaaaatcccattcgagataatggatttggaaaaacgccacgttctaggaagattaattacggtaaatcctatagtaaccgagaaagattcgccagttaacatagaagcagaaccaccctttggagactcatacattatcattggggttgaaccaggacaactcaaacttaactggtttaagaaagggagcagtattggccaaatgttcgaaaccacgatgcgaggagcaaaacggatggcaattctgggagacacggcgtgggactttggtagtctaggaggtgtctttacatcaattggaaaggcattacatcaagtttttggggccatatatggagcggctttctcgggtgtctcttggacaatgaaaattttaatcggcgcgataataacttggataggaatgaactccaggtcgacgagtctatctgttagcctcgtattagtgggcgtaattacattataccttggagcaatggtacaagctgattcaggttgtgtcgtaagttggaagaataaagagctcaaatgtggttcaggcatctttatcacggataatgttcatacatggacggaacagtacaaatttcaaccggaatctccaagcaaattagccagcgccattcaaaaagcgcatgaggagggaatatgtggaatacgatcagttaccaggctcgaaaatctcatgtggaaacaaataacaccggagttaaatcatatactaagcgaaaatgaagttaaattaacgataatgactggtgatataaaaggcataatgcaagcaggaaaacggagtttacgtcctcaaccaacagaactaaagtattcttggaaaacatgggggaaagcaaagatgttatcaactgaatcgcacaatcagacctttctaatagatggacccgagactgcggagtgtccaaatacaaaccgagcgtggaactcgttagaagtcgaggactatggttttggcgtttttacaaccaatatatggttgaaactgagggaaaagcaagatgtattttgtgattcgaaattaatgagcgcagctattaaagacaatcgggctgtgcacgcagacatgggatattggattgaatcagccctaaatgatacatggaaaatggagaaagcaagtttcatagaggtcaaaagttgtcactggccgaaatctcatacattatggtcaaacggagttcttgagagtgaaatgatcatacccaaatcatttgcaggccccgtaagtcaacataattaccgacccggttactacacacaaacagctgggccgtggcacctaggaaaattagaaatggactttgacttttgtgagggtacaacagtcgtcgtcactgaagactgcggaaatcgcggcccctctttaagaactacaaccgcatcaggtaaactaataaccgagtggtgttgtcggtcctgcacattaccgccactaagatacaggggtgaagatggatgttggtacggaatggagattcgaccactaaaagaaaaagaagaaaacctagtcaattcacttgtaacggccggccacgggcagatagataatttctcgttaggagttctaggaatggccctgtttctagaagaaatgttaagaactagggtaggaactaaacacgctatactacttgtcgccgtatcctttgttacactaattaccggaaatatgagctttagagacctcggaagagtgatggtcatggttggtgcaacaatgacagatgatataggtatgggagtgacttatctcgctttactagccgctttcaaggttcgtcccaccttcgccgctggactcttattgagaaagctcacttcaaaagaattaatgatggctaccatcggaatagcactcttaagtcagtcaacaatccctgagacaatacttgaactaaccgatgccctagcgctaggaatgatggtgttgaaaatcgttagaaatatggagaaataccaattagcagtcacaataatggcgattagctgtgtacccaatgcagtaatattgcaaaacgcttggaaagtgagttgtacgattttagcggctgtatcggtctcgccactactactaacttccagtcaacagaaggcggactggatccccctggctctgaccattaaaggattaaaccccacagcaattttcttaacaacattatcaagaacgtctaagaaacgtagttggccattaaatgaagctattatggcagtggggatggtaagcatactagcctctagtttgttaaagaacgatataccgatgacgggacctctcgtagcagggggcttactgaccgtgtgctacgtcctaacagggagatcagccgatcttgaactcgaacgcgccacagatgtaaaatgggaagaccaagccgaaataagtggaagttctcccattttaagcattactatatcagaagatggaagtatgtctattaaaaacgaagaagaagaacaaacgctaactattttaattcgtacgggattgctcgtaatatctggactttttccagtgtcaatccctattactgcagcagcgtggtatttatgggaagtaaagaaacagcgggccggcgttctttgggatgtgccatcaccgccaccagtggggaaagcagaattagaagatggtgcctatcgtatcaaacaaaagggaatccttggttatagccaaattggagctggagtatataaggaagggacatttcacacgatgtggcatgtaacaagaggagccgtattaatgcatcggggcaagagaatcgaaccaagttgggctgatgtcaagaaagacctaatttcctatggaggaggttggaaacttgaaggggaatggaaggaaggagaagaagtccaagttctagcgttggagcccggcaaaaatccaagagcagtacaaacaaaaccgggtctcttcaaaacaaacacaggaactataggggcagtgtctttggacttttcacctgggacatcaggatctcccatcgtagacaggaaagggaaggtagtaggactatatggcaacggagtcgtcacaagatcaggcgcgtacgtatcagcgattgcccaaactgaaaaatcaattgaagataatcccgagattgaagatgatatctttcgcaagaagaggttaaccataatggatttgcacccaggtgcgggtaaaaccaaaaggtatttaccagccatagttagggaagcaatcaaaaggggccttcgaacgctgatattagcacctacacgagttgtagcagccgaaatggaagaggcactaagaggtttaccaattcgataccaaacacccgcaattcgagctgagcacacgggcagagaaatagtcgacttgatgtgccatgcaactttcacaatgaggctattatctccagttcgagtaccaaattacaatctaatcattatggacgaagctcattttacagacccagctagtattgctgctaggggctatataagcacaagagtagaaatgggagaggcagcagggattttcatgacggctactccaccgggcagcagagatccctttcctcagagtaatgccccaataatagacgaagaaagggaaatacccgagagatcatggaacagcgggcacgaatgggtgactgatttcaaaggcaagacagtatggttcgtcccctcgatcaaagcaggtaatgacatagctgcgtgtttaagaaagaatggcaagaaagttatccaactttcccggaaaacctttgacagcgaatatgtcaaaaccaggaccaatgattgggactttgttgtaaccactgacatatctgagatgggtgccaattttaaagccgaacgagttatcgaccctcgacgctgtatgaaacctgttatcctaacggacggtgaagaaagagttattcttgctggtccaatgccagtgacacattcttcagcagcacaacgtcgaggtagaattggtagaaacccaaagaacgagaacgatcagtatatatatatgggtgaaccacttgaaaatgacgaagattgtgcgcattggaaagaagcaaagatgctactcgacaacattaatacaccagaaggtataataccgagtatgttcgagccggaacgagagaaggtcgatgctatagatggcgaatatagattacggggagaggctcgcaaaactttcgtggacttaatgaggagaggtgatctaccggtatggctagcgtatagagttgctgccgaggggattaattatgcagatcgacgatggtgctttgacggagccaaaaacaaccagatcttagaagaaaatgttgaagtcgagatatggacgaaagagggcgaacgtaaaaagttaaaacctcgatggctggatgcaaggatatacagcgatcccttagcattaaaagaatttaaagaatttgcggctgggagaaagtcgcttacgctcaatttgataaccgagatgggtagacttcccacttttatgactcaaaaagcacgggatgcattagacaatctggcagtattacacactgccgaggcaggaggtagagcatataatcatgcattgagcgaattacctgaaactcttgaaaccctcctactcctgaccttacttgctacagtaacgggaggaatatttctttttctgatgtctggaaagggggtaggtaagatgacattaggaatgtgttgcataataacagctagcattcttctctggtacgctcaaatacaaccacactggatcgcagcgagtatcatattagagttctttttaatagtgttattgatacctgaaccagaaaaacaaagaacgcctcaagacaatcaactcacatacgtcgtaattgcaatactgaccgtcgtagcagctacaatggctaatgaaatggggtttctggagaaaactaagaaagacttaggccttggtagcatagctacgcaagaaccggaatccaatattctagatattgacttaagacccgcctcagcttggacgttatatgcggtcgccacgacgtttgttacacctatgttacgtcattcaattgaaaacagtagcgttaacgtcagtctaactgccatagcaaaccaagcgaccgttctgatgggactgggaaaaggttggcctttaagtaaaatggatataggtgtcccattgctagcgattggttgttacagtcaggtcaatccgataacacttacagctgccctactattactcatagcacactatgcaataatagggcctggtttacaggcaaaggcaacaagagaggcacagaaacgtgcagccgcaggaattatgaagaacccgactgtagacggaatcacagtgatcgatttagacccgatcccatacgacccaaaattcgaaaaacaactgggacaagttatgttgctaatactctgtgtcacgcaagtattaatgatgagaaccacttgggctctatgtgaggcccttacgttagcaacaggtccaatatcaacactgtgggaaggaaatccaggccgtttctggaatacaacaatagcagtaagcatggctaacatattcagaggatcatatttagctggagcaggactactattttcaattatgaagaatacgactaatacaagaagaggcacggggaatataggagaaacgcttggagagaagtggaagagtagactgaacgcattggggaaaagcgaatttcaaatatacaagaaatcgggcatacaggaagtagatcgaacactagcaaaagagggcattaagcgaggagaaactgatcaccacgcggttagcagaggaagtgcgaaattaaggtggtttgttgaacgtaacatggtaacaccagaaggaaaggtagtagatctcggctgtggtcgaggaggttggtcatattattgtggaggtctcaaaaatgtgagagaagttaagggactaactaaaggcgggccgggacatgaagaaccaatcccgatgtctacttatggttggaacttggtcagactacaatcaggtgttgatgtattctttacacctccagaaaaatgcgatacactattatgtgatattggcgaaagctcaccaaatccaaccattgaagccggtagaacgttacgagtattgagtttagttgagaattggctaaacaacgatacccaattctgcataaaagtacttaatccatacatgccctcggtaatagagaagatggaaactctccaacgtaaatatggaggggccctagtcagaaatccgctatctcgaaattcaacacatgaaatgtactgggtttctaatgctacaggcaatattgtttcttccgtcaacatgatctctagaatgttgataaataggtttaccatgaagcacaagaaagctacttacgaacctgacgtcgatttaggttcagggactaggaatattgggatagaatcggaaatacccaatctagacatcatagggaagaggatagagaaaataaagcaggaacacgagacatcgtggcactacgatcaggaccatccttataagacctgggcttaccatggatcatatgaaactaaacaaaccggaagcgcttcttcgatggtcaatggtgtcgttaggctattaaccaaaccatgggacgtagtcccaatggtaacacaaatggcgatgacggatacgactccgttcggtcagcaaagagtgttcaaggaaaaggttgatacacgaacacaagaaccgaaagaaggaactaagaaattaatgaaaataactgccgagtggctctggaaagaactcgggaaaaagaaaacgccacgtatgtgcacaagagaagaatttacccgaaaagtacgtagtaatgccgccctaggtgctatcttcacagatgaaaacaaatggaaaagcgcgagagaagccgtagaagatagtcgtttttgggaattagtagacaaagaaagaaatttgcacttagaaggaaagtgtgaaacttgtgtgtataacatgatgggtaagcgggaaaagaaactgggcgaatttggcaaggctaagggaagtagggcaatctggtatatgtggctaggagcaagattcctcgaatttgaggctttaggtttcttgaatgaggatcactggttctcaagggagaatagcctctcaggtgtggaaggggaaggacttcataaattaggttatatattacgtgatgtaagtaagaaagagggcggagctatgtacgcagacgatactgccggctgggacacaagaatcacacttgaggatctcaaaaatgaagaaatggtcactaatcacatggaaggtgaacataagagactagcagaagcgattttcaaattaacataccaaaataaagttgttcgagttcaacgacccaccccaagaggtaccgttatggacataatcagccgtagagaccagcgaggaagtggacaagtaggaacgtacggcttaaatacttttacaaacatggaggcccaattgataaggcaaatggaaggtgagggaatttttaaaagcatacaacatttaaccgtaactgaagagatagctgtacagaactggttagcgcgggttggcagggaaaggctatctagaatggccatttcaggagatgattgcgtagtcaagccgttagacgataggttcgcaagcgcactaacggccctcaatgacatgggtaaagtacgaaaagacatacaacaatgggaaccaagcaagggatggaacgactggactcaagttcctttttgtagtcaccatttccatgaattgatcatgaaagatggcagggtcctagtggtaccatgcaggaatcaggacgaattgataggtcgagctagaatttcccaaggggcgggctggagcctgaaagaaacagcgtgcctcggaaaaagctatgcacaaatgtggtcccttatgtattttcacaggcgtgaccttagactagcggctaatgccatatgtagcgcagtaccttcccattgggttccaacctcccgaacaacctggtctattcatgctaagcacgaatggatgacaacagaagacatgctcaccgtatggaatcgagtatggatacaggagaatccatggatggaggacaaaactccagtcgagtcctgggaagaagtcccgtatctcggaaaacgggaagatcagtggtgcggtagtctcataggcttgacttcacgagctacatgggctaaaaatatacagacagctataaatcaagtgcgaagtctaatcgggaacgaagaatataccgattatatgccttcaatgaaacgttttcggagagaggaagaagaggctggagtgttgtggtaa

SEQ ID NO: 22835 - RNA, 9876 nt, synthetic construct
  misc_feature 1..9876: note = derived and/or modified CDS sequence (opt6) from DENV-2__FM210225__SS-prME
  source 1..9876: mol_type = other RNA
acagctggtgttatcattatgctaattccaaccgcgatggcattccatttaaccactagaaatggtgaacctcacatgattgtaggtagacaagaaaaaggtaagagcttacttttcaaaactgaagacggtgtaaacatgtgcactctaatggcaatagatttaggtgaactgtgcgaagatactattacctataaatgtccattactacgacaaaacgaaccggaagatattgattgctggtgcaattcgacctctacttgggtaacttatggtacctgcaccactaccggtgagcacagaagagaaaaacggagtgtagcactcgtaccacatgtaggcatggggcttgaaaccagaacggaaacgtggatgagtagcgaaggggcgtggaaacatgctcaacggatagaaacttggatcttgcgtcatcctggttttactataatggcagcaatactagcatatacaattggtaccacacactttcaacgtgcgcttatatttatcctactaacagcagtggcgccctccatgacaatgagatgcataggaattagtaatagagatttcgtagaaggagtgagtggcggcagctgggtagacatagttttagaacatggaagctgtgttacaacaatggccaaaaataaaccaactctcgattttgaactaataaaaacagaagctaaacaacccgcaacactacgtaaatattgcatagaagcaaaactaaccaatacgactactgaaagcagatgtccaacacagggagaaccatcgttaaatgaggagcaggataaaagatttgtatgcaaacattcaatggtagacagagggtggggaaacggatgtggattattcggtaaaggtggcatagtaacgtgtgcaatgtttacctgcaagaaaaatatggagggtaaaatagtgcagcccgaaaatttagagtatactatagttattacaccccactcaggcgaagaacatgcagttgggaatgataccgggaaacacggaaaagagataaaaattacacctcaatctagtattacagaagcagaactcacaggctacggaactgtaactatggaatgcagccccagaaccggacttgactttaatgaaatggtattgctacagatggaagacaaagcatggcttgtacatcgtcaatggttcctcgatcttcctttaccttggctccccggagcagatactcaagggtccaactggattcaaaaagaaactttagttacctttaaaaaccctcacgcgaagaaacaagatgtagtggtattaggatcacaagaaggagcaatgcataccgccctaacaggtgcaacagaaatacaaatgtcgagtggaaacttactttttactggacacctcaaatgtcgattaagaatggacaaactgcagcttaaaggtatgtcttatagtatgtgtactggtaaatttaaaatcgtgaaggaaatagctgagacacagcacggaacaatagttatacgagtccaatatgagggggatggatcaccatgcaaaattcctttcgaaataatggatctagagaaaagacatgtcttaggaagattaattactgtcaatcccatcgtgacagaaaaggacagtccagtaaatattgaagccgagcccccattcggggattcatacataattatcggagttgaaccgggacaacttaaactaaattggtttaagaagggctcaagtataggacaaatgtttgaaacaacaatgaggggtgctaaaagaatggcaatcctcggagacacagcatgggattttgggagtctagggggcgtttttactagcataggaaaagcattgcaccaagttttcggagcaatttatggagcagctttttctggggtgagctggacaatgaaaatactcattggagcgattattacttggatcgggatgaactctcgatccactagcctatctgtctcacttgtcttagtaggagttataaccttgtatttaggtgccatggtgcaggcggattctgggtgtgttgtcagctggaaaaacaaggagttaaaatgtggatcagggatatttattaccgataatgtgcatacctggacggaacaatacaaatttcagccagaatccccctctaaactcgcatcagctatccaaaaagcacatgaggaaggaatatgtggaataagatcagttaccagattagaaaacttaatgtggaaacaaatcacccctgaactcaaccatatattatccgaaaacgaagtaaaattgacgattatgacgggtgatataaagggaataatgcaagcaggaaagaggagcttaagacctcaacctacagaactcaaatattcatggaaaacgtggggtaaagcaaagatgctcagcacagaatcccacaaccagacattcctcatagatggaccagaaacagcagaatgtcctaatacaaatcgtgcgtggaactcgttggaagtcgaagattatggttttggggtatttaccacaaacatttggctcaaattaagagagaaacaagacgtgttttgcgatagtaaactgatgtcagcagcgatcaaagataacagagctgtacacgcagatatgggctactggattgagtcagcactaaatgatacgtggaagatggaaaaagctagttttatagaagtgaagtcctgtcattggccaaaaagtcacactttatggtctaacggcgtactagaatcagaaatgataatacctaagagctttgctgggcctgtctcccagcacaactaccgtcctggttattacacacaaacagctggtccttggcatctgggcaaattggaaatggactttgacttttgcgaaggtactacagtagtagtaaccgaagattgcggcaatcgtggtcctagtttacgaacaactacggcctctggaaaattaataacagagtggtgctgccgaagttgtacattaccacctctaagatacaggggagaagatggctgttggtatggaatggaaatacgcccactaaaagaaaaggaggaaaatttagtaaatagtttggtgactgcaggacatggtcaaatagacaatttttcccttggcgttttagggatggcactcttcctggaggaaatgctaagaactcgcgtcggaaccaaacatgcgatactattagttgcggtatcatttgtaaccctaataacaggcaacatgtcattcagggacctcggacgtgtgatggttatggtcggtgcaacaatgacagacgatattggaatgggagtaacatatttagctttattagcagccttcaaggtgagaccgacctttgctgcagggctcttgttgagaaagctaacaagtaaagaacttatgatggccacaataggtatagcactactttcacaatctacaattccagaaactattctcgagcttacggacgccttagcactgggaatgatggtcctaaaaatagtacgcaacatggaaaaatatcaactcgccgtcacaataatggctatctcatgcgtacctaacgccgtgatacttcagaatgcttggaaagttagctgcacaatacttgccgccgtgtcagtatctcccctactactgacaagctcgcaacagaaagctgactggatacccctagcgttaacaataaaaggtctgaaccctacagcaatttttctaactaccttatccaggacctctaagaaaagaagctggccattaaacgaagctataatggcagtagggatggtcagcatcttagctagcagtttactgaaaaatgatatcccaatgacgggcccattagtggcaggaggactactcactgtctgctatgtgttaactgggcgtagtgcagatttagaattagagagagctacggatgttaagtgggaggatcaagcagaaatttctggatcgtctcctatccttagtataacaatatctgaagatggcagcatgagcattaaaaacgaagaggaagaacaaacactaaccatcttaattcgtacgggactccttgtcatatctggtttatttcccgttagcataccaataactgcggcagcatggtacctatgggaggtcaagaaacagcgagccggagtgttgtgggatgtaccaagcccacccccggtgggaaaggcagagcttgaagacggcgcatacagaataaagcaaaaaggcattcttggatattctcaaataggcgcgggtgtttacaaagagggaactttccacactatgtggcatgttactagaggcgcggtactcatgcaccgagggaaaagaatagaacccagttgggcggacgtcaagaaagacttaatctcgtacgggggaggatggaagctcgagggagaatggaaagagggggaagaagtacaggtcttggctttagaacctgggaagaacccgagggcagtccaaacgaaacctggattattcaaaactaacacaggtacgataggtgcagtaagcctggactttagccctggtacttccggttcacccatcgtagacagaaaaggtaaagttgttggactttatggtaatggagtcgtaactagatcaggtgcttatgtttcagcgatagcacaaacggaaaaatcaatcgaagataatccggagatagaagatgatatttttaggaaaaagcgactgacaattatggatttacacccaggagcaggcaagacaaagcgatacttaccagcgatagttagagaagccatcaagcgcggattgagaaccctaatattagctcctacgagagtggtggccgcggaaatggaagaagctctacgaggacttccaattaggtatcaaacccccgcgataagagccgaacacacaggcagggagatagttgacttaatgtgtcatgcaactttcacaatgcgattgctctcaccagtgagagttccgaactacaacctaataatcatggatgaagcccactttaccgatcccgcatcaatagcggcccgtgggtacatctctacacgtgtcgagatgggtgaggcagcaggaatcttcatgactgccactcctcctggtagccgagatccatttccacaatcaaatgctcccataattgatgaagaaagagagatacccgaacggtcatggaactcaggtcacgaatgggtcacagattttaaaggaaaaacggtgtggttcgtaccatcaataaaagcaggaaatgatattgcagcttgtctacgaaagaatggaaagaaggtaattcaactcagtagaaaaactttcgatagtgagtatgtaaaaacacgaacaaacgactgggactttgttgttacaacagacatttcagagatgggagcaaattttaaagcagaacgagtaattgaccctcggaggtgcatgaaaccggtaattttaacagatggggaggaacgagttatacttgcaggtccaatgccagttacgcactcctctgcagcgcagcgacggggtaggatcggacgaaatcccaaaaacgaaaacgatcaatatatttatatgggggagccgttggaaaatgatgaggattgcgcacattggaaagaggcaaaaatgctcttagataacataaacaccccggagggaattatcccctccatgttcgaacctgagcgagaaaaagtcgatgctattgatggcgaataccgtctacgaggagaagcaagaaaaacgtttgtagacctcatgcgtagaggggacttaccggtttggcttgcatatagagtcgcggcggaaggaattaattacgcagatcgaagatggtgcttcgatggcgttaaaaataaccaaatactcgaagaaaacgttgaagttgaaatttggactaaagaaggagagagaaagaagctaaaacctaggtggctagatgctcgtatatattccgatccattggcattaaaggaatttaaagaatttgctgcgggtaggaagtctctaacgctaaacttaatcacagaaatgggtcggctacccactttcatgacgcagaaagcgcgtgacgccttagacaaccttgctgtcctgcatacagcagaagcaggcggacgagcatataatcatgcactatccgagctcccagagactctggaaacacttttacttttaacacttctagccactgtaactggaggtatttttctgttcttaatgagtggtaagggcgttggtaagatgactttggggatgtgctgcataatcaccgcgtctatattgttgtggtatgctcagattcagcctcattggattgcagcgtcaattatactagagttctttctgatagtgcttttgatccctgaaccggaaaaacaaagaactccacaggataaccagctcacatatgtagtaattgctatacttacagtcgtagcagcaacgatggcaaatgaaatgggatttttagagaaaacaaagaaagatttaggactaggttctatagcaacacaagagcccgagagtaacatactagacattgacttaaggcctgcatctgcatggaccttgtatgctgtcgctacaacgttcgtaactccaatgttacgacatagtattgaaaacagcagcgtaaatgtgtccctcactgcaatagcaaatcaagccacagtgttaatgggcttgggtaaaggttggccgctatctaaaatggacatcggagtcccacttctggcaattggctgttactcacaggtcaacccaataacactcactgctgcactactgctactcatagcacactatgcaattattggccctggcttgcaagccaaggcaactagagaagctcaaaaacgcgccgccgctggcataatgaagaatcctacagttgatggtataaccgtgattgatctggacccgataccttatgatcccaagtttgaaaaacaattagggcaagtaatgcttttaattctttgtgtcacccaggtacttatgatgaggactacctgggcgttatgcgaggcattgactttagcgacgggaccaatttctactctttgggagggtaacccaggaagattttggaatactacgattgccgtatcgatggccaacatatttagaggttcttatcttgcaggcgcaggtctgttgtttagtataatgaaaaacacaactaatacaagacgaggaacaggtaacattggagagacgttgggagaaaaatggaaatctcggttaaatgctctaggaaaaagtgaatttcagatctataaaaagtcaggaatccaagaagtagaccggacactagcaaaagaaggaataaagagaggggaaaccgatcatcatgctgtaagtcgggggtccgcgaagttacgatggttcgtagaaagaaacatggttaccccggagggaaaggtcgtggatctgggttgcggacgcggaggttggtcatactattgtggaggtctcaaaaatgttagggaagtaaagggactaacgaaaggaggcccaggccacgaggaacctatccccatgagtacttatggatggaatctagtacgactacaaagcggggtcgatgtatttttcacgcctcctgagaaatgcgacacattgctgtgtgatatcggcgagtcatcaccaaatccgactatagaggcgggacgcacattgagagttttgtctttagtcgagaattggctcaataacgatacgcagttctgtataaaagtcttaaatccttacatgccatcagtaattgagaaaatggaaacgctacagagaaaatatggtggcgctctagttagaaatcccctaagtcgaaatagcactcacgaaatgtactgggtgtcaaacgccaccggaaatatagtatcttccgtcaatatgatatcgcggatgctaattaatagattcacaatgaaacacaagaaagctacatatgaaccagacgtggacctagggtcaggaactaggaatataggaattgaatctgaaatccccaacctcgatataataggaaaaagaatcgagaaaataaaacaggagcatgagacttcttggcactatgaccaagatcatccatataagacgtgggcgtaccatggatcgtacgaaactaaacaaactggcagcgctagtagtatggttaatggagtagtacgtctactaacaaaaccttgggatgtagtaccaatggtaacacagatggcaatgacagacacaacgccattcggtcaacaacgggtctttaaggaaaaagttgatacccggacccaagaaccaaaagaaggtaccaagaaactaatgaaaattacagctgaatggctctggaaggagttaggaaagaagaaaacaccaaggatgtgcacgagggaagaatttacgcgaaaagttagaagtaacgcagctttaggcgcaatttttacagacgagaataaatggaagtcggcacgggaagctgtagaagactcccgtttttgggagttggttgataaagaacgcaatttacatttagagggaaaatgcgaaacctgcgtctataacatgatgggtaagcgggagaagaaactcggagagttcggaaaagcaaaaggatctcgagcgatatggtacatgtggcttggagcaagatttcttgagttcgaggctttgggatttttgaacgaagatcattggttttcaagagaaaattcactaagcggggtggaaggtgaaggtctccataagttgggctatattctacgcgatgtcagcaagaaagaaggaggggctatgtacgcagatgacacagcgggctgggatacacgaattacattagaagacctaaagaatgaagaaatggttaccaatcatatggagggtgagcacaaaagattagcagaagccatctttaaactcacataccaaaacaaagtagtaagagtacaacgacctacaccaagaggaactgtaatggatatcataagtaggcgagaccaaaggggatcagggcaagtaggaacatatggattaaacacatttacaaatatggaagctcaactcatacgacaaatggaaggcgaaggaatttttaaatccatccagcacctaacagtaacagaagaaatagcggtgcaaaattggctagcaagagtaggccgtgaaagactgagtagaatggccataagtggcgatgattgtgttgtaaaaccactagatgatagatttgcatctgcattgactgcactaaacgatatgggcaaagttaggaaagacatacaacaatgggaacccagtaagggatggaatgactggactcaagtaccgttctgtagccatcacttccacgaactaattatgaaagatggacgagtgctagttgtgccatgtagaaaccaggatgaattaattggtagggccaggatcagccaaggagcaggatggtcattaaaagaaactgcatgtctgggaaaaagctacgcacagatgtggagtctgatgtactttcatcgacgggacctaaggttggctgccaatgctatttgctcagctgtaccaagccattgggttccaacgagtagaaccacttggtccatacatgccaaacatgaatggatgaccacagaagacatgttgacagtgtggaatagagtatggatacaagaaaatccatggatggaagacaaaacgcctgttgaatcatgggaagaagtaccttatctaggaaagagggaagatcaatggtgtggatcgctcattggattaaccagcagagcaacatgggcaaagaatattcaaacagctatcaatcaggtaagatcattgatcggaaatgaagaatataccgattatatgccaagcatgaagaggtttcgccgggaagaagaagaagcaggagttttgtggtaa

SEQ ID NO: 22836 - RNA, 9876 nt, synthetic construct
  misc_feature 1..9876: note = derived and/or modified CDS sequence (opt6) from DENV-2__FM210226__SS-prME
  source 1..9876: mol_type = other RNA
acagcaggagtaataatcatgctaattccaacggcaatggcatttcatttgactactcggaatggggaaccgcatatgatagttggacgacaagaaaaaggtaaaagtcttctcttcaaaacggaagatggggttaacatgtgcactttgatggcaatagacctgggtgaattatgtgaagatactattacttacaaatgtccgctattacgccaaaatgaacctgaagatatagactgttggtgtaattcaacgtccacgtgggtcacttatggtacatgtactactaccggagaacataggcgggagaaaaggagtgtggcgttagtaccacatgttggtatgggactcgaaacaagaacagaaacatggatgagttccgaaggtgcgtggaaacacgctcagagaattgaaacatggatattgagacaccccggttttaccattatggcggcgatattagcatatacagtaggcacaacacatttccagcgagctttaatatttatattgctcgctgctgtagctcctagtatgacaatgcgctgtattggcattagcaatagagatttcgtcgaaggagtatcgggaggatcttgggttgacatagtattagaacatggcagttgtgttacgaccatggccaaaaacaaaccaacgctagactttgaactcataaaaaccgaagcaaaacaacctgcaaccttacgtaaatattgcattgaagcgaaattgactaataccacaacagaaagtaggtgcccaacacaaggagaaccgagcttaaatgaggaacaagacaaacgattcgtttgcaaacacagcatggtggatagaggatgggggaacggttgtggactgttcggcaaagggggaattgttacttgcgcgatgttcacatgcaagaaaaatatggagggaaaaatagttcaacctgagaatctagaatacacaattgtaatcacaccacattcaggtgaagaacatgcggtaggaaatgacacaggaaaacatggaaaagaaataaaaatcacaccacaatcacctataaccgaagcggaattaactggatacggtacggtaacgatggaatgctcaccacggaccggcttagactttaatgagatggtactgctccagatggaggataaggcttggctggtccataggcaatggttcctcgatcttccactcccatggcttcctggagcagatactcaaggtagtaattggatacagaaagaaacccttgtaacttttaaaaacccacatgcaaagaaacaagacgtggttgttttagggagtcaagaaggagcaatgcataccgcgttaacaggtgccacggaaatacagatgtctagcgggaacttactttttactggacatctgaaatgtcggctaaggatggacaaattacagttaaaaggaatgagttattcgatgtgcacaggtaaatttaaaattgtcaaagaaatagcagaaacacaacatggaaccatagtcataagggtgcaatacgaaggggacggctccccatgtaaaatccctttcgagataatggacctagaaaagagacatgtattggggagactgataacagttaatcctatcgttacagagaaagacagtcccgtaaatatcgaagcggaacccccatttggggacagttacataatcataggggtagagccaggtcaactaaaactaaattggtttaagaaaggatctagtataggccaaatgtttgagacgacaatgagaggcgccaaacgtatggcaatacttggtgacaccgcttgggattttggatctctcggaggcgtgttcacatcaattggaaaagcgttacaccaagtgtttggtgcaatctacggagcagccttcagcggcgtatcgtggacaatgaagatcctaataggagtcataattacatggatcgggatgaatagtagatctacaagcctgtcggtcagcctagtacttgtaggtgtaataacgctgtatctgggtgccatggttcaggctgattcaggctgcgtagtctcgtggaagaacaaggaattaaaatgtgggtccggaatatttatcactgataacgtacatacatggacagaacaatataaattccagccagagtctccctccaagttggcatctgcaatacagaaagcacacgaggagggtatatgtggaattagatcagttacaagattggaaaacttaatgtggaaacaaataacacccgaactaaatcacatattatctgagaacgaagtaaaactaactatcatgactggcgatattaaagggataatgcaagccggtaagaggtcgttaaggccccaacctaccgagctaaaatatagttggaaaacctgggggaaagctaaaatgttatcaacggagagtcataatcaaacatttctaatcgatggcccggaaacagcggagtgtccaaacacaaatcgagcctggaactccttagaagttgaagactatggatttggggtattcaccacaaatatctggttaaaactcagggaaaagcaagatgtattttgcgactctaagttaatgtcggcagctattaaagacaacagagctgtgcatgcagatatgggttactggatagaatcagctttaaatgatacctggaaaatggaaaaagctagctttatagaagtcaaatcttgtcattggccaaaaagccatactttgtggagtaacggcgtgcttgaatcggagatgattataccaaaaagtttcgcagggccagttagccaacacaattacagaccaggctattacacccaaactgcaggaccatggcatctaggaaaattagaaatggactttgatttctgtgaagggacgactgttgtcgtcacagaggattgtggcaacaggggtccctcattaagaacaacaaccgcatcaggaaaactaataacagaatggtgttgccgatcatgcaccttgccacctttacggtatcgaggagaagacggatgttggtatggaatggaaatacgaccactaaaagaaaaggaagaaaaccttgttaactccttagtaacggcaggacacggacaaatcgataattttagtttaggcgtattgggtatggcattatttttggaagaaatgctgcgtacgagagtagggacgaagcacgcaatcctactcgttgccgtatccttcgtgacccttataaccggaaacatgagctttagagacctgggtcgggtcatggtaatggttggcgctgcgatgacagatgacataggaataggagtgacatacctagcattattggcagcatttaaggtcagaccaactttcgccgccggtcttctactaaggaagttaacatcaaaggaactgatgatggccacgataggtatagcactcttatctcaatcaacaattcccgaaacgattcttgaattgacagatgctctagctctaggaatgatggtattaaaaatagtccgtaatatggagaaatatcagttagcagtcacaataatggccatatcgtgcgttccaaatgctgttatcctacagaacgcctggaaagtatcatgtacgattctagcaacagtatcagtatccccactactgctaacaagctctcaacaaaaggctgattggattccattagcattgacgataaaaggattgaaccctactgccatatttctaacaacactatcacgaacgtctaagaaacgatcatggccactaaacgaagctataatggctgttggcatggtatcaatactcgctagcagtcttcttaagaatgacattcctatgacgggaccattagtcgccggtgggcttcttactgtttgttacgtactgacggggcgtagtgcggaccttgaattagaacgagccaccgatgtcaaatgggaagaccaagccgaaattagtggtagttcgcctattttatcaattactatcgcagaggatggatctatgtcaatcaaaaatgaagaagaagaacaaacccttacaattctaattcgaacagggcttttagtgatctcgggcctgttccctgtgagtattcccatcacagctgccgcttggtacctttgggaggtgaagaaacaaagagccggggttttatgggatgtgccctctcccccgcccgttggaaaagcagaattggaagatggcgcgtaccgaatcaaacaaaaaggtattctaggatacagtcaaataggtgccggtgtatataaagaaggaactttccatacaatgtggcacgttacaagaggagcagtactaatgcataggggtaaacgaatcgaaccttcatgggctgatgtcaaaaaggatttaatctcatatggtggaggttggaaattagagggtgaatggaaagaaggagaggaagtacaagtactcgcacttgaaccaggcaaaaatcctagggcagttcaaactaaacccggacttttcaaaaccaatacaggaacaataggcgctgttagtctcgactttagtccaggcacttcaggatccccgatagttgacagaaaaggaaaagtcgtaggtctatatggaaatggagtagttactagatctggcgcttatgtatcagcaatagcacagacagaaaaatcaattgaagataatcccgagatagaggatgacatttttcggaagaaaagactaactattatggacttacatccaggcgcaggcaaaacaaaacgatacttacccgccatcgtaagggaagctataaaaaggggattgaggacacttatattagcccccactagggtcgtggcagcggagatggaggaagcgttaagaggactccctatccgctatcaaacgccagctatacgagcagaacacaccggacgagagattgtagatctaatgtgtcacgctacttttaccatgcgtttgctaagtccagtaagggtgcctaattataacttaataattatggatgaagcgcactttaccgatccggcttccattgctgcacgtggatacatctcaacaagagttgaaatgggcgaagcagcaggtattttcatgacggctacgccaccgggcagtagagatccttttccccaaagcaacgccccaataatggatgaagaaagggaaatacccgaacgaagctggaatagtggacatgaatgggttactgattttaaaggaaaaacagtttggttcgtccccagcataaaagccggaaatgacatagcagcctgcctccgtaaaaatggcaagaaagttattcaattaagtagaaagacattcgattcggaatacgttaaaacccgcacgaatgattgggattttgttgtgaccacggatataagtgaaatgggagcgaacttcaaggcggaacgtgttatagacccgagacgatgtatgaaacctgtaattctcacagacggtgaagaacgcgtaatactagctggcccaatgccggtaactcattcatccgccgcacagcgcagaggtcgcataggacgtaacccgaaaaatgagaacgaccaatatatatatatgggcgaaccattagaaaatgatgaagactgtgcgcattggaaagaagcaaaaatgctactagataatattaatacacctgaagggattataccttcaatgtttgaacccgaaagagaaaaggttgatgccatagatggagaataccgactaaggggagaagcaagaaaaacattcgtggatctaatgcgtagaggggacctgcccgtatggctggcatatagagtagcagcggagggaataaactatgcagacagacgctggtgttttgatggagttaaaaacaatcagattttggaagaaaatgtagaagtagagatttggactaaagaaggcgagagaaagaaactaaaaccgcgatggctagacgcccgaatttattccgatccactagctttgaaagagttcaaagaatttgcagctggacgtaaatcattaacgttaaacttaattacagaaatgggtaggctaccaacttttatgacccaaaaagctagggacgcattagacaacttagcagttttacataccgctgaagctgggggacgagcttacaaccatgcattgagtgaactacccgaaacattagaaacactccttctgttgacattactcgcgacagtaacaggtggtatttttcttttcttaatgtcagggaaaggtgtaggaaaaatgaccctaggaatgtgctgtattattacagcatcaattctattatggcatgcgcaaatacagccgcattggatagccgcatctattatattagaatttttcctaatcgtgctacttatccctgaaccagagaaacaacgcacccctcaagataaccaattaacctacgtagttatcgcgatattaacagttgtggccgcgaccatggccaacgaaatggggttcttagagaaaaccaagaaagatctaggattggggagcatagcaacacaagaaccagaatcaaatatattagacattgatcttagaccagcttcagcatggaccctctatgcagtagcaacaacgtttgtcactccaatgttaaggcattccattgagaatagtagtgtcaatgtaagtcttacagcaatcgcgaatcaagctactgtcctgatgggtctagggaaaggatggccattatccaaaatggacatcggcgtgcccttgttagcaatcggatgttatagccaggtcaaccccataaccttgacagctgcactattacttctagttgcacactacgccataataggtccgggtttgcaggccaaggcgactcgggaagcacaaaagagagctgcagctggtataatgaagaacccgacagtcgatggtatcactgttatagacttagatccgataccctacgatccgaagttcgaaaaacagttaggacaagtaatgcttcttatattatgcgtaacacaagtacttatgatgaggaccacttgggccctgtgtgaagcattgaccttagctacaggacccatttccacgttatgggaaggcaatcctggacgattttggaacactacaatagctgtaagcatggccaatattttccgaggttcttatttagcaggagcaggattattgttttccataatgaaaaacactacgaatacgcgaagaggtactggcaatattggcgaaacattaggagaaaaatggaagtctagattaaatgcgttaggtaaaagtgaatttcagatatacaagaaatctggaatacaggaagttgatcgcactcttgcaaaagagggaatcaaaagaggggagactgatcatcatgctgttagtagaggatcagcaaaactaaggtggtttgtagagaggaacatggtcaccccagaaggcaaagtagttgacctaggatgcggacgtgggggatggtcatactattgcggaggattgaaaaatgtgcgcgaagttaaaggtttgacaaaaggcggacctggccacgaagaaccagttcctatgtcgacatatggctggaatttagttcgattgcaatccggagtcgacgtattctttacaccacccgaaaaatgtgatacattgctttgcgacataggggaatcaagcccaaacccaaccatcgaagcaggtagaactcttagggtactatccttggtagaaaactggcttaataacgatacacaattttgtattaaagtgttaaatccatacatgccctccgttatagagaaaatggaaacactacaacgaaaatacggaggggccctagtaagaaacccactctctcgtaatagtactcatgaaatgtattgggttagtaacgcgacaggaaacatcgtttcttcggtcaatatgatatctcgaatgctaataaacagattcacaatgaaacacaagaaagccacttacgaacccgatgtagacctcggaagtggtactaggaacattggcatcgaaagcgagatcccgaatctcgatataataggaaaaagaatagagaaaattaagcaagagcatgaaaccagctggcattatgatcaggaccatccttataaaacttgggcttatcacggtagctacgaaacgaaacaaacgggaagtgcatccagtatggtaaacggtgttgtaagacttctaacgaaaccctgggacgtggtgccaatggtaacacaaatggctatgacagacacaactccatttggccagcaacgagtatttaaagagaaagttgacactcggacgcaggagccaaaagaaggaactaaaaagttaatgaagatcacagctgaatggctttggaaggaactaggcaagaagaaaactccccggatgtgtacacgcgaagaatttacgcgtaaagtgagaagtaacgctgcactgggggccatattcaccgatgaaaacaaatggaaaagcgcgagagaggcagtcgaagactcaagattctgggaattggttgataaagaacgtaatttgcatctagaaggcaaatgtgagacgtgcgtatacaatatgatgggcaagagagagaagaaacttggggagtttggaaaagcaaaaggctcaagggctatatggtatatgtggctaggtgccagatttttagagtttgaggcacttggattcctgaacgaagaccattggtttagtcgtgagaatagcctttcaggagtagaaggggaaggtttgcataaattaggatacatcttacgggacgtcagtaagaaagaagggggtgctatgtatgctgatgatacagcgggttgggacacgagaataacgctcgaggatctcaaaaatgaagagatggtaacgaatcatatggaaggagagcataagaaactcgctgaagcaatttttaaattaacttaccagaataaagttgttagggttcaacgaccgactccgcgggggactgttatggacataatcagtcgaagagaccagagaggaagcgggcaagttgggacatatgggctaaataccttcacgaatatggaagcacaattaattcggcaaatggaaggagaaggtatctttaaatcaattcaacatctgacggttaccgaagaaattgcagtacagaattggctagcaagagttggcagagagcgattaagccgcatggctatttctggagatgattgcgtcgtgaaacctctagacgatcgattcgctagcgcgcttactgcgctgaatgacatgggaaaagtaaggaaagatatacagcaatgggaacccagtagagggtggaatgactggacacaggtaccattttgttctcatcacttccatgaattaattatgaaggatggacgcgtactcgttgtaccttgtagaaatcaagacgaacttattggtagggctagaatttctcaaggagctggatggagcctaaaagaaacagcgtgccttgggaaaagttatgcgcaaatgtggtccttaatgtactttcacagaagagacttacgtttggctgcaaacgctatctgtagtgcagttccctcacattgggtacctacaagtagaactacttggagcatacacgctaaacatgagtggatgactactgaggacatgttaaccgtatggaaccgagtgtggatccaagaaaacccatggatggaagacaaaacgcccgttgaaagttgggaagaagttccttacttaggcaaaagagaagatcaatggtgtgggagcctcatcggtttaactagccgagcgacttgggcgaaaaatattcaaacagctataaaccaagtacgatcacttataggaaatgaagagtatactgattacatgccaagtatgaagagattcaggagagaggaagaggaagccggtgttctttggtag

SEQ ID NO: 22837 - RNA, 9876 nt, synthetic construct
  misc_feature 1..9876: note = derived and/or modified CDS sequence (opt6) from DENV-2__FM210227__SS-prME
  source 1..9876: mol_type = other RNA
actgcaggagtcattataatgttgattcctacggcgatggcttttcacttaactactcgtaacggtgaaccacatatgattgttgggcgtcaagaaaaaggaaaatccttactatttaaaactgaagacggagttaatatgtgtaccctcatggccatcgatctaggagaattgtgcgaagatacaattacatataaatgccccttactaaggcaaaacgaacccgaagacatcgattgctggtgcaatagtacaagtacatgggtgacatatgggacatgtacaacaacaggtgaacatagaagggagaaaaggagtgtggcacttgtcccgcacgttggtatgggcctggaaaccagaacagaaacctggatgagtagtgaaggtgcctggaaacatgctcaaagaattgaaacgtggattctaagacatcccggatttactattatggcagccatactagcctatacaattggtactacgcattttcaaagagcgttaatctttatcctactgacagctgtagccccaagtatgactatgcggtgtatcggtatttcaaacagagattttgttgaaggcgtatcaggaggatcctgggtcgatatagttttagaacatggatcatgtgttacgacaatggcgaaaaataaaccgacactagactttgaactaataaaaacagaagctaaacagcctgcaactctaagaaaatattgtatcgaggcaaaactgaccaacacaacaacagaatctcgatgccccacacaaggagaaccaagtttaaatgaagaacaagataaaaggtttgtctgcaaacactcaatggtagatcgaggatggggaaatggttgtggactgttcggtaaaggaggtatagtaacttgtgcgatgtttacatgcaagaaaaatatggaaggcaaaatagtccaaccagagaatctggaatatacaatagtgattacaccccattcaggagaagaacacgcagtcggtaatgataccggaaaacatggaaaagaaatcaaaataacaccacaatctagtgttaccgaggctgaattaactggatatggaactgtaacaatggagtgctcaccgagaactggactagactttaatgagatggttttacttcaaatggaagataaagcatggctagtccatcggcagtggtttctagatctgccccttccttggttgccaggtgctgacacacaaggtagtaattggatacaaaaagagacactcgtaacatttaaaaacccacatgcgaagaaacaagacgtagtcgttttggggtcgcaagaaggagctatgcatacagccttaacaggggcaactgaaattcaaatgtcttccggaaacctgctgtttaccggtcatctaaaatgtaggttaaggatggacaagctccaacttaaaggaatgagttactcaatgtgtactggtaaatttaagattgtaaaggaaattgctgaaacacagcatggaacaatagttatacgagtacaatatgaaggagatgggagtccttgtaagataccttttgaaatcatggacctcgaaaagcgccatgtattaggccgactaattacagtaaaccccatagttaccgaaaaagattctccagtcaatatagaggcagagcctccattcggagattcatatataattattggcgtagaacctggacaactaaaattaaactggtttaagaaaggtagctccatcggtcaaatgttcgagacaacgatgagaggtgcgaagagaatggctatactgggagatacagcctgggactttggatcactaggtggggtcttcacatctattggtaaagccttacaccaggtttttggcgcaatttatggagcagcattctcaggtgtatcatggaccatgaaaatacttatcggagctattataacgtggataggaatgaatagtagatcgacgagcttaagcgtcagcttagtattagtcggtgtaataacactctatctcggagctatggtgcaagcggattctgggtgcgtagtaagttggaaaaataaggaattgaaatgtggatctggaatttttataactgataatgtacatacatggacagaacagtacaagttccagccagaaagtccatcaaagttggcgtcagcgattcaaaaggctcacgaagaaggcatatgtggtattagatcggtcacaagattggaaaacctaatgtggaaacaaattacacccgaattgaaccacatattatcagaaaacgaggtgaaacttacgatcatgacaggcgacataaaaggtattatgcaagctggaaaacgtagcctccgtccacaaccaacggaactaaaatacagctggaaaacttggggcaaagctaaaatgctatccacagaatctcataatcagacttttctaatagacgggcctgagactgctgagtgtccaaataccaaccgagcttggaactctcttgaagtagaagactacggatttggtgtgtttacgacaaatatttggcttaaactgagagagaaacaagatgtattttgtgactctaaacttatgagtgcggcaattaaagacaaccgagcagtacatgcggatatggggtactggatcgagtccaccttaaatgacacatggaaaatggaaaaagccagctttattgaggtgaagtcttgccactggccaaagtcgcataccctctggagtaatggcgtgcttgaaagtgaaatgattatccccaagagctttgcaggcccagtatcccagcacaactatagaccaggatatcatactcaaaccgctggaccctggcatctgggaaaactagagatggactttgacttctgtgagggaacaacagttgttgtaacagaggattgcgggaatagggggcccagcttacgtacaacaacagcatctgggaaattaattaccgaatggtgttgtagaagctgcacattacctccactccggtatagaggcgaagatggatgctggtatggtatggaaatcaggcctttaaaagaaaaggaagaaaatttagttaatagtctagttacagctgggcacggacaaatagataacttctctctaggtgtacttggaatggccctatttctagaggagatgttaagaactagggtaggtaccaagcatgcgatattactggtagcagtatcgttcgtgaccttgatcacaggtaatatgagctttagagacttaggaagagttatggtgatggttggcgccacgatgacagacgatatcgggatgggggtaacgtacctagcactgttggcagcatttaaggtaagacccacctttgcggccggtttgttactacgtaaactaaccagtaaagaacttatgatggcaacaataggaatcgctttattaagccagtcgacaattcccgaaacaatactagaattgactgatgccctggcactaggaatgatgatactcaagatagtacgaaatatggagaagtatcaactagctgttaccattatggctataagctgcgtaccaaatgcggttatcttacaaaacgcatggaaagtttcgtgtactatattggcagcagtttccgttagtccactactacttacaagttcccaacaaaaagctgattggatcccattagcgttaacgattaaagggttaaacccgaccgcaatattcttaaccacactgtcaagaacatctaagaaaagatcatggcccctcaacgaggctataatggccgtgggaatggtgagtatcttagcgtcctctctattgaaaaatgacataccgatgactggacccttggtagcaggcgggttgttaactgtttgctatgtacttactgggcgtagcgccgatctcgaactggaaagagcaacagacgtcaaatgggaagatcaagctgaaatctcagggtcgtccccaatactaagtataacaataagtgaagatggctcgatgagtatcaaaaacgaagaagaagaacagacacttacaattctaataagaacagggttattggttatttctggactctttcccgtatccatacccatcacagctgcggcttggtatctttgggaagtcaaaaagcaacgtgccggagtcctatgggacgtaccatccccgccacctgtggggaaagctgaactggaagatggcgcttataggataaaacaaaaaggcatacttggctactcccagataggtgcaggggtatataaagaaggcacctttcacacaatgtggcatgtaaccagaggtgcagtgttaatgcatagaggaaaaagaattgaacccagctgggcagacgtcaagaaagatttgatatcctacgggggaggttggaaactagagggagaatggaaagaaggcgaagaagtgcaagtattggcactagaacccggaaagaacccgcgtgctgtgcagactaagccgggtctttttaaaacaaacacaggaacgatcggagcagtatcattagacttctcaccgggtacatctgggtctccgatagtagacagaaaaggtaaagtagtaggactctacggtaatggcgttgttaccagatcaggagcttatgttagtgcaatagcacagacagagaagagtatagaagataatccagagatagaagacgatatattcagaaagaaaagattgacaataatggatctgcaccccggcgctggtaaaacaaaaagatatctccctgcgattgtaagagaagcgataaagcgaggcctcagaaccttaatactcgcaccaacgcgcgtagtagcagcagaaatggaagaggctttacggggattacccatcaggtaccaaacaccggccatcagagcggaacacaccggtagggagatagtagatttaatgtgccacgcaacttttactatgcgactacttagtccagtgagagtcccaaactacaatctcatcattatggacgaagctcactttacagaccctgcctcaatcgcagcgcgaggctatatttcaactagggtagaaatgggggaggccgcaggtatatttatgactgcaacaccacctgggagcagagacccatttccgcagagcaatgctcctataatggacgaagaaagagagattccggaaagaagctggaatttcggccacgaatgggtaaccgattttaagggaaaaacggtctggtttgtcccaagcataaaagcaggaaatgatattgccgcatgcttgagaaagaatgggaaaaaggttatacaactatctagaaagacttttgattcagagtatgtaaaaacaagaaccaatgattgggactttgtggtcacgactgatatctccgagatgggagcaaactttaaggcagagcgcgtgatcgatccaaggagatgcatgaaacccgttatactaacagatggtgaagaaagagttattcttgctggtcctatgccggtaacacattcatcagctgcgcaacgtaggggtagaattggcagaaatccaaagaacgagaatgaccagtatatttatatgggagagccattagaaaatgatgaggattgtgcccattggaaagaggcaaagatgctactggacaatattaatactccagaggggataattccatctatgtttgaaccggaacgggaaaaggtcgacgctattgacggggagtataggcttcgcggagaagcgagaaaaacatttgttgatctcatgcgaagaggtgacttacctgtctggttggcgtacagggttgctgccgaaggaataaattatgctgacagaagatggtgtttcgacggagtcaaaaataatcaaatactagaagaaaatgtcgaggtagaaatatggacaaaagagggagaaaggaagaaattgaaaccgcggtggcttgatgcaagaatatacagcgatccccttgcacttaaagagtttaaagaatttgctgcgggaagaaaatcactaacactaaacctaataacagagatgggaagacttccaacatttatgacacagaaagctcgggatgctctagataacctcgcagttttacatacggcagaagccggtggacgagcatataaccacgctctatcggaattaccggaaactctagaaaccttgcttctactaactcttctggcaacagtaacaggaggaatcttcctcttccttatgagtggcaagggtgtaggaaaaatgactttgggaatgtgctgtataataacggcatcgattcttttatggtatgcacaaattcaaccccattggatcgcagcatctataatcctagagttctttcttattgttcttttaattcctgaacccgaaaaacaaagaacgcctcaggataaccaacttacatatgtagtaatagctatattgacggtcgtagcggctaccatggcaaatgaaatgggatttctagagaaaaccaagaaggatttaggtcttgggtccgtcgcaactcaagagcctgaatcaaatatattagacatagatctgaggccagctagtgcgtggacactgtacgcagtggctacgaccttcgtcacgccaatgctacggcactcaatagagaacagtagtgttaatgtatctctaaccgccattgctaatcaggccactgttttgatgggccttggtaaaggctggcccttatcaaaaatggacatcggtgtacccttattggcaataggatgctattcacaggtcaacccgataactcttaccgcagccttattactattggttgcacactacgctattatagggccgggtctacaagcaaaagccacaagagaggcacagaaaagagctgcagcgggtataatgaaaaatccaaccgttgacggtataaccgtaattgacctagaccctataccatatgatcccaaatttgaaaaacaactaggccaagttatgcttttaatattatgcgtaacacaagtactcatgatgagaacaacctgggctctttgcgaggcgctcactctggctacaggcccaatcagcaccctgtgggaaggaaatcctggtagattttggaataccactatcgcagttagcatggcaaatatttttagaggaagctacctagcaggagcaggattattgttctcaatcatgaaaaatactacaaatacaagaagaggtacgggaaatattggcgaaacccttggtgaaaaatggaaaagtcggttaaatgcattagggaaaagcgaatttcagatttataagaaatctggaatacaagaagtggaccggacactagctaaggaaggaataaaaagaggcgaaacggatcaccatgcagtatcacgtggaagtgccaagctccggtggtttgtcgaaagaaatatggtaacacctgaaggtaaggtagttgatctaggctgtggacgtggtggttggagttattattgtggcggtcttaaaaatgtcagagaggtaaaagggttgactaagggtggccccggacatgaagaacctataccgatgtcgacctacggatggaaccttgtaagactgcagagtggtgtagacgtattctttacacctccagaaaaatgcgatacgttactttgtgatattggagaaagctcaccaaacccaactatagaggcaggacgaaccttacgtgttctgtcactcgttgaaaattggttaaataatgacacacagttttgcataaaagtactaaatccatacatgccttcagtaatcgaaaagatggagacactgcaacgcaaatacggaggggcattagtacgaaacccgttaagtcgcaattcaacccacgaaatgtactgggtatcgaacgctacaggtaacattgtttcaagtgttaatatgatttcacgcatgctaataaatcggttcaccatgaagcacaagaaagctacgtatgaaccggatgtagatctcggcagcgggacccggaatataggcatagaatcggaaataccaaatttagacataattgggaaaagaatcgaaaagataaagcaagaacatgaaacatcctggcactacgatcaagatcatccctataagacatgggcataccatggtagctacgaaaccaaacaaacaggatcagcaagtagcatggtaaatggagtagtacgattgttaacaaaaccgtgggatgttgttcctatggtcacgcaaatggcaatgacagatacaacaccatttggacagcagagagtgtttaaagaaaaggtcgatactaggacccaggaacctaaagaaggtactaagaaattaatgaagatcactgcagagtggctttggaaagaacttgggaagaagaaaactccaagaatgtgtacacgggaagaatttacacgaaaagtacggtcgaatgcagctttgggtgcaattttcactgacgaaaacaaatggaagagtgctagagaggcagttgaggacagccgattttgggaattagttgacaaagaaagaaaccttcatttagaaggaaaatgcgaaacctgcgtatacaatatgatgggcaaacgagagaagaaactgggcgagttcggaaaggcaaaaggttccagagcgatttggtatatgtggctcggtgcaagattccttgagtttgaagccctcggtttcttaaatgaagatcattggtttagccgggaaaatagcttgagcggcgtagaaggagaagggcttcacaaattgggttatattttgcgtgatgtaagtaagaaagagggtggcgctatgtacgccgatgataccgcagggtgggacactaggataactctagaagatttgaaaaatgaagaaatggtcaccaaccacatgggaggagaacacaaacggctagcagaagccatttttaaacttacatatcaaaataaagtggtacgagtccaacggccaacacctcgagggaccgtaatggatatcatcagcagacgagatcaaagaggttcgggccaagtaggcacttacggacttaacacttttacaaatatggaagcacaactcataagacaaatggaaggtgagggaatatttaaatctatacaacacttgaccgttacggaggaaattgccgtccagaactggttggcacgcgttggtagagaacggttaagccgcatggcaatttcaggagatgactgcgtggtgaaaccgttggacgaccgatttgcgagtgccctaacagcgttaaatgatatgggcaaagttagaaaagacatccaacagtgggaaccaagtaaaggttggaacgattggactcaagtgcccttctgttctcaccacttccacgatttgataatgaaagacggtcgagtccttgtagtaccatgtcgaaatcaagatgaactgataggtcgcgcaagaatatcacagggggctggatggtcattgaaagaaacagcatgcctgggaaagtcctatgcacagatgtggagtctaatgtattttcacagacgtgacttgagattagccgcaaatgctatatgttcagcagtgcctagtcattgggtcccgacgagcagaaccacgtggtctatacacgcgaaacatgaatggatgaccactgaagatatgttaacagtctggaacagagtctggatacaggaaaacccctggatggaagacaaaaccccagttgagtcttgggaagaagtgccgtaccttggaaaacgcgaagaccaatggtgtggcagcctaattggacttacaagtagggcaacctgggccaaaaatatccaaacggcaatcaaccaagtaagatcacttataggcaatgaagaatatactgactatatgcctagtatgaagcgatttcgaagagaagaagaagaagcaggggttttatggtaa

SEQ ID NO: 22838 - RNA, 9876 nt, synthetic construct
  misc_feature 1..9876: note = derived and/or modified CDS sequence (opt6) from DENV-2__FM210204__SS-prME
  source 1..9876: mol_type = other RNA
accgcgggcgtaataattatgttaattcccaccgctatggcattccatctcactactagaaatggggaaccccacatgatagtcggtagacaagaaaaaggcaaaagccttttgtttaaaactgaagacggcgtaaatatgtgtacactcatggctatagatttaggtgaattatgtgaagatacgatcacttataaatgccctctactgaggcaaaacgaaccagaagacatagattgttggtgcaatagtactagcacttgggtaacatacggtacatgcactacaactggagagcaccgacgggagaaaagatccgtcgctttagtaccacatgtagggatgggcttagagaccaggaccgaaacatggatgtcaagtgaaggagcatggaaacacgctcaacgaattgaaacatggatactacgacatccaggattcacaataatggcagcaatactggcatataccatcggcacaactcattttcaaagagcccttatctttatacttctaactgccgtggctcctagcatgacaatgagatgtatcggcatatcaaatcgggattttgtggaaggtgtgtcaggtggtagttgggttgacattgtattagaacatggctcatgtgttaccaccatggctaaaaataaaccaaccttagattttgaattgattaaaacagaagcaaaacaaccagccacactaagaaaatattgtattgaagcgaaactcacaaataccacaacagaaagccgctgtcccactcaaggagaaccatcattgaacgaggagcaagataaaaggttcgtatgtaaacattcaatggtcgacagaggttggggtaacggttgcgggttgttcggcaaaggtggaatagtaacatgcgctatgtttacttgtaagaaaaacatggaaggtaaaatcgtccaaccagagaatctggaatatacgatagtcatcactccccattcaggagaggaacatgcagttgggaatgacaccggaaaacatggcaaagaaataaaaattaccccacaaagtagtgtaaccgaagctgaattaacaggttacggaacagtaacaatggaatgctctcctaggacgggcctagacttcaatgagatggtactgcttcaaatggaagataaagcatggttggttcataggcaatggttccttgacttgccattaccttggctcccaggagccgatacgcaaggtagtaattggatacaaaaagaaacattagtcacttttaaaaatcctcacgccaagaaacaagatgtagtagtactaggttcacaagaaggcgcaatgcacactgctttaacaggagccacagaaattcaaatgtccagcgggaatttacttttcactgggcacttaaaatgcagactcagaatggataaattgcaactgaaaggcatgtcatactcgatgtgcacaggcaaatttaaaatagtaaaagaaattgctgaaacccaacacggaactattgtgattcgagtacagtatgaaggcgatggaagcccatgtaaaataccgttcgagataatggatcttgagaaaaggcacgtcttggggaggttaatcacagtaaacccaatagtaacagagaaagacagtccggtaaatatcgaagcagagccacccttcggcgattcgtatataataataggtgtagaacccggacagttaaaactcaactggtttaagaaaggatcatcaattggacaaatgtttgagacgacgatgcgtggcgctaaaagaatggctatactgggggatacggcgtgggatttcggatcattaggaggtgtgtttacatcaatcggtaaagcactacatcaagtatttggagctatatatggcgccgcattctcaggagtcagctggactatgaaaatattaataggagctatcataacttggattggtatgaatagtaggagcacaagtttatccgtatcattggtcctagtgggcgttataacactatacttaggagccatggtgcaggctgatagcggatgtgttgtaagctggaaaaacaaagagctgaagtgcggaagcggcatttttattacagataacgtacacacatggacagaacaatacaagttccaacccgaaagtccttctaaactggcctctgcaattcaaaaagcctatgaagaaggcatatgtggcatacgatccgtgactcgtctggaaaatctcatgtggaaacaaataactcctgaattaaaccatatattatccgaaaatgaagtcaaattgaccataatgacgggagatataaagggaattatgcaagcaggaaaaagatcgctaagaccacaaccaacagaattaaagtacagttggaagacttggggcaaggctaaaatgctgagtaccgaatctcataatcaaactttcttgattgatggcttagaaacggctgaatgtcccaatacaaatcgagcatggaatagtttagaagttgaggactatggttttggagtctttacgacaaacatctggttaaagctccgcgaaaaacaagatgtcttttgtgactcgaaattgatgtcagcagcaatcaaagacaaccgggctgtacatgcagatatgggatattggattgagagtgcgcttaatgacacttggaaaatggaaaaggctagtttcatagaagtcaaaagctgtcattggccgaaatcacacaccttatggtcaaacggagttttggaatcagaaatgataattccaaaaagttttgcaggaccagtatctcagcataattatcgtcctggataccatacacaaactgccggcccatggcacctgggaaaacttgaaatggattttgatttttgcgaggggacaaccgtagtggtaacagaagattgtggaaacaggggaccgagcttgcgaacaacgacggcgtccggcaagttaattactgaatggtgttgcagatcgtgtaccttacctcccctaagataccgtggcgaagatggatgttggtatgggatggagatacgacctttaaaagaaaaagaggaaaacctagtaaacagcttagttaccgcgggtcacgggcaaatcgataacttttcattaggcgttctaggaatggccctatttttagaggaaatgcttcgaacacgtgtaggaacaaagcatgcaatactattagtggcagtatcgttcgtgactctaataacgggaaatatgagttttaaggatctgggaagagttatggtcatggttggagctacaatgacggacgacataggaatgggagtaacctacttagctctcctagctgcttttaaggttagacctacattcgccgcaggactgttacttaggaaactaacgtcgaaagaactgatgatggccaccattgggatagctctcctgtctcaatcaactattccagaaacaatattggaactcaccgacgcccttgcactgggaatgatggttttaaaaatagtgcgcaatatggagaagtatcaattagcagttacaataatggcaatctcatgtgtcccgaacgccgtgatattacagaatgcctggaaggtctcctgtactatattagcagcagtctcagtatctcctttgttattaacatcatcacaacaaaaggctgattggatccccctggcactaacaattaaagggttgaatccaaccgctatatttttaacgaccctttccagaacgagcaagaagagaagttggccactcaacgaggctataatggcagtgggcatggtatcaatattagcgagtagcttattgaaaaatgatatccccatgacaggccctctagttgcaggaggtttactgactgtttgctatgtactaacagggcgatcagccgatctggagctagaaagagcaaccgacgtaaagtgggaagatcaagcggaaatatcaggatcgtcacctatactgagcataacaattagcgaagatggatcaatgagtatcaaaaacgaagaagaagaacaaaccctaacaatcttaataaggactggacttctagtcatctcaggattatttccggtttcaatcccaatcacggctgctgcatggtatctatgggaagtcaagaaacaacgtgcgggtgtactatgggacgttccatccccgcctccagttggaaaggcagaattggaagacggagcgtatcgtataaaacagaaaggaatattaggctattctcaaatcggagctggagtctataaagaaggaacgtttcatacaatgtggcacgtcacgagaggggctgtgctgatgcataggggcaaaagaatcgaaccgtcatgggccgatgtcaagaaagacctaataagttacggtgggggttggaaattggaaggagaatggaaagaaggtgaagaagtacaagtcttagccttagaacctggtaaaaaccctagagcagtacagacaaaaccaggtctattcaagacgaataccggaacaatcggggcggttagtctagacttttccccaggaacatcggggtcccctatagtagatcgaaaaggaaaagtggtaggactctacgggaacggtgtagtgactagatccggtgcatatgttagcgctatagcacagacagagaaaagcatcgaagacaatccagaaatagaagacgacatatttcgtaagaaaagactcactataatggatctccacccaggtgcaggaaaaactaaacgctatctgccagcaattgttagagaggcaatcaaaagagggcttcgtacacttatacttgcacccacgcgcgtcgtagctgctgaaatggaagaagcattgcgtggattacctatcaggtatcaaactcccgctataagagcagaacatactggacgtgagatagtggacttaatgtgtcacgccaccttcactatgaggctattaagcccggtgcgagttccaaattataatttaattattatggatgaagcgcactttacagacccagcctccatcgcggcacgaggctatatcagtaccagggtagaaatgggagaagcagctgggatatttatgacagcgacaccgccaggttcacgagatccattcccgcagtccaatgcgccaataatggatgaggaaagagaaattccagaaagaagctggaactctggtcatgaatgggtaacagatttcaagggaaaaactgtatggtttgtaccatcgatcaaagcaggtaacgatatcgctgcatgtttaaggaaaaatggtaaaaaggttatccagctatcaagaaagacatttgactctgaatatgttaagacaagaaccaatgattgggattttgtagtgactaccgatatttcggaaatgggagcaaatttcaaagctgaacgagtcattgatccaagacgatgcatgaaaccagtgattctaacggatggtgaagaaagagttatattagcaggaccaatgcctgttacccacagtagcgcagcccaacgtagaggcaggatcgggaggaaccccaaaaatgagaatgatcaatatatctacatgggagaaccactagaaaacgacgaagattgcgcgcattggaaggaagcaaagatgttactagacaatataaatacaccggaagggattataccatcaatgttcgaaccggaacgtgagaaagttgatgccatcgacggggaatatagattgcgaggtgaggctcgtaaaaccttcgtggatctaatgcgaagaggtgatttacccgtatggttagcatacagggttgctgcagaggggattaattacgcagatcgacgttggtgtttcgatggggtcaaaaataatcagatattagaagaaaatgttgaagttgaaatatggacaaaggagggagaacgaaagaaattaaaaccaagatggttagatgcaagaatttatagcgacccactagcgctaaaagaatttaaggaatttgcggcaggtagaaaatcactgacactaaatttaatcacagaaatgggtcgattacctacctttatgacacagaaggctagagatgcgttggacaatttggccgtcttacacacggcagaagcaggagggagggcatataatcacgccctttcagaactccctgagacattagaaactttgctgctcttaacattgttagctacggtaacgggtgggatatttttgttcctcatgagcgggaaaggtgtcggaaaaatgaccctagggatgtgttgtattattacagcatcgatcctattatggtatgcgcaaatccaaccgcactggattgcagcatcaatcattttagagttcttcctaatagttctgttaattccagagccggagaagcaaagaactccacaggacaatcaactgacctatgtggttatagcgatactaacagttgttgccgcaacaatggcaaacgagatgggttttctagagaaaactaagaaagatttaggtttgggtagtgtagcaacacaagaacctgaatctaacattctagatattgacctaagaccagcaagtgcatggaccctgtatgccgtagctactacgttcgttaccccgatgttacgtcactctattgaaaactcatctgttaatgtgtctcttacagccatcgcaaaccaagctacggtgctaatgggcctaggtaagggttggccactttcgaaaatggatataggagtacctttattggctatagggtgttactctcaagtcaatcccattacactcacggctgctctgctattattagtcgcacactatgcaataatcggacccggtctccaagcaaaggctacacgggaagcacagaaacgtgctgctgcgggaataatgaaaaaccccacagttgatggcatcactgtgattgatttagatcctattccttatgatcctaaatttgaaaaacaactaggccaagtaatgttgctaatcttatgcgtaactcaagttcttatgatgcggacgacttgggcattatgcgaagcgttgactttagcaaccggccccatttctaccctgtgggagggtaacccagggaggttttggaacacaaccatagcagtgagtatggccaatatatttagaggcagttacctagcgggtgctgggttattgttcagcatcatgaagaatactacaaatacacgtagaggaacgggtaatatcggtgaaacattaggtgaaaaatggaagtctagactaaacgcgttaggaaaaagcgaatttcagatatacaagaagagtgggatacaggaggtggatcgaactctggccaaagagggtataaagaggggcgaaacggaccaccatgcagttagcagaggaagtgccaaactgcgatggtttgttgagcgaaatatggttacgcctgaggggaaagtcgtagatctaggatgtgggagagggggatggtcctattattgtggaggattaaagaacgttagagaagtaaaaggactaacaaaagggggaccaggacatgaagaaccgattcccatgagtacgtatggatggaacctggtaaggttgcaatcaggggttgatgtattcttcactccacctgaaaaatgcgatactcttctatgtgacataggcgagtcaagcccgaatccgacgatagaagcggggcgtactctaagagtactgagtcttgtagaaaactggttaaataatgacacacagttttgtataaaagtattaaatccatatatgcctccggttatagagaaaatggaaaccctacaaaggaagtacggaggggctttagttcgaaatccgctttctcggaactcaacccatgagatgtactgggtgagcaatgccactgggaatatagtatcgagcgtaaacatgataagtcggatgttaataaacagattcacaatgaaacataagaaagctacatatgaaccagatgtggatctaggatctggtacacgaaatataggcatcgagtcagagatcccgaatctggacatcataggcaaacggatcgagaaaattaaacaagaacatgagacaagctggcattatgatcaagatcatccatataaaacctgggcctaccatgggagttacgaaacaaagcagaccggtagtgcgagtagtatggtaaacggggtagtgagattgttaacaaaaccctgggacgtagtacctatggtcacccaaatggcaatgactgatacgactccatttggtcaacaacgcgtttttaaagagaaagtagatactcgcacccaagaaccgaaggaagggaccaagaaattaatgaaaatcacagcagaatggttatggaaagaacttggcaagaagaaaactcctagaatgtgtacaagagaagagttcacaagaaaagtaagatcaaacgccgctttaggagctatctttaccgatgaaaacaaatggaaaagcgcaagagaagccgtagaagattctcgcttttgggagcttgttgataaagagagaaatctgcacctagaaggaaagtgtgaaacatgcgtctataatatgatgggtaagagagagaagaaacttggtgagtttggcaaagctaaaggcagcagggcaatatggtacatgtggcttggagcgagatttttagagttcgaggcactcggattcctaaacgaagatcattggttctcccgagaaaattcattgtcaggagtagaaggagagggactgcataaactaggatatatactaagagatgtctctaagaaagaagggggagccatgtatgcggatgataccgcaggatgggatacaagaatcacgttagaagatctaaagaatgaggaaatggtaacaaatcatatggaaggcgagcataaaaggctggcagaagcaatattcaagttaacgtatcagaataaggtagttagggtacaaagaccaacgcctaggggaacggtaatggatataatatctcgaagagatcaaagaggctctggacaagtgggcacatatggtttaaatacatttactaatatggaagcgcaattgattaggcaaatggaaggagaaggaatattcaaatcaatacaacatctaaccgtaacggaagaaatagcagtacaaaattggttagctcgcgttgggagggaaagattatcaaggatggcgatatccggagacgactgtgtagtaaaacctttagatgataggttcgccagtgctcttactgcgttaaacgatatgggcaaagtcagaaaagatattcaacagtgggagccgtcaaaaggctggaacgactggacccaggtaccattctgtagtcaccactttcacgatctcataatgaaggatggaagagtattagtagtcccttgtcgaaaccaagacgaattaatcggcagggctagaattagtcaaggagctgggtggtcattgaaagaaacagcatgtctaggcaaaagttacgcgcagatgtggagtcttatgtactttcacaggcgcgaccttagactggcagcaaatgccatttgcagtgctgttccatctcactgggttccaacttcaagaacgacgtggtccatacacgcaaagcatgagtggatgactactgaagacatgcttacagtttggaatagggtatggatacaagagaatccttggatggaagacaaaactcccgtagaatcgtgggaggaagtaccttatttgggaaaaagagaagatcagtggtgtggctcattaattggcttgacaagtcgtgctacatgggccaaaaatatacaaacagcaattaatcaggttcgctcgcttataggaaatgaagaatacacagactacatgccgagtatgaagaggttcagacgggaggaagaagaggccggagtgttatggtag

SEQ ID NO: 22839 - RNA, 9876 nt, synthetic construct
  misc_feature 1..9876: note = derived and/or modified CDS sequence (opt6) from DENV-2__FM210230__SS-prME
  source 1..9876: mol_type = other RNA
acagcgggtgttattataatgttgattcctacggctatggcatttcatcttactacgagaaatggagaaccacatatgattgtaggaaggcaagaaaaaggtaaaagtctcttgtttaaaacagaagacggtgttaacatgtgtacgcttatggcaatagacttaggcgaactctgcgaagatactattacttacaaatgtccactactcagacagaatgaaccagaagatatcgattgttggtgtaactctacgtcaacatgggtaacttatggaacgtgcacaacgacaggtgaacacagaagagaaaaacgctcagtagcattggtgccacacgtaggaatgggactagaaacgagaactgaaacctggatgtcgtccgaaggcgcatggaaacacgctcaacgaatcgaaacctggattctgagacacccaggtttcacaattatggcagcaattttagcctacacagtgggaactactcactttcaaagagcgctaatttttatattacttgcagccgttgcgccaagcatgacaatgcggtgcataggaatatctaatagagattttgttgaaggagtgtcaggagggtcatgggtagacattgttctagaacatggaagttgcgtaacaacgatggccaaaaataaaccgacgcttgatttcgaattgattaaaactgaagcaaaacaacctgctacgcttagaaaatattgcatagaagcaaaattaactaacacaacaacggaaagtagatgtccaacccaaggagaaccatcattaaacgaggaacaagataaacgattcgtttgtaaacattcaatggtagatagggggtggggtaatggctgtggactatttggtaaaggtgggatcgtcacctgtgctatgtttacatgcaagaaaaacatggaaggaaaaatagtccaacctgaaaacttagaatacacaatagtaataactccacattcaggcgaagaacatgcggtaggtaatgatacaggaaaacatgggaaagaaataaaaatcactccccaatctcccatcacagaagctgaattaactggatacggaacagtaacaatggaatgtagtccacgcacgggtctagattttaacgaaatggtacttcttcaaatggaggataaggcttggctcgtccataggcagtggtttttagacctacccttaccttggcttccaggtgctgatacccaaggaagcaactggatacaaaaagaaactcttgtaacgtttaaaaacccgcatgccaagaaacaagacgttgttgttctcggatctcaagagggcgccatgcatactgcactaacgggagcaacagagatccaaatgtcaagtggaaatttactgtttacaggacatctaaaatgccgactaaggatggataaacttcaattaaaaggaatgagttatagcatgtgtacaggcaaatttaaaatagttaaagaaattgcggaaacacagcacggaactatagtcatacgtgtccaatatgagggtgacggatccccatgtaaaattccgttcgaaatcatggaccttgaaaagagacatgtcttaggacgacttataacagtaaaccctatcgtgaccgagaaagactctccagtgaatatagaagctgaacctcctttcggggatagttacataattataggagtggagccaggtcaattaaaattaaattggtttaagaaaggatcatccataggccaaatgttcgaaacaacgatgagaggagcaaaaagaatggctatcttaggtgacaccgcatgggactttgggagtcttgggggagtatttacgagcattgggaaggcactacaccaggtatttggggcaatttatggcgcagcattttctggagtctcgtggactatgaaaatattgataggtgtaataataacatggataggtatgaactcgaggagcacgtcactctctgtatctttggtccttgttggtgtaattactttatacttgggagcgatggtgcaagctgactctgggtgtgtcgtatcgtggaaaaataaagaactaaaatgcggtagtggtatttttataactgacaacgtgcatacctggacagaacaatataaattccagcctgaatcaccctcgaaacttgcaagtgcgattcaaaaagcccacgaagagggtatttgtggcataaggtcagtcacacggttagaaaatctaatgtggaaacagattactccggaattaaatcatatactcagtgaaaatgaagtcaaacttacaataatgactggtgatataaagggaattatgcaagccggaaaacgttcactaagaccccagccgacagagctgaagtatagttggaaaacctggggcaaagcaaaaatgctaagtacagagtctcacaaccaaacattcctaattgatggaccggaaacggcagaatgccctaatacaaatcgcgcatggaatagcttagaggtcgaggattacggctttggagtattcacaacaaatatatggctaaaactacgtgaaaaacaggatgtattttgcgactcaaaactaatgtccgctgctattaaagataatagagccgtacatgctgacatgggctattggatagaatcagcattgaatgatacttggaagatggagaaagcctcttttatagaagtaaaaagttgtcattggccaaagagtcacacgctttggtcaaacggcgtgttggaaagcgagatgatcatcccaaagtcctttgcgggcccggtatctcaacataattatcgaccaggttattatacccaaaccgcgggaccatggcatcttggtaaactcgagatggattttgatttttgtgaaggaacaacagtggtagtcacggaagattgcggtaacaggggtccttccttaagaacaactaccgcgagcggcaaattaataacggaatggtgttgtcggtcatgcaccttaccgccattacggtacagaggagaagatggatgctggtatggaatggaaatacggccactaaaagaaaaagaggaaaacctagtgaacagtctagtcacggctggccatggacaaatagacaacttttcattaggtgttctcggcatggctctatttttagaagaaatgctgaggacaagagtaggtactaagcatgctatattgcttgtcacagtttcatttgtaacattaataaccgggaacatgtctttccgcgatctcggacgagtgatggtgatggttggagctgcaatgaccgacgacattggaatgggagttacatacttagccctactagccgcttttaaagttcgaccaacctttgcagcgggtttactactcagaaaattaacttcaaaagagctaatgatggcaacaatcgggattgcattactctcgcaaagcactatccctgagactatactagaacttactgacgcacttgcactcggaatgatggtcttaaagattgtccgtaatatggaaaagtaccaactggcagtcacaattatggccatatcctgtgtacctaacgccgtcattctacaaaacgcgtggaaagtgtcttgtacaatattagctgcggtaagtgtatctcccatgctattgacgtcttcacagcaaaaggcagattggatacctctggccctcacaatcaaaggtctgaatcctacagccatatttttaactacactttctcgaacttccaaaaagcgaagttggccccttaatgaagcaataatggccgtaggcatggtgagtatcttagcgtctagcctactcaaaaatgatattccaatgacaggtcctttagttgctggagggttattaacggtatgttatgtattaaccgggcgctcggcggatttagagcttgaaagagctactgacgtcaaatgggaggatcaagccgagatctcgggttcgagccctatactctcaatcacaatcgccgaggacggcagcatgagtatcaaaaacgaagaggaagaacaaacccttacgatactgattagaacgggtcttctcgtaataagcggcttatttccagtgagcattccaataacagctgcagcgtggtatctatgggaggtcaaaaagcagcgcgcaggagttttatgggatgttccatcaccgccaccggttggaaaagccgagttagaagacggagcatacagaataaagcaaaaaggcatactaggatattcacaaattggagccggcgtatataaagaaggcacctttcatactatgtggcacgtaactagaggcgcagtgttaatgcacaggggcaagagaatcgaaccaagctgggccgatgtcaagaaagatttaatcagttatggaggtggttggaagctcgaaggtgaatggaaagaaggagaagaagtacaagtactagcattagagcccggcaaaaaccctcgtgcagttcaaacgaaaccaggactttttaaaacgaatacgggaactattggcgctgtaagtttagatttttccccaggtacatcaggctcaccaatagtcgaccgtaagggtaaagtggtaggtttatatggaaatggagtagttaccaggagcggagcttatgtttcagctattgcgcaaactgagaagtcaatagaagataaccctgagatagaagacgacatcttcaggaagaaaagacttaccatcatggacttgcacccaggagcaggaaaaactaagagatacttaccggcaatcgtgcgtgaagccattaaaagaggcctgcgtactttaattctagcgcctacgagagttgtagctgcagaaatggaagaggcattgagaggcctaccgatacgctatcagacccccgcaatcagggctgaacataccggcagggaaattgtagacttaatgtgccatgcaacttttactatgcggcttctatcacccgttcgagtccctaattataaccttattataatggatgaagcacacttcacagaccctgcttcaatcgcagcacggggatacattagcacgcgagtggaaatgggtgaagcagcaggtatattcatgactgctacaccgccaggcagtcgagacccctttccacaatcaaacgcgcccataatggatgaagaacgcgaaatacccgagagatcatggaacagtggtcatgaatgggttacagacttcaaaggtaaaacagtgtggtttgttccatcgattaaagccggtaatgatattgccgcttgtctaaggaaaaatggcaagaaagttattcagttgagtcggaaaacttttgactcagaatatgttaagacaagaactaacgactgggattttgttgtaactacggatatttcggaaatgggggccaatttcaaagccgagagagtaattgatccaaggagatgtatgaagccagtaatactaacggacggcgaagaaagggtcatattagcaggtccaatgcctgtaacccatagcagtgcagcgcaaagaagaggcagaatagggcgtaatccaaagaatgagaatgatcaatatatttacatgggtgagcctctggaaaacgacgaagactgtgctcactggaaggaagctaaaatgctgcttgacaatataaacacaccagaaggaataataccaagcatgtttgaaccagagagagaaaaagtagacgcaatagatggagaatatagactgaggggtgaggctcgtaaaacattcgtggacctcatgagaagaggcgacttacccgtatggctggcctatcgagtcgcagcagaaggaattaattatgcagatagacgatggtgcttcgacggagtcaaaaataaccaaatattagaagaaaatgtagaggttgaaatatggacaaaagaaggcgaacgaaagaaacttaaaccacgttggcttgacgccaggatatattcggaccccttagccctcaaagaatttaaagaatttgcagcaggtcgaaaatccttaacacttaatctaattaccgaaatgggacgcctgcctacctttatgacacaaaaagcaagagatgcgctggacaaccttgctgtattgcacacagcagaagccggtggacgggcatacaaccacgccctgagtgaactacccgaaacattggaaacactacttctattaactttattagcaacggttactgggggcatatttctctttctgatgtcaggcaaaggtgtaggcaaaatgacattgggtatgtgttgcatcattacagcatcaatattgctctggtacgcacaaatacaaccacattggatcgcagccagcatcatattagagtttttcctaatagtacttcttatcccagagccagaaaaacaaagaacgccgcaggacaatcaactaacctatgtagtaattgctattcttacagtggtggccgccactatggccaacgaaatgggctttctggaaaagacgaagaaagatttgggcttaggcagcatagcaacgcaagaaccagaaagtaatattttagatattgacctaagacctgcatcagcctggacgttgtacgcagtcgcaacaaccttcgtgactccgatgctacgacatagcatcgaaaattcatcagtcaacgtctcactcacggctatagctaatcaagccaccgtattaatggggctaggaaaaggatggccactcagtaaaatggacatcggagtcccgcttcttgcaataggttgttattcacaggtaaacccaattactctaacggccgcgctattacttttggtagcacactatgcaatcatcgggccaggtctacaagccaaggcaacaagagaagcccagaaaagggctgccgctggaattatgaaaaaccctacagttgacggagttacagtaatagatcttgatccaattccgtatgatccaaaattcgaaaaacagcttggtcaagtgatgttgttgattctttgtgtgactcaagttttaatgatgcgtacaacatgggcactttgtgaagccctaacacttgcaaccgggccaattagcacactatgggaaggcaatccgggtcgattttggaacactacaatagctgtatcaatggctaatatttttaggggttcctatcttgctggggcaggactattattttcgattatgaagaatacaacaaatacaagaaggggtactggaaatataggggaaacactcggcgaaaagtggaagtcacgactaaatgctctagggaaaagcgaatttcagatatacaagaagtctggtatacaagaggtagatcgaacattagcgaaggaaggaattaaaagaggagaaactgatcaccacgcggtatcgaggggaagcgctaaactccgttggtttgtagaacgaaatatggtaacaccggagggtaaagtggtagatctaggctgtggtaggggaggttggtcatattactgcggtgggttaaaagatgttagggaagtaaagggacttacaaaaggaggtccgggacatgaagaacccattccgatgagcacatacggatggaatctcgttcgtttacaatcgggtgttgacgtattctttaccccgcctgaaaaatgcgatactctgttgtgtgacatcggagaatcgtctccaaatcctactattgaagcgggaagaacattaagagtattaagtctagtagaaaactggctgaataatgacacgcaattttgcattaaggttttaaatccatatatgccaagcgtaattgagaaaatggagacactacaacgcaagtacggtggcgcattggtaaggaacccactatcacggaactcgacccacgagatgtactgggtaagcaacgcaacaggtaatatagttagtagcgtcaacatgatttcacggatgttaataaaccggttcaccatgaaacataaaaaggccacatacgagcctgacgtagatctgggatcgggaacaaggaacataggaatagaatctgaaattccaaaccttgatattatcggcaaacgtatagagaagattaaacaggaacacgagacatcctggcattacgatcaggaccacccttacaagacttgggcatatcatggttcgtacgaaactaaacaaacaggaagtgcatctagcatggtcaacggagttgtccggttactaaccaaaccatgggatgtagttccgatggtaacccaaatggcaatgacagacacgacaccctttggccaacaacgggtattcaaggaaaaggttgatactaggacacaggaaccaaaagagggtaccaagaaacttatgaagattacggctgaatggctctggaaagaattagggaagaagaaaactcctagaatatgcacaagagaagagttcactcgaaaagtacgtagtaatgccgcattgggagcgatattcaccgatgaaaataaatggaaatctgcgagagaggctgtggaagattcacgattttgggagttagtcgataaagaaagaaatttacacttggaaggtaaatgcgagacttgcgtgtacaatatgatgggaaaaagagagaagaaactaggagagttcggtaaagcaaaaggaagccgagcaatatggtacatgtggctaggtgcaagattcttagagttcgaagcactcggatttttgaatgaagatcactggttctcccgcgaaaactctctttcaggggtggaaggggaaggactgcataaattaggatacatattaagggacgtctcaaagaaaggtggaggcgcaatgtatgcggacgatacagcggggtgggatacgaggattacactagaggatctaaagaatgaagaaatggtgactaatcatatggaaggcgaacacaagaaattagcagaagctatattcaaattaacctatcagaacaaagtagtacgggtccagcgaccgactcctagaggaacggtcatggacataatttcaagacgtgatcagagaggttccggtcaagttggcacatatggactaaacacattcaccaacatggaggcgcaacttatacgacagatggaaggcgagggagtttttaaaagcatccaacgtttaacagttactgaagagatcgcggtgcaaaattggttggcaagggtaggtagggaaaggctatccaggatggccatcagtggtgacgactgcgtcgtaaaaccattagatgacagatttgccagcgctttgaccgctcttaatgatatgggaaaagtccgaaaagatatacaacagtgggaaccatctcgaggctggaatgactggacacaggtaccattttgtagtcaccattttcacgaacttataatgaaagatggacgagtcctggttgttccgtgtagaaaccaggacgagttaattggtcgtgcaagaatctcccagggcgcaggatggagcttaaaagaaaccgcctgtctcggaaaaagttacgctcaaatgtggagtcttatgtactttcaccgccgagatctgagactggcagcaaatgctatatgctctgcggtcccatcacattgggtgccaacaagccgaaccacatggagtatacacgcaaaacatgagtggatgacaactgaagacatgctaaccgtgtggaaccgcgtatggattcaagaaaatccatggatggaagataaaacccccgttgaatcgtgggaagaagttccatatttgggaaaacgagaagatcaatggtgtgggtcgctcataggtctaacatcaagagcaacatgggcgaaaaacatacaaaccgccatcaatcaagtacggagtctaattggaaacgaagaatatactgattacatgccgagcatgaaacgctttcgaagagaagaggaggaggctggagtcctttggtga

SEQ ID NO: 22840 - RNA, 9876 nt, synthetic construct
  misc_feature 1..9876: note = derived and/or modified CDS sequence (opt6) from DENV-2__KC762665__SS-prME
  source 1..9876: mol_type = other RNA
acggccggaattattataatgatgattccaaccgttatggcattccacctgactactagaaatggtgaaccgcatatgatagtttcaagacaggaaaaaggaaaaagtctcctatttaaaacggaaaatggggtcaatatgtgcacgttaatggctatggacttgggagaactatgtgaagatactatcacttataattgtcccctactaaggcaaaatgaaccagaagacatagactgctggtgcaacagcacaagcacttgggttacatatggcacgtgcactgcaactggagaacacagaagggagaaaagaagcgtcgcacttgtccctcacgttggaatgggactagaaacgaggaccgaaacatggatgtcgagtgaaggagcgtggaaacatgcacaaagaatcgaaacttgggttcttcgtcatccaggatttactataatggctgcaattttagcatacacaataggaacaacatatttccaaagggtcctcatatttattctattgacagcagtcacacccagcatgaccatgagatgtattgggatcagtaaccgagatttcgtcgaaggagtatcaggaggcagttgggttgatatagtgttggaacacggatcgtgtgtaacaacaatggcgaaaaataaaccgaccttagattttgaacttataaaaacggaagcaaaacatccagctacccttcggaaatattgcatagaagcgaaattgactaacactacaacagcttctagatgtcccactcaaggagaaccatccctgaatgaagaacaagataaacgatttgtatgcaaacactcaatggttgacagaggatggggaaatggttgtggtttatttggaaaaggaggtattgtcacatgcgcgatgtttacatgtaagaaaaatatggaaggtaaaatagtacagcccgaaaatttagaatacacaatagtaataacaccacactctggagaagaaaatgcagtaggaaatgacacagggaaacatggcaaagaaataaaagtgacccctcaaagttccataactgaagcagaactcacggggtatggcacagtgacaatggaatgttcgcctagaacaggtttagactttaatgaaatggtactactacagatggagaacaaagcatggctcgtgcatagacaatggtttcttgacttgccactaccttggctacccggagcagacactcaaggcagtaattggatccaaaaagagacattggtaacgttcaaaaacccacacgcaaagaaacaagatgtagtagttctgggcagccaggaaggagccatgcataccgcgctcacaggagctacagagatacaaatgagttccggtaacctcctgtttacaggtcatttaaaatgtagactacgaatggataaactacaactcaaagggatgtcgtattcaatgtgcactgggaaattcaaagtggtgaaagaaattgcagaaacccaacacggtacaatcgtgataagagttcagtacgagggtgacggttcaccttgcaaaatcccctttgaaattatggatcttgaaaaacgacatgtcttagggcgtcttattaccgttaaccctatagtaacggaaaaagacagtccagtaaatatcgaagcagaaccgccatttggcgattcctacattataataggcgtagaaccaggtcagttaaaactatcatggttcaagaaaggttccagcataggtcaaatgtttgagaccactatgcggggcgccaaaagaatggcgatcttaggagataccgcatgggatttcggaagtctaggaggcgttttcacatctatcggaaaagcattgcaccaagtttttggtgctatttatggagcagcattctcgggagtgtcttggactatgaaaattctaataggagtagtcattacgtggataggaatgaactcacgttctacatcgctatcggtttcacttgtcttagtgggggtggtaacactatatttaggcgttatggtccaagcagatagtgggtgcgttgtatcatggaagaacaaagaactaaaatgcggaagcggcatctttatcacggacaacgtccatacctggacagaacagtacaaattccaaccagaaagcccaagtaaattggcttccgcaatccaaaaggctcatgaagagggtatctgtggaatccgaagcgtcacaaggttagaaaatttgatgtggaaacaaatcacacctgaactgaaccatattctatcggagaacgaagtgaaactaacaataatgaccggagatataaagggtatcatgcaagctgggaaacgttctcttcgcccacaaccaactgaattaaaatactcttggaaaacatggggaaaagccaaaatgttatcgacagaattacacaatcatacgttcttgatagacggccctgaaaccgcagaatgtccaaatgcaaatagggcatggaatagcttagaagtagaagattatgggtttggagtttttacaacaaacatatggttaaagttaaaagaacgccaagatgcattctgcgatagtaagctaatgtcagcggccataaaagacaatcgagcagtccatgcggatatggggtactggatagaaagcgctctaaacgatacatggaaaattgagaaagcatcatttattgaggtaaaaagctgccattggcctaaatcccatacactctggtccaacggggtcctcgaaagcgagatgatcatacccaaaaactttgccggtccggtgagtcaacataattaccgacctggatatcatacacaaacagcaggtccgtggcacctgggaagattagaaatggactttgacttctgcgagggaacaacagtggtcgtgacggaggactgtggcaatagaggcccatctttaagaacaacaacggcctcaggtaaattaataaccgaatggtgttgcagatcatgcacactaccgccactgcggtaccgaggagaggatgggtgctggtacggaatggaaatacgaccactaaaggaaaaagaggaaaatctcgttaatagcctcgttacggctggccacggacaaatagacaatttctcgttaggtgttttgggtatggctttgtttctagaggaaatgttaaggacgagggttggcacgaaacacgctatattacttgttgccgtaagttttgtgacacttataactggtaacatgagtttcagagatttgggtagagtgatggtaatggtaggcgctacaatgacagatgacatagggatgggagtaacctatttagcgttattggcagcttttaaggttagaccgacgtttgcagctggactcttattaaggaagctaacgtctaaagaactcatgatgaccactattggcataacattactttcacaatcaaccataccggaaactatactagaactcacagatgctctggcactagggatgatggttcttaaaatagttagaaacatggaaaaataccaattagcagtaacgataatggcgatattatgcgttccgaacgctgttattctacaaaatgcgtggaaggtatcttgtacaacactagcagtcgtatcagtatcgcctctattattgacctcaagccaacaaaaagcagactggattcctctggccttaaccataaaaggattaaatcccactgctattttcttgacaacattaagtcgaactagcaagaaaagatcatggccacttaatgaagcaatcatggcagtcggtatggtgtccatattagcatcatcattattgaagaacgatataccgatgacaggcccacttgtggcaggcggattattaacggtctgctatgtacttacagggcgcagcgccgacctcgaattagaaagggcagcagatgttcgctgggaagaacaagcagaaatatccggttctagccctatattaagtataaccattagtgaagacggtagcatgtcaattaaaaacgaagaagaggaacaaaccctaactatactcataaggacagggctattggtgatttcaggcctattccctgtcagtattccaataaccgccgcagcatggtacctttgggaagtcaagaaacaacgcgcaggagtgctgtgggacgttcctagtccaccccctgtcggcaaagcagaactagaagacggcgcatatagaattaaacagaaaggaattttaggttattcacaaataggggcaggggtatataaagaaggtacgttccacacaatgtggcatgtcactcgcggcgctgtattgatgcataaagggaaaagaattgaaccaagctgggcagacgtcaagaaggatctcatatcatacggaggtggttggaagctcgaaggtgagtggaaggagggagaagaagtacaagtgctagccttagaaccagggaaaaatccaagggcagttcaaactaaaccggggctgtttaaaacaagtacaggaacaattggagctgtttcactggacttcagcccgggaaccagtggttctccaatagtagataaaaagggcaaggtggtaggactttacggtaatggcgttgttaccagaagcgggacgtacgtaagcgcaatcgcgcagactgagaaaagcattgaagataacccagaaatagaggatgacattttcagaaagaaacgacttactattatggatttacatccaggagctggaaaaacaaaaaggtatttgcccgcgatagtaagagaagcaattaaacggggtttaagaaccttaattttggcacctacacgagttgtcgctgcagagatggaggaggcactgcgtggactacctataagatatcaaacaccagctataagggccgaacacacggggagagagatagtggaccttatgtgtcatgcaacgtttactatgaggttgttatccccaatacgagtacccaactataacttaattatcatggacgaggcacactttacagaccctgcttctatagcagcaagaggttatatttctacgcgagtagagatgggtgaagcagcggggatattcatgacagcgacaccacccggatctagagatccgttcccccagtcaaatgctcctataatggacgaagagagggaaatccctgagaggtcatggaactcaggacacgaatgggtgacagacttcaagggaaagacagtttggtttgttccatcgataaaggcagggaatgacatcgcggcctgcttaaggaagaacggcaagaaagtaattcagctatctaggaagacttttgactttgaatacataaaaacaagaacaaacgattgggatttcgtggtaaccaccgatatttccgaaatgggcgcaaattttaaggcagaaagagtaatagatcccagacgatgtatgaaaccagtaattctcacagacggcgaagaaagagtcatactagctggacccatgcccgtcacacattcatcagccgcgcaaagaaggggaagagttggccgcaatcctaaaaacgaaaacgaccagtatatatatatgggtgaacccctagaaaatgatgaagattgcgcacactggaaagaagctaaaatgctattagataatataaatacaccagaagggataataccatcaatgttcgagccagagcgcgaaaaggttgacgctatcgacggagaatacagattgcgcggagaagccagaaaaacatttgtggacctaatgagacgtggtgaccttccggtatggctagcctatcgagtagctgctgaagggatcaattatgccgacaggcgatggtgtttcgatggtgttaagaacaatcaaatattggaagaaaatgttgaagttgaaatatggacaaaagaaggtgaacgaaagaagctcaaacctaggtggttggatgcgagaatttattcagatcctttagcccttaaagagttcaaagaatttgcagcggggaggaaatccctgacattaaacttgattacggaaatgggtcgactacctacattcatgacacagaaagctagaaacgctctagacaatttagcagtattacacacagcagaagcaggcggaagggcatataatcatgccctttctgaattgcctgaaaccttagaaacattactcttgctgactctactggcaacggtaaccggtgggatatttcttttcctaatgtcaggcaaaggtataggcaaaatgacattaggaatgtgttgcataataactgcaagcatcctcttgtggtatgctcaaattcaacctcattggatagcggcatcaatcatactcgaatttttcctaatcgttctactcataccagaaccggaaaaacagcggacaccacaggacaatcagttgacttacgtcgtcatagctattctaacagtagtagcagcaaccatggcgaacgaaatgggatttttagagaaaaccaaaaaggactttggattaggctcaatcacaacgcaacaaccggaatcgaatatattggatattgatctgcgtccggcctcggcatggacgttgtatgcagttgctacgacctttataacccccatgttaagacactccatagaaaatagctcagtaaacgtctctttaacggctatcgccaaccaagcaaccgttctaatgggtcttggaaaaggctggccactgtctaaaatggatataggtgttccattattagcgattggctgctatagtcaagtaaatcctataacgttgactgctgctctactattgctggttgcccattatgcaattattggaccgggcttgcaagcaaaggcaacgcgtgaagcacagaaaagggcagctgcaggaattatgaaaaatcccacagttgacggaatcacggtaatagatttagatcccataccgtatgacccaaaattcgagaaacaactgggacaggtaatgttacttgtcctgtgtgtaacacaagtactaatgatgcgcactacatgggcgctctgcgaggctttgacactagcaacgggaccgatctcaacgctatgggagggaaacccaggccgtttttggaacacgacaatagcagtttcgatggcgaacatattcagaggtagttacctagcaggagcaggtctcctattttctattatgaaaaatacagctaacacacgacgtgggacgggtaatacaggagaaactttaggtgaaaaatggaaaaatcgtctaaatgcactaggaaaaagtgagttccagatttataagaaatctggaatacaagaagtagacaggacactggctaaagagggtattaaacgtggggagaccgatcatcacgccgtatctcgaggttcagcgaaattaagatggtttgttgagcgaaatttagttgccccagagggcaaggttgtagatctgggatgcggtagaggtgggtggagctattattgtggaggattgaaaaatgtaaaagaagttaagggtctaacaaaagggggacccggtcatgaagaaccaatcccgatgtcaacctatggttggaatttggtacggttgcaatcaggggtggatgtattctttactccgccggagaaatgtgatacattactttgtgatattggtgaatcatcacctaacccaaccgttgaggccggtagaactttacgagtactcaatctagtggagaactggcttaataataatacgcagttctgcataaaagttttaaatccctacatgccatctgtgatagagaaaatggaggctttacagcgcaagtatggtggtgctctggtcaggaatccgctaagtcggaatagtactcacgaaatgtactgggtaagcaacgcttcaggtaatatcgtaagttccgttaacatgatatcaagaatgctgataaatagattcactatgcgacacaagaaggcgacatatgaacctgacgtagacttaggttccggtacgaggaatatagggatagaatcagaaacaccgaacttagatataatcggaaaaaggatcgagaaaataaaacaagaacacgaaacctcgtggcactatgaccaagatcacccatataaaacctgggcctatcatggaagctacgagacgaaacaaaccggaagtgcttcgagtatggtaaacggagttgtaaggttactaacgaagccctgggacgtcattccaatggttacacaaatggcgatgacagacactacccccttcggacaacaacgagtattcaaagagaaggttgataccaggacacaagaaccaaaagagggaacaaagaaattaatgaaaattacggcagagtggttatggaaagaattgggcaagaagaaaactccaagaatgtgtacgagggaagagttcacaagaaaagtaaggagtaacgctgcactaggcgcaatattcactgatgaaaataaatggaagagtgcacgagaggcggttgaagacagtggtttttgggagctagtagataaggagcggaaccttcacctggaggggaagtgtgagacctgtgtatataacatgatgggaaaaagagagaagaaactgggcgaatttggtaaagcgaaaggaagcagagctatatggtacatgtggttaggtgcgcgattcctcgagttcgaagcactaggattcttgaacgaggaccattggttcagtagagaaaactcgcttagtggagtagagggcgaaggcctccacaaattaggatatatactgcgagacgttagcaagaaagagggaggggccatgtatgcagatgacacagcaggttgggacacacgtataacgttagaagatcttaaaaacgaagaaatggtaacaaatcatatggagggcgaacataagaaattagccgaagcgatattcaaactcacctatcaaaataaagttgtcagggtacaacgacctactccgcgaggaacagttatggatattatttctcgcagagatcaaagagggtcgggccaagtagtaacatatggcctaaacacattcaccaacatggaagcacaattaattcgacagatggaaggagaaggtgtctttaagagtatccaacagttaacggtaacggaagaaatagcagtcaagaattggctagttagagtaggacgagaaagattatcaaggatggctataagcggcgatgactgtgtcgtaaagccattggacgatcgtttcgcaagtgctttaacagcattaaatgatatggggaaggtaagaaaagacatccaacagtgggaaccgagtaggggatggaatgactggacacaggtacctttctgcagtcatcattttcatgaacttattatgaaagatggcagggtcttagtcgttccatgccgcaaccaagatgaactaatcggtagagcacgtatctctcaaggcgcggggtggtcactgagggagacggcctgtttaggtaaatcttacgcgcagatgtggtcactcatgtactttcacaggcgcgacctaagactagccgcaaatgctatatgctcggcggttccatcgcactgggtgccaacttcccgaactacatggtcaatacatgcaactcacgaatggatgaccacagaagacatgctaaccgtatggaacagagtatggatccaagagaacccttggatggaagataaaacgcccgttgaaagttgggaggaaattccatatctaggtaaaagggaagatcaatggtgtggatctctaattgggttaacaagtagagcaacctgggctaagaatatacaaacagcgataaatcaagtcaggtcactcattggtaacgaagaatatacagactacatgcctagtatgaagcgattcaggagagaagaggaagaagctggagtattatggtaa

SEQ ID NO: 22841 - RNA, 9876 nt, synthetic construct
  misc_feature 1..9876: note = derived and/or modified CDS sequence (opt6) from DENV-2__KC762669__SS-prME
  source 1..9876: mol_type = other RNA
actgctggaattataatcatggtaatccccactgtaatggcatttcatcttaccactagaaacggagaacctcacatgattgtgagtcggcaagaaaaaggcaaatctttattatttaaaacggaaaatggagtaaatatgtgtacattaatggcgatggacctaggagaattatgtgaagatacaattacatacaattgcccgttattgaggcaaaatgaacccgaagatattgactgttggtgtaatagtacaagtacgtgggtaacgtacggaacatgtaccgcaacaggggaacataggagggagaaaagaagtgtagctctggtaccccatgttggaatgggactcgaaacaagaaccgaaacttggatgtcatcagaaggcgcatggaaacacgcacaacgaatagaaacttgggtattaagacatccaggtttcaccataatggcagcaatactagcatatacaataggtacaacatacttccaaagagtactaatcttcatattattgacagcggtggccccctcgatgacaatgcgatgcataggcataagcaacagggatttcgtggaaggagtcagtggaggctcttgggtggatattgtattagaacatggctcgtgtgtaacaacaatggccaaaaataaaccaaccttggactttgaactgataaaaacagaagcgaaacaccctgcaaccctgcgaaaatattgtattgaagctaaattaacaaataccactacagcaagtcgatgtcctacacaaggagaaccttcattaaacgaagaacaagataaaagatttgtgtgtaaacactccatggttgacagggggtggggtaatggctgtggcctgttcggtaaaggcggaatcgttacttgtgctatgtttacttgtaagaaaaatatggaaggtaaaattgttcaaccagaaaacctggaatacacgatagtgataactcctcattctggcgaggaaaatgcagtcggcaatgacacaggtaaacacggaaaagaaataaaagtaacaccacaaagttcgatcacagaggcagaactcacaggctatggaacggttaccatggagtgctctccaaggacaggattagattttaacgaaatggtcctgctacaaatggaaaataaagcatggttagttcatcgccaatggtttcttgatttacccctaccctggctaccaggagcagatacacagggtagcaattggatacaaaaagagacattagtcaccttcaaaaatcctcacgctaagaaacaagatgtcgtagtcttagggtcccaggaaggggcaatgcatacagcactgacgggtgcaactgaaattcaaatgtccagtggaaacctactgttcacgggacaccttaaatgcaggctcagaatggataaactacagctcaaggggatgtcctactctatgtgtacaggtaaatttaaagtggtgaaggaaattgcagagacacaacacgggacaatagtgatcagagtacagtacgaaggcgatggatcaccctgtaaaattcctttcgaaattatggatttggagaaaagacatgtcctagggagacttatcacagttaacccgatagtgactgagaaagattcacccgtaaatattgaagcagaaccaccgtttggtgatagttacataataataggagttgaaccaggccaattaaaactaagctggtttaagaaagggtcgtcaattggtcaaatgtttgaaacaacaatgcgcggcgcgaaaaggatggctatattgggagatacagcatgggattttgggagtctgggtggtgtgttcacatccatcggcaaggcacttcaccaggtatttggtgcaatttacggcgcagccttctcaggagttagctggactatgaagatattaatcggagtggtaataacatggattggcatgaatagcagatcaacaagtttatccgtatctctagtcttagtgggagtagtaacattatacttaggcgtaatggttcaggcagattcgggctgtgtcgtttcgtggaaaaataaggaactaaaatgcggaagtgggatctttattaccgataacgtacatacttggacggaacagtacaaatttcagcctgaaagtccaagtaaactcgccagtgctatacaaaaggcccatgaggagggaatctgtggtatacgttccgtaaccaggctggaaaatctaatgtggaaacaaattacacccgaattaaatcatattctcagtgaaaatgaagtaaaattaacaataatgactggcgacataaagggcataatgcaagctggaaaaagatcacttagaccacaacctactgaactaaaatactcttggaaagcatggggtaaagcaaaaatgttgtccactgaattgcataatcacacatttttaatcgatggtccagaaacagctgaatgtcctaacaccaatcgagcttggaactccctggaagttgaggattatggatttggggtctttactacgaacatctggcttaagctgaaagaacgacaagatgtattttgtgattccaagctcatgagtgcggcaataaaagataaccgagctgtgcatgcagatatggggtactggattgagtctgcgcttaacgacacctggaagatagaaaaggccagttttattgaagtcaaatcatgtcattggcctaaaagtcatactttgtggagtaatggagttcttgaatccgagatgatcatcccaaagaattttgctggaccggtgagccagcacaattatcggcccggctatcatacccaaacagcaggcccctggcatctcgggaggttagagatggatttcgacttctgtgaaggaaccactgtcgtagttacggaagactgcggaaatagaggtcctagcctaagaacgaccacagcgtctgggaaattaataacagaatggtgttgtagatcatgtacactaccacccttacgttatagaggcgaggatggttgctggtatggtatggagattagaccactaaaagaaaaggaagagaatctagtaaattctctcgtaaccgctgggcatggtcaaatcgacaacttctctttaggtgttttaggaatggcgttattccttgaggaaatgttgaggacacgggtgggaacaaaacacgcaatattactggtagctgtaagttttgtaactctcataactggtaatatgtcttttcgcgatttaggacgggttatggtcatggttggagccacaatgactgatgatataggaatgggagtgacctatttggctctgcttgccgcatttaaagtaagaccaacatttgccgcaggcctgctgctacgcaagttgacatccaaagaattaatgatgacaacaattggtattgtgcttttatcgcaaagcactattcccgagacaatactcgaattaaccgacgctttagctttgggcatgatggtactaaaaatcgtaagaaacatggaaaagtaccagttagctgtaacaataatggcaatcctatgcgtacctaatgctgtaattttacaaaacgcatggaaagtttcctgtacaactcttgctgtagtgtctgtatcccctctgttattaacgtcttcacagcaaaaagccgattggataccactcgcactaacaatcaaaggtctaaacccaaccgcaatatttttgactaccctatccagaaccagtaagaaacgatcatggcccttgaacgaagctataatggcagtaggtatggtatcaatattagcatcaagcctgctaaagaacgatattcctatgactggaccattagttgcaggaggtcttctgacagtatgttacgttctgacaggcagatcagcggacctggagttagaaagagcagcagatgtacgatgggaagaacaagcagagatatccggaagttcacctatattatcgattactataagtgaagatgggagtatgtctattaaaaatgaagaagaagaacagacccttactattctaattcgaacaggattattggttatttctggattgtttccagtgagcattcctattacagccgcagcctggtacctctgggaagtcaagaaacagagagcgggcgtattatgggatgtgccatcacctccaccggtcggaaaagcagaactggaagacggagcatatagaataaaacaaaaaggaatattaggttactcacagataggagccggtgtttataaggaaggtacattccatactatgtggcatgtaactcgtggagccgttctaatgcacaaaggtaaaaggattgaaccatcatgggccgacgtcaagaaagatttaatatcttacggcggaggatggaaactcgagggggagtggaaagagggtgaagaggtacaagtgcttgccttagaaccaggcaaaaaccccagggctgttcaaacgaaaccaggtttattcaaaacaaataccggaataataggagcagtttctttggatttttcaccaggcacatcaggatcaccaattgttgacaagaaaggaaaggtagtaggactttatggcaatggggtcgtgacgcgaagtggaacttatgtatctgcaatagcacagacagaaaagagtatcgaggataaccccgaaatagaagacgatatcttcagaaagaagcgattaacaatcatggaccttcacccaggcgcaggaaaaacaaaaagatatttaccagcgattgttagagaagcgataaagcgtggtttacggaccctcatattagcaccaactcgagttgtggctgcagaaatggaagaagcacttcgaggattaccgatcaggtatcaaaccccagcaatacgagctgaacatactggccgggaaatcgtcgacttaatgtgccatgcaacctttacaatgagactattgtcacctataagggttcccaattataatttaataataatggacgaggcccattttactgacccagcaagtatagcagctagaggatacatttcgacaagagttgagatgggagaagcggctggtattttcatgacagcaactccaccaggcagtcgtgatccttttcctcagtcaaacgcacctatcatggatgaggaacgagaaatacctgaacgtagctggaactcgggacacgaatgggtcacagactttaaaggtaagaccgtgtggtttgtgccgtccataaaagctggtaacgacattgccgcgtgcttaaggaaaaatggtaaaaaggttatccaattaagtcggaaaacgtttgacttcgagtacatcaaaacaaggactaatgattgggattttgttgtgaccacggatatttcagagatgggggccaattttaaagcggaaagggtaatcgaccctagacgttgtatgaagccggttatactcactgatggcgaagaaagggtaatattagccggaccaatgccagttacacattcgtcggctgcacaaaggcgcggtcgagtaggaagaaaccctaaaaacgaaaatgaccaatacatatacatgggagagcccttagaaaacgatgaagactgcgctcattggaaggaagcgaaaatgctacttgacaatataaatacacccgaaggaataataccgagtatgttcgaacctgaacgagaaaaagttgacgctatagatggcgaataccgtttgcgcggtgaggctagaaaaacttttgtcgatttgatgcgacgtggggatctgccggtctggctagcttacagagttgccgccgaagggattaattacgctgatcgacgttggtgtttcgatggtgtcaagaataatcaaatcctagaagagaatgtcgaagtggaaatatggacgaaagaaggcgaaaggaagaaacttaaaccacgatggctagatgcacgaatatattcagatcctcttgcacttaaggaatttaaggaatttgctgctggaagaaagtcccttacactaaacttaatcacagaaatgggtaggctccccacctttatgactcagaaagcgagaaatgccttagataacttggctgttctgcatacagccgaagcaggaggaagggcatacaatcatgctctttcagaactgccggaaactctagaaacactgctgttgctcactcttcttgcaacagtaacaggtgggatatttctttttctaatgtctggaaaaggaataggcaaaatgaccctaggcatgtgttgtattatcaccgccagtatattattatggtatgcccaaatccaaccccattggatagcagcctcaataattctggagttctttcttatagttcttctcatccctgaaccagaaaaacaaagaacaccacaagataatcaattaacttatgtagtaatagctatactaacagttgtagccgctacaatggctaacgaaatgggatttttagaaaagaccaagaaagattttggactaggaagtatcacaacacaacaactagaaagtaatatcttagacatagacctaagaccggctagtgcctggacactttatgcggtggcaacaaccttcatcaccccaatgcttagacattcaattgaaaattccagcgtgaacgtctcgttgactgccatagcaaatcaagctactgttttgatgggacttggcaagggctggcctctctcaaaaatggacataggagtcccactactggcgataggatgctattcacaagttaatcctatcacattaaccgcagcattacttttgctcgtggcgcactatgcaataatcggacctggcctacaagcaaaggctacaagggaagcacagaaaagagccgctgcgggcatcatgaagaacccaacagtcgacggtataacggtaatcgacctagacccaattccatacgatccgaagttcgagaaacagttggggcaagttatgctgctggtgctatgtgtcacacaagttttaatgatgaggaccacatgggctttatgcgaagcattaacgctagcgaccggtccaatatccactctatgggaaggaaatcctggacggttctggaacacgacgatcgcagtaagtatggccaatatattccgaggctcgtacctggctggagcaggtttattgttttcaatcatgaagaatacagccaacacacgccgagggactggaaacacaggcgaaacactaggtgaaaagtggaaaaacagattgaacgctttaggcaagagtgagttccaaatctacaaaaagagtggcatacaagaagttgatcgcaccttagcaaaagagggaataaaaagaggtgaaacagaccaccacgctgttagtagaggctccgctaagctacgctggttcgtagaacgcaatttagtaactcccgaaggcaaagtggtcgatttaggttgtggtcgtggtggttggtcatactattgtggtgggcttaaaaatgtgaaagaagtcaaagggctaacgaaagggggcccgggtcacgaagaacccattcccatgtcaacatatggatggaacttagtaaggctacagtcaggagtagacgtattctttacccctcctgaaaaatgcgatactttattgtgtgacataggcgaatcatctccaaatcccacagtagaggctggtcgtacactgcgggtactaaatttagtagaaaactggttaaataataacacccaattttgtattaaagtcttaaatccgtacatgccttcagttatagagaaaatggaagcactgcagcggaagtacggtggagcattagtaaggaaccccttatcgcgtaattcgactcacgaaatgtattgggttagtaacgcatctggaaatatcgtatcatctgtaaacatgatatcaagaatgttaataaacaggttcactatgagacataaaaaggccacgtacgaacctgatgttgatctcggctctggtacaaggaacataggtattgaatctgaaacacccaatctagacatcataggaaaaagaattgagaaaattaaacaagaacacgaaacctcttggcattatgatcaagatcatccatacaagacatgggcatatcacggatcttacgaaacaaagcaaacagggagtgcaagttcaatggtaaacggcgtggtccgtcttttgacgaagccatgggacgtaattccaatggtaacacaaatggcaatgacagacacaactccttttggacaacaaagagtttttaaagaaaaggtggatacgaggacgcaagagccaaaagagggtactaagaagctaatgaaaattacagcagaatggctatggaaggaattaggcaagaagaaaactcccaggatgtgtacaagagaagaatttacaaggaaagtaagaagcaatgcggccttgggtgcaatattcacggatgaaaataagtggaaaagcgctcgcgaagctgtcgaagacagcggattttgggagctagttgataaggaaagaaacttacatctagagggaaaatgtgagacatgcgtttacaacatgatggggaaaagagagaagaaattgggtgagtttggcaaagctaaaggttccagagcaatttggtacatgtggctgggagccaggtttttagagttcgaggctttgggattccttaacgaagatcattggttctcccgtgaaaacagtttatcaggtgtggaaggtgaagggctccataaattgggatacattttaagagacgtgtcgaagaaagaaggtggggcgatgtacgcagacgacacagcaggctgggatacacgaattacactcgaggatctgaaaaatgaagaaatggtaacaaaccacatggagggtgagcacaaaaggctagcagaagctatcttcagattaacttatcaaaacaaagttgtgagggttcaaagacccactccgcgcggaacagtgatggacatcatatcacgacgcgatcaacgcggatcagggcaagtagttacttatggcttaaatacttttacgaacatggaagctcaactcattaggcagatggaaggtgaaggagtttttaaaagtatacaacatcttactgtcaccgaggagattgcagttaaaaattggcttgcaagagtaggtagggaaagactatctcgtatggcgatttccggagacgattgcgtagtgaagccactagatgatcgatttgcaagtgcattaacagcattaaacgatatgggaaaggtacgcaaagacatacaacagtgggaaccttcgagaggctggaatgattggacccaagtaccattctgttcgcatcatttccatgaattaattatgaaagatggacgtgtattggttgtcccatgtagaaaccaggacgaacttataggccgagcacgcataagccagggtgcagggtggtcattacgagaaacagcatgccttggaaaaagttacgcgcagatgtggagcttgatgtattttcatagaagagacttaagactagcagctaatgcaatatgcagcgctgttccgagtcattgggtaccaacttctaggacgacttggagtatccacgcaacacatgagtggatgacaacggaagacatgctcacagtctggaacagggtatggattcaagaaaacccgtggatggaagacaagacgccagttgaatcgtgggaagaaattccgtatctaggtaaaagagaagaccagtggtgtggttctcttatcggactgacaagcagagctacatgggccaaaaatatacaaaccgcgataaaccaagtaagatccttgattggcaatgaagagtatactgattatatgccatcaatgaaaagatttaggcgcgaagaagaagaggcaggagtactatggtag

SEQ ID NO: 22842 - RNA, 9876 nt, synthetic construct
  misc_feature 1..9876: note = derived and/or modified CDS sequence (opt6) from DENV-2__KC762658__SS-prME
  source 1..9876: mol_type = other RNA
acggcagggattattattatgatgattccaacagtaatggctttccatttaaccacccgtaatggcgaaccacatatgatagtcagcaggcaagaaaaaggaaaatcgttattgttcaaaaccgaaaatggagtaaacatgtgcaccctcatggctatggatttaggagaactctgtgaagacacaattacttataactgcccgttacttaggcaaaatgaacctgaagacatagattgttggtgtaattctacgagtacatgggtaacatacggtacatgtactgctcctggtgaacatagaagagagaaaaggtcagttgctttagtacctcatgtaggtatgggactagaaactagaacagagacatggatgagttcagagggggccggaaaacacgctcaacgcattgagacttgggtactccgacatccaggatttaccataatggccgccatattagcatatacaataggtaccacatatttccaacgtgtgctaatttttattcttctaactgctgtaacgccctctatgaccatgaggtgcattggaattagtaatcgggatttcgtggaaggagtctctggagggagttgggtagatattgttttagagcatggttcttgtgtcacaacgatggctaaaaataaacccaccttggattttgagctaataaaaacagaagcaaaattacccgcgacactcagaaaatattgtatagaggcaaaactaacgaacaccacaactgcttctcgatgccctacccagggcgaaccgtcattaaatgaggagcaggacaaacgatttgtctgcaaacattccatggtagacagaggctgggggaatgggtgtggactcttcggcaaaggcgggatagttacttgtgctatgtttacatgcaagaaaaacatggaaggtaaaattgttcaaccagaaaatttagaatacactattgtaatcacacctcactccggagaagaaaatgcggtaggtaacgacactggaaaacatggcaaagaaataaaagtaactccccaatcctccataactgaagcagaattaacaggatatggaactgtgaccatggaatgttcaccacgcactggcctagattttaatgagatggtcttactgcaaatggaaaacaaagcctggctagtacacaggcaatggtttctggatctacctcttccgtggctgcctggggctgacacgcaaggaagcaattggattcaaaaagagactttagtaacatttaaaaacccgcacgctaagaaacaagacgtggtggtattaggtagtcaggaaggagcaatgcacacagcgctgaccggagcaactgaaatacaaatgagctctggaaacctattatttacgggacacctaaaatgtagactgagaatggataaattacaattgaaaggtatgagttacagcatgtgcaccggaaaatttaaagtggtaaaagaaattgccgaaacccaacacggaactatcgtaatccgagttcaatacgagggagatggaagcccatgcaaaataccattcgaaataatggatcttgagaaaagacatgtacttggaaggcttataaccgttaatccgatagtcactgaaaaagattcgccggtaaacattgaagcagagcctccttttggagactcgtacataatcattggggtcgagccaggccaactaaaactatcatggtttaagaaagggagtagtatcggtcagatgttcgaaaccacaatgcgaggagcaaaacgcatggcaatactcggagacacggcatgggattttgggagcttaggaggtgtattcacatcaattggcaaagcacttcatcaagtgttcggtgcgatttatggtgccgcttttagcggggttagttggacaatgaaaatcttaattggagtagttatcacgtggataggaatgaactctcgaagcacaagtttaagcgttagcctcgtattagtaggtgtggttacactatacttgggcgtaatggtacaagcagactctggctgtgtagtaagttggaaaaataaagaattaaaatgcgggtcgggaatctttatcacggataatgtacacacgtggacagagcagtacaaattccaaccagaatcaccaagtaaactggcttctgcgatccaaaaagcacatgaagaagggatttgcggaattagatctgtgacaaggcttgagaatttaatgtggaaacagataactccagaactaaatcatattttaagtgaaaatgaagtaaaactcacaattatgactggcgacataaaaggaattatgcaggcaggcaaacgcagcttgcgtccacagcctacagagttgaaatattcctggaaaacctggggcaaagctaaaatgttatcaacggaactgcacaatcacactttcttaattgatggtccagaaactgcggagtgccctaacactaatcgggcatggaactcgttggaagtagaggactatgggttcggagtattcacaactaacatatggctaaaattgaaagagcgacaagacgtgttttgtgactcaaaacttatgagcgctgcaattaaagataatagagcggtacatgcagatatggggtactggatagaatcagccctcaatgacacatggaaaatagaaaaggcgtcgtttatagaagtgaaatcctgtcattggcctaagtcccatacgttatggtcaaatggagtcctcgaaagtgaaatgattatacccaaaaactttgcaggtcctgtatcacagcataactacagaccgggataccatactcagactgctggtccatggcacctaggacgattggaaatggatttcgatttttgtgaaggaacaacagtagtcgttaccgaagattgtggaaaccgtggtccatcgctgaggacgactaccgcaagtggtaaattaattaccgaatggtgttgtagatcctgcacattaccaccactgagatatagaggagaagacggatgctggtatggaatggaaataagacccttaaaggaaaaagaggaaaatctcgtcaacagcttagttacagctgggcatgggcaaatagacaatttctctttgggagtactaggaatggcattatttttagaagaaatgttacgtaccagagtgggtacgaaacacgctattctgctcgtcgcggtatcattcgtgacactgatcacaggtaacatgagcttcagggatttgggtagagtaatggttatggtgggtgctacaatgacggacgatataggaatgggggttacgtacctagcactactcgcagcgtttaaggtaagacccacattcgcagcgggattgctgttgagaaaattaacctcgaaagaattgatgatgacgactatcggaatcgtacttctatcacaatcgactattccggaaactattctggaattaactgacgcgcttgccctcggaatgatggtacttaaaatagtcagaaacatggaaaaataccaattagcagtaacgattatggccatattatgtgtgcccaacgcagttatcttacagaacgcctggaaagtttcttgtacaacactggcggttgtcagcgtttcgcctctattactaacctcgagccaacagaaggctgattggatacccctagcattaacgatcaaaggattaaaccctaccgccatctttctgacgacccttagcagaacctctaagaaacggtcatggccgcttaacgaagctatcatggcggtgggtatggtttctatactagcttcttcacttcttaagaatgatattccaatgacaggtccgctcgttgctgggggattattaacagtatgttacgttcttacgggacgcagtgctgacctggagctcgaaagagcagcagacgtgcgatgggaagaacaagcggagattagtggtagttcaccaattctttcaataacaataagtgaagatggtagtatgagcatcaaaaatgaggaggaggaacaaaccttaacaatactgattcgaactggactcctagtaattagtggattatttccagtttcgattccaataactgcagccgcctggtatttgtgggaggttaagaaacaaagggccggagtactatgggacgtacctagtccgcctccagtcggaaaagcagaactagaagacggagcatataggataaaacaaaaaggtatattaggttactcacaaataggtgcaggcgtctataaagaaggaacctttcataccatgtggcatgtcacgcgaggggcagtacttatgcacaagggaaagcgcatagaacctagctgggcagacgttaagaaagatttgataagctatggaggaggttggaaactagagggagaatggaaagaaggggaggaagtgcaagttttagcattggaaccaggcaaaaacccaagagctgttcaaacaaaaccgggcttatttaaaactaacaccggcacaatcggagctgttagcttagatttttcaccaggcacgagtggctctccaattgtagacaagaaaggcaaggtagtaggtctatatgggaatggcgtagttacgcgatcaggaacttatgtaagcgcaatagcacaaacagagaaaagcattgaagataatccagaaattgaggatgacatattcaggaagaaaagactaacaataatggacttacaccccggggctggaaaaaccaaacgctacctacccgctattgtacgagaggcaataaaacgaggactgagaacacttattctcgcgcctacgagagtggtggccgctgaaatggaagaagcactaagaggtctgccgattagatatcaaaccccagctatccgtgcggaacatacaggcagagaaatagttgacttaatgtgtcacgccactttcacgatgcgattactatcccccattagggtacctaattataacctcattataatggatgaagcccactttacggaccccgcgagtatagcggccagaggatacatcagcactcgcgttgaaatgggggaagcggccggaattttcatgacagctacacccccaggatcccgagatcctttcccacaatccaacgcaccaataatggacgaagaaagggagatacctgagcgctcttggaacagcgggcacgaatgggtaacagactttaaaggaaaaacggtgtggttcgtgccgtcaatcaaagctgggaacgatatagcagcgtgtctgagaaagaacggcaagaaagtaatacagttatctcgtaagacatttgactttgaatatataaaaacaaggacgaatgactgggatttcgtagttactacagatataagtgaaatgggagcaaactttaaggctgagagagtaatcgacccgagacgatgcatgaagccagtaatattaacagatggagaagaacgagttatacttgcaggccctatgccggttacccactcaagcgccgcgcaaagaagaggacgggtaggtcgcaaccctaaaaacgaaaacgaccaatatatttacatgggagaacctttagagaacgacgaggattgcgctcattggaaggaggctaaaatgttactggataacatcaataccccagaaggtatcataccttccatgtttgaaccagaacgagaaaaagtagatgcgatcgacggagaatatcgattgagaggcgaggcgagaaaaacattcgtagaattaatgaggcgtggagacctaccggtgtggttggcgtatagagttgcagctgaagggattaactatgctgatagaagatggtgttttgatggcgtgaagaataatcaaatcttagaagaaaacgtagaagtagaaatttggacaaaggagggcgaaagaaagaaactaaaaccaaggtggcttgacgcgagaatttattcggaccctttggcgctgaaagagttcaaggaatttgctgccggtcgaaaatcattaacattgaatttaataactgagatgggacgactgccaacattcatgacccaaaaagcaagaaacgctctagataacctcgcagtactacacaccgctgaagctggaggtagggcatataatcacgccttatcagagcttcctgaaactttagaaacgctacttttattaactcttctcgctacagtcacaggtggtatatttttgttcctaatgtctggcaaaggaataggtaaaatgacactagggatgtgttgcataattacagcaagcattctactatggtatgcccaaattcagccacattggatcgcagcatccataatattggagttctttctcatagttcttttaataccagagccagaaaaacaaagaacaccgcaagacaaccaactgacatacgttgtaattgcaatattaacagttgtagccgcgactatggccaacgaaatgggattcttagaaaagacgaagaaagactttggactcggctcgattacaacccaacaaccagaatcaaatatattagacattgatttacgaccagccagtgcgtggacgctttatgctgttgcaactacttttataacacctatgttacgacactcaattgaaaattcatctgtaaacgttagtttaaccgcaatcgcaaatcaagcgaccgttcttatgggtctagggaagggttggccattaagcaaaatggatatcggcgtaccgctcttagctataggatgttattcgcaggttaatcctataactcttacagcagcattgttattgttagtagcccattatgcaattataggaccaggactgcaagcgaaggctacgagagaagctcagaaaagggccgctgccggaatcatgaagaaccctacagtagacggaattacggtgatagatctagaccctattccatacgacccaaaatttgagaaacagcttggacaagtcatgctcctagtattatgtgttactcaagtcttgatgatgcgtacaacttgggcactttgcgaggccttgacgcttgcaactggtccaatttcgacattgtgggaaggcaatccaggaagattctggaatacaaccatcgctgtcagcatggcaaatatattcagaggaagctaccttgcaggcgcaggccttttatttagtataatgaagaataccgccaatacaaggagaggcactggaaacacaggggaaactctcggcgagaaatggaaaaatcgcttgaatgcactaggaaaatctgaatttcaaatatacaagaaaagtgggatacaagaagttgatcgaactttagccaaagaaggtatcaagagaggggaaacagatcaccacgcggttagccgagggtcggcaaaactacgttggtttgtcgaaagaaacctggtaacaccagaaggcaaagtcgtagatctaggatgcggtagaggagggtggtcatactactgcggagggttgaaaaatgttaaagaagtaaaggggctaacgaaaggaggaccaggtcatgaagaaccgatacccatgagtacgtacggatggaatttagttcgattacagtcaggtgtagacgtgtttttcacaccaccggaaaaatgtgacacacttctatgtgatataggagaatcgtcgcctaatcctacggtggaagctggcaggacgctccgcgtcctgaacctagtggaaaactggctaaacaataacactcaattttgcataaaagtattaaacccatatatgccatcagtaattgagaaaatggaagcacttcaacgaaaatacggtggggcgttagtgcgtaaccctcttagccgtaacagtacacacgagatgtattgggtaagtaacgcctctggaaacatagtgagcagtgtcaatatgattagtagaatgctaataaatcgttttactatgcgtcacaagaaagcgacttatgagcctgatgttgatctaggatcaggaacaagaaacatagggatagaatccgaaactcctaacttggatatcataggtaaacgcatcgagaaaataaaacaagaacatgaaacatcctggcactatgaccaagatcatccctataaaacatgggcatatcacggcagttacgaaacaaaacaaacgggatcagcgtcgagtatggtaaacggagttgtacgtttattaaccaaaccttgggatgtaataccgatggtgacgcaaatggcaatgacagatacaaccccctttggacaacaacgcgtgttcaaagaaaaagtagacacccgtacgcaagagccaaaagaaggcactaagaaactcatgaaaattacggccgaatggctttggaaagagttaggtaaaaagaaaacaccgcggatgtgtacaagggaggaatttacaagaaaggtacgttcaaatgcagctttgggagcaatatttaccgatgaaaataagtggaaaagtgcccgcgaagctgtggaagattctggcttttgggaactcgtggataaagagcgcaacctacatcttgaaggaaaatgtgaaacctgtgtgtataatatgatgggtaaaagagagaagaaattaggagaatttggaaaggcaaaaggatcaagagctatatggtacatgtggttaggagctaggttcctggaatttgaagctctaggatttcttaacgaagaccactggttttcgagagaaaacagtttatcgggagttgagggagaggggcttcataaattaggctatatactccgtgacgtaagcaagaaagagggcggcgcaatgtatgcggatgacaccgcaggctgggacactcgaatcactttagaagatttaaagaatgaagaaatggttactaatcatatggagggagaacataagaaattggcagaggctattttcaagttaacctatcaaaacaaagtggtaagggtccaaagacccacaccaagaggaaccgtcatggacatcatatcccgaagggaccaacgcggaagtggacaggttgttacgtatggtttaaacacattcacaaatatggaagcacaattaatacgccaaatggaaggagaaggtgtatttaagtccattcaacagctgacggtgacggaggaaatagcagtcaaaaattggttagttagagttggaagagaaaggttatcacgaatggcaattagtggcgacgactgtgtagtgaagcccttggacgatagatttgccagcgctttaacggctcttaatgatatgggtaaagttagaaaagacattcaacagtgggagccatcacgcggatggaatgactggactcaagttccattttgctcacatcattttcatgaactaataatgaaagatggaagggtattagttgtaccgtgcagaaaccaggacgaattgatcgggagagcgagaatatctcaaggtgcgggatggtcactacgagaaaccgcatgcctcggtaaatcctacgctcagatgtggtcactaatgtattttcacagaagagatttgaggttggcagctaatgctatttgttcggcagttccttcacattgggtaccgacatcacgtacaacatggagcatccacgcaacacatgagtggatgacaactgaggacatgttaaccgtctggaatagagtctggatacaagaaaacccttggatggaagacaaaactccggtcgaatcatgggaagagataccttaccttggaaaaagagaagatcaatggtgcggctctctcatcggacttacatctagagcaacgtgggccaaaaatatccaaacggcaataaatcaagtccgtagtctcatcggaaatgagaaatacactgactatatgcccagcatgaaacgattcagaagagaggaggaagaagcgggagttctctggtag

SEQ ID NO: 22843 - RNA, 9876 nt, synthetic construct
  misc_feature 1..9876: note = derived and/or modified CDS sequence (opt6) from DENV-2__KC762660__SS-prME
  source 1..9876: mol_type = other RNA
acagcaggaattataatcatgatgataccaacagtcatggcattccacttgacaacaaggaacggcgaaccacatatgatagtttcaagacaagaaaaaggtaaaagtctactttttaaaactgaaaatggagtcaatatgtgtactttgatggcaatggacctgggtgaattgtgcgaagatactatcacttacaattgcccactattgagacaaaatgaaccggaagatattgattgctggtgcaattcaacatcgacctgggtaacttacggaacctgcacagcaacgggtgaacatagaagagagaaaaggtcagtagctttagtccctcatgtagggatggggctagaaactcgaacggaaacatggatgagttcagaaggggcgtggaaacacgcacaacgcattgaaacatgggtcttgcgccatcctggattcacgatcatggcagcgatattagcatatacaataggcaccacctacttccaaagggtcttaattttcattttactaaccgcagtgaccccgtcaatgacaatgagatgtataggaatatcgaatcgagatttcgttgaaggggttagcgggggaagctgggttgacatagtattagaacatggttcgtgcgtaacaactatggctaaaaacaaaccgacccttgactttgaactaatcaaaactgaagcgaaacacccagcaactttaaggaaatactgcatagaagccaaactaacgaatacaactacggcgtcacggtgccccacacaaggagaaccttctctaaacgaagaacaagataaaaggttcgtctgcaagcactccatggttgacagaggttggggaaacggatgcggacttttcggaaaaggtggtatcgtcacatgtgcaatgtttacttgtaagaaaaatatggaagggaaagttgtccaaccagaaaatttggaatataccattgtaataacaccccatagcggtgaagaaaatgcggtagggaatgatacaggaaaacacggaaaagaaattaaagtaacgccgcaatcatcgattacggaagcagaactcacaggctatggtactgtaacaatggaatgctcgccaagaacgggtttagattttaatgaaatggtacttctacaaatggaaaacaaggcctggttagtccataggcaatggttcttggacttaccattaccatggctacctggggcagatactcaaggaagcaactggatacaaaaggagacgctcgttacttttaaaaacccacatgctaagaaacaagatgtggttgtgctcggatcacaagagggtgcaatgcacacggcattaaccggggcaactgagattcagatgtcctctggaaatctactatttacgggccatttaaagtgcagattaagaatggataagctacagctaaaaggtatgtcttactctatgtgtactggtaagtttaaagttgtaaaagaaatagcagaaactcaacatggcactatagttattagggtgcaatatgaaggagatggaagcccctgcaagatcccatttgaaatcatggatctagaaaagcgtcacgtgctgggaagattaattacagttaacccaatagtaacagaaaaggacagtccagtcaacatagaagctgagccaccattcggcgacagttacataataatcggtgtcgaaccagggcaacttaaattatcatggttcaagaaagggagttcaataggtcaaatgttcgaaaccacaatgcgcggagcaaaaagaatggctatattgggagatactgcatgggattttggcagcttaggtggagtattcacttctatcggaaaagctctgcatcaagtctttggcgcgatctacggcgcagcattctcaggagtctcatggactatgaagatacttatcggagtggtgattacttggataggcatgaacagtcgatctactagcctgtcggtatcactcgtactggtgggggtagtaacactatatctaggggttatggtacaagctgattccggttgtgttgtgtcatggaaaaataaagaactaaaatgcggaagtggaattttcatcacggataatgtacacacatggactgaacaatacaaatttcaaccagaaagccctagcaaactagcctcagcaatacaaaaagcacacgaagaaggtatctgcgggatacgtagtgtgacacgcttagagaaccttatgtggaaacaaataacaccggagctcaaccatatattaagtgagaatgaagttaaactcacaataatgacgggcgacataaaaggaatcatgcaggcgggaaaacggtcattgcgaccccagccgactgagttaaaatactcatggaagacatggggaaaagctaagatgctatcaacagaattacacaatcacacgtttttaatagacggaccagagactgcagaatgtcctaacaccaatagggcatggaatagcttagaagtcgaggactacggttttggcgttttcacaaccaatatatggttaaagttaaaagagcgacaagatgtattctgtgacagtaagctaatgtcagcggccatcaaggataaccgtgcagtacatgcggatatgggttattggatagaaagcgcattgaatgatacttggaaaatagagaaggcgtcatttatagaagtaaagagctgccattggccgaaatcacatacgctttggtcaaacggagtgctcgaaagtgaaatgatcatacccaaaaacttcgcaggtccagtcagccagcataattatcgacccggttatcacacccaaactgcaggaccctggcatctcggccgactggagatggactttgacttttgtgaaggaacaacagttgtggtaactgaagattgtggaaaccgtggaccatcgctacgaacaactacagctagtgggaagttgattacagaatggtgttgccgaagctgcaccttacctcctctgcgatacagaggtgaggatggatgctggtacggtatggagatacggccacttaaggaaaaagaggaaaacttagtaaatagtttggtaacagccggccacggtcagattgataatttctctttaggagtgttaggaatggcactcttcttagaagaaatgctgaggacccgagtaggcactaaacatgctatattacttgtcgccgtatcttttgtaactttaatcacaggcaatatgtctttccgagatctagggagggtcatggtaatggtaggggctacaatgacggatgatattggaatgggtgtaacatacttagctttgttagcagctttcaaagtaaggccaacttttgctgcaggtcttttacttcggaagttgacatctaaagaactaatgatgactaccataggaattgtacttctgagtcaatccactatcccagaatctatcttagaattgacggatgcactcgccctgggaatgatggttttaaagatcgtccgaaatatggagaaatatcagctagctgtaacaatcatggcaatcctttgtgtccccaacgcagtaatcttacaaaatgcatggaaggtctcatgcacgacattagccgttgtatccgtttctcctttgttattaacctccagccaacagaaagcagattggatccccttagccctaacgatcaaagggttaaatcccacagcgatcttcttgactacactctctcgaacgagtaagaaacgatcctggcccttgaatgaagccataatggcagttggcatggtaagtatccttgcttcatcattactgaagaatgatatacctatgactggcccgctagtagccgggggattattgactgtatgctatgttctcacgggaaggtctgcagacttagaactggaacgagctgcagacgtaaggtgggaagaacaagctgaaataagcggatcttcaccaatactatccattacaatttctgaagacggtagcatgtctattaagaatgaagaggaagaacaaacgctgacgatccttatcagaacagggttacttgtcataagcggactctttccagtttccataccaatcaccgccgcagcttggtacttgtgggaagttaaaaagcaacgagctggtgtcctatgggatgttccgtcaccgcccccagttggcaaagcagaactcgaggatggtgcatatcgaatcaaacaaaaaggaatactgggatatagccaaataggcgcaggggtatacaaagaaggaacatttcacactatgtggcatgtcacaagaggagcagttttaatgcataagggaaagagaatagaaccctcttgggcagatgttaaaaaggatctgatcagttacggtggaggttggaagttagaaggtgaatggaaagaaggggaagaggtacaagtgctagcactcgaaccgggcaaaaacccgagagcggtccagaccaaacctggactattcaaaacaaatacggggactattggagccgtcagcttagatttctccccgggcacaagcggaagccccatagtggataagaaaggtaaagtagttggcctctatggtaacggggtagtaactcgctccggaacatacgttagcgcaatagcccaaactgagaaaagcatagaagataacccagaaatagaggatgatatttttaggaagaagagactaaccataatggacctgcatcctggagcaggaaaaactaagagatatctacctgcaatagtcagagaagcgattaaacggggcttacgtacccttatattggcgcctactagagttgtagcagccgaaatggaagaggcacttcggggattgccaatacgatatcaaacgccggcgatacgagcagagcatacgggtagggaaatagtcgaccttatgtgtcatgcaacatttacaatgcgattactaagtccgatcagagtacccaactacaatttaataataatggatgaagcccactttattgatcctgcatccatagcagctcgcggttatatttcaacaagggtggaaatgggggaagccgctggtatctttatgaccgcaacaccaccggggagccgagatccttttccgcagtcaaatgctccgataatggacgaagaaagagaaatccctgaaagatcatggaactctggacatgagtgggtaaccgacttcaagggtaaaactgtctggttcgtgccaagtataaaagctggtaatgacatagctgcgtgtctacgaaagaatgggaagaaggtaatacaattatcacgtaagactttcgatttcgaatatattaaaaccagaacaaacgactgggatttcgttgttacgaccgatatatctgaaatgggggcaaactttaaagcagaacgagttatagatccacgaagatgtatgaagccagttatcttaacggacggagaagaacgagtcattctagcagggccgatgccggtaactcacagctcagccgctcagcggcgaggaagagtcggaagaaaccctaagaacgaaaatgatcagtatatatatatgggcgagcctttggaaaatgatgaagattgcgcgcactggaaggaagcaaaaatgttgctagataatataaacacaccagaagggataatacctagtatgtttgagcctgagcgagagaaagtcgacgctatagatggagaatacagattaagaggagaagcaagaaaaacatttgtagacctcatgagacgtggggatcttcctgtatggttagcgtatagagtagcagccgagggaattaattatgcggacagaaggtggtgttttgatggggttaaaaataaccagatccttgaagagaacgtggaagttgaaatatggaccaaggaaggagaacgtaagaaattaaaaccaagatggctagatgctcgaatatattcggacccgctcgcattaaaagaatttaaagagttcgcagcggggagaaagagtttgaccttaaacttaataacagaaatgggtagattacccacgttcatgacacagaaagccaaaaatgcgctcgataatttagctgttctacataccgctgaagcaggcgggcgggcatataaccacgcgttaagtgagctgcctgaaactcttgagacactccttttactcacgctacttgcaactgttactggaggcatattcttatttttaatgtcaggtaagggtataggtaagatgactcttggaatgtgttgtataataactgcgagtatacttctgtggtatgcacagatccagccacattggatagcggcatcaatcatattagagttctttttaatagttctattaattccagagccagagaagcaaagaacccctcaagataatcaattaacttatgtcgtaatagcaatacttaccgttgttgctgctacaatggctaatgaaatggggtttctagagaaaaccaagaaagatttcggattaggtagtattactactcaacaacctgaatcaaatattttagatatcgatctaaggcctgctagtgcctggaccttgtatgctgtagcaacaacattcataacaccaatgctgagacacagtatcgagaatagctctgtaaacgtttcactaacagcaatagcgaaccaggctaccgttcttatgggtttagggaaaggatggccactctcaaaaatggacataggcgtaccccttttggccattggatgttatagtcaagtgaatccgattacgctaacagcagctctattgctattagttgcccattatgcaataattggtcctgggctacaggccaaagcgactcgagaggctcagaaacgcgccgcagcggggataatgaaaaatccgactgtggatggcataaccgtaatagatttggacccaataccttacgatcccaaattcgaaaaacagttagggcaagtaatgctgctagttctctgtgtaactcaagtacttatgatgcggactacgtgggccctctgtgaagcgttaacattagctaccgggcctataagtaccctttgggaggggaacccagggcgattttggaacacaacaatagcagtaagtatggccaatatttttagaggttcatatttagcaggagccggactacttttctctataatgaaaaacactgcaaatacgcgaaggggaacaggaaatactggtgaaacgctaggagaaaagtggaagaatcgattaaatgccctcgggaaatctgagttccaaatatataagaagtcaggcattcaagaagtcgataggacattagctaaagaaggtatcaaacggggcgaaacagaccatcatgcagtctctcgcggtagtgctaaactacgctggtttgtggaaagaaacttagtgacgccagaaggtaaagtcgttgatcttggctgcggtagaggtggatggtcatattactgcgggggtttgaaaaatgtaaaagaagtaaaaggcctaacaaaaggcggtccaggtcatgaagaaccgatacctatgagtacgtatggatggaatttagttagactacagtctggcgtagacgtattctttacaccacctgaaaaatgtgatactttgctatgtgatatcggtgaatcgagcccaaatccaaccgtggaagccggccgaactttaagagtactgaacctggtagaaaattggttaaacaataacacacaattttgtataaaggttttgaatccgtacatgccaagcgtgatagagaaaatggaagcgctccaacgaaaatacggtggggcgctcgtccggaaccccctatcaagaaattctacacatgagatgtattgggttagcaatgcaagtggtaacatagttagtagtgtaaatatgattagcagaatgttgattaaccgatttactatgagacacaagaaagcaacctacgagccagacgtagatctaggatcaggaacaagaaatataggaatagaatccgaaactccaaaccttgatatcataggtaaacgaattgagaaaatcaaacaggagcatgaaacatcttggcattatgatcaagatcacccatataaaacatgggcatatcatggtagttatgaaactaaacaaactggatcagcaagctccatggtgaatggtgtggtcagactattaacaaaaccctgggatgtgatccctatggttacacaaatggcaatgacagatacaacacctttcggtcaacaaagagttttcaaagagaaagtcgatacgagaacgcaagaaccaaaggaaggtacgaaaaagctaatgaaaattacagctgaatggttatggaaggaattaggcaagaagaaaacaccacgtatgtgcacaagagaagaatttacaaggaaagtaagaagcaatgctgcactaggagcaatattcacagatgaaaacaaatggaaatcagctcgggaggctgtagaagatagtggattctgggagcttgtggacaaagaaagaaatctacatcttgaaggaaaatgtgaaacttgtgtctataacatgatgggaaaacgggaaaagaaattaggagagttcggcaaggcaaaaggaagccgtgccatatggtatatgtggttaggagcgagattcctggaatttgaagcgctaggatttcttaatgaggaccattggttctcaagggaaaatagtctcagtggagttgaaggcgaagggctacacaaactgggctatatcttaagagacgtaagtaaaaaggaaggaggggcaatgtacgcagatgatactgctggttgggatacgcgcatcactttagaagatctcaaaaatgaggaaatggtgacaaaccatatggaaggtgaacacaagaaacttgccgaagcaatatttaaattaacataccagaacaaggtagtacgtgtacaaagacctactcctcgaggcactgttatggatatcatctcacggagagaccaaagggggtcaggtcaggtcgtgacatacggtctaaatacgttcacaaatatggaagcccaattgattagacaaatggagggagagggagtatttaagagtatccaacagctcactgtaactgaagaaattgctgtcaaaaactggctggtgagagttggacgggaaaggctgtcaagaatggcaatctccggtgatgactgtgtcgtcaaacccttagacgatcgttttgctagtgccctaaccgcgctaaatgacatgggaaaagtaagaaaagacatacaacagtgggaaccatctagggggtggaatgattggacccaagttcctttctgttcccaccactttcatgaattaattatgaaagatggccgagtattagtagtaccttgtagaaaccaagatgaacttatcggacgtgcccggatttcacaaggggcagggtggtccttacaggaaacagcttgtttagggaaatcctatgcacaaatgtggtcgttaatgtatttccacagaagagatctaagactggcagcaaacgctatttgctctgccgtaccttcacattgggttccaaccagcagaaccacatggtcaattcacgcgactcatgaatggatgactacagaggacatgctcacagtatggaatagagtatggatacaagagaatccgtggatggaagacaaaactcctgtcgagtcgtgggaggaaatcccataccttggaaagcgtgaagatcagtggtgtggctccttgatcggtctaacgagtagagcaacctgggcgaaaaacatccaaactgccatcaatcaggtgagatctttaattggcaatgaagagtatacggattatatgccatcaatgaagcgattcaggagagaagaagaagaagccggtgtactctggtaa

SEQ ID NO: 22844 - RNA, 9876 nt, synthetic construct
  misc_feature 1..9876: note = derived and/or modified CDS sequence (opt6) from DENV-2__KC762676__SS-prME
  source 1..9876: mol_type = other RNA
actgcaggcataatcattatgatgatccctacggtaatggcttttcatttaactacgcgtaatggtgaaccgcatatgattgtatcgcgacaagaaaaaggcaaaagtttattattcaaaacagaaaatggtgttaatatgtgtaccctgatggcaatggatttaggcgagttatgcgaagatacgattacatacaattgtcctttgttgagacagaatgaaccggaagacattgattgctggtgtaattctacatcaacatgggtaacgtacggaacctgcaccgcaaccggggaacatagaagagagaaaagatcagtagccttagtaccacatgtcggtatgggactagaaacgagaacagaaacatggatgtccagcgagggagcatggaaacatgcacagcgtatcgagacatgggtactccggcacccagggtttacaataatggcagcaatactagcttatacaatagggactacacatttccagcgggtactgattttcatactcttgacagcagttgctccatctatgacgatgcgatgtatcggtatctcaaatagagattttgtagagggagtttccggaggctcatgggtagatatagtcttagaacacggttcttgcgtaacaacgatggcgaaaaataaaccgacgttggactttgagctaataaaaaccgaagcgaaacacccagccacactgagaaaatactgcatcgaagcaaaattaacaaacacgactactgcatcaagatgtcctacacaaggagagccatcattaaatgaagaacaagataaaagattcgtttgtaagcactctatggtagatcgtggatggggcaatggctgcggtttatttggcaaagggggtatcgttacatgtgcgatgtttacatgtaagaaaaacatggaaggaaaaattgtccagccagaaaatctagaatatacgatcgtaattacacctcattcaggtgaagaaaacgctgttggtaacgatacaggtaaacatggaaaagagataaaggtaaccccgcagagtagcataacagaggctgaattgacaggatacggcactgtgaccatggaatgctccccgcgaacaggactagactttaacgaaatggttctattacaaatggagaataaagcatggttagtacatagacaatggtttctcgatctaccgttaccttggcttcctggggccgacacacagggatccaactggatacaaaaagaaaccttggtgacattcaaaaatccacatgctaagaaacaggacgtggtagtacttggctcccaggaaggcgccatgcatacagcactcactggggctactgagattcaaatgtcatcagggaatcttttattcaccggccatctaaaatgccggctaagaatggacaaattacagctaaaagggatgagctattcgatgtgcaccggtaagtttaaggtagtaaaagaaatagcagaaacacagcatggtacgatcgtaatacgcgttcagtacgagggcgacggtagcccttgtaagattccatttgaaatcatggatttagaaaaacgtcatgttttaggtcgactgataacagtaaacccaatcgtcacagagaaggacagtccagtaaacatagaagccgaaccaccgttcggagactcgtatatcattattggagttgaaccagggcaactaaagttgtcttggtttaaaaaggggtcgtcgataggacaaatgtttgagacaacaatgcgaggagcgaaacgcatggctattttaggagatactgcatgggattttgggtcccttgggggagtatttacatcaatcgggaaagcgttacatcaagtattcggagcaatatacggagcagctttcagcggcgtatcgtggaccatgaaaattctcataggagtagttataacatggatcggcatgaactcaagatcaacttcactttctgtaagtctagtacttgtcggagtagtaactctttacctcggtgtcatggtacaagctgatagcggttgtgttgtgtcttggaaaaataaagaattaaaatgtggatcaggaatattcattacagataatgtacatacttggactgaacaatacaaattccaaccagagtccccttccaaattagctagtgcgattcaaaaagcccatgaggaaggcatatgcgggatccgttccgtaacccgattagagaatttgatgtggaaacaaattacccctgagctgaatcacattctaagtgagaatgaagtcaagttaacaattatgacaggagatattaaagggataatgcaggcaggaaaaagatctttaagacctcaacccactgaactaaaatactcatggaagacttggggtaaagcaaaaatgctcagcacagaactacacaaccacacatttttgatagatggccctgaaacagccgaatgtccaaatacaaaccgtgcatggaactcactagaagtagaagactatggtttcggggtttttacaacaaacatctggcttaagttaaaagaacgtcaagatgtgtattgtgactcaaaattaatgagtgcggccataaaagacaacagagctgttcacgctgatatggggtattggatcgaatcggctcttaatgacacctggaaaatagagaaggcttcatttattgaagttaagtcatgttactggcccaaatcgcatacactgtggtcaaacggagttttagaatcggaaatgatcatacccaaaaatttcgcaggtcccgtatcacaacataattatagacctggctatcacactcagaccgcaggaccctggcacctagggagattggaaatggactttgatttctgtgaaggcacaactgtagtagtcactgaagattgcggtaacaggggtccatctttaagaacgacgacagcttcaggaaaactaataacagaatggtgttgccgaagctgtactcttccaccactacgatatcgcggtgaagatggttgctggtacggaatggagattagacccttaaaagaaaaggaagaaaacctagtcaattctctagttacggccggacatggtcagattgacaatttttctttaggggtcctaggaatggcacttttcctcgaagaaatgttacgaactagagttggaacgaaacatgctattcttctagtcgctgtttcattcgttacgctaataactggtaatatgagttttcgcgatcttgggagagtgatggtaatggtaggcgcgacaatgacggacgacataggcatgggggtaacttacttagcactcctcgcagcgttcaaggttaggcccacgttcgcagcaggtttactattacgaaaattaacatcaaaagaattaatgatgaccactattggtatagtattattgtcacaatcaaccattcctgaaacaattctagaactgactgatgctttggccctaggtatgatggctcttaaaattgttaggaatatggagaaatatcagttagcagtgacaattatggcaatactttgtgtcccaaatgccgtaattctacaaaatgcttggaaggtatcatgtacaacgttagcagttgtgagcgtctcgcccttgcttttaactagctctcaacagaaggctgattggataccgttggcacttacgataaaaggtcttaatcctactgcaatattcctaacaactttatcgagaacttcaaagaagagatcttggcctttgaatgaagctatcatggcagtaggaatggtatcaatcctagctagtagtctgcttaaaaacgatataccaatgacaggaccactcgtagccgggggattactaacggtatgctacgtattaacagggagaagcgcggacttagaacttgaaagggcagctgacgttcgttgggaagaacaagcggagatcagtggatcttcaccaatattgtccataacaattagtgaggatgggtctatgagtatcaagaatgaagaggaagaacaaactttaacgatacttattcgtacaggactattggtaatttcagggctattcccagtatcaatccctataactgcagcggcatggtatctatgggaggtgaagaaacaacgagctggagtcttatgggacgttccgtcaccccctcccgtaggtaaagcagagcttgaggatggagcgtaccggataaaacaaaaaggtatcttgggctacagtcaaataggggccggcgtatataaagaaggtactttccacacaatgtggcacgtaacaaggggagccgtactaatgcataaagggaagagaatagagcctagttgggcggatgttaagaaagacctaatatcatatggaggaggttggaaactcgaaggcgaatggaaagaaggtgaggaagtgcaggtcttggccttagagccaggcaaaaatccaagagcagttcaaacaaaaccaggcttgttcaagacaaatactggcactattggagcagtatcactagatttttctccagggacttctggttcaccaatagtggataagaaaggtaaagtcgtaggtttatatggaaacggtgtagtaacacgaagcggtacatacgtttccgctatcgctcaaaccgagaaatcaattgaagacaatcccgagattgaagacgacatattccgcaaaaagaggttaaccataatggatctacaccctggcgcaggtaaaacaaaaagatacctacctgctatcgtaagggaagccattaaaagaggcttacgcacactcattcttgcacctactcgagtagtagcggcggaaatggaggaggcccttagaggcctgccaattagatatcaaactccagctatacgcgccgaacatactggaagagaaatcgtagatctcatgtgtcatgcaaccttcacaatgcgactgctgtcaccaataagagtacccaactacaatcttataatcatggacgaggcacacttcactgatcctgcatcgatagcggcacgaggttatatttcaacgagggtggagatgggagaagcggctggaatttttatgacagctaccccaccaggaagtagagatcccttccctcaatcgaacgctcccataatggatgaagaacgtgaaattcctgaaaggagctggaactctggacatgagtgggtaacagacttcaaaggaaagacagtgtggtttgttccgtcaataaaagcaggtaatgatattgcagcctgccttaggaaaaatggtaagaaagtaattcagttatcccggaaaacttttgacttcgaatacattaagactcggacaaatgattgggacttcgttgtcacgacagatatatcagagatgggagctaattttaaggcagaaagagtaattgatccaagaagatgtatgaaaccagtcatactaactgatggcgaagagagggttatactagctggaccaatgccagtgacacactcaagcgcagcacaaaggcgaggcagagttggaagaaaccccaaaaatgaaaatgaccaatatatctatatgggtgagcctttggaaaacgatgaagattgtgcacattggaaggaagctaaaatgcttttggataatataaacacacctgaaggtattattccctccatgtttgaacctgaacgggagaaagtcgatgcgatcgatggtgagtatagactacgcggtgaggcacgaaaaacgtttgttgacctaatgcgtcgtggagatctaccagtttggttagcatacagagttgctgctgaagggataaattacgcagaccgaagatggtgttttgatggtgtcaaaaacaaccaaatattggaagaaaatgtagaggtagaaatttggaccaaagaaggcgaaaggaaaaagttaaaaccccgatggttagacgcccgaatctatagtgatcctcttgcattaaaagaatttaaagaatttgcggccggtaggaaatcattaacactaaacttaataacagaaatgggaagattaccaacgtttatgacccaaaaagcacggaatgctctagataacttagctgtgcttcatacggctgaggccggtgggagagcatataatcatgcgctcagtgagttacctgaaacactcgaaactttactactcctgaccctgttagccacagtcacaggtggcatttttctctttctaatgagcgggaagggaatcggtaaaatgaccttaggaatgtgttgtatcattaccgcttccatcctattatggtacgcacagattcagcctcactggatcgctgcatcaatcatattagaatttttcctcatcgtcctcctgatacctgaacccgaaaaacaacgtaccccacaggacaatcagctgacgtacgtcgtaattgccattttaacggtggttgccgcgactatggcgaatgaaatgggatttttggagaaaacgaaaaaggactttggcttgggttcaatcactactcagcaacctgaatcgaacatcttagatatcgaccttaggccagcaagtgcatggacgttatatgcggtcgcaactacatttataacaccaatgcttagacactcaatagagaatagctctgtaaacgttagcttaacagcaatagcaaatcaagcaacggtcctgatgggacttggtaaagggtggccgttgtccaaaatggacataggagtaagtctcctggcaataggatgttacagccaggtcaacccgataacattaactgccgcacttttattattagtcgctcattatgccataataggccctggattgcaggcaaaggccacacgtgaagcgcagaaacgagcagcagctggtataatgaaaaatccgacagttgatggaataacagtcatagatttagaccctataccatatgacccaaaatttgagaaacaattagggcaagtaatgctcttagtattatgtgtaacccaagttctgatgatgagaacgacatgggctttatgtgaagcattgacactcgccactggtcctatatcaactctatgggaaggcaacccaggtagattctggaacaccacaattgctgtatctatggcaaatatattcaggggttcatatctagccggagcaggactattattttcaataatgaaaaatacagcaaacactagaagaggaaccggcaacacaggtgaaacacttggtgaaaaatggaaaaaccggctgaatgctcttggtaaaagcgagtttcaaatatacaagaagtcaggtattcaagaagtagacagaacacttgcaaaggaaggaataaagagaggtgagacagatcatcacgcggtatcgcgcgggtccgcaaaactaagatggtttgtagagcgcaatttggtaacaccagaaggcaaggtggtggatctaggttgtggtagaggaggatggtcttactactgcggcggtctaaagaatgtgaaagaagtcaaaggcttaacaaaaggtggtccaggtcacgaagaaccaataccgatgagtacatacggttggaacttagttagactacaaagtggagtggatgtattctttaccccacccgaaaaatgcgacactcttttgtgtgatataggggaatcttctccaaacccaacagttgaagctggccgcacactgagggttctgaacctggttgaaaattggttaaataataacactcaattttgtataaaagtacttaatccatatatgccatctgttattgaaaagatggaagctctacagagaaaatatgggggagcgttagtaagaaatcctttatcacgcaatagtacacatgaaatgtactgggtatctaacgcaagtggaaatatagtttcgagtgtaaatatgatatcgcgaatgctaatcaacaggtttacaatgagacacaagaaagcaacttatgaaccggacgttgatttaggatcaggaacccgaaatattggaattgaatccgaaatccctaacctcgacataataggaaaacgaattgagaaaattaaacaagagcatgaaacaagttggcactatgaccaggatcacccttatcgtacctgggcgtaccatggaagctacgagacaaagcaaactggcagtgcatcatccatggtcaatggagtcgtcaggctgctaacaaagccttgggatgtaattcccatggtaactcaaatggctatgacagatacaacaccatttggtcagcaacgagtttttaaagagaaagtagatacaagaacgcaagaaccaaaagaaggaacaaagaaattaatgaaaataactgcagaatggctctggaaagaactaggcaaaaagaaaacgcctaggatgtgtacacgagaagaatttacgagaaaagtcagaagtaacgccgcgttaggagcgatttttacagatgagaacaaatggaagtcggccagagaggcagtagaagactccggattttgggagttagtggacaaagaacgaaatcttcacctggagggtaaatgcgaaacctgtgtttacaatatgatggggaagcgtgagaagaaacttggagaatttggaaaagccaaaggaagcagagccatatggtacatgtggcttggagccagatttctggaatttgaagctcttggatttttaaatgaggatcattggttctcacgtgaaaattcgctctcaggcgtggaaggggaaggactccacaaattgggttatatactacgggacgttagcaagaaagaaggaggagctatgtatgcggatgatacagcaggttgggacacaagaatcactcttgaagacctgaaaaatgaagagatggtaactaatcacatggaaggcgaacataagaaattagcagaagctatatttaaattaacttaccaaaacaaagtcgtaagagtacagagaccgacacctcgaggaacggtgatggacatcatatctaggcgagatcaacgcggatccggacaggtagtcacttatggcttaaatacgttcacgaacatggaagcgcaactcatacggcaaatggaaggggaaggtgtttttaaatcaattcaacaactaacagttacagaggagattgccgtgaaaaactggctggtaagagtaggaagagaaagattatcgcgtatggctatctcaggagatgactgtgtagttaaacccctagacgaccgattcgcgaacgcgttgactgccctcaatgatatgggtaaggtacgaaaggatatacaacagtgggaaccgtcccgtgggtggaatgattggacacaagtccccttttgtagccatcattttcatgaattgatcatgaaggatggcagggtcctagtagtaccttgcaggaatcaggatgaactaattgggcgagccagaatatcccagggtgctggatggtcacttagggaaacagcatgtctaggtaaatcatatgcacagatgtggagcttgatgtattttcaccgcagggatctgagacttgcagctaatgccatttgcagcgctgtcccaagtcactgggtgcccacctctagaaccacctggagcatacacgcaacccatgaatggatgacaaccgaggatatgctaacagtttggaaccgtgtttggattcaagaaaatccatggatggaagataaaacacccgttgaatcttgggaagaaatcccttatctaggaaaaagggaggatcaatggtgcgggtccttaatcggattaacatcgagagctacatgggctaaaaatattcaaacggcaatcaaccaagtacgatcgttaattggaaacgaagaatatacagactatatgccaagcatgaagagattcagacgtgaagaagaggaagctggagtattgtggtaa

SEQ ID NO: 22845 - RNA, 9876 nt, synthetic construct
  misc_feature 1..9876: note = derived and/or modified CDS sequence (opt6) from DENV-2__KC762662__SS-prME
  source 1..9876: mol_type = other RNA
acagcaggtataataataatgatgataccgacagtgatggcatttcacttaactacaagaaatggggaaccacacatgatagtgagtaggcaagaaaaaggaaaatctcttttgtttaaaacagaaaatggtgtaaacatgtgtacacttatggctatggatctaggagaattatgtgaagatacaattacttacaattgtccacttcttagacagaacgaaccagaagatatagattgctggtgtaattcaacaagtacatgggttacttacggcacgtgtacagctaccggtgaacatcgtcgagaaaaacgaagtgttgcactcgttccacatgtgggaatgggtctcgaaactagaacagaaacttggatgagcagcgaaggggcatggaaacatgctcaaagaatcgaaacttgggtattgcgccatccaggctttacaataatggcagcaattcttgcttacactattggtacaacatattttcagagagtactaatcttcatcctactcacggctgtaacgccttctatgacaatgaggtgtattggaatatcaaacagggattttgtagaaggagtatctggaggtagttgggtagatatcgttttagaacatggctcgtgcgttactacaatggccaaaaataaaccaaccttggattttgaactaataaaaacagaagcaaaacacccggctacgttacgtaaatactgcattgaagcgaaactcaccaacacgacgacggcttcaagatgtcctacacaaggcgagccttctctgaacgaagaacaagataaaagattcgtatgcaaacactcaatggttgatcgaggatggggaaatggatgcggattgttcggtaagggcggaattgtaacatgtgcaatgtttacctgcaagaaaaacatggaaggtaagatcgtccagccagaaaacctagagtataccatagtaataacaccacattccggggaagaaaacgcagtcgggaacgataccggcaaacatggtaaagaaattaaggtcacgccccaatcaagcatcacagaagcagaattaaccggatatggtactgtaaccatggaatgttctccaaggactggtttagactttaatgaaatggtattgctacaaatggaaaacaaagcctggttagtacatagacaatggttcttagatttacctctgccttggttgccaggagctgacacgcaaggatccaattggatacaaaaagaaaccttagtgacatttaaaaaccctcatgctaaaaagcaagatgtagtggtgcttggaagccaagaaggtgcaatgcatactgctctaactggagcgacagaaattcagatgtccagtggaaacttactatttactggacacttaaaatgtcgcttacggatggataaacttcagcttaaaggaatgtcatactcaatgtgcaccggtaaatttaaagtggttaaagagatcgcagaaacacaacatggaacaatagttataagggtccaatacgagggggatggcagcccttgtaaaatcccgtttgaaataatggatcttgagaaaaggcacgttctaggaagacttattaccgtaaatccaatagtaactgagaaggatagtccagtgaacatcgaggcggaacccccattcggcgactcttatattataattggtgtagaacctggtcaactaaaactatcctggtttaaaaaggggtcgagcatcggccaaatgtttgagactactatgagaggtgcaaagcgaatggcaatattaggggatacagcatgggactttggttcactaggaggggtttttacaagtataggtaaagcgctccaccaagtattcggtgcaatctatggtgcagctttttctggagtgagttggacaatgaaaatattaatcggagttgtaataacctggatagggatgaactctcgatcaacgtcgttaagtgtcagtctggttctagtaggtgtcgtcacgctgtatctgggtgttatggtacaagcagactcgggatgcgtggtaagttggaagaacaaagaactaaagtgtggctcagggatttttataacagacaatgtacacacatggactgaacaatataaatttcaacctgaatctccttcaaaactagcatcggccattcagaaagctcatgaagaaggaatttgcggtataaggtccgtcacaagactcgaaaatctaatgtggaaacagatcacccctgaactgaatcatatcctaagtgagaatgaggttaaattgactattatgaccggtgatattaaaggaataatgcaagcaggtaaacgcagcttacgtccccagccaaccgaattaaaatactcatggaaaacatggggaaaggcaaaaatgttatctacagaattacataaccacacatttttaattgacgggcccgaaactgctgagtgccctaacgcaaatagagcttggaatagcctagaagtagaagattatgggtttggtgttttcacaactaacatatggttaaaactgaaagaacggcaggatgcattctgtgactccaaattaatgagcgcagcaataaaggataatcgtgcggtccacgcagatatgggttactggattgaatcggcactgaatgacacatggaaaatcgaaaaggcttcgttcatcgaagtaaaaagttgtcattggccaaaatcacatacactatggtcaaacggggttctcgaaagtgaaatgataattcccaaaaattttgccggccctgtatcccaacacaattaccgacccggttaccacacacaaacagcagggccatggcatctgggacgccttgaaatggattttgacttttgcgagggcacaacagtagtagtgacggaggattgcggaaaccggggaccttcccttagaacgacgacggcaagcgggaaattaataaccgaatggtgttgtagatcctgtactctcccaccactcagataccgaggcgaggatggctgctggtacggcatggaaatccgccctttaaaggaaaaagaagaaaacttagtgaacagcttagtaacggcaggacacggacaaatcgataatttctctttgggagtactaggaatggcactattcctagaggaaatgctgaggactagggtgggtacgaagcacgcaatacttttagtagcagtttcatttgtaacgttaataacaggaaacatgtcatttagggatcttggaagggtgatggttatggtaggcgcaacgatgacggacgatatcggtatgggtgttacttacttagccttgctcgcagcattcaaagtgcgtccgacatttgcagccggattattattacggaagttaacgtctaaagaacttatgatgacaaccatcggcataactttgctctcgcaatcgactatccccgaaacaatactcgaacttacggacgcccttgctctaggtatgatggtcttaaaaatagtaaggaatatggaaaaatatcaactagcagtaacgataatggctatattatgcgttccaaatgcagtaatactacagaacgcttggaaagtgtcttgcacaacgctcgcagtggtgtcagtatctccgttattattaaccagcagtcaacagaaagctgattggattcccctagctctgacaattaaaggtctgaaccccacagcaatattcttaacgacactctcaagaacatctaagaagagatcttggcccctaaacgaagcaatcatggctgtaggtatggtaagcattttagcgtcttccttactcaaaaatgatatcccgatgacaggtccccttgtagctggtggactattaaccgtttgttacgtattaaccggtagatcagccgatttagaattagaacgcgcggcagacgtgagatgggaagaacaagctgaaataagcggaagttcaccgatactcagtattactatatcagaggacgggtcaatgtcgataaagaatgaagaggaagaacaaacgttaactatattaattagaacgggactactcgtaatttcaggtttattccctgtttctatacctataacagccgcagcttggtatttatgggaagtcaagaaacagcgagcaggagtactatgggatgtaccgagtcctccgccagtaggaaaagctgagctagaggatggagcgtatagaatcaaacaaaaaggaattttaggatattcgcagatcggcgcgggagtatataaagagggcacatttcatacgatgtggcatgtcacacgcggggctgtattaatgcacaaagggaaaagaatagaaccaagttgggcagatgtcaagaaagaccttataagctacggaggaggttggaaactagagggagaatggaaagaaggagaagaagtgcaagtcttagccttagagccagggaaaaaccctagagcggtacaaactaaacccggcttgttcaaaacttctacagggactattggtgctgtatcacttgatttttctccaggtactagcggatcgcccatcgtcgacaagaagggaaaagtagtaggcttatacggtaacggggttgttactagatctggtacatatgtatctgcaatagcacaaactgagaagtcaattgaagacaatcccgaaatagaagacgacatatttaggaagaaaaggcttacaattatggacttacatccaggggcaggaaaaacaaaacgatacctaccagctatcgtcagagaagctatcaaacgaggattgaggactttaatattagcacctacacgagtcgtagcggcagagatggaagaagcactcagaggactgcctattagataccaaactccagcaatacgggccgaacatacaggaagagagatcgtagacctaatgtgccatgctacctttactatgaggcttctcagtccaataagagttcccaactataatttaatcattatggatgaggcgcactttacggaccccgctagcatcgctgcaagaggatatattagtactagggtggaaatgggcgaagcggcaggaattttcatgacagcaactccaccaggatccagagacccatttccacaatcaaatgcaccaataatggatgaagaaagagaaatcccggagcggagctggaactcagggcatgagtgggtaacggattttaagggaaagaccgtatggttcgtcccctctataaaagcgggcaacgatatagcagcgtgcttacggaaaaatggaaagaaagtcattcaattgagccgaaaaacgttcgactttgaatacataaagacaagaacaaatgattgggatttcgtagtgacaacagatatatccgagatgggggccaacttcaaagcagaaagggtaatcgatccgagacgatgtatgaaaccagtaatattaaccgacggggaggaaagagtaattttagccggacccatgcccgtaactcactctagtgcggcacaaagacgcggccgtgtcgggagaaaccccaaaaatgaaaacgaccaatatatatatatgggagaacctctggaaaacgatgaagactgcgcacactggaaagaagcaaaaatgttacttgacaatataaatacaccagaaggtataattccatctatgttcgagccagagagggagaaggttgatgcaatagacggagagtacaggttacgaggagaagcgagaaaaacgttcgtagacttaatgcgaagaggggatttaccagtttggcttgcatacagagttgccgccgagggaattaactatgctgacaggagatggtgctttgatggggtgaaaaacaaccagattcttgaagaaaacgtagaagtagaaatctggaccaaagaaggtgagcggaagaaacttaaaccaagatggctggacgctcgaatatactccgacccattagcactaaaagagttcaaagagttcgccgctgggcgaaaatctcttaccttgaacttaataactgaaatggggcgattaccaacatttatgactcagaaagccagaaatgcattagataacttagcagtattgcatacagctgaagccggaggtcgagcttataatcacgcgttgagcgaattacccgaaacactcgaaacattattactattaaccctattggctactgtaacgggtggaatattcctatttttgatgagtggtaaaggtgtaggtaagatgactcttgggatgtgttgtataattactgcttcaatcttactgtggtacgctcaaatacaaccacactggattgcagcatctattattctagaatttttcctaattgtattattaattcctgagcccgaaaagcagcgaactccgcaagataatcaattaacgtatgtcgttatagccattcttaccgtagttgcagcaacaatggcaaatgagatgggtttcctagagaaaactaagaaagactttggacttgggtcgataaccacacaacaaccagaatctaacattctcgatatagacctccgtccagcgagtgcatggacattatatgctgtagcaacgacattcatcacaccgatgctacgtcattctatagaaaattcaagcgtcaacgtttcgctaacggcgattgctaatcaagccactgttctaatggggttgggaaaaggatggccattaagcaagatggacatcggagtacctttactcgcaatagggtgctattcccaagttaacccaataacattaacagctgcacttctattgttggtagcacattatgctatcattggtccggggttacaagcgaaagcaacacgggaagcccagaaacgggccgctgcaggtattatgaaaaaccctacggttgacggaataactgtcatcgatttagacccgatcccttacgatcccaaatttgagaagcaactaggtcaagtgatgctgctagttctatgtgtaactcaagttttgatgatgagaacaacatgggctctttgtgaagcgttaacattggcgacagggcctatatctacattatgggaaggcaatcctggacgattctggaacactacaattgcggttagcatggcgaatatattcagaggaagctatttggcaggagcgggtctactatttagcattatgaaaaatacggcgaatacaaggagaggaacggggaatacaggtgaaacgcttggagaaaaatggaaaaacagacttaatgccttaggaaagtcagagttccagatttataagaaatcaggaatccaagaggtagacagaactctagcaaaggagggaataaaaagaggagagactgatcaccatgcagtcagcagaggatcagcaaaattaagatggttcgtcgaacgtaatttagtgactccagaaggcaaagtggttgatctaggctgtggaaggggagggtggtcctactattgcggcggtttaaagaatgttaaggaggtaaaaggtttaacaaaaggcggaccaggccatgaagaaccaataccaatgagtacatacggatggaatcttgtcaggttacaatcaggagtagacgtcttctttaccccgcctgagaaatgcgacacgctcctatgcgatattggcgaatccagccccaatccgacggtggaagcaggacgcacgctcagggtacttaatctagttgagaattggttgaataacaatacacaattttgcataaaagtacttaatccgtatatgccatcggtcatcgagaaaatggaagccttacaaagaaaatacgggggagcattagttagaaacccattaagccggaactccacacacgaaatgtactgggtttcgaatgcaagcggaaatattgtttctagcgttaatatgataagcagaatgctcattaatcgctttactatgagacacaagaaagcgacatatgaaccagacgttgatttgggttcaggtacacgtaacataggcattgaaagtgaaacacctaatctagacataattggtaaaagaattgagaaaattaaacaggaacatgaaacaagttggcattatgaccaagaccacccgtataaaacttgggcttaccatggctcttacgaaacgaagcaaaccggatccgcatcgtccatggttaatggagtcgtaaggttgcttaccaaaccatgggacgtaatccctatggtaactcagatggcaatgacagacacaaccccgttcggacaacaaagggtatttaaagagaaagtagatacccgtactcaagagcctaaagaaggcaccaaaaagctaatgaaaatcacagcggagtggttgtggaaagaattgggcaagaagaaaacacctaggatgtgtactcgtgaagaatttacacgcaaagtgaggtctaacgcagctctaggtgcgattttcactgatgagaacaagtggaaaagcgcaagggaggcagtcgaggactcaggattctgggagctagtcgataaggaaagaaatttacatttagaaggaaaatgtgaaacatgcgtatacaacatgatgggcaaaagagagaagaaactgggtgaatttgggaaagcaaaaggaagccgcgctatctggtacatgtggctaggagcacgcttcctggaatttgaagcactaggctttttaaacgaggaccattggttcagccgcgaaaattccctcagcggagtagaaggtgaaggcctacataaactaggttatatattaagggatgtaagtaagaaagaagggggcgcgatgtacgcagacgacacagcaggttgggacaccaggattaccctggaagatctcaaaaatgaagaaatggtgaccaatcatatggagggagagcataagaaactagctgaagcaatcttcaaactaacataccagaataaagtggtaagggtacaacgtcctacaccgagaggaacagtaatggacattatttcaagaagagatcagcgaggatcgggccaagtcgtaacatatgggttaaacacttttacaaacatggaagctcaattaataagacaaatggagggggaaggtgtttttaaaagtatacagcaactgacagtaaccgaagagattgcagttaagaattggctcgtaacagtaggtcgagagcgacttagcagaatggcaataagtggagatgattgcgtcgttaaacccttggatgatagatttgcatctgcattaacagccctaaatgacatgggaaaagtcaggaaggacatccaacaatgggaaccatctagaggttggaatgactggacgcaagtacctttttgctcacatcatttccacgaattaataatgaaagacggccgggtactcgttgtgccatgccgcaaccaagatgaactaatcggcagggcgagaataagtcaaggtgcaggctggagtctgagggaaacggcttgtcttggtaaatcatatgctcaaatgtggtcacttatgtattttcatcgacgagacctgagacttgctgcaaacgcaatttgttcggcggtcccttcgcattgggtacccacatcacgtacgacttggtctatacacgcaacgcacgaatggatgacaaccgaagacatgcttacagtctggaatagggtttggatacaggaaaacccatggatggaagataaaactccagtagaatcctgggaagagataccctatttagggaagagagaagatcaatggtgtgggtctttaattggactaaccagcagagcaacctgggctaagaacatccaaacagcaataaatcaggttaggagtttaatcggcaatgaagagtacacagattacatgccgagcatgaaaagatttcgacgtgaggaggaagaggccggtgtactttggtag

SEQ ID NO: 22846 - RNA, 9876 nt, synthetic construct
  misc_feature 1..9876: note = derived and/or modified CDS sequence (opt6) from DENV-2__KC762661__SS-prME
  source 1..9876: mol_type = other RNA
acagcagggataattattatgatgatcccaacggtaatggcattccatctaacaacaagaaacggggaaccccacatgatagtctcacgccaggaaaaaggaaaatctttgttattcaaaacagaaaatggagtaaatatgtgcacactgatggcaatggatttaggtgaactttgcgaagatacaataacctacaattgcccattattacgtcaaaatgaaccagaagatatagattgttggtgcaactctacttcaacatgggtcacttatggcacatgcacagcaacaggggaacacagacgtgaaaaacggagtgttgcactggtacctcatgtcggaatgggactagaaacaaggacggagacgtggatgtcatcggagggcgcatggaaacacgcacaacgtattgagacatgggtcttaagacatcccggattcaccattatggcggcaatattggcgtatacaataggtactacatactttcaacgagtactaatttttatactattaaccgcagtcacccccagcatgacaatgcgatgtataggtataagtaaccgggattttgtagagggtgtgtcaggtggttcgtgggtcgatatagtccttgagcatggcagttgtgttaccacgatggccaaaaataaaccaactctagactttgaattaataaaaactgaagcaaaacatccagcaactttgagaaaatattgtatagaagcaaaattaacaaacactaccacagcatcaagatgtcccactcagggggaaccttctttaaatgaggaacaagataaacgattcgtttgtaaacatagtatggtggataggggttggggcaatggctgcggtctttttggaaaagggggtatcgtaacatgtgcaatgttcacgtgcaagaaaaacatggagggtaaaattgtacagccggaaaacctcgaatatactatcgtaataacacctcatagtggagaagagaatgctgtcggcaatgatacaggaaaacacggaaaagaaataaaagtcaccccacagagctcgattacggaggcagagttaactggttacggtacggtgacaatggaatgctctccaaggactggactcgattttaatgaaatggttctactacagatggaaaataaagcatggttagtccatcggcagtggttcttagatttaccattgccatggcttccgggtgcggatacacagggaagtaattggatacaaaaagaaactttagtcacttttaaaaatccacatgcgaagaaacaagacgtggttgtcttagggagccaagagggtgcaatgcatacagctttaacaggtgctactgaaatacaaatgtcttccggtaatttactttttacaggacacttaaaatgccgtctcagaatggacaaactacaactgaaaggtatgtcttattctatgtgtacagggaaattcaaagtcgtaaaagaaattgctgaaactcaacacggaaccatagtaatacgagtacaatatgaaggggacggctcaccttgtaaaataccttttgagattatggatttagagaaacgacacgtcttaggaaggttgataacggtgaatcccatagtaaccgaaaaagactcaccggttaacatagaagcagaaccacccttcggcgactcttatattataattggcgttgaaccaggtcaattaaaactttcatggttcaagaagggaagctccattggccaaatgttcgaaacaacaatgcgaggtgcaaaaagaatggccatattaggtgacaccgcatgggacttcgggtccttgggaggtgtcttcacgtctatcggaaaagccttgcaccaagttttcggggcgatctacggtgcagctttctcgggagtcagctggacaatgaaaattttaataggagtggtgataacatggataggtatgaactcccggagtaccagtctctctgtatcattagtcctagtgggggtcgttacattatatttaggagtgatggtgcaagccgatagcggatgcgtcgttagttggaaaaataaggaattaaaatgtggatccggtatattcataaccgataatgtacatacatggacagaacagtataagttccaaccagaatcaccatcgaaactagcctcagctattcaaaaagcccatgaagaaggaatatgcggtatacggtcagttacgagattagaaaacctcatgtggaaacaaataactccagaactaaatcatatattgagtgagaatgaagtaaaactaactattatgacaggagatataaaaggaataatgcaagccggcaagcggtctcttcggccacaaccaactgaacttaagtattcatggaaaacctggggtaaagctaaaatgttatcaacggaactgcataaccatacgttcttgatagatggtccggaaacagcggaatgccctaatgcaaatcgagcctggaacagtttagaagttgaagactatggctttggggtttttacaacgaatatctggttaaaacttaaggaacgacaagatgcattctgcgactcgaaactcatgagtgcagccataaaggataacagagctgttcatgcagacatgggatactggattgaatctgcactgaacgacacttggaaaattgaaaaggcttcctttatagaagtgaaatcttgccattggcctaagtcacacacgctatggtctaatggcgtgttagaatctgagatgatcataccgaaaaacttcgctggaccagttagtcaacacaattaccgcccagggtatcaaacgcaaactgccggaccatggcatttaggacggctagaaatggattttgatttttgtgaaggcaccaccgtagtcgtaacagaagattgtgggaatcgtggtccatcgctaaggactactacagcgtctggaaaattgatcacagaatggtgttgccgatcgtgtaccttacctccgttgcgttatcgaggagaggacggatgctggtacggtatggagataaggccgcttaaagaaaaggaagagaacctagtaaattccctggtgactgcgggccatggtcaaatagacaatttttctctaggagtcttaggtatggcactctttttggaagaaatgttaagaacgagggtagggacaaaacatgcaatcttgttggtagcagtgtcttttgttacgctgattactggaaacatgagttttcgagatttaggtagggtcatggtcatggtaggtgccacaatgacagacgatatcggcatgggtgtaacatatttagctctattagctgctttcaaagttcgacctacttttgccgctggcttactcctacgaaaactaacatcaaaagagctgatgatgacaacaatcggcatcacactattgtcgcagtcaaccatccccgaaacaatactcgagcttacagatgcattggccctcggtatgatggtattaaaaattgttcgtaatatggaaaagtaccaattagctgttacaataatggctatactatgcgtacctaacgcagtaattctgcaaaatgcatggaaagtaagctgtacaacattagcagtagtaagtgttagtccgcttctacttacaagctcccagcaaaaagccgattggatcccattggcgctaacaataaagggattaaacccaaccgctatcttcctaacaactttaagcagaacaagcaaaaagcgatcatggcctttgaatgaagctattatggcagtaggaatggtctctatcctagcttcgtcgctcctcaaaaacgatatacccatgacaggtccactcgtcgcaggcgggttattaacagtgtgctacgtattgactggtcgttccgcagacctagagttggagcgcgcggcagatgtaagatgggaggaacaagcagaaatatccggttcatcgcctatattatcgataactatttcagaggacggatcaatgtctattaagaatgaagaagaagaacaaacactaacgatacttatacggacaggactgttagttattagtggcttattccctgtaagtattccaataactgccgcagcttggtatttatgggaagtgaaaaagcagcgtgctggtgttttatgggacgtaccttcccctcccccagtaggaaaagcagaactagaagacggagcgtataggattaaacaaaaggggatactaggatacagtcaaatcggcgctggcgtttacaaagaaggtaccttccatactatgtggcacgtaactagaggtgcagtgcttatgcacaaggggaaaagaatagaaccatcttgggctgacgtcaagaaagatctcatatcatacggcggtggatggaaactagaaggcgaatggaaagagggcgaagaagttcaggtccttgctttagaaccaggcaaaaatcccagagctgtgcaaactaaacccgggctctttaagacatcgaccggaaccataggcgccgtatctttggacttttctccaggaacgtccggttctcccatagtagataagaaaggaaaagtcgtgggattatatggcaatggcgtagtgactaggagtggaacatatgtatcggcaatagctcaaacggaaaagagtatagaagataatcccgaaattgaagatgatatcttcagaaagaaaaggctaacaatcatggacttacaccccggtgctggtaagacgaaacgatatctaccagcaatcgttagagaagccattaagaggggattgagaacactcatccttgcaccaacgagagttgtagcagcagagatggaggaggcactgagaggtttacccattcgataccaaactcctgcgataagagcagagcacactgggagagaaatcgttgatcttatgtgtcatgccacattcacaatgcgattattaagtccaatccgagtcccaaattataacctaataataatggatgaagctcactttaccgatccagctagcatcgcggcgcgtggatacataagtaccagggtggaaatgggggaagctgctggaatcttcatgacggctacaccacccgggagtcgcgatccctttccgcaatctaacgccccaataatggatgaagaacgcgaaataccggaaaggtcatggaatagcggacatgaatgggtgacggattttaaaggaaaaacagtatggttcgtaccaagtataaaagccggcaacgatattgctgcctgtctgcgcaagaatggaaagaaagtcatacagctatctcgtaaaacctttgattttgaatatattaaaactcgcactaatgattgggatttcgttgtaactacggacatttcagaaatgggtgcaaattttaaagcagaaagagttatcgacccacgccgatgcatgaaacctgttattctgaccgatggagaggagcgagtaatattagctggacccatgccagtcacccattcgagtgcagcccagagaaggggaagagtcggaagaaatcctaaaaatgaaaatgatcagtacatttatatgggcgaaccattggaaaatgatgaggactgcgctcattggaaagaagcgaaaatgctcttagacaatatcaacacaccagagggtataattccatctatgtttgaaccagagcgtgaaaaagtcgatgcaatagatggtgaatatagattgcgaggagaagcaagaaaaacttttgtagatcttatgagacggggcgatcttccagtgtggttagcatatcgagttgcggccgaaggcataaactatgctgacagaaggtggtgttttgacggagttaaaaacaaccagatcttggaagaaaatgtggaagtagaaatatggacgaaagaaggagaaaggaagaaattaaaaccgagatggctagacgcacgcatttattccgacccattggccttaaaagagttcaaagaatttgccgcaggaagaaaatccttgactctgaatttaataacagaaatgggtcgactaccgacatttatgactcagaaagcaagaaatgcactggataacttagccgtcttgcatacggcagaagccggagggcgagcatacaaccatgcattaagcgagcttccggaaacattagagacgttattattacttacgttgttggctactgttaccggaggcattttcctctttttgatgagcggaaaaggcataggaaaaatgaccttgggaatgtgttgtataataactgcctcaatattactttggtatgcacagattcaaccccattggattgcggcaagtattatactagagttcttcttaatagtactactaattcctgaacctgaaaaacagcgtacaccacaagataatcaacttacatatgtagttatagctattctcacagtggtagctgcaacaatggccaatgaaatgggattcctcgagaaaaccaagaaagactttggactgggtagtatcacaactcaacaacctgaatcaaacattctagacattgatttaaggcctgcctcagcttggaccctgtatgcagttgcgacaacatttatcacaccaatgctacggcatagcatcgaaaatagctcagtaaatgtatcacttactgcaatagctaatcaagcaacagtgctaatgggccttgggaaaggatggccattgagtaaaatggacataggtgtacctttgcttgctatcggctgttattcacaggtaaacccgatcactctaacagccgcattgctccttttagttgcgcattacgctattataggcccgggactacaagccaaagcaactcgggaagctcaaaaacgtgcggcagccgggataatgaaaaatccaacggtcgatggtattactgttattgatttagacccaattccatatgatccgaaattcgaaaaacaacttggccaagttatgctcctagtcttgtgcgttactcaagtacttatgatgcgtacaacatgggcactttgtgaggcgctaactctagctactggaccaatatcaacattatgggaaggaaacccaggacgattctggaacacgactatagcggtaagcatggcaaacatatttcgtggcagctatttagccggtgcaggactcctgtttagcataatgaaaaatacagcaaatactcgtcgaggaaccggaaatacaggagagacccttggtgagaaatggaaaaacagattaaatgccctgggcaaaagtgaatttcaaatatataaaaagtctggtattcaagaggtagacagaactctagctaaggaaggaataaaaagaggtgaaacagaccatcatgctgtcagcagaggaagtgctaaacttcgttggtttgttgagaggaatttagttacacctgagggaaaagtagtcgacctagggtgtggccgtggagggtggagttattattgcggaggtctcaagaatgtaaaagaagtaaaaggactgactaaaggagggcccgggcacgaagaaccaatacctatgtctacctatggttggaatttagttagactgcaatccggtgtcgatgtattctttacgccgccagaaaaatgcgacactcttttatgtgatatcggagaatcatcgccaaaccccactgtcgaggcaggtcgaactttaagagttctcaacttggtcgaaaattggctcaataataacacccaattttgtattaaagtactcaacccttacatgccatctgtgatagaaaagatggaagccttacaacgcaaatacggcggagctctggtaagaaaccccctatctcgcaatagtacccacgaaatgtattgggtcagcaacgctagtggcaatatcgtctctagcgttaatatgattagtcgaatgctcataaaccgcttcacaatgcggcataagaaagcaacttatgaacctgatgtagatctcggaagtggaaccagaaacataggaattgagtcagaaacacccaacctggatataataggcaagcgtattgagaaaatcaaacaggaacatgaaacatcttggcactatgaccaagatcacccatacaaaacttgggcatatcatggcagttatgaaacaaaacaaactggaagtgcttcaagcatggtaaatggggttgtacgcctcttgacaaagccatgggacgtcatcccaatggttacacaaatggcgatgactgacaccacgccattcggtcaacaacgagttttcaaagagaaagtagataccagaacacaagaaccaaaagaaggaaccaagaaactcatgaaaatcaccgctgaatggctttggaaagagttaggaaagaagaaaacaccgaggatgtgcactagggaagaatttacgaggaaagtaagaagcaacgcagcattaggagccatattcacagacgaaaacaagtggaaatcagccagagaagcggtggaagattcaggcttttgggagcttgtggacaaagaaagaaatttacatttagaaggtaagtgtgagacatgtgtttacaacatgatgggaaaacgggaaaagaaacttggtgagttcggtaaagcaaaaggaagtcgagcaatttggtatatgtggctaggagcgcgatttttggagttcgaagctctgggttttctcaacgaagatcattggtttagccgtgaaaattcattgtcaggagtagaaggggaaggtttgcataaattagggtacatactccgcgatgtatcaaagaaagaaggaggggcgatgtacgctgacgatacagcaggctgggacactcgcattactcttgaggatctcaaaaatgaagagatggtgaccaaccacatggaaggagaacacaagaaactagctgaagcgatcttcaagctaacctatcaaaacaaggtagtaagagtacaacgaccaacccctagagggacagtaatggacattataagcagacgggaccaaagaggttctggtcaagtggtaacctacggcctaaatacttttaccaatatggaagctcagctaatacgtcaaatggagggtgaaggggttttcaaaagtattcagcaactcacagttacagaagaaatagctgtcaaaaattggttggtacgcgtcgggagagaacgcctgtctcgcatggcgataagcggagacgattgcgtagttaaacctctcgacgacagattcgcgtcggccctgacagcattaaacgatatgggaaaagtccgtaaagacatacaacagtgggagccatctagaggatggaacgattggacgcaagtaccattttgtagtcatcatttccacgagctaataatgaaagacggtagagttttagtcgtcccttgccgtaaccaagacgaattgatcgggagagcgaggattagtcaaggcgctggttggagtttgagagaaactgcctgcttaggtaagtcatatgctcagatgtggagtctaatgtacttccataggagagatctgcgcttagccgctaatgcgatttgcagtgcagttccaagccattgggtgccgacatcaagaacaacttggagtattcatgcaacacacgaatggatgacaactgaagacatgcttacagtatggaacagggtttggatccaggaaaatccatggatggaagataaaacacccgtagagagttgggaggagataccctaccttggcaaacgagaggatcaatggtgcggatccttaattgggctaacaagtcgagcgacatgggcaaagaatattcaaactgccataaatcaagtcagatctttgataggaaatgaggaatataccgattatatgccaagcatgaaacgattcagaagagaggaagaagaagcaggagtcttatggtga

SEQ ID NO: 22847 - RNA, 9876 nt, synthetic construct
  misc_feature 1..9876: note = derived and/or modified CDS sequence (opt6) from DENV-2__KC762655__SS-prME
  source 1..9876: mol_type = other RNA
actgctggaataatcattatgatgataccaactgtgatggctttccatctcactacacgaaatggcgaaccacacatgattgttagccgtcaagaaaaaggaaaaagccttcttttcaaaacagaaaacggtgtgaatatgtgtacacttatggcgatggatctaggagaattatgtgaagataccataacatacaactgtccacttctaagacaaaacgaaccagaagacattgattgctggtgcaacagcacctcaacttgggtaacttatggcacgtgtactgcaacaggagaacaccgaagagagaaaaggtccgttgcattagtaccacatgtaggaatggggttagaaactaggacagaaacgtggatgtcaagcgaaggagcatggaaacatgcacagcgaatagaaacatgggtgttacgtcatccgggattcactattatggctgctattttagcatacacaatcggaacaacatatttccaaagagtactcatatttattttactgactgcagttacgcctagcatgactatgcgctgtatagggatctcgaatcgtgattttgttgaaggggtttctggaggcagttgggttgatatagtattagaacatggctcgtgcgtaacaacgatggccaaaaataaacccactctagattttgaattaatcaaaaccgaagctaaacatccagcaacattgagaaaatattgtattgaagcaaaattgactaacactaccacagcaagtaggtgcccgacacaaggtgaaccctctttgaatgaagaacaagataaaagatttgtttgtaaacacagcatggtagaccgtggttggggcaatggctgcggacttttcggtaaaggcggcatagtaacctgtgcgatgtttacctgcaagaaaaatatggaaggtaaagtagtacaacctgaaaatctggaatatacaatagtaataacaccacatagtggagaagaaaacgcagtaggcaatgacacaggtaaacatggtaaagaaatcaaagtaacaccgcaatcttcaataacggaagcagaactgacaggatatggaaccgtaaccatggaatgtagcccccgtacgggactcgactttaacgagatggtattattacaaatggaaaacaaagcgtggctggtacatagacagtggttcttagacttaccactgccttggcttcctggtgcagacacacagggttcaaattggatacaaaaagaaacgttagtaacatttaaaaacccccatgccaagaaacaagatgtagttgtattaggatcccaagagggagccatgcatactgcccttactggtgccacagagatacaaatgagctctggaaatcttctattcactggacatctcaaatgtcgcctccgaatggataaactccaactaaaaggaatgtcgtattcaatgtgtacgggaaaatttaaagtagtaaaggaaatagcggaaacgcaacatggaactatagtaatccgagtacaatatgaaggtgacgggtcaccatgcaaaataccttttgaaattatggacctggagaaacgacacgtattaggaagattgataacagttaatccaatagtaacagagaaggactcacccgtgaacatagaggcggaaccacctttcggagattcttatataataatcggagtggaaccaggacaactcaaattgagttggttcaagaaaggaagttcaataggtcaaatgttcgaaacaacaatgcgtggagctaagagaatggctatactaggggatactgcctgggactttggatccttgggaggagtatttacaagtataggaaaagcacttcatcaagtgtttggtgcagtttatggtgctgcattttcaggcgtatcatggactatgaaaatattaataggggtggtaataacatggattggtatgaatagtagatctacaagtctcagcgtcagcttagtcttagtcggtgtggtaaccctttatttgggtgtgatggtacaagctgacagtggctgcgttgtatcatggaaaaacaaggaattaaagtgcggatcgggcattttcatcacggataacgtacatacctggacagaacagtacaaatttcaaccagagagcccaagcaaacttgctagtgcaattcaaaaagcacatgaagaaggaatatgcggcatcagatcggttaccagattggaaaatttaatgtggaagcaaattacacctgaattaaaccatatcttatccgaaaacgaggttaaattaacaataatgacgggcgacattaaaggaataatgcaggctggaaaaagatcactacgtccacaaccaacagaattgaagtattcttggaaggcgtgggggaaagcaaaaatgctcagcactgaacttcacaatcatacatttttaatcgacggccccgaaacagcagaatgtccaaatactaatcgcgcatggaactccctggaagtagaggattatggatttggtgttttcactacaaacatttggttgaaactaaaagagcgacaagatgtgttttgtgattcaaagttgatgagcgcagccattaaagataataaggctgtacatgctgacatggggtattggatagagagtgcgcttaatgacacgtggaagatcgaaaaagcctcgttcattgaagttaagtcgtgtcattggccaaaaagtcacaccctgtggagtaacggtgttcttgaaagtgaaatgataatccctaaaaacttcgcaggtccagtcagccaacataattatcgacccggatatcatacccagaccgcaggcccgtggcatctgggacgacttgaaatggactttgatttttgcgaaggaacaactgtagtagtaacggaggattgtgggaatcgaggaccgtcattaagaaccacgacggctagcggtaaacttataacagaatggtgctgccggagttgcacactacctccactcagatacagaggggaagatgggtgctggtatggaatggaaataaggccactgaaagaaaaggaggaaaacctggttaattctctggtaacagccggccatgggcaaatcgacaacttttcattaggagtcttaggcatggcgctatttttggaggagatgctaaggacgcgtgtaggaacgaagcatgccatactattagtagcagtatcttttgtgacgcttattactggtaatatgtcatttagagatctaggtagagtaatggtaatggtgggtgctacaatgactgatgatataggcatgggggtaacgtacttggcattactagcagcattcaaagttaggcctaccttcgctgcagggctgctcttgcgcaaacttacatctaaagaactcatgatgactaccataggaatagtactcctcagtcaatcgacgatcccagagaccatacttgagctgactgacgcgctagctttagggatgatggttcttaaaattgtacgcaatatggagaaatatcaactagcagtaacgataatggcgatcctatgcgtacccaacgccgttattttacaaaacgcttggaaagtctcctgcaccacattagccgtagtgtcagtatcgccactattgttaacttctagccaacaaaaagcagattggatacctctagcacttacaattaagggtctgaatccaacggcaatttttcttactacattatctaggacaagtaagaaaagatcgtggccattaaacgaagctattatggcagtcggtatggtcagcatcttagcaagttccctactaaagaacgatataccgatgacgggtcctctagtagcaggaggcttacttacggtctgttacgtcttaacaggtcggagtgcagatctggaattagaacgtgcagcagacgttaggtgggaggaacaagcagaaattagtggaagcagcccaattctaagtattacaatatctgaagacggatcaatgagtatcaaaaacgaagaagaagaacagactctcacaatattgattagaaccggtttattagtaattagtggtctatttccagtctcgataccgataaccgcaacagcctggtatctatgggaagtcaagaaacaaagagctggagtactatgggatgtacctagtccgcccccagtcggtaaagccgaattagaagacggagcctatcgtattaagcaaaaaggtattctaggatactcgcagattggagcgggggtttataaagaaggaacctttcacactatgtggcatgttacacgaggggctgtgttaatgcataagggaaagcgtattgagccaagctgggctgacgtcaagaaagacctgatctcgtatggaggaggatggaaattagagggagaatggaaggagggagaagaagtacaagtattagccctagaacccggaaagaatcctcgggccgtccagaccaaaccagggctatttaaaacaaacacaggtacaatcggggcagtgtctttagatttctcacccggtacatctggctcgccaattgttgataagaagggaaaagtagtaggattatatggtaatggtgtagtaacaaggtcaggtacatacgtctctgcaattgcacagacagagaaaagcattgaggataatcctgaaatagaggatgacatatttcgtaagaagaggctgaccataatggacctacacccaggtgccggaaaaaccaagagatacttacctgcaattgtacgagaggcaataaaacgtggactacgaaccttaattttagctcctacgagagtagtagcagcggaaatggaagaagcattaagaggacttcctataagataccagactccagcaataagggctgaacatacaggccgtgaaattgtagacctcatgtgccatgcaactttcaccatgcgactgttaagcccaatacgagttcctaattacaacttaattatcatggacgaagcgcattttaccgatccggcgtccatagcagcccgaggatatatttctacgcgagtagaaatgggagaagcagcaggaatctttatgacagctacgccaccgggttctagagaccccttcccccaaagtaatgcaccaattatggatgaagaaagagaaatacccgaaagatcatggaatagcggtcacgaatgggtaactgactttaaaggaaagacagtatggttcgtaccatccatcaaagctggtaatgatatcgcagcttgtttacggaaaaacggtaagaaagttatccagttatcccgaaaaacgtttgatttcgagtatatcaagactcggacaaatgattgggactttgttgttacgacagacatcagtgaaatgggagcaaattttaaggctgaacgagtcatagatccaagaaggtgtatgaaaccagttatattaactgatggcgaagagagggtcatattggcgggaccgatgccagtcactcactcatcagcggcacaaagaagaggacgagtaggcagaaaccctaaaaacgaaaatgaccaatatatttacatgggcgaaccactcgaaaacgatgaggattgcgcgcattggaaagaggcgaagatgttgctagacaatattaatacacctgagggaattataccaagtatgtttgaacccgaacgggaaaaagtcgatgcgatagacggggaatatagactacgaggggaggctaggaaaacttttgtagatctaatgcgacgcggagacttaccagtatggcttgcatacagggtagccgcagagggcatcaattatgctgatagacgatggtgcttcgacggagtcaaaaacaatcaaatattggaagaaaatgtagaggttgaaatttggactaaagaaggagaaagaaagaaattgaaaccacgatggttagacgcaagaatctactccgatccattagctttgaaagagtttaaagaatttgcagcaggacgtaagtcactgacacttaatttaataacagaaatgggacgtctgcctacattcatgacacaaaaggcaaggaacgctttggacaatttggctgttctacatacagctgaagcaggaggccgcgcctataaccacgcactttcggaactaccagagacgctcgaaaccttactattattgacactgttggctaccgttacgggtggaatcttcttgttcctgatgtcgggtaaagggataggtaaaatgacactaggaatgtgctgtataataacggcttcgatattgctttggtacgcacaaatacaaccccactggattgcagcatcgatcatactggagttctttctaatagtattgttaataccggaacccgaaaaacagcgcactcctcaagacaaccaacttacatacgtggtaattgcaatactcacagtcgtggcggctactatggccaatgaaatggggtttttggagaaaacgaagaaagatttcggtctggggtcaattgccacacaacaaccggagagcaatattttagacattgatcttagaccagcttcggcttggactctttatgcggtagctacgacatttataactcctatgcttcgccattctatagaaaactcaagcgtaaatgtttcattaacagctatagctaatcaagcgacagttctaatgggcttagggaaaggatggccactgtccaaaatggacatcggagtacctctacttgccatcggctgttatagtcaagttaatccaataaccctgactgcagcactattactactggttgcacattatgcgatcataggacctggtctacaagcgaaagccactcgtgaggcgcagaaacgagccgcagccggaataatgaaaaatcctacggtcgatggaatcactgtgatagatctggatcccataccatatgatcctaagttcgaaaagcaacttggacaagtgatgctcctcgtactttgcgtgacacaggtattaatgatgagaaccacatgggcactatgtgaagcactcacgttagcaacaggtcccataagtacactttgggaaggaaacccaggccggttttggaatacaactatagctgtttcaatggcgaacatattcagaggctcatacttagcaggagcggggctactattttcaattatgaaaaatacagctaatactcggagaggaaccggtaatactggtgaaaccctaggagagaagtggaagaacaggttgaacgctctgggcaagagcgagttccaaatatataagaagtcaggtatccaagaagtagatcggacgctagcgaaagaaggtataaaacgaggagaaactgatcatcatgctgtctcgcgaggaagcgcaaaattacgatggttcgtggaaagaaacctggttactccagaaggaaaagtcgtagatttagggtgcggtcgaggaggttggtcatattactgtggcggattgaagaacgtaaaagaagtgaaaggattgaccaaaggtggtccaggtcacgaagaacctatcccaatgtcgacctacggatggaatttagtacggctccaaagcggtgtagacgtcttctttactccccctgaaaaatgcgatacactactttgcgatatcggcgaatcgtctcccaatccgaccgtcgaggcagggcgaacactacgagtgctaaatttggtagaaaattggttaaacaacaatacacagttttgcataaaggtgctaaatccctacatgccaagcgtaattgagaaaatggaagcgctacaacgaaagtatgggggagctctagtacgtaatccattgtctcgaaatagtacacatgaaatgtactgggtgtctaacgcttccgggaacatagtaagttccgtaaatatgataagcaggatgctaataaatcgatttacgatgcgacacaagaaagcaacatatgaacccgatgttgatcttgggtcagggactcgtaatataggaatagaatcagaaacacctaacttggatattatagggaaaagaatagaaaagataaaacaggaacacgaaacatcatggcattacgaccaggatcacccgtataaaacatgggcataccatggttcttatgagacaaaacaaaccggaagcgctagctccatggtcaatggggtagtccgcttgctgacgaaaccatgggatgtgattcccatggtgacgcaaatggctatgacggatacaacaccattcggacaacagcgtgtcttcaaagagaaagttgacacaaggacacaagaacccaaggaagggacaaagaaactaatgaaaataactgcagaatggctttggaaggaattgggcaagaagaaaacccctcgcatgtgtacacgtgaggagtttacacgtaaagtaagaagtaatgcggcgcttggcgccatcttcaccgacgagaataaatggaaatcggctcgcgaggcagtggaagattcaggcttttgggaattggtagacaaagagagaagcctacatcttgaaggaaagtgtgaaacatgcgtgtataacatgatgggcaaaagagagaagaagctaggtgagttcggaaaggccaaaggatctcgagctatatggtatatgtggttgggagcacgctttttagagttcgaagctctaggctttcttaatgaagatcattggttctctagagagaatagcctatcaggagtggaaggcgaaggtttacataaactaggttacatcttacgggacgtatcaaagaaagagggaggagctatgtacgcagatgataccgctgggtgggatacgaggattacactagaagaccttaaaaatgaagagatggttacaaatcacatggaaggtgaacacaagaaattagctgaggcaatatttaaattgacatatcaaaataaagtagtgagagtacaacggcctaccccacgcggcatcgtaatggatattatttctagacgagatcagagaggcagtgggcaagttgtgacatacggactcaatacattcacaaacatggaagcacagttaataagacaaatggaaggggaaggtgtatttaaaagcattcaacaattaactgtaaccgaggaaatagcagtgaaaaattggttagcaagagtaggacgagagaggttatcaaggatggcgatatctggagacgactgtgtagtaaagcccttagacgaccgcttcgctagtgccttaaccgccctcaacgacatgggaaaggtcagaaaagatatacaacaatgggagccttcaagaggctggaatgattggacacaggtaccgttttgttcacaccattttcatgaactaatcatgaaagatggccgggtccttgtcgtcccgtgcaggaaccaagatgaactaataggaagggcaagaatcagccaaggtgcaggctggagcctaagggagacagcgtgtctaggaaaatcgtatgctcaaatgtggagcttgatgtatttccacagaagagatttaagattagccgcaaatgcaatttgtagtgcagttccttcacactgggtaccaacatcaaggacaacatggagtatacacgccacacatgaatggatgacaacagaagacatgctaacagtatggaatagagtgtggatacaagaaaacccgtggatggaagacaaaacacccgtagaatcttgggaggaaattccatatttaggtaagcgtgaagaccaatggtgcggatctcttataggcctaacttcgagggctacttgggcacgtaatatccaaacagcaataaaccaggttagaagtctcataggcaatgaagagtatactgactatatgccgagtatgaaaaggttcaggagagaagaagaagaagctggtgtattatggtaa

SEQ ID NO: 22848 - RNA, 9876 nt, synthetic construct
  misc_feature 1..9876: note = derived and/or modified CDS sequence (opt6) from DENV-2__KC762656__SS-prME
  source 1..9876: mol_type = other RNA
accgctggcataataataatgatgatcccaactgtaatggcatttcatttaaccactcgtaacggcgaaccacatatgatcgtgtcccgacaagaaaaaggaaaaagtctattattcaaaactgaaaacggagtaaatatgtgcacattaatggctatggatttaggtgaactatgtgaagatacgattacatataactgtcccctattacgtcaaaacgaaccggaagatatagattgttggtgtaacagtacttcaacatgggtaacctacggtacttgtacagcaacgggggaacatagacgggagaaacgatccgtggcgcttgttcctcacgtaggaatgggactagaaactagagcggaaacatggatgtccagcgaaggcgcatggaaacacgcgcagagaattgaaacatgggtattacgccacccaggattcacaatcatggcagcaatcctggcatatacgataggaactacatatttccaaagagtactaattttcatacttctgacagcagtaacaccgtctatgacaatgagatgtattggtattagtaacagagacttcgttgaaggcgtatccggtggtagttgggtagacattgtacttgaacacgggtcttgcgttaccacaatggctaaaaataaacctaccctagactttgaactaataaaaactgaagctaaacatcctgcaactttacgcaaatactgcatcgaagcaaaacttactaacacaacaacagcatcaagatgtcccactcagggtgaacccagcttaaatgaagaacaggataaacgctttgtatgcaaacatagtatggtcgataggggttggggaaatggctgtggtctattcggaaaaggaggaattgtaacatgtgcgatgtttacgtgcaaaaagaacatggaagggaaagtggtgcaacctgagaatcttgaatatactatcgtgatcacaccacactctggtgaagaaaacgctgttggtaacgatacaggtaaacatggtaaagaaataaaagtaactccgcaatctagcataacagaggctgagttaacaggatatggtacggtcacaatggagtgtagccctagaacggggcttgattttaacgaaatggttttattacagatggaaaataaagcatggcttgtacatcgacagtggtttcttgatttaccactgccgtggttacccggtgcagacactcagggttctaattggatccaaaaagaaacccttgtaacctttaaaaatccacacgctaagaaacaagatgtcgtcgtccttgggagtcaagaaggggctatgcacacagcactaacaggagcaaccgaaatccaaatgtcatccgggaatttgctatttaccggacatctgaaatgccgacttcgaatggacaaacttcaattaaagggcatgtcatattcaatgtgcacagggaagtttaaagtagttaaagagatcgctgaaacacaacatggtactatagtaatccgtgttcaatacgaaggtgatggatccccgtgtaagattcctttcgaaataatggacttagaaaaacgtcatgtgttaggaagactaatcaccgtaaatccaatcgtgaccgaaaaagattccccagttaatatcgaggctgaaccccctttcggggattcatacataattataggtgtcgaacccggtcaattaaaactgagctggttcaagaaagggagctccatcggtcaaatgtttgagacaactatgagaggagcaaaacgtatggcaatcctcggagatactgcatgggactttggctctttaggtggggtttttacatccatcggtaaagcattacaccaagtgtttggtaccatctatggagcagcattttcaggagtatcctggaccatgaaaatcttaattggagtagtaattacttggatcggcatgaacagccgtagcacaagtcttagtgttagtttagtgttggtaggtgtggtaactctatacctaggtgtaatggttcaagcagacagtgggtgcgtagtcagttggaaaaacaaagaattaaaatgcggttctggaatatttataaccgacaacgtacacacgtggacagaacagtacaaatttcaaccggaatctcccagcaaattggcttccgcgattcaaaaagcacatgaagaggggatatgtgggatccgctcggtcactcgtctggaaaatttgatgtggaaacaaataacacctgaacttaaccatatattatcagaaaatgaagttaaactaactataatgacgggtgatattaaaggtataatgcaagcaggcaaacgtagcctaagaccccaacccacagagttgaaatatagctggaaggcctggggtaaagccaagatgttaagtacagaattacataaccatacttttcttatcgacgggccagaaactgctgaatgccctaacacgaacagagcatggaatagtcttgaagttgaagactacggtttcggagtctttaccacgaacatttggttaaagttaaaggaacgtcaagacgtgttttgtgattccaaattaatgtcagcggctattaaagataacagagcagtgcatgctgacatgggttattggattgaaagtgcactgaacgatacttggaagatagaaaaggcatcatttattgaagtaaaaagttgccaatggcctaaatcacatacactatggtcaaatggagttttagaatctgaaatgataatacccaaaaattttgcgggtccagtctcacaacataattacagaccgggttatcatacacaaactgctggcccttggcacttgggaaggcttgaaatggatttcgatttttgcgaaggtactacagttgtagttacggaagactgcggaaaccgaggcccaagtctaaggacgacaacggccagtggaaagttaataacagagtggtgttgtaggtcttgcactttaccgccgttgcgatataggggagaggacggatgctggtatggaatggaaatacgacccctcaaagaaaaggaagaaaatttagtgaacagtctggttacagcggggcacggacaaatagacaatttcagtttgggtgttctaggaatggctctgtttttggaggaaatgctccggaccagagtaggcactaaacacgcaattttactcgtcgcggtctcattcgtgaccttaataacgggaaatatgtcatttagagatctagggagggttatggtgatggtcggagctactatgaccgatgatattggaatgggggttacgtacctagcactccttgctgcattcaaagtgcgacctacatttgcagctggtctattattacggaaactaacctcaaaagaactgatgatgactactatcggaatcgtattattatcacaaagtacgatacccgagactatacttgaattaacagacgcgctagcactaggaatgatggttttaaagatcgttcgcaacatggaaaagtatcaattagcagtaactattatggcaatactttgtgttcctaacgccgtaattcttcaaaatgcatggaaagtaagctgtactacactagcagtcgtaagtgtgtcaccgctcttactaacgtcgagtcaacaaaaagccgattggattccactagcactaactataaaaggattgaatccaacagcaatattcctaactaccttaagtcgcacatcaaagaaaaggagttggcctttaaatgaagccattatggcagtcggtatggtttctatattagcttcaagccttcttaaaaacgatataccaatgacgggaccattagtggcgggaggtctgcttactgtatgttatgtgttaacaggccgctccgcagacttagaattagaaagggcagcagatgtccgttgggaggaacaagcagaaatatcagggagttccccaattctatccataaccatcagcgaagacggaagtatgagtattaaaaacgaggaagaggaacaaactttaacaatacttatacgaacaggtctacttgtcgtctcagggttatttccagtaagcatcccgattacagcagcagcttggtatctctgggaagtcaagaaacagcgcgcaggcgtcttatgggacgtcccatcaccgccgcctgtcgggaaagccgaattagaagatggcgcttacagaataaaacaaaaaggtatattaggatacagccaaattggagctggcgtctacaaggaaggaactttccacacaatgtggcatgtaactcgaggcgctgtattgatgcacaagggtaaaaggatagaaccttcgtgggcagatgtgaaaaaggacctgatttcatatggaggtgggtggaaattagaaggtgagtggaaggaaggggaagaggtacaagtactcgcgttggaacctgggaaaaacccaagagccgtgcaaacgaagccaggtttatttaaaaccaatacgggcacaataggcgctgtaagcctagattttagtccaggtacgtcaggaagtccaattgtagacaagaaaggcaaggttgtaggattatacggaaacggagtagtaacacgtagtggcacctatgtatcagccattgcccagactgagaaaagtatagaggacaaccctgaaatagaagatgacatattcagaaagaagcgattaactataatggatttacatccaggagccggtaaaaccaaacgatacctacctgcgatcgtaagggaagcaataaaaagaggactacgaacactgattctagcgccaactcgagtggtcgcagcagaaatggaagaagcactgagaggattaccaatacgatatcaaacgcctgccataagagctgaacatacaggccgggaaatcgtagacctcatgtgccacgccacctttactatgcgcctgctctcacctataagagtacccaattacaacttaattattatggacgaggcacactttacagatcccgcatcaattgccgcaagggggtatatttctactcgagtagaaatgggagaggccgcgggaatattcatgacagcaacaccaccaggtagccgagatccctttccccagagtaatgcaccgattatggatgaggaacgagaaatcccggagagatcatggaactcaggtcatgaatgggtaacagattttaaaggtaaaactgtgtggtttgttccatccattaaagcggggaatgatatagcggcctgtttgaggaaaaatggtaagaaagtcattcagctaagcaggaaaacttttgacttcgagtatataaaaacacgcacaaatgactgggactttgtcgttactaccgatatttctgaaatgggagctaatttcaaagcggaacgcgtcatcgatcctaggaggtgcatgaaacctgtaatattaacggatggcgaagaaagagtgattctggctgggcccatgccagttactcacagtagtgcggcccagagaaggggcagagtgggtaggaatcccaaaaatgagaacgatcaatacatctacatgggggaacctttggaaaatgacgaggactgcgctcattggaaagaagcgaaaatgttgttggataatattaatactccagaaggtattatccctagcatgttcgaacctgaaagagaaaaggtggacgctatagatggagaataccgtttgaggggtgaagcacgtaaaacattcgtcgatttgatgaggcgcggagacttaccggtatggctagcttaccgagtagcggcggaagggattaactacgctgacagaagatggtgctttgatggtgtaaagaacaaccaaatattagaagaaaacgtggaagttgaaatatggactaaggaaggggaaagaaagaaactaaaacctagatggttagatgctagaatttattccgacccactagcgttaaaggaatttaaagaatttgctgcggggagaaaaagtctaacattaaacttaatcacggaaatgggacgtttaccgacgttcatgacacaaaaagctagaaacgcgctagataacctagcagtactacatacggccgaagctggcggaagggcctataaccatgcactctcagaactaccagaaacccttgagaccttactactattaactttactggctactgtaacaggagggatttttctatttctgatgagtggcaaggggattggaaagatgaccttggggatgtgttgcattattacagcatcaattctactctggtatgcccaaatacaaccccattggatagcggcgtccataatactagaatttttcttaatagtactactcatccctgaaccagaaaaacaaagaaccccacaagataatcaattgacatacgtcgtcatagctatactaacggttgtcgctgctactatggcaaatgaaatgggttttctagagaaaaccaagaaagactttggactggggagcatagcgacccaacaacctgaatcaaacattcttgatatagacctacgaccagcgagcgcatggacactttatgcggtagcaaccacgttcattacacctatgttgagacattccatagaaaattcatcggttaacgtaagccttactgcaatagccaatcaagcgacagtgctgatggggctgggtaagggttggccattatcgaaaatggatatcggcgtcccgctattagctatcggctgttattctcaagtaaatccgataactttgactgctgctctactactattagttgcacattatgctattattgggccggggctccaagctaaggccacgcgagaagctcagaaaagggcagcagcgggtataatgaaaaacccgaccgtagatgggataactgttatagatctagatcctatcccatacgatccaaaatttgaaaagcaactaggacaagtaatgctcctcgttctatgcgttacacaagttttgatgatgcgcactacttgggcgttatgtgaagcccttactttagcaacaggacctatatctactctatgggaaggaaaccccggtcgcttttggaatacgactattgccgtgagtatggctaacatttttagaggatcatatctagcaggcgcaggactattattcagcatcatgaaaaacacggcgaacaccagacgaggcactggtaacaccggagaaaccctaggggaaaaatggaaaaaccgcttaaatgcgctcggcaaatcagaatttcaaatatataagaaaagcgggatacaagaagtagatagaacacttgcgaaagagggtataaaaagaggagagacggatcatcatgcagtaagtcgtggttcagcaaagttacggtggttcgtagaaagaaacttagtaactcctgaaggtaaagttgtagatctaggatgtggaaggggcggctggtcgtattattgtggtggactcaaaaatgtaaaggaagtaaagggtttaaccaaaggtgggccaggacatgaagaaccaattcccatgtccacttatggctggaatctagtaagactgcaatcgggtgttgacgtgttctttacaccaccagagaaatgtgatacattactttgtgacataggagagtcaagtcccaatccaacggtcgaagctggtagaactctaagggtgctgaacttggtggagaactggctgaacaataacacacaattctgcataaaagtactgaatccttatatgccttccgtgatcgagaaaatggaggcacttcaaagaaaatatggaggggctctagtaagaaatccattatctagaaatagtactcacgagatgtattgggtcagcaatgctagcggaaacatagtatcgagtgtcaacatgatatcccgtatgttaattaaccgtttcacaatgagacataagaaagcaacttacgaacccgacgtagacctcggttctggcacaaggaatataggaatcgaatccgaaacaccaaatcttgacataataggaaagaggatagagaaaataaaacaagagcacgaaacatcatggcattatgaccaggatcacccttataaaacgtgggcctatcatggcagttatgagacaaagcaaacaggatctgctagcagtatggtgaacggcgtagtacggttattaacaaaaccctgggacgtgatccccatggtaacccagatggcaatgacagatacaactccgttcggtcaacaacgagtattcaaggaaaaggtagatacgcgtactcaagaaccaaaggaaggaacgaaaaagttgatgaaaataactgctgaatggttatggaaagaacttggtaaaaagaaaactcctagaatgtgcacacgtgaggagttcacgaggaaggtcaggtcaaacgcagcacttggagcaatattcactgacgaaaacaaatggaaatcagctagagaagccgttgaggattccggtttttgggagctagtagacaaggagaggaatcttcatctggaaggaaaatgtgaaacttgtgtatacaatatgatgggcaaaagagagaagaaactaggtgaatttggaaaagctaaaggatcaagagctatttggtatatgtggttaggagcacgtttccttgaatttgaagcgctaggatttcttaatgaagaccactggttcagtagagaaaactcgcttagcggagtcgaaggcgaaggtttacataaacttggatacatactaagggatgtgtcgaagaaagaaggtggtgccatgtatgctgatgatacagcgggttgggatacacgcataacattagaagacctcaaaaacgaagaaatggttaccaaccatatggaaggggaacacaagaaactcgcagaagcaatttttaaactaacgtatcaaaataaagttgttcgagtacaaagacccacacctcgaggaacggtaatggatattatctctagacgcgatcagagaggatctggacaagtggtgacttatggattaaatacattcactaacatggaagcccaactaataagacaaatggaaggagaaggcgtttttaaatcaatccaacagctaacagtgacggaggagattgcggtcaaaaactggctagtccgggttggccgagaaagattaagccgtatggcaatatccggggatgattgtgtagttaaaccattagatgatagatttgccagtgcgcttactgcgttaaatgatatgggcaaagttagaaaagatattcaacaatgggagccgtcaaggggttggaacgactggacacaagtaccattttgtagtcaccactttcatgaacttatcatgaaagatggacgagtattagtagtaccgtgtcgcaatcaagacgaattgatcggtcgcgcaagaataagccaaggagcaggatggtcgcttagagaaactgcatgtttaggaaaatcttacgctcaaatgtggtcattgatgtacttccatcgtagggatttacgactggcagctaatgcaatatgctctgcagtaccatcgcactgggtcccaacatctcgaacaacctggagtatacacgctacacacgagtggatgaccaccgaagacatgttaacagtttggaaccgagtctggatccaagaaaatccctggatggaagataaaacccccgttgaatcgtgggaggaaattccatatctaggtaaaagagaagatcaatggtgcggttcactaattgggcttacctctagagcgacttgggccaaaaatattcaaacggcgataaatcaagtacgatcactaatcggtaatgaagaatacacggactatatgccgtcaatgaaaagatttcgaagggaagaagaggaagccggagtactctggtga

SEQ ID NO: 22849 - RNA, 9876 nt, synthetic construct
  misc_feature 1..9876: note = derived and/or modified CDS sequence (opt6) from DENV-2__KC762673__SS-prME
  source 1..9876: mol_type = other RNA
acagcagggataatcattatgatgatcccaacagtaatggcatttcatttgacaactagaaacggagaaccgcacatgattgtaagtcgtcaagaaaaagggaaaagtctcctatttaaaacagaaaacggagttaatatgtgtacacttatggcaatggatttaggagaattatgtgaagacacgattacttataactgcccgttattaaggcaaaatgaaccggaagacattgattgttggtgcaacagtacgtcaacatgggtcacatatggaacttgcactgcaacgggggaacatagacgggagaaaagatccgtcgctttagtgccacatgtcgggatgggactcgaaactagaacggaaacatggatgagttcggaaggagcatggaaacatgctcaaaggattgaaacgtgggtattacgacacccaggatttactataatggctgcaatccttgcgtataccataggaacaacccacttccaaagagtattgatattcatcttactaacagcagtggcgccgtcgatgacaatgaggtgtataggaatatcgaatcgcgatttcgtggaaggagtatcaggagggagttgggttgacattgtattagaacatggaagttgcgttacaactatggccaaaaataaacctacgctagactttgaactaataaaaactgaagcaaaacacccagcgacgcttcggaaatactgtatagaagcaaaacttacaaatacgacaacagctagcagatgcccgacacaaggagaaccgtctttaaacgaagaacaagacaaaagatttgtttgcaaacattctatggtagatcgcggttggggaaatggttgtgggttgtttggaaaaggtgggattgtcacctgtgctatgtttacatgtaaaaagaatatggagggaaagatagtccaaccagaaaacctagaatataccatcgtcataacaccacacagtggagaagaaaatgcagtaggaaatgacactggtaaacatggtaaagaaatcaaagttacgccccaaagctctataacggaagcagagctcactgggtacggaacggtcacaatggaatgcagcccgcgcacaggtctagattttaacgaaatggtgttattacagatggaaaacaaagcatggttagtgcaccgccagtggtttttagacttaccattaccttggctaccaggtgcggatacgcaaggaagcaattggatccaaaaagagaccctggtaaccttcaaaaatccacatgctaagaaacaagacgtagtcgtgctcggaagtcaggagggcgcaatgcacaccgcgttaacaggcgcgacagaaattcagatgtcatcgggaaacttattgtttaccggacatttgaaatgcaggttaagaatggacaaattacaattaaaaggtatgtcatattcaatgtgcacaggcaaattcaaagtcgttaaagaaatagctgaaacccaacacgggactatcgtaattcgagtacagtatgaaggggatggatcaccttgcaaaataccgttcgaaatcatggatctagaaaagaggcatgttcttggaagactgattacagtcaatccaatagtcacagaaaaggatagtcccgttaacatagaggcagaaccacccttcggtgatagttacatcataataggagtagaacccggtcaactcaaactatcctggtttaagaaaggctcaagcatcggacagatgtttgaaacaactatgcgtggtgcgaagagaatggcaatattaggagatacagcgtgggattttgggagtctgggtggagtatttaccagtataggaaaagcactacaccaagtatttggagcgatatacggagcggcattctcaggagtaagttggacgatgaaaattttgataggggttgttataacatggataggcatgaacagcaggagcacaccgctctccgtaagcctagttctagtaggtgtggtaacactatacttaggagtaatggttcaagctgattcaggctgcgtggtgagctggaaaaacaaagaactcaaatgtggcagtggaatattcatcacagacaacgtccacacgtggactgaacaatacaagtttcaacctgaatcgccaagtaaactggccagtgctatacagaaggcccatgaagaagggatatgtggcatcagaagtgtcacacggttagagaatttaatgtggaagcaaataactccagaactaaatcacatattatcggagaatgaagttaaattgacaataatgaccggagatatcaaaggcattatgcaagctggtaagcgttctcttcgtccgcaaccaactgaacttaagtatagttggaaaacgtggggcaaggccaagatgttgtctaccgaattgcacaaccatactttcttaatagacggaccagaaactgctgaatgcccaaacacgaaccgggcctggaactctttagaagtcgaagattacggattcggtgtcttcacaacaaacatctggctaaaattaaaagagcgtcaggacgtgtactgcgatagcaagctgatgagtgctgctattaaagacaatcgagcagtacacgcagacatgggatactggatagaaagcgcgctaaacgatacgtggaaaattgaaaaggcttcatttatagaggtaaaatcatgttactggccaaaatcacatactctctggtcaaatggagttctagaaagtgaaatgatcataccaaagaattttgctggtccagtaagtcagcataactatagaccaggttatcacacacaaaccgcaggaccatggcatttaggtaggttggaaatggatttcgacttttgcgaaggtacgacggtagtagtgactgaagactgtggtaacagaggtccaagtttgcgcaccacaactgcatcaggaaaattaatcacagaatggtgttgtagaagctgtacgctaccacctcttcggtatcgcggagaagatggctgttggtatggaatggaaattcgaccattaaaagaaaaggaagaaaatctggttaacagtttggtcaccgcgggacacggacaaatagataatttctcactaggagtactgggcatggcattatttctcgaagaaatgttgcgtacaagagtaggtacaaaacatgctattctcttagttgcagtaagttttgttactcttataactggtaatatgtctttcagagacttgggtcgcgtaatggtcatggtcggtgctacaatgacagacgacatcggaatgggagttacataccttgctttattagcggcctttaaagttagaccaacattcgccgctggcctgctattaagaaaattaaccagtaaagaattaatgatgacaacaataggaatcgtcctactctcccagagtacgattcccgaaacaatattagaattaacagacgccttagccctaggaatgatggctttaaaaatagtgaggaacatggaaaagtatcagcttgcagttacgataatggcaatattgtgtgtgccaaacgcagttattttacaaaacgcgtggaaagtatcatgcactacactagccgttgtctcagttagtcctttattattaacctcaagccaacaaaaggccgattggattcccctggcgttgacaataaaagggttgaatcctacagctatatttttaactacgttgagtcgtacctcaaagaagagatcatggccattaaacgaggcgatcatggccgtgggtatggtgtctattctagcttcatcgctattgaagaatgacataccaatgaccggacctttagtcgcgggaggactactcacggtatgttacgtcttaacagggcgcagtgcagacttagaattagaaagggcagcggatgtaagatgggaagaacaagccgaaatttcaggaagttcgcccatcttatcaataactattagcgaagatggatccatgtccatcaaaaatgaggaagaagaacagacactcactatacttatccgcactggcttgctagtcatatcaggcctattcccagtgtccatccccataacagcagcagcctggtacctttgggaggtgaagaaacagcgtgccggagttttatgggacgttccgagtccccctccagttggaaaggcagaattagaagacggagcgtacagaattaaacagaaaggaatattagggtatagtcaaattggtgcgggagtgtataaagagggcacttttcacactatgtggcatgtcacacgcggcgctgtattaatgcacaaaggtaagcgaatagaacccagttgggcagatgtcaaaaaggatctgatttcttatggaggcggctggaaactggaaggagaatggaaagaaggagaagaggtccaagttctcgctctagaaccaggcaaaaatcctagggcagtacagacaaagccaggtttatttaagaccaatactgggactataggtgcggtcagtttggacttcagtccgggtacatcagggagccccattgtagataaaaagggaaaggttgttgggctctatggcaatggagttgtcactagaagtggaacatatgtaagtgcgattgcccaaacagagaaatctattgaagacaacccagaaatcgaagatgacatatttcgcaagaaaagactaacgatcatggatctgcatccaggtgcgggtaaaacaaagaggtacctccctgcaattgttagagaagcaataaaaagaggactgcgcactcttatattagctcccaccagagtcgtggccgcagagatggaggaagcactaagagggctaccaatacggtatcagactcctgctataaaagcggaacacactggcagagagattgtggacctcatgtgccacgcgacgtttacaatgagactattaagcccaattcgagttccaaattacaatctcattattatggatgaggcacattttactgatccagcttcaatagcagcaagaggctatatctcaaccagagttgagatgggagaagcagctggcatattcatgaccgcaacaccccctggatccagagacccgttccctcaatcaaacgcccccattatggatgaagaacgagaaatacctgaaaggtcatggaatagtggacacgaatgggttaccgactttaaaggtaaaactgtttggttcgttcctagtattaaggctgggaatgacatcgcagcgtgcctgaggaaaaacggtaagaaagtaatacaattgagtcgtaaaacgttcgacttcgaatatataaaaacaagaacaaatgattgggatttcgtcgttacaactgatatctcagaaatgggagccaattttaaagccgaaagggtaatcgatcctcgccgttgtatgaaaccggtaattttaacagatggtgaagaacgagtaattctggcaggacctatgcccgtaacgcactcttctgccgcacaacgtcgaggacgagtgggaaggaatcctaagaatgaaaacgaccaatatatatatatgggcgaacctttagaaaacgatgaagactgcgctcactggaaagaggcaaaaatgttactagataatatcaataccccggagggtataatcccgagtatgtttgaacctgaaagggaaaaagttgatgccattgatggcgaatatcgtctaagaggtgaagccagaaaaacatttgtagacttgatgaggcgtggcgatttacctgtatggcttgcgtatagagtcgccgcagaagggattaactacgccgatagacgatggtgcttcgatggagtgaaaaataatcaaatactagaagaaaatgtcgaagtagaaatatggacaaaggaaggagaaaggaagaaactgaaacctagatggttagacgcgcggatatactcagaccctttagcacttaaagaatttaaagaatttgccgccggaagaaagtcgctaaccttaaatttgatcacagaaatgggtcgattgcccacatttatgacccaaaaagctagaaatgcattagataatctagcggtccttcacaccgcagaagctggtggcagagcctataatcatgcgttaagcgaacttccagagaccctagaaacgctacttctattaactttattagcgacagtaactggaggaatatttttgttcttaatgtcaggcaaaggcataggtaaaatgactctcggaatgtgttgtattataacggccagcatacttttatggtatgcgcaaatacaaccacattggatagctgcaagtataatattagagttctttttaatagtcctattaatcccagaaccagaaaagcaacgtactccacaagacaatcagctgacatatgtcgtcattgcaatcttgacggtagttgctgcaacgatggcaaacgaaatgggattcttagagaaaaccaagaaagattttggtttggggtcgatcaccacgcagcaaccagaaagcaatatattagatattgatttgagaccagcttcggcatggacattatacgcggtggctacgacattcattacaccaatgttgagacatagcatagaaaattcatcggttaatgtttcattaaccgctatcgcaaatcaagctactgtccttatgggcctcggcaaaggctggcccctatctaaaatggacataggggtaccgttactagccattggttgctattcacaagttaatccaattacactaacggctgcattacttttacttgtagcacattacgccataattggacccggactgcaagcgaaagcaacaagagaagctcagaaaagagcagctgcaggtataatgaagaacccaacagttgacggaatcacagtaatagatttagaccctattccctatgatcccaaattcgaaaaacaactagggcaagtgatgttacttgtactttgtgttacacaggttctcatgatgagaacgacatgggcattgtgtgaagcattaactctggccaccggaccaataagcacattatgggagggaaaccctggaaggttttggaacactacaatagcggtaagcatggcgaatatatttcgaggatcttacctagccggagccgggttgttatttagcataatgaaaaacacagcgaacactcgtcgaggcacagggaatacgggcgaaacattaggagaaaaatggaaaaatcgcttaaatgcactaggtaaatctgaatttcagatatacaagaaatcaggaatacaagaggttgacaggacattagctaaagagggcattaagaggggcgaaacggatcaccatgcggtctcacgaggctccgcaaaactaagatggttcgtagaaagaaatctagtcactcctgaaggaaaagtcgtggacttaggttgtggcagagggggctggtcatattactgcggagggttaaagaatgtgaaagaggtcaaaggcctgacgaaaggaggaccgggccacgaggaacctattcctatgtctacatacggttggaatttggtaaggttacaatcgggagttgatgtgttctttacacctccggaaaaatgcgacacgctcctctgtgacattggagaatccagtccgaacccaacagttgaagcaggccgaacacttcgagttctaaatttagtagaaaactggttaaataataacactcaattctgtataaaagtactaaacccatacatgccttcagttatagagaaaatggaagcacttcaaagaaaatacggcggtgccctagtaagaaacccactaagccgaaactcaacccatgaaatgtattgggtatccaacgcatccggcaacatagtaagctcagttaatatgatatcgcgtatgttaatcaatcgattcactatgcgacataagaaagccacatatgaacctgacgtagatttgggatcaggcactcgtaatattggaatcgagtctgaaattccgaatttagatataattggtaaacgaatagaaaagattaaacaagagcacgaaacaagctggcactatgatcaagatcacccttatcgtacttgggcctaccatggaagttatgagaccaagcagacagggtcagcatcaagcatggttaacggagtagtgcgattactcaccaagccgtgggacgtcattccgatggtcactcaaatggctatgaccgatacaacgccatttggacaacaaagggtgtttaaagaaaaagtagatacacgaacccaagaaccaaaagaaggaactaagaaactaatgaagataacagccgaatggctctggaaagaactcggcaagaagaaaacaccgcgaatgtgtacaagggaagaatttacacgtaaggtaaggtctaacgcagcattgggagccatctttacagacgagaacaaatggaaaagcgctcgagaagcagtcgaagattcggggttttgggaattagttgacaaggaacgaaatttacatctagagggaaaatgcgaaacatgcgtttacaatatgatgggtaaaagggagaagaaactcggggaatttggaaaagctaaaggaagccgagcgatttggtacatgtggttaggagctaggtttctagaatttgaggcgttaggttttctgaacgaagaccactggttttcccgggaaaacagtctaagtggggttgaaggagaaggattacacaaacttggatatattctcagagatgtatctaaaaaggaaggaggggcaatgtacgctgatgacactgcaggatgggacacaagaataactctcgaagaccttaaaaacgaagaaatggttacaaaccatatggaaggggaacataaaaagctggctgaggctatatttaaattgacttatcaaaacaaggtcgtaagagtacaaagaccgactcctcgaggcaccgtaatggatataatatctagacgcgatcaacgcgggtcaggacaggtagtaacttatggactgaacacattcacaaatatggaagcacaattaattcgacagatggaaggcgaaggcgtatttaaatccatacagcaactaaccgttacggaagaaatcgccgtcaaaaactggcttgtaagagtcggaagagaacgactaagtagaatggccatttcaggggacgattgtgttgtcaaaccattagacgaccgtttcgcttccgcattgactgctttaaacgatatgggaaaggtccgaaaagacattcaacaatgggaaccaagcagagggtggaatgattggactcaagttccgttttgtagtcatcattttcatgaattaattatgaaagatggcagagtactcgttgtcccatgcagaaatcaagatgaactaattgggagggctcgcatcagccaaggcgccggctggagtctccgagaaacagcgtgtctaggaaaaagctatgcacaaatgtggagcttaatgtattttcaccggagagatctgaggttagccgcaaacgcaatatgcagcgccgttccttcgcactgggtacccacatcacggactacatggtcaattcatgccactcacgaatggatgactaccgaagacatgctgacagtatggaacagagtttggatccaagaaaacccatggatggaagataaaacacctgtagaaagctgggaagaaatcccatatttgggcaaacgagaagatcaatggtgcggttcactaataggactaaccagtagagcgacttgggccaaaaacattcaaacagcgataaatcaagtacgctcgctgatcggcaatgaggaatatacggattacatgccgagcatgaagagatttcgcagagaagaagaagaagctggagttctatggtag

SEQ ID NO: 22850 - RNA, 9876 nt, synthetic construct
  misc_feature 1..9876: note = derived and/or modified CDS sequence (opt6) from DENV-2__KC762663__SS-prME
  source 1..9876: mol_type = other RNA
acggctgggattataatcatgatgataccgactgtaatggcatttcatttaactacgagaaatggggaaccacacatgatcgtaagtcgtcaagaaaaaggaaaatctttgttgtttaaaaccgaaaatggagtaaacatgtgcaccttgatggcaatggatttgggagagttatgtgaggataccattacttataactgtccattactcagacaaaatgaacctgaagacattgattgttggtgtaacagcacctctacatgggttacatacggaacttgcactgctacaggagagcatagaagagagaaacgttcagtggctttagtaccacatgttggaatgggattagaaacacgaactgagacatggatgtctagtgaaggggcatggaaacacgcacagcgcattgagacatgggtattacgacacccaggattcaccataatggctgcaatcttagcatatacaataggtactacctattttcaaagagtgttgatatttatactgcttacggcagtaacaccatcaatgactatgagatgtatagggattagcaacagggactttgttgaaggcgtatcaggcggctcatgggtagacatagttctagagcacggtagctgcgttacgacaatggccaaaaacaaacctaccttagacttcgaattaattaaaacggaagcaaaacacccagccactttacgaaaatactgtattgaggctaaactaacaaacactacaacagcatctagatgcccaacccaaggagaaccctcattaaatgaggaacaagataaaaggtttgtatgtaaacacagtatggtcgacagaggatggggaaatggctgtggactattcggaaaaggtggtatcgtgacatgcgctatgtttacgtgtaagaaaaatatggaggggaaaatagttcaaccggaaaatctagaatatacaattgttataacaccccactcaggggaggagaatgcggttggtaatgatacaggcaaacatggaaaagaaattaaagtaacaccgcaatcgtcaatcaccgaagcagaacttacaggatatggaacagtcactatggaatgctctccccgtaccggtctagacttcaacgagatggttttactacagatggagaacaaagcctggctggtgcatagacaatggttccttgatttacccctcccatggcttccaggagctgatactcaaggatctaattggattcaaaaagaaactctggtgacctttaaaaatcctcacgccaagaaacaagatgtagtagtattgggatctcaagagggggccatgcacacagccctgacaggagcaacggagattcagatgagttcgggtaacttattattcaccgggcatctgaaatgccggctgagaatggacaaacttcagctgaagggtatgtcctattcaatgtgcacgggtaagtttaaagtggtcaaagaaatagcagaaacacaacacggaacaatagtcatacgcgttcaatatgaaggagatggttccccatgtaaaataccgtttgaaataacggatcttgaaaaacgacatgttctaggaagattaataacagttaacccgatagtcaccgaaaaggattccccagtaaatatagaagcagaaccaccgttcggagatagttatatcattataggggtagagccaggacagctaaaactaagctggtttaagaaaggaagttcaattggtcaaatgttcgaaactactatgagaggggcaaaaaggatggcgatcctgggcgatacagcgtgggacttcggaagcctcggtggtgtattcacaagtataggaaaagcgcttcatcaagtattcggtgctatttatggagccgcatttagtggagtgtcatggactatgaaaattctcattggtgttgtgattacttggatcgggatgaacagccgttcaacatccctctcggtatcactggtcctagtaggggtggtgactttataccttggagtgatggttcaggctgacagcggatgtgtggtctcatggaaaaataaggaattaaaatgtgggtctggtatttttattactgataatgtccacacgtggaccgaacaatataagtttcagccagagagcccctctaaattggcatctgcgatccaaaaagcacatgaagaaggaatctgtggaataagatcagtcacacgcttggaaaatttaatgtggaaacaaattactccggagctaaatcacatcctcagcgagaacgaagtaaagttaactataatgacaggtgatataaaagggatcatgcaagctggtaaacgctcactaagaccacagcctacagaacttaaatactcatggaaaacttggggtaaggccaaaatgctaagcacagaattacataaccacacatttttaatagacggccccgaaacagcagagtgtccaaatgctaacagagcatggaatagcctagaagtagaagactatgggttcggagtattcacaaccaatatatggttaaaattaaaggaaaggcaagatgcattttgtgacagtaaattgatgagcgcagccataaaagataatcgagccgttcatgctgatatgggatattggatagagtcagcactaaacgacacctggaaaattgaaaaagcgagctttatagaagttaaatcatgtcactggccaaagtctcatacactatggagtaatggggtactggaatcagagatgataattcccaaaaattttgccgggccggtttctcaacataactaccggccgggttatcatacacagacggcaggtccatggcatttaggacggctagaaatggattttgatttttgcgaaggtactacagtagtcgtgactgaagactgcggtaaccgaggaccatcactgagaacaacaacagcgtcaggaaaactaattacagaatggtgctgcagatcctgcacattaccaccgctaagatatcgcggagaagatggatgctggtacggaatggaaattaggccactgaaggaaaaagaagagaatcttgtaaatagtttagtaactgccggccacggtcaaattgataatttctcgttaggtgttttaggaatggcactttttcttgaagagatgttacgtacaagggtagggactaaacatgcgatattattagttgcagtcagctttgttactcttatcactggtaacatgagttttcgagaccttgggcgagtaatggtcatggtgggtgcaactatgacagacgatatcggaatgggtgtaacgtatctagcactactcgccgcttttaaggtaaggcccacatttgccgcaggattgttgctaaggaaactgacaagtaaagaattaatgatgacaactatagggataacactactaagtcaaagcactataccagaaacgatacttgaattaacagatgctctcgccctcggaatgatggtcctaaaaatcgttcgaaatatggaaaaatatcagttagctgttacaataatggcaatattatgcgtgccaaatgccgtaatacttcaaaatgcgtggaaggtatcatgtacgacattagccgtagtaagtgtatcaccactattattgacgtcctcccaacaaaaagctgactggatccccctagcacttacgattaaaggtctaaatccgacggcaatctttctaacaacactctcaaggacaagtaagaaacgctcgtggcccctaaatgaggcaattatggcagtaggtatggtatcaatacttgcttcctctttgttaaagaatgatattcctatgacaggacctttagtggccggaggattactaacagtgtgttatgtcctaaccggccggagtgcagacctagaactcgaacgagccgctgacgtcagatgggaagaacaggctgaaattagcggatctagtcctatcttaagcataacaatatcagaagacggatcaatgtcaatcaaaaatgaagaggaagaacaaacactcactatactgattagaactgggttattggtaatatcagggctatttcccgttagcatcccgataacagcagcagcctggtacttatgggaagtcaagaaacaaagagccggtgtgttatgggatgtaccttcacctcctccagtggagaaagcagagcttgaagatggagcttatcgcataaaacaaaaaggaattttaggatacagtcagataggagcaggagtttataaggaaggtacttttcatacaatgtggcatgtgacacgaggtgctgtacttatgcataagggtaaaagaatagaaccttcatgggctgatgtgaagaaggatcttataagctatggaggtggctggaaattagaaggagaatggaaagaaggagaagaggtgcaagtactagcgttggagcctggcaaaaatccaagggcagttcagacgaaacctggactgtttaaaacatctactggtacgattggagctgtatcattagatttttcacccggtacaagtgggagcccgattgtcgacaagaaaggaaaggtagttggtctgtatggaaacggagtggtgacaaggagcgggacgtacgtctccgcgatagcccagacagaaaaatcaatagaagataatccagaaatcgaggacgacatttttagaaagaaaaggctcacgattatggacttacatcctggagcagggaaaacaaaacgatatctaccagccatagttcgagaagcaattaagagaggcttacgaacactaatattagctccaacgcgagtagtagctgcagaaatggaagaagcgctgagaggactaccaatccgctatcagacgccagccatcagagctgaacacacaggaagagaaatagtcgatctgatgtgccatgcaacgtttacaatgcggttacttagccctattcgtgtaccaaattataatctgattataatggacgaagcacacttcactgaccctgcatccatagccgccaggggatacatatccactcgagtggaaatgggagaagcagctggaatctttatgactgcaacaccacccgggtcccgagacccatttccacagtccaacgcacctattatggatgaagaaagagagataccagaaagatcctggaactctggccatgaatgggtgactgattttaaaggaaaaacagtatggtttgtcccatctataaaagcaggcaacgatatagcagcgtgtttacgtaaaaatggcaagaaagtgatacaactttcaaggaaaacttttgactttgaatatataaagacaagaaccaatgattgggatttcgtcgtgacgacggatattagtgaaatgggagcgaattttaaggcagagagagttatcgatcctaggaggtgtatgaaaccagttatcctaacagacggtgaagaacgagtaatactcgctggccccatgccggtaacccactccagtgcggcgcaacgtagaggacgagtaggcagaaatccaaagaacgaaaatgatcaatatatttatatgggtgaaccattagaaaatgatgaggattgcgcccactggaaggaagccaagatgctcttagacaacattaacacgccagagggcatcattccatctatgttcgaaccggagagggagaaagtagacgcaatagacggagaatatcgattacggggagaagcccgcaagacttttgtagacctaatgaggagaggggacctgccagtatggctagcttatagagttgctgcagaaggtattaattatgctgatcgcagatggtgctttgacggagttaaaaataaccagatattagaagagaatgtagaggtggaaatatggactaaagaaggagagcgtaagaaacttaaacccaggtggttagacgcgagaatctattccgacccattagcgcttaaagaatttaaagagttcgctgctgggcgaaaaagtttaacattgaatcttattaccgaaatgggtaggttaccaacttttatgacacagaaagctaggaacgctttggacaaccttgcggtgctacacacagccgaagctggaggaagggcgtacaatcacgcgctaagtgaactgcctgaaacattggaaactttgctattactaactttactcgcgacagtaactggtggtatttttctcttcctcatgtcaggcaagggtatcggcaaaatgacattgggcatgtgttgcatcataacagcaagcatacttctctggtacgcccagatacaaccacattggatagctgcatccattatactagagttctttcttatagtactcttgataccagaaccggaaaagcaaagaacaccacaagataaccaattaacttacgtcgtaatagccatactgacagtagtagcagctactatggccaacgaaatgggattccttgaaaagactaagaaagatttcgggcttgggtcaatcacgacgcaacaacccgaaagcaatattctcgatatcgatttgcgaccagcttccgcttggacactttatgctgttgccacaacatttataacaccaatgctcaggcattccatcgaaaatagcagtgtcaacgtaagcctcaccgctatcgcaaaccaagcaacggtattaatgggattaggtaaagggtggcctttgtctaaaatggacattggggtgccccttctggcaataggctgctactctcaagtaaacccaatcacgctaacagccgctctgcttttgcttgttgcacactacgccataatcgggccaggactacaagcaaaagcaactcgtgaagcgcaaaaacgcgcggcggcagggattatgaaaaatccgactgttgatggtatcactgtaatcgacctagaccctataccatatgaccctaaattcgaaaaacaactaggccaagtaatgctattagttctatgcgtaacacaagttctgatgatgcgcactacgtgggccctatgcgaggctttaactctggcaacgggacctataagcacactttgggagggaaatccaggaagattttggaacactactatagctgtaagcatggcaaatatatttcgaggctcatacttagcaggagcgggcctattattcagtataatgaaaaatacagccaacaccagaagaggaacgggaaacactggagaaaccctaggagaaaagtggaaaaaccgcttgaatgcactcgggaaaagcgagtttcaaatatataagaaatcaggcatacaagaagttgacagaacactggcaaaggagggtataaagaggggagaaaccgatcaccacgccgtctccagaggaagtgctaaactgaggtggtttgtcgaaagaaacttagtaacaccggaaggaaaagtagtagatttaggatgtggtagaggtggttggtcatactactgcgggggtctgaaaaacgtgaaggaggttaaaggcctaacaaaaggtggacctggacatgaagaaccaatccccatgtcaacttatggttggaatctggtgcgactacaatctggggtagatgttttcttcaccccaccagaaaaatgtgataccttattgtgtgatatcggagagtcgtcaccaaacccaacggttgaggcaggtagaaccctaagggtattaaatctggtagaaaactggctcaacaataacacgcagttttgcataaaggtattaaatccttatatgccgagtgtcattgaaaagatggaggcgttacaaagaaaatatggtggagcactcgtgcggaatccattatctagaaattcaacacacgagatgtactgggtatcaaatgcaagcggcaacatagtaagttctgtaaacatgatctcaaggatgcttataaacaggtttacaatgagacataagaaagctacgtatgaacctgacgtggatctaggatcgggaacacgaaatatcgggatcgaatccgaaacgccgaacttggatataataggcaagcggatcgagaaaataaaacaggagcatgaaacatcatggcattacgatcaagatcacccatataaaacatgggcatatcatggtagctatgagacgaagcagacaggctctgctagctcaatggtaaatggggtagtaagacttttaactaaaccatgggatgtaattccgatggtaactcaaatggccatgactgacacaactccgtttggtcaacaaagagtattcaaagaaaaagttgacacaagaactcaggagcccaaagaagggacgaaaaagttaatgaaaatcacagcagaatggctctggaaagagctcggcaaaaagaaaactccgcgaatgtgtacgcgtgaagagttcacaagaaaggtccgttcaaatgctgctttaggagcgatattcaccgacgaaaataaatggaaatcggcaagagaggcggttgaagattcgggattctgggagcttgtagacaaggagcgcaatctacacctagaaggcaaatgtgaaacttgcgtatataacatgatgggtaaacgagagaagaaattaggtgagtttggaaaagctaaaggatcacgagctatttggtatatgtggttgggtgcacgatttttagagttcgaagctctaggatttctaaacgaagaccactggttctcaagagaaaactcgctaagtggagtagagggtgagggtttacataaattagggtatatactacgtgatgttagtaagaaagaaggtggggctatgtatgccgatgacacagcgggttgggacacacgcatcaccctagaggatttaaagaatgaagagatggtcactaatcatatggaaggagaacacaagaaactagcggaggccatatttaaattaacctaccaaaataaggttgtaagagtgcaacggccaactccgcgtggtacagttatggacattatatcacgacgtgaccagcgtggatcaggacaagttgttacgtacggcttgaacacattcactaatatggaagcccaattgattcgacaaatggaaggagaaggagtctttaaatcaatacagcaattgaccgtaacagaagaaatagcagtgaaaaattggcttgttaccgtaggtagagaaagattatccagaatggcaataagtggagatgattgtgtagtgaaacctctagacgatagattcgcatcagcattaacagcgttaaacgatatgggaaaggtcaggaaagatattcagcaatgggaaccttcccgaggatggaatgattggacacaagtccccttttgctctcatcacttccatgagctcatcatgaaggatggtagggtgttggtagtaccttgccgcaaccaagacgagttaataggcagagcgagaatatctcaaggcgctggatggtctttgagagaaacagcttgcttaggaaagtcatacgcacaaatgtggagccttatgtattttcaccgtagagatttgaggctagctgctaatgccatatgttcagccgtcccttcacattgggttccaacctcaaggactacttggagcatacatgcaacgcatgaatggatgacgaccgaggatatgttaacagtatggaacagggtatggatacaagaaaatccgtggatggaagataagacaccggttgaaagctgggaagaaattccctacctaggtaaaagagaagatcaatggtgcggtagtttgatagggttaacctctcgagctacttgggccaaaaacatacaaaccgcaataaatcaagtgagatcgcttataggtaatgaagaatatacggactatatgccgtcgatgaaaagatttcgaagagaagaagaagaggcaggcgtattgtggtag

SEQ ID NO: 22851 - RNA, 9876 nt, synthetic construct
  misc_feature 1..9876: note = derived and/or modified CDS sequence (opt6) from DENV-2__KC762675__SS-prME
  source 1..9876: mol_type = other RNA
acggcaggtatcataataatgatgatacctacggtaatggcattccatctcacgacacgaaacggtgaaccgcatatgatagtaagtcgacaagaaaaaggtaaatcgcttctatttaaaacggaaaacggtgttaatatgtgtactctgatggcaatggacttaggcgaactatgtgaagacaccataacctataattgccctctactaagacagaacgaaccagaagacatagattgctggtgtaattccacctctacttgggtaacctatgggacctgtacagcaacaggagaacaccgaagagagaaaagatccgtcgcattagtaccacatgtaggaatgggtttagaaacgagaacggaaacatggatgtcgtccgaaggcgcatggaaacacgcacaaagaatcgaaacgtgggtacttagacatccaggtttcacaataatggcagcaatactggcatacacgataggcacaactcattttcaaagagtcttaatatttatacttctaacagcagtagcgccaagtatgacaatgagatgcatcggaatttccaatcgagactttgtggaaggggtatctggtggatcatgggtagacatcgtattagaacacggtagttgcgttaccacaatggccaaaaacaaaccaacccttgatttcgaattaatcaaaacagaagcaaaacatcctgcaaccttgagaaaatattgtattgaagcaaaattaaccaacactactactgcatcaagatgccccacacaaggtgaacccagccttaatgaagaacaggataaacggttcgtttgcaaacattctatggtagaccgtgggtggggcaatggctgcggtctgtttggaaaaggaggaattgttacctgtgcgatgttcacttgtaaaaagaacatggaaggcaaaatcgtgcagcctgagaatctcgaatataccattgtaataacgccacactctggcgaagaaaacgcagtaggtaatgatacaggtaaacatggaaaagaaataaaagtaactccacagtcatcaataacagaagccgaactaacaggttacggtacagtaactatggaatgtagtccaagaacgggattggatttcaacgaaatggtgctactacaaatggaaaataaagcatggctggtccatagacaatggttcctagacctgcctctcccgtggctgcccggcgcagatacacaaggttcaaattggattcaaaaagaaacccttgtgacatttaaaaacccacacgctaagaaacaagatgtagtagtactggggtctcaagaaggagcaatgcatacagcgttgacgggagctacagaaatacaaatgtcatcaggaaatctattatttactggacacctaaaatgtagactcagaatggataaactacagttgaaaggaatgtcttacagtatgtgtacaggaaaattcaaagtagttaaagaaatagctgagactcagcacggtaccattgtaattcgtgtacaatacgaaggtgatggcagcccatgcaaaataccttttgaaataatggacctagagaaaagacatgtgttgggtcgattgatcacagtaaacccaattgtgacagagaaggattctccagtaaacatcgaagcagaaccaccctttggcgactcgtacatcatcataggagttgaacctggccaactgaaactatcatggttcaagaaaggtagctctatcggacaaatgttcgaaacgacgatgcgaggtgctaaacgaatggcaatcttgggcgatacagcatgggattttgggagtctcggtggagtgttcacaagtattggcaaggctctacatcaggtctttggagcgatatacggcgccgcattcagtggtgtaagttggacaatgaaaatactaatcggggttgtaattacttggatcggaatgaactcacgcagtacttccttatcagtatcgttggtattagttggggtagtaacattatatcttggagtaatggtgcaagcagacagcggatgcgttgtatcttggaaaaacaaagaactcaaatgtgggtcaggcatcttcataacagacaatgtacatacatggacggaacagtataaatttcaaccagaaagtccttcgaaattggctagcgctattcagaaagcgcatgaagaaggcatatgcggaattagatctgtcactagattagagaacctcatgtggaaacaaataactccagaattaaaccatatattaagtgagaatgaagtcaagttaaccataatgacaggagacattaaagggattatgcaagcaggtaaaagatctttaaggcctcaaccaacagaattaaagtattcatggaaaacatggggcaaagcgaagatgttgtcaacagaacttcataaccatacctttttgatcgatggaccggagaccgccgagtgcccaaacactaatcgtgcatggaacagccttgaggtggaagattatggttttggagtgtttactacaaacatatggcttaagttaaaagaaaggcaggacgtttactgtgactcgaaactaatgtctgcggctattaaggacaaccgggcagtacacgccgatatggggtactggattgaaagcgcattaaatgatacctggaaaattgaaaaagcatcatttatcgaagtcaaatcctgttactggccgaagtctcatacgttatggtctaacggagtattggaatcagagatgatcatacccaaaaatttcgccggacccgtgtcacaacacaactaccgcccaggttaccacacccaaacagcgggcccgtggcacctaggaaggttagaaatggattttgacttttgtgaaggaacaacagtagtagtgacagaagattgtggaaatcgaggcccttcacttagaactacaaccgctagtgggaaactaatcacagaatggtgttgtagaagttgcacacttcctcctttaagatatcgtggagaagatggatgctggtatggaatggagattaggcccttgaaagagaaagaagaaaacttagtaaactcattagtgactgccgggcatgggcaaatcgacaacttttctttgggggttcttggaatggcactatttttagaggaaatgctccgcaccagagtaggtactaaacacgctatattattggtagcggtatcttttgtcacccttatcacaggtaatatgtcatttagagatctgggaagagttatggtcatggtaggtgcgacaatgactgatgatataggcatgggagtaacatacttagcactgcttgcagcgtttaaagtgcggccgacgttcgcagctggcttgttattaagaaaactaacatcgaaagagttaatgatgacaacaattggaattgttttactctcccaatcaaccattccagaaactatcctagaacttaccgacgcactggcattaggaatgatggcacttaaaattgttcgaaacatggagaaataccagcttgcagtcacaattatggcaatattatgcgtaccaaatgctgtaatattacagaatgcatggaaagttagttgtacaacattggctgtagtttcggtttcgccgttactacttaccagcagccaacagaaagctgattggataccgctagctctaacaattaaagggttaaaccccacagcaatcttcttaactaccttaagtagaacatcaaagaaacggtcttggccactcaacgaagccataatggcggtcggtatggtaagcatcttagcctcatcgttactcaagaacgatattccaatgacagggcctctagtagcaggcggattattaacagtttgctacgtacttacgggaaggtcggctgatttagaattagaaagagcggccgacgtgcgatgggaggaacaagctgaaatctcaggatcatccccaatactatctataactatctctgaggacggatctatgtccattaagaacgaagaagaagaacaaacgttaacaatactaataagaaccggtctgttagtaatatcgggtctatttccagtgagtataccaataactgctgctgcgtggtatctctgggaggtaaagaagcagagagccggtgttttatgggatgtcccaagccctcctcctgtgggcaaagcagagttggaggacggggcgtaccgtataaaacaaaaaggaatattaggatattcacaaataggagccggagtatacaaggaaggcactttccacacaatgtggcacgtaacacgaggtgcagttctgatgcataagggaaaaagaatagaaccgtcatgggccgatgtcaagaaagacttaatctcgtacgggggtggctggaaacttgaaggagaatggaaggagggggaggaggttcaggtactagccttagaaccaggcaaaaatccgagagctgtacagacaaaaccaggcttgttcaaaacaaatactggaacgataggagctgtatcacttgacttcagccctggtacctctggatcaccaattgtagataagaaaggcaaggttgttggactttacggaaatggggtggtaacgcgatccggaacgtatgtatcagctatagcgcaaaccgaaaagagtatagaagataatcccgagattgaggatgacattttcaggaagaaacgattaactattatggatttacacccaggagcaggaaaaacgaaacggtaccttcctgccattgtcagagaggcaataaaacgcggactcagaactctaatactcgcccctacacgtgtagttgccgctgaaatggaggaggcattgaggggactaccaataagatatcaaactccagcgatacgcgcagaacataccggccgggaaattgttgacttaatgtgccatgcaaccttcacaatgagattacttagcccgatacgtgtacctaactacaatttgattatcatggatgaagcccattttacagatcccgctagtatagccgcaagaggctacatcagtacaagagtagaaatgggtgaagctgccggaatattcatgacagcaacaccaccgggttcgcgggacccctttccacaatcaaatgctccgatcatggatgaagaaagagagattcctgaaagaagttggaatagcggccatgaatgggtcacagatttcaaaggcaaaactgtttggtttgttccatcgataaaagccggaaacgatattgcagcttgtttgcgtaagaatggtaaaaaggtaattcagttgtcgagaaaaacatttgacttcgaatatataaagactcgtactaacgattgggattttgtagtgaccacagacatatcagagatgggggcgaactttaaagctgaaagagtaatagatcctcgacgctgtatgaaaccagtaatactcacagacggtgaagaaagagtgattctggcaggcccaatgcccgtaacacactcatctgccgcacagaggagaggtagagtcggtcgaaatcctaaaaatgaaaatgatcagtacatatacatgggtgaaccattagaaaatgacgaggactgtgcacattggaaagaggcgaaaatgctacttgataatataaacacacccgaaggaataatcccatccatgttcgagcctgagagagaaaaagtggatgccatagacggagaatacagactaagaggtgaggctaggaaaacctttgtggaccttatgcggaggggtgacttgcctgtctggttggcctatcgggtagcagctgaagggattaattatgcggataggagatggtgctttgacggagtaaagaataatcaaatactcgaagagaatgtggaagttgagatctggacaaaagaaggtgaacgaaagaaattgaaacccaggtggcttgatgcaagaatttattcagaccctttagcgctaaaggagttcaaagagttcgcagcgggtagaaagagtctgactctgaatctaatcacagaaatgggaagattaccaacattcatgactcaaaaggctcgaaacgcattagataacctagcggtacttcacactgcagaagcaggagggcgagcttacaatcacgccctaagcgaactcccagaaactcttgaaacacttttattgctaactcttttggctactgtaactgggggaatatttctgtttctaatgtcaggtaaaggcatcggcaaaatgactctaggtatgtgttgcataattaccgcaagtattttactatggtacgcacaaatccaaccacactggattgcagccagtataatactagaatttttcctgattgtgttgctcatcccagaaccagaaaaacaacgtacaccccaagacaatcagttaacttacgtggttatagcaatattgactgtcgtcgcagcaacaatggccaatgaaatggggttcttggagaaaactaaaaaggattttggcttgggatccataacaacacaacagccagagagcaatattctggatattgacttgcgaccggcttcagcatggactctatatgctgtagcaacgacattcatcacgcccatgctaaggcatagtattgaaaatagcagcgtaaatgtaagtcttacggctatcgcaaatcaggcaacggtattaatgggcctaggaaaaggatggcctctcagtaaaatggatataggagttccactattagcaataggatgttatagccaagtaaacccaataacacttacagcagctttactacttttagtagcacattatgccattataggacctggtctacaagcaaaagccacacgcgaagcacaaaaacgtgctgcagcgggaatcatgaagaatccaactgttgacggtataacggtaatcgatctagacccaatcccgtatgatccaaaatttgagaagcaacttggtcaggtaatgttattagtattgtgtgtgacccaagttttaatgatgagaacgacatgggctctatgtgaagcattaaccttggcaaccggtccaatttcaacgctctgggaaggaaacccaggaagattttggaacacaactatcgcagtatctatggcaaatattttcaggggatcttatttggcgggagcaggattgctattctcgataatgaaaaatacagctaatactaggcggggaacgggtaataccggagagacattgggcgagaaatggaagaaccgacttaacgctttgggaaaatcagagttccagatttataagaaatctggtatccaagaagtcgaccgtacactcgctaaagaaggaattaagcgaggtgaaaccgaccatcatgctgtcagtcgggggtcggccaaattgcgttggttcgtagagagaaatctcgtcacgccggaaggtaaagtagttgatttagggtgtggaagaggaggatggtcctattactgtggaggacttaaaaatgtaaaggaagtcaagggcctaaccaaaggtggacctggacacgaagaacctattccaatgtcaacttacgggtggaatttggtacgactacaaagcggcgttgacgtgttctttactccaccagaaaaatgtgacaccctactatgtgatataggagaatcatcgccaaatccaaccgtcgaagcaggtagaactctgcgagtacttaatttggttgaaaattggcttaataataacacacaattttgcattaaagtactcaatccttatatgccgtctgttattgagaaaatggaagccttacagagaaagtatggaggcgccttagtacgtaacccgctatcacgcaactctacccacgagatgtactgggtgtctaacgctagcggcaatatagtttcgagcgttaatatgatcagtaggatgctcattaacagatttaccatgagacataaaaaggcgacctacgaacctgacgtggatttaggttctggtacaaggaacataggcatagaaagcgaaattcccaatttagatataatcggaaagcgaatagagaaaatccaacaagaacatgagacctcttggcattatgatcaagaccatccataccggacctgggcatatcatgggagttacgaaaccaagcagacagggagtgctagtagtatggtaaatggtgtagtaagactactaaccaagccctgggatgtaatcccaatggtaactcaaatggcaatgaccgacacaactccgttcggccaacagcgcgttttcaaagaaaaagttgatacacgaactcaagaaccaaaggaaggaacgaaaaagctcatgaagataacagcagaatggctttggaaggaacttggcaagaagaaaactccccgaatgtgtacccgcgaagaatttacacgaaaagtacgatcgaatgcagcattaggtgcaatcttcacagacgagaataaatggaaatcagcaagggaagcggtagaagattctggattctgggaattagtcgacaaagaacgaaacctacatctggaaggaaaatgcgagacctgtgtatacaacatgatgggaaagcgtgagaagaaattgggcgagtttggcaaagcaaaaggatccagagcaatctggtacatgtggctgggtgctcgtttcttggagttcgaagcactaggatttttaaatgaagaccactggttttcacgtgaaaactcactatcgggtgttgaaggtgaaggcctacataaattgggttatatcttaagagatgtctctaagaaagaaggtggtgccatgtatgccgatgatacggctggctgggacactagaatcacacttgaagatctcaaaaaggaagagatggtcactaaccacatggagggtgagcataagaagttagcagaagcaattttcaaacttacatatcaaaataaagttgttagagtacagcgtccgacaccgaggggtacagttatggatattatttcccgaagggaccaaaggggttccgggcaagtcgtaacatatggactgaacactttcacaaacatggaggcacagcttattagacaaatggaaggtgagggagtgttcaaatcaatacaacaattgacagtcacggaagagatagctgtgaaaaattggctggtgagagtaggcagagaaaggttgtctagaatggctataagtggcgatgactgtgtcgtcaaaccactggatgatcgctttgcatcggctttaacagcccttaacgatatgggtaaggttagaaaggacatccaacaatgggagccatctagaggctggaacgactggacacaggtaccattctgtagccaccacttccacgaattaattatgaaagacggaagagttctagtcgtaccttgtcggaaccaggacgagctgattggtcgtgctagaatttctcaaggagcaggatggtcactacgggaaacagcatgcctaggcaaatcgtatgcacagatgtggtctcttatgtatttccacaggcgagatttacgtttagctgcgaatgctatatgttcagcagtaccatcacactgggtacctacatccaggaccacatggtctattcatgccacccacgaatggatgacaacagaggatatgttaactgtgtggaatcgggtatggattcaggaaaatccgtggatggaagacaaaacgcctgttgaaagttgggaagagataccttatctagggaagagggaggaccaatggtgtggaagtttgattgggctgacgagtcgagcgacgtgggctaaaaatatacagactgcaatcaaccaagtaagaagcctaataggaaacgaagaatacacagattatatgccatctatgaaaaggtttagaagagaagaagaagaagccggtgtgttatggtaa

SEQ ID NO: 22852 - RNA, 9876 nt, synthetic construct
  misc_feature 1..9876: note = derived and/or modified CDS sequence (opt6) from DENV-2__KC762671__SS-prME
  source 1..9876: mol_type = other RNA
accgcaggaattataataatgatgattcccacggtaatggcttttcaccttaccactcgaaatggtgaacctcacatgatcgtatctcgacaagaaaaaggcaaatctctattattcaaaactgaaaatggagtgaatatgtgtactctaatggcaatggatctaggagaactgtgtgaagacacaatcacgtataattgcccgcttctaagacaaaacgaaccagaagatattgattgctggtgcaattcaaccagtacatgggtaacatatgggacatgcacagcaacaggagagcatcggcgggagaaaagatctgtagcacttgttccccacgtgggcatgggtttagaaacacgaactgagacctggatgtcgtctgaaggcgcatggaaacatgcacaaaggattgaaacttgggtattaagacaccccggtttcactataatggcagcaatcttagcatatacaatcggcacgacatattttcagagagtactcatttttatactactgactgctgtagcaccaagcatgacaatgagatgtatcggaatatccaacagagattttgtagagggagtatcaggaggttcatgggtggatattgtcctggaacatggatcatgcgtgaccactatggcgaaaaataaaccaacattggacttcgaattgatcaaaaccgaggcaaagcatcccgcaacacttcggaaatattgtattgaagctaagttgaccaataccaccactgcatcaaggtgtccaacccaaggtgaaccctcacttaacgaggaacaagataagcgatttgtatgtaagcactctatggtagacaggggttggggcaatggatgtggtctctttggcaagggaggcattgtaacatgcgcaatgttcacctgtaaaaagaatatggaaggaaaaatcgttcaacccgaaaatttagaatacactatagtaatcacgccccatagcggagaggaaaatgctgtaggtaatgatacaggcaaacacggcaaggaaataaaagtcactccacaaagctcaataactgaagcagagttgaccggctatgggacagtcacgatggaatgttcgccacggaccggactcgatttcaatgaaatggtattattgcaaatggagaacaaggcatggttagtgcaccggcaatggtttttagatctgccactgccttggttaccaggtgcagatacacagggttcgaattggatacaaaaagaaacccttgttacgttcaaaaaccctcatgccaagaaacaagacgtagttgtgcttggctctcaagaaggtgccatgcatactgctttgacaggggcaacggaaatccaaatgtcttctggaaatctattatttaccggtcatttaaagtgtagattgagaatggacaaattacaactgaaaggcatgtcatattcaatgtgcactggtaaattcaaggtagttaaagaaattgccgagacgcaacacggaaccattgttattagggtccaatatgaaggcgatggctcaccctgcaaaataccatttgaaatcatggatctagagaaaagacatgtattaggtcggctaataaccgtaaacccgatagtgacggaaaaggactcacctgtaaacattgaggccgaacccccatttggcgattcatatataataataggagtggaacctggacaattaaaactatcatggttcaagaaaggatcgtccattggacagatgttcgaaaccacaatgagaggtgcaaagagaatggctatcctaggggatacagcttgggatttcggtagcttgggtggcgtattcacctctatcggcaaagcactccaccaggtttttggtgctatctatggtgctgcgtttagcggcgtatcctggaccatgaaaatattgattggcgtagtcataacctggatcggcatgaatagtaggtcgacgtcattatctgtctcattggtattagtgggagtggtcactttataccttggtgtgatggttcaagcagacagcggttgtgtagtaagttggaaaaataaagaattaaagtgtgggtcaggcatctttataactgacaatgtacatacgtggacagaacaatacaaattccaacccgaaagccctagcaaactagcctcagctatacaaaaagcccatgaggagggaatttgcggaataaggtctgtaacaagacttgaaaacttaatgtggaaacaaataacgccagaactaaatcacatattaagtgaaaatgaagtgaaactcacaattatgacaggagatataaagggaataatgcaggctggaaaaagaagtctcagaccacagcccacggaattaaaatatagttggaaggcttggggaaaagctaaaatgttaagtaccgagctccacaaccatacatttttgatcgacggacccgaaacagcagaatgcccaaatacgaacagagcgtggaactcattagaagtagaggattacggattcggtgtatttactacaaacatttggcttaaattaaaggagagacaagacgtattttgcgatagcaaattaatgtccgctgcaataaaggactcccgagctgtacacgcggatatgggttattggattgaatccgctctgaacgacacctggaaaatagaaaaggccagctttatagaagtaaaaagctgccattggcccaaatcacatactttgtggtcaaatggtgttctagaatccgagatgataattcccaaaaatttcgccggccctgtctcacaacataactacagacccggataccacactcaaacggctggtccatggcatttaggaagattagaaatggatttcgatttttgcgagggaaccaccgttgtggtgacggaggactgcggaaacaggggacctagcttaagaacaacaactgcaagtgggaaactgattactgagtggtgttgtagaagttgtacattaccaccacttagatatcgaggtgaggatgggtgttggtatggtatggaaatccgaccgcttaaggaaaaggaagaaaatctcgttaattcattggttacagccggccatggacaaatagataatttctccttgggtgttctagggatggcgttgtttcttgaagaaatgctcagaacaagggttggcactaaacatgcaatattgctagtagccgtaagtttcgtaacgttaatcacaggcaacatgtcgtttagggatttaggcagagttatggtaatggtaggtgcaacaatgacggatgacataggtatgggggtaacctatctagcactattagcggctttcaaagtacgccccacgttcgcagctggccttcttttacgcaagctaacatctaaagagctaatgatgacaaccataggtattgtattactcagtcaagcaacaatcccagaaactatactagaactcacggacgctctggcattaggtatgatggttcttaagatagtcaggaatatggagaaataccaactcgctgtaactattatggccatattatgcgtaccaaatgccgtaatactacagaatgcgtggaaagtgtcatgtacgacactagcggtcgttagcgtaagtccactgctcttaacttcatcacagcaaaaggcagactggatacccttagccctcacgataaaagggcttaatcccacggccatatttctaacaacactcagtcgcacaagcaaaaagcgatcatggccactaaacgaagctatcatggccgtaggaatggtatcaatattggcaagcagcttgctcaaaaatgatatacccatgacgggtcctttagttgcaggaggactattaacagtttgttatgtactaactggaagatcggctgatctggaacttgaaagagccgctgatgtgagatgggaagaacaagcagaaatttccggctcctcacctatactatctataaccataagcgaagatggaagtatgtccatcaagaatgaagaagaggaacagacactaacaatccttatacgcacgggtctgctggtgatttctggattatttcctgtaagcataccgataacagctgcagcatggtatctttgggaagtgaagaaacagagagccggtgtcttatgggacgttccttctccacccccagtaggtaaggcagaactagaagatggagcctacaggattaagcaaaaaggaatacttggttattcacaaatcggtgccggtgtatacaaagaagggacatttcacactatgtggcatgtcaccagaggggcagtactgatgcacaagggaaagaggatagaacctagctgggccgacgtcaaaaaggacttaatctcgtatggtggtggttggaagctagaaggtgaatggaaggaaggggaggaggtacaggtgcttgctctcgaacctggcaagaatccgagagcagttcaaacaaagccaggtttatttaaaaccaatacaggaactatcggggctgttagcttagatttttcgccaggtacgagtggtagtccaatcgtagacaagaaaggaaaagtagtcggactatatggtaatggagtggttacgcgttcggggacctatgttagtgccatagctcaaacggagaaaagcattgaagataacccagaaatagaagacgatatatttagaaagaaaagacttacgataatggatctgcaccccggtgcgggaaagaccaagcgatatcttccagcaatagtaagagaggctataaaacgaggactacgcacactgatactagctcccaccagagtagttgcagccgagatggaggaagcattacgaggtttacctattaggtaccaaacaccagcaataagagcagaacatactggccgagaaattgtagacttgatgtgtcatgcaacttttacaatgcgactcctatccccaataagggtcccaaattataatttaatcataatggacgaagcccactttacggacccggccagtatagcagcgcgaggttatataagcactcgggtcgagatgggagaggctgcaggcattttcatgaccgcaactccaccggggtccagagacccatttccgcagtccaatgctccgataatggacgaggagagagaaattcctgaacggtcatggaatagtggtcatgaatgggtaaccgacttcaaaggtaaaactgtctggtttgttccaagcattaaagcaggtaatgacattgccgcatgcttaaggaaaaatggcaagaaagttatacaattatctcggaaaactttcgatttcgaatatataaagacacgaacaaacgactgggactttgtagtaactacagatataagcgaaatgggcgctaattttaaagcggaaagggtgatagatccacgaaggtgcatgaaaccagtcattctcacagacggggaagaacgagtaattctagctggcccaatgcctgtcacacattcgtcggctgcacaaagaaggggacgtgtggggagaaatcctaaaaacgaaaatgatcaatatatatacatgggggaaccactggaaaatgacgaagattgtgcacattggaaagaagcaaagatgcttttagacaacattaatacaccggaagggattataccatctatgtttgaaccagaaagggaaaaagtagacgcaatagatggtgaatatagactccgcggagaggctcgtaaaacatttgtcgacttgatgagacgaggagatttacccgtttggttggcgtacagagtggcggccgaaggtatcaattatgcggacagacgatggtgctttgacggggttaaaaataatcagatcttagaagaaaacgtcgaggtagagatctggactaaagaaggagaaagaaagaaactaaaaccacgatggctagatgcaagaatttatagcgacccactggcgttgaaagaatttaaagagttcgcagctggcagaaaaagtctcacactaaatttaattacggaaatgggtcgacttccaaccttcatgacacaaaaagcccgaaacgcacttgataacctggcagtactacacacagctgaagccggtggaagggcatacaaccatgcactaagcgagcttcccgaaactttagagactcttttactcctcacattgttggcaacagtaacaggtggtatctttctattcttaatgtccggaaaaggtatcggaaaaatgactttagggatgtgttgcattattacagcgagtatattattatggtacgcacagatacagccacactggatagcagcttcaataatcctagagttctttcttatcgtactgctaatacctgaacctgaaaaacaacgcacaccacaagacaatcagttgacatacgtcgtaattgcgatattaactgtagttgccgcaacaatggcgaacgaaatgggattcttggagaaaacaaagaaagacttcggattagggagtataacaacgcaacaaccagaatccaacatactggatatagacttaaggcctgccagcgcttggacgttatatgcagtagctacgacatttataacccccatgctcagacatagtatagaaaattctagcgtcaacgtatctcttactgcaatagctaaccaggctaccgtactaatgggcttaggaaaaggttggccgctttcaaaaatggacataggcgtaccattactcgcaatcggctgttactcgcaagttaaccctataacgttaactgcagcgttattactgctcgtagcacactatgcgataataggacccggattgcaagctaaagcaacaagagaagcgcagaaaagggcagcagcagggattatgaaaaatccaacggtggacggaataacagtgatcgatcttgatcccatcccatacgacccgaaatttgaaaaacaacttggccaagtcatgctgttagtattatgcgtgacgcaagtgcttatgatgagaacgacatgggcactttgtgaagcactaaccttagctactggtcccatttctacgttgtgggaaggcaaccccggtcgattctggaatactactatcgcagtatccatggctaacatatttcgggggtcctatcttgctggagcaggtttgttgttttcgataatgaaaaatacagcgaacacaagacgaggaacgggaaatacaggagaaacgctaggagaaaaatggaagaacagactaaacgcattaggaaaatcggaatttcagatatacaaaaagagcggcattcaagaagtggatcgaactttggcaaaagaaggaatcaaaagaggagaaacagaccatcatgcagtttcaagagggagcgcaaaactccgatggtttgtggaaagaaacctagttaccccagaggggaaagttgttgacctaggatgtggtcgcggaggctggtcttactactgtgggggacttaaaaacgtcaaagaggtcaaaggactaactaaaggcgggccgggacatgaagaaccaatacccatgagcacatacggatggaatcttgtgcgcctacaatcaggagtagatgttttctttacacctccagaaaaatgtgacactctattgtgtgatataggagaatcttcaccaaatccaactgtcgaagcgggtagaacccttagagttttaaacctagttgagaactggctcaataataacacccagttttgtattaaagttctaaacccttacatgccatcggtgatagagaaaatggaagcacttcaaagaaaatatggcggagcattagtccgcaaccctctatctagaaacagcacccacgaaatgtactgggtatcaaacgcatctggaaacatagtaagctccgttaatatgatatcaagaatgctaattaatagatttactatgcgtcataagaaggcaacttacgaaccagatgtcgacctaggatcaggaacgagaaatattggtattgaaagcgagacgcccaatttagatataataggtaaacgaatagagaaaataaagcaggaacacgaaacatcgtggcactatgaccaggatcatccttataagacttgggcctaccatggttcatacgaaacgaaacaaacaggtagtgcgagctcaatggtaaatggggttgttaggttattaactaaaccctgggatgtgatacccatggtaactcaaatggcaatgacagatactactccatttgggcaacaacgagtgtttaaagaaaaagtagacacacgaacacaagaacccaaagaaggtactaagaagctaatgaaaattactgcggaatggttatggaaggaattaggcaaaaagaaaacacctagaatgtgtacacgagaagaatttgcccgaaaagtacgatctaatgcagcactgggagccatctttacggacgaaaacaaatggaaaagtgcaagagaagctgtagaagatagcggattctgggaattagtagataaagagcgcaatctgcatttagaaggtaaatgtgaaacttgcgtatataatatgatggggaaacgtgagaagaaactcggggagtttgggaaagcaaagggttcccgcgcaatatggtatatgtggttgggcgcacgtttcctggagttcgaggcactaggatttttgaacgaagatcactggtttagccgggaaaattctctttccggtgtagaaggagaagggctccataagttaggatatatattaagagacgtctctatgaaagaaggcggtgccatgtatgccgatgatacggcgggctgggatactagaataacgctagaagatcttaaaaatgaagaaatggtaactaatcacatggaaggagaacataagaaacttgcagaggctatttttaaacttacctatcaaaataaggtcgttcgggtacagagaccaacaccaaggggcacagtcatggacataatatcgagaagggaccaacgtggatcaggacaggtagttacttacggattaaataccttcacaaacatggaagctcaattaatccgacagatggagggggaaggagtgtttaaaagtatacaacaactcacggtaacagaagaaattgcagtgaagaattggttggtgcgagttggcagagaaagattgtcaagaatggcaatatcgggggacgactgcgttgtaaagccccttgatgaccgctttgctagtgcgttaacagcacttaatgatatgggtaaggtcagaaaagacatccaacagtgggaaccctctcgaggttggaacgattggacgcaggttcccttttgctcgcaccattttcacgaattaataatgaaggatggacgagtacttgtggtcccttgcagaaatcaagacgaactgattggcagagcacgaatctctcaaggagcaggctggagtttaagggaaacagcttgtttaggtaaatcatacgcccagatgtggagcctgatgtattttcatagaagggatctaagactagccgcaaatgcaatatgtagcgcagttccatcacactgggttcctacgagtcgtaccacctggagcatccatgctacacatgaatggatgaccacggaagacatgctaacagtttggaatagagtatggatacaagaaaacccatggatggaagacaaaacaccggtggagagttgggaagaaataccctatcttggcaaacgcgaagaccaatggtgtgggagtttaataggattgacaagtcgtgcaacatgggccaaaaatatccaaacagctataaaccaagtacgtagcttaatagggaatgaagaatatacagactatatgccttcaatgaaacgatttagaagagaagaagaagaagccggtgttctttggtag

SEQ ID NO: 22853 - RNA, 9876 nt, synthetic construct
  misc_feature 1..9876: note = derived and/or modified CDS sequence (opt6) from DENV-2__KC762664__SS-prME
  source 1..9876: mol_type = other RNA
acggcaggtattattataatgatgatacctacagtgatggcatttcatttgacaacgagaaatggagaaccacacatgatagtatctagacaagaaaaaggaaaaagtctgctatttaaaacagaaaatggggtaaatatgtgtaccttaatggcgatggatctgggagaactatgcgaagatactataacttacaattgcccactcttgcgacaaaatgaaccagaagatatagactgttggtgcaatagcacatcgacatgggtcacatacggtacatgcactgcaactggtgagcataggagggaaaaacgttccgtagcattggttccacacgtaggaatgggattagagacacggacggaaacctggatgagttcagaaggtgcatggaaacacgcacaacgaatagaaacatgggtcctaagacaccccggatttactattatggcggctatactcgcatatactataggaacgacgtatttccaaagagtactaatattcatactcttgaccgcagtaaccccgagtatgactatgagatgtataggaatttcgaatcgggattttgtcgaaggagtgagtggaggttcttgggtagatatagttttagagcacggatcgtgtgtcacaaccatggccaaaaataaaccaactcttgattttgaactaataaaaactgaagctaaacatcctgcgacattaagaaaatactgtatagaagcaaaactaacgaacacgacaacggcatcaagatgtccaacgcaaggagaacctagcctgaacgaggaacaagataaaagatttgtctgtaaacactcgatggtagatcgtggctggggcaatggttgtgggctctttgggaaaggaggaatagtcacatgcgcaatgtttacatgcaagaaaaacatggaagggaaaatagttcagccagaaaaccttgagtatacgatagtaataacgccacactctggggaagaaaatgcagttggcaacgacaccggaaaacatggaaaagaaatcaaagtaactccacaaagtagcattacggaagcggaattaacgggttatggaacagtaaccatggagtgtagtccacgtactggcctagatttcaacgaaatggtacttttacagatggaaaataaagcatggctagtccacagacaatggttcctcgacctaccgctcccttggttacctggtgcagatacccagggttctaattggatacaaaaagaaacattagtaacctttaaaaatcctcacgcaaagaaacaagatgtagtagtattagggtcacaggaaggagcgatgcataccgcgttaacaggggcaacagaaatccaaatgtcatcaggaaacctactatttaccgggcatcttaaatgtaggctgaggatggacaaattgcaattaaaaggaatgtcttactctatgtgcactggaaaattcaaagttgtcaaagaaatagcagaaacacaacatgggaccatagtgatcagagtacaatacgaaggcgatgggtccccctgcaaaataccttttgagatcacagacctggaaaaacggcatggtctaggaaggctgatcactgtgaacccaatcgtgaccgaaaaagacagtccagttaacattgaagcagaacctccatttggagatagttatataataatcggggttgaacccgggcaactcaaattatcatggtttaagaaaggttcttcaatagggcaaatgtttgaaacaactatgcgaggcgctaaaagaatggctatcttaggtgatacagcatgggattttgggtctttaggcggtgtctttacttcaatcggcaaagcgctacaccaagtcttcggggccatctacggagcagcattctccggagtctcctggaccatgaaaatattaataggtgtcgtcataacatggataggaatgaactcaagaagtacctcattatcagtatcccttgtgttagtaggggtggttacgctttacctaggagttatggtacaagccgattcggggtgtgttgtgagttggaaaaataaagagcttaaatgtggatcgggcatatttattaccgacaatgtacatacttggactgaacagtacaaattccaaccagagagtcctagtaaattagcctctgcaatccaaaaagcacacgaagagggcatctgtgggataagaagtgtaacacgactggaaaatttaatgtggaaacaaataacccctgagctaaatcatatcttatccgaaaatgaagtcaaacttactattatgacgggtgacattaaaggcatcatgcaagcaggaaaacgatcgctccggccccaaccaacagaacttaaatattcttggaaaacctggggcaaagcgaaaatgttatccaccgagcttcataaccataccttcctaatcgacggtccagaaactgcagagtgtccaaacgctaatcgcgcttggaactcattagaagttgaagattatggtttcggagtctttacgacaaacatatggctaaaactaaaagaaagacaagacgcattttgtgacagcaaacttatgagcgctgcgataaaggataatcgcgcagtacacgctgatatgggatattggatagagtcggcactgaacgatacgtggaaaatagagaaagcatcatttatcgaagtaaagtcctgccactggcctaaatcgcacaccttatggagcaacggagtattagagtcggaaatgataatacccaaaaatttcgctggtccggtctcccagcataattatagaccaggctatcacacgcaaacagcagggccctggcatcttggcagactagaaatggatttcgatttctgtgaaggcacaacagtagtagtaacagaagattgtggtaatcgtgggccaagtttacgaacaacaaccgcaagtggaaagttaatcactgaatggtgttgtagatcttgcactctgcctcccctccgatacagaggagaagatgggtgctggtacggaatggaaattcgaccccttaaagagaaagaagaaaatttagtaaatagtctggtcactgccgggcacggtcagattgacaatttctcgttaggtgtacttggcatggcactattccttgaagaaatgctgcgaactcgtgtagggacaaaacacgccatactattagttgcggtttcattcgtgactcttataacgggaaatatgtcatttagggacttaggtagagtcatggttatggtgggagctacgatgactgacgacattggtatgggggtaacatatctggctctcctcgcagcatttaaagttcgacctacatttgctgctggactgttgctcagaaagttaacctcaaaagagcttatgatgaccacaataggaataacactattatctcaatctacaatacctgaaacaatacttgaactcacggatgccttagctcttggaatgatggtattaaaaatagtacgaaacatggaaaagtatcagctcgccgtaaccatcatggccatattatgtgttcctaacgctgtcatacttcaaaatgcatggaaggtttcttgtactacgctcgccgtagtcagtgtatcaccattattgctaacatcatcacaacagaaagccgattggattccattggcgttgacaattaagggattaaaccctaccgccatattcttaacaaccttatcacgaacaagtaaaaagcgctcttggccgcttaacgaagccatcatggcagtgggtatggttagcatactggcaagcagcttactgaaaaacgacattccaatgactggcccattagtggctggaggattattgactgtatgctatgtactgactggtagatctgctgacctagaattagaacgagcagccgacgtccgctgggaagaacaagcagaaatttccggtagtagtccaatcttaagcataactatcagcgaggacggttcaatgtccattaaaaatgaagaagaagaacaaactcttactatacttataagaaccggcttgctggtaatctccggattattcccagtatcaataccaataactgcagcggcatggtacttgtgggaagttaagaaacaacgtgcaggggtattatgggacgtaccatcccctcctcctgtagagaaagccgaactcgaggacggagcttacaggattaaacaaaaaggaatactaggatacagtcaaataggggctggcgtatacaaagaagggacattccatacgatgtggcatgtaactcgaggtgccgtattgatgcacaaaggaaagcgcatagagccgtcatgggcagacgtcaaaaaggatttaataagttatggaggtggatggaagctagaaggagaatggaaagagggagaagaagtccaagtactagcactggagcctgggaagaatccacgagccgtccagacaaaaccaggccttttcaaaacatcgacgggtacgattggagccgttagtctagacttctcaccgggcacctctggcagtccgatcgtagataagaaaggcaaggtggtcggtctatatggaaacggagtagttacacgtagtggaacttacgtatcagcaatagctcagacagaaaagtcaatcgaggacaaccccgaaatagaggacgacatttttaggaagaaacgactcacaataatggacttacatcccggtgcaggcaaaactaaaagatatttacccgcgatagtacgggaggcaatcaaacgtggacttaggacacttatattggctccaacgagggtagtggcagcagaaatggaggaggcactgagaggtctaccaatacgctatcaaacgccagctattagagcagaacacacaggacgcgaaatcgtagatctaatgtgtcacgccacatttacgatgcgccttctatcaccgataagagtgcctaactataacttaataatcatggatgaagcgcattttacagacccggcgtccattgcagcacgtgggtatatatccacgagagtagaaatgggtaaagctgccggtattttcatgaccgcaactccaccagggtcaagagatccattccctcagagtaatgcccctattatggacgaagaaagggaaattccagagagatcatggaactcaggacatgagtgggttacagatttcaaaggaaaaactgtatggtttgtgccttccataaaggcgggaaatgacattgcagcgtgtctgaggaaaaatggcaagaaagttatacaattaagtcgaaaaacatttgattttgaatatatcaaaacacgaaccaatgattgggattttgtggtgacaacagatataagcgaaatgggagctaactttaaagctgaaagagtcatagaccctcggcgttgtatgaaacccgtaattttgacggatggtgaagagagagttatcttagcaggaccaatgccggtaacgcattcctctgcagcacagcgcagaggtcgggttggccggaaccctaaaaatgaaaacgatcaatatatatatatgggcgaacctctcgaaaatgatgaggattgtgctcattggaaagaagcgaaaatgttacttgataacatcaacacaccggaaggaatcataccatctatgtttgaaccagagagagaaaaagttgatgcaattgatggtgaatataggttacgaggagaagcaagaaaaacttttgttgatttaatgagaagaggagatcttcccgtatggttagcctacagggtagccgcggagggtattaactatgcagaccgaaggtggtgcttcgacggagtcaaaaataatcagattctcgaagagaacgtcgaggttgaaatctggacgaaagaaggagaacggaaaaagctaaaacctagatggttggatgcgaggatatatagcgaccccctagcgttaaaggagtttaaagagtttgcagctggtcgtaagagtttaaccctcaaccttataacagaaatgggtcgcctaccgacctttatgactcagaaagcaaggaacgcgctggataaccttgccgttttacacacagccgaagccggcggaagggcttacaatcatgccctaagtgaactacccgaaaccttagaaaccctacttctgctaacactattagccacagtgactggaggtatatttctgttcttaatgtcaggaaagggaattggaaagatgacgctgggaatgtgttgcataattacagcaagcatcctgctttggtatgcacaaattcaaccacattggatagctgctagtatcatattagagttctttctaattgtcctcttgatcccggaaccggaaaaacaaagaacaccccaggataaccagcttacctacgtagtaattgcaattttaacagttgttgctgcgaccatggccaacgagatgggctttttagagaaaacaaagaaggattttggattgggaagtataaccacccaacaaccagaaagtaacatactagacatagacttaagaccagcaagcgcctggactctatatgccgtagcaactaccttcattacaccgatgctaagacattctattgagaactcatctgtaaacgttagtctgaccgcaatagctaatcaagccaccgtattaatggggctcggaaaaggttggcctttaagcaagatggatattggcgtgcctctattagcaatcggttgttacagtcaagttaacccaataactctaactgctgcgctactactactcgttgcacactatgccataataggaccaggtctacaagccaaagcaactagggaagctcaaaaacgagctgctgcaggcataatgaaaaacccgacagtagatggcataacagtgatagatttggaccccatcccatatgacccaaaatttgaaaaacaactaggtcaggtaatgctacttgttctgtgtgtaacacaagtcctcatgatgagaacgacatgggccctgtgtgaagccctaacgctcgccactggacctataagtaccttgtgggaaggtaatccagggcgattctggaatacgacaatagcagtgtcgatggctaatatattcagggggtcatatttagcaggagcaggtttacttttctcaattatgaaaaatacggcaaacactagaagaggaacagggaatacaggagagaccttgggagaaaagtggaaaaacagattgaacgccctaggtaaatccgaatttcagatatataagaaaagtggaatccaggaagtggatagaacattagccaaggagggtatcaaacgaggagagacggaccatcatgcagtatcacggggttctgcaaaattaaggtggttcgtagagcgaaacctcgttacaccggagggaaaggttgtagacctaggatgtggaagaggtggatggtcttactattgtggcggactgaaaaacgtgaaagaggtaaagggactgacaaaaggtggtccaggacatgaagaaccaattcctatgagtacctatgggtggaacctagttaggttacaatcaggggtggacgtattctttacaccaccagaaaaatgtgatactctattatgtgatataggagaatcgagtcccaatccaacagtagaggcggggagaacattaagagttctgaatcttgtggaaaattggctcaacaacaatacacaattttgcataaaggtgctaaacccatacatgccaagtgtaatagagaaaatggaagcgttacaaagaaaatatggcggggccttagtaaggaatccactatctaggaacagcacccatgagatgtattgggtaagtaacgcctcaggcaatatagtgagttccgtaaacatgatctcaagaatgcttatcaatagatttacaatgaggcacaagaaagctacatatgaaccagatgtcgacctcggttccggaaccagaaatataggtattgaaagcgaaactccaaatcttgacattataggaaaaagaatagagaaaattaaacaggaacacgaaacaagctggcattacgaccaagaccatccgtataaaacatgggcgtaccatggctcgtatgaaacaaaacaaacagggtcagcatcatcgatggtaaacggagtcgtgagacttctaacaaaaccatgggatgtcatacctatggtaacacaaatggcgatgactgacacaacccccttcgggcaacaacgagtatttaaagagaaagtagatactagaacgcaggaacccaaagagggcacaaagaaattgatgaaaatcaccgcagaatggctatggaaagaattgggaaagaagaaaacaccaaggatgtgtacaagagaggaatttacccggaaagtgagaagcaacgcagctctcggagccatatttaccgatgaaaataaatggaaatctgctcgggaagcggtagaagatagtggattctgggagctagtagacaaagaacgtaatcttcacctggaaggaaaatgcgaaacctgtgtatataacatgatggggaaaagagagaagaaattaggagaatttggaaaagcaaaaggttcgagagccatttggtatatgtggttgggagccagatttttagagtttgaggcattaggatttttaaatgaagaccattggttttctcgagaaaatagtctcagtggagtagagggagagggactccataaattgggatacatactcagagatgtctctaagaaagaagggggtgccatgtacgcagacgatacagctgggtgggatacgcgaatcacactagaagacctgaaaaatgaggaaatggtcactaaccatatggaaggtgaacataagaaactcgctgaagctatttttaaattaacataccaaaataaagtagtgagagttcagcgaccaactccaagaggaacggtaatggatataatctctcgaagggaccagaggggctccgggcaggtagtaacgtacggtttaaacacatttacaaacatggaagctcagctaatcaggcaaatggaaggggaaggagtatttaaaagcatacaacaactaacagttacggaagagatcgcggtcaaaaattggctagtgacagtcggccgcgaaagactctctagaatggcaatcagcggtgacgattgcgtagtgaaaccattagacgatagatttgcatcagctctaacagccctcaatgatatgggaaaagtaagaaaggatattcaacagtgggaaccatctcgcggatggaacgactggacacaagtaccattttgtagccatcactttcatgaactcataatgaaagatggaagggtcctcgtcgtaccttgcagaaaccaagacgagcttattgggagagcacggatctcacaaggtgcaggatggtcgctacgcgaaacagcctgtctgggaaaatcttacgcacaaatgtggtcccttatgtatttccatagacgcgacctccggcttgcagccaacgcgatttgctctgcagtaccgtcacattgggtacccacatcaagaaccacttggagcattcatgcaactcatgaatggatgactacagaagacatgttaacagtctggaatcgagtatggatccaagagaatccctggatggaagataaaacccccgtgggatcttgggaagaaattccatatctaggaaagagggaggaccagtggtgtgggagcctaattggattaacgtcccgagctacttgggccaaaaacatacaaactgctatcaatcaagttaggtcactaatcggtaatgaagaatacactgattacatgccttccatgaaaagatttagaagagaagaggaagaagccggcgtattatggtaa

SEQ ID NO: 22854 - RNA, 9876 nt, synthetic construct
  misc_feature 1..9876: note = derived and/or modified CDS sequence (opt6) from DENV-2__KC762674__SS-prME
  source 1..9876: mol_type = other RNA
actgcggggattataataatgatgatcccaaccgtaatggcgtttcatttaaccactcgaaatggagaaccgcatatgatcgtgagccgtcaggaaaaaggtaaatcactactattcaaaaccgaaaacggagtgaacatgtgtactttgatggcaatggatttaggggaactgtgtgaagatacaataacatataactgtcccttacttcgacaaaatgagccggaagacatagactgctggtgtaactccacgagtacttgggttacatatgggacatgtacagctacaggggagcacaggagagaaaaacgaagtgtagccttagtgccccatgttggcatgggccttgaaactcggacagaaacttggatgtcgtctgaaggtgcatggaaacatgcacaacgcattgaaacatgggtgttaagacaccccgggtttacaatcatggcggcaattcttgcatacacaatagggaccacacactttcaacgagttctgatttttatattgctgacggcagtagcaccatctatgacgatgcgatgtataggcatatcaaatagagatttcgtagaaggtgtatccggaggtagttgggttgatatcgtactagaacatggcagttgtgtgacaacaatggctaaaaataaaccgacacttgatttcgaacttataaaaacagaggcaaaacatccggcaaccttaagaaaatattgcattgaggcaaaacttaccaacacaacaaccgcatctagatgtcctacacagggagagccttctctgaatgaagaacaggacaaaaggttcgtatgcaaacacagtatggtagataggggatgggggaatggatgtggactatttggaaaagggggcatcgtaacgtgcgcaatgttcacatgcaagaaaaatatggaagggaaaatagtacaacctgagaacctagaatataccatcgtaattacaccacacagtggagaggaaaatgcggtgggcaacgatacaggcaaacacgggaaagagataaaagtgaccccacaatcaagtataacggaagcagagttaacgggatatggaacggtgacgatggaatgtagtccaagaaccgggttggactttaatgagatggtactattacaaatggaaaataaagcctggctagtacaccgacagtggtttttagatctaccattaccgtggctaccaggggctgacactcagggaagcaactggatacaaaaagaaacattagtaacgttcaagaatccccatgccaagaaacaagatgttgttgttcttggttcacaagaaggcgcgatgcatactgcattgactggggctactgaaattcaaatgtcatcgggaaatttattatttactggccacctgaaatgtcgtctaagaatggacaaactgcagctaaaaggaatgagttactccatgtgcacaggcaagtttaaggtggtgaaagaaatcgcagaaacacaacatgggaccattgttatacgggtccaatatgaaggagacggttccccttgtaagataccatttgagatcatggatttggaaaaacgacacgtacttggtagactcataacggtaaatcctattgttacagaaaaagatagtccagtaaatatagaagcagaaccaccctttggcgacagttatataattatcggagtagagcctgggcaattgaaattatcttggttcaaaaagggatcttcaatcggacagatgtttgaaacaacaatgaggggagctaagagaatggctatattaggcgacactgcatgggattttggtagcctaggcggggtctttacaagtataggtaaggccttacatcaggtattcggagccatatatggtgccgctttttcgggagtaagctggacaatgaagattctaataggagtggtcataacctggattggtatgaactcaagatcaacaagtttgagtgtcagtttggtattagtaggagttgtaacactatacttgggtgtaatggtacaagcggattctgggtgtgtagtcagttggaagaataaagaattaaagtgtggatcaggcatctttatcacagacaacgtacatacttggacggaacaatacaaattccaacccgagagcccatctaagttagcgtcagcaatccaaaaagcccacgaggaaggcatatgcgggataaggtctgtaacacgactggaaaatttgatgtggaaacaaataactccagaacttaaccatatcctctccgagaacgaagtaaaattaacaataatgacaggagatattaaagggattatgcaggctggtaagaggtctctaaggcctcagccaacggaattaaaatattcttggaaaacctggggtaaagccaaaatgctttcaacggagttgcataatcatactttcctaatagacggcccggaaacagcagagtgtccaaatacaaaccgcgcatggaacagtctagaggtagaagactatggttttggtgtatttacaacaaatatatggctcaaattgaaagagagacaggatgtatactgtgactcaaaattgatgtctgcagcaattaaagacaaccgggcagtacatgcagatatgggttattggatagaatctgcactaaatgatacatggaaaattgaaaaagcgagctttatcgaggttaaaagttgctattggccaaaaagccacaccttatggagcaatggagtattggagagcgaaatgataattcccaaaaatttcgcaggaccagtttcccagcataactacagacccggttaccacacacaaacagcaggtccatggcatctggggcgtttagaaatggattttgatttctgcgaaggcacaacagtggtagttactgaagactgtgggaacagaggaccatccttacgaacaaccacagcatctggaaaattaattacagaatggtgttgcagatcatgtactcttccacctctacgctacaggggtgaagatggatgctggtacggcatggagattcgtcccctaaaagaaaaagaagaaaacctggtaaattctctagtaaccgcaggtcacggacaaattgataatttctcattaggcgtactaggcatggcactatttttagaagaaatgttaagaacccgtgttggcactaaacatgcaatactgttggtcgcagtctcattcgtgacattaattacgggtaatatgagttttagagatctaggacgagttatggttatggtaggggctacaatgactgacgatatcggtatgggcgtaacgtaccttgcattgttagcagccttcaaagtgcggcctacattcgcagctggtcttttgctgcgtaaattaacttcaaaggaattaatgatgacaacaataggtatcgtcctacttagccaaagtacgataccagaaactattctcgaactcacagatgcactcgccctgggaatgatggcgcttaaaatcgttcgtaacatggaaaagtatcagcttgcagtaacaataatggcaatattgtgtgtacctaatgcagtaattttacagaacgcttggaaagtatcttgcaccacactggcagtggtctcggttagcccattgttacttacgagtagtcaacagaaagccgactggataccactcgccttgactattaaaggcttaaatccaacagcaatatttctgactacattatctaggacaagtaaaaagagatcgtggccattgaatgaagcaattatggctgtaggtatggtaagcatacttgcaagcagcttgctcaaaaatgatattccaatgacaggaccacttgtggcaggcggcctacttacagtatgttatgtattgacaggtagatcagccgatttggaattagaacgtgcagctgatgttcgatgggaggaacaagctgaaatatcggggtcgtccccgatactttcaataactatttctgaagacggatctatgtctattaaaaatgaagaagaagaacaaaccctgaccatattaatacgcacaggccttctagtaatatcaggcttgtttccagtatcgataccaattaccgctgctgcatggtacttatgggaagtcaagaaacagcgagcaggggttctctgggatgttccaagtcctccaccagtaggcaaggccgagttagaggatggggcgtacagaataaaacaaaagggaatactcggatactcgcaaataggagccggagtatacaaagagggaactttccataccatgtggcatgtaactcgtggtgcagttctaatgcataagggaaaacgcattgagccgagttgggcagatgtcaagaaagacctaatttcgtatggaggaggttggaaattagaaggagaatggaaagaaggagaagaagtacaggtgctcgcattagaaccaggtaaaaacccacgtgcagttcagacaaaacccggcctattcaaaactaatacaggaactatcggcgctgtttcactggatttttcccccggtacatcaggttcgcccattgtagataaaaagggaaaagtcgtcggtctatatggtaatggagttgtgacacgatccggtacatatgtatcagcaatagcacagacagagaaaagcattgaagataaccccgaaatagaagatgatatttttcgcaagaaacggttaacgataatggatctccatccaggtgcaggaaaaactaagcggtatttgcctgcaattgtgcgagaagctataaaacgaggattaagaacgttaattcttgctcctacgagagttgtggcagcagaaatggaagaagcattacgaggtttacctattcgctatcagactcctgctatccgagccgagcataccgggcgggaaattgttgatttgatgtgccatgcaactttcaccatgcgcctattaagtcccattagagttcctaattataacctaataattatggatgaagcccacttcacagacccggcgtccattgctgcgagaggatatatcagtacgagagtcgagatgggcgaagcagcaggtatatttatgaccgcgactccacctggaagccgagacccttttccacaatcaaacgccccgataatggacgaagaaagggaaatcccagaacggagctggaactcaggtcacgagtgggttactgacttcaaaggaaaaacagtctggtttgttccatctataaaagcgggtaatgatattgccgcatgtcttcgcaaaaatggaaagaaagtaattcagttgtctaggaaaactttcgattttgagtatattaaaacccgcacaaatgactgggattttgtcgtaacaacagatatttcagagatgggggcaaatttcaaagctgaaagagtaatagatccgagaaggtgcatgaaaccagtaatattaactgatggggaagagagagtcatattagctggacctatgccagtaacacactcgagcgcggctcaacgtcgcggacgtgttggcaggaatcctaaaaacgaaaatgaccagtatatatacatgggggaaccacttgaaaacgacgaagattgtgcacattggaaagaagccaaaatgctattagataatattaataccccagaaggaataattccatcaatgtttgaaccagaaagagaaaaggtggacgcaattgatggagaatatcgattaagaggagaagcaagaaaaacgtttgtagatttaatgagacgaggcgatctaccagtatggctcgcttacagagttgcagcagaaggtattaactacgcagacagacgatggtgttttgacggcgttaaaaacaatcagatattagaggaaaatgtagaagtagaaatttggacaaaagaaggcgaacgtaaaaagctcaaaccacgttggcttgatgcaagaatctatagcgaccctttagcgttgaaggaatttaaagagttcgcagcaggtagaaagtcattgactttgaatctgatcaccgaaatgggtaggcttcccacgtttatgacgcaaaaagctagaaacgcacttgataatcttgcagttttacatacagcagaggctggaggacgggcctacaatcacgctttgagcgaactgccggaaacccttgaaacacttcttttactaacactacttgccacagtaacaggaggaattttcttatttcttatgtctggaaaggggatcggaaaaatgacattaggaatgtgctgcataataactgcttctatacttctttggtacgctcagattcagccacattggatcgcagcatccattattttagaatttttcctaatagtactactaatacctgaacccgaaaagcaaaggacgccacaggataatcaacttacttatgttgtaatagcgatcttaacggtagtcgctgcgaccatggccaatgaaatgggctttttagagaaaactaagaaagatttcggactcgggtctattacaactcaacaacctgaatcaaatattttagatatagatcttaggccggcatctgcttggacactctatgctgtcgcgacaacttttataacaccgatgcttaggcattccatagaaaattcctccgtaaacgtatcattaacagcaattgcaaatcaagcaacagtactcatgggtctgggaaagggatggccattatcaaaaatggatattggcgttccgttattagccataggctgctactcacaggttaatccaataaccttaactgccgcccttctactcttagttgcacactacgcgataataggaccaggactacaagcgaaggcaaccagagaagctcaaaagagagcagcagcaggtattatgaagaacccaacagtcgatggtataacggtaattgacctagatcccatcccatatgatccaaaattcgagaagcaacttggtcaagtcatgttgttagttttgtgtgtaacccaggtgcttatgatgagaacaacgtgggccctatgtgaggcgttgacattggccacgggtcctatcagcactctatgggaaggtaatccaggacgattctggaatacaacgatagcagtcagtatggcgaatatatttaggggatcataccttgccggcgcaggtttactgttttcaattatgaaaaacacagcgaatacccgcagaggtactggtaataccggggagaccctaggcgaaaaatggaagaatcgtcttaatgcgttaggcaaatctgaatttcaaatttacaagaaatccggcatacaggaggtcgatagaactctcgccaaggagggaatcaaaagaggagaaacagatcatcacgctgtatcaagaggaagtgctaaacttagatggtttgtagaaaggaatcttgtcacacccgaagggaaggttgttgatttagggtgcgggagaggcggttggagctactattgcggtggattaaagaacgtcaaagaagttaaaggtctgaccaaaggaggcccgggacatgaagaacctatccctatgagcacctacggttggaatcttgtaagattgcaaagtggagtagacgtatttttcacaccaccagagaaatgtgatacgttactctgtgatataggagaaagtagcccgaaccctacggtagaagcaggaaggaccctacgagtactcaatttagtcgaaaattggctcaataataatacccaattttgcataaaagtcctaaacccttacatgccctcagtaatagagaaaatggaagcactccagagaaaatacggtggcgctttggtaaggaatcctttatcacgaaattcaacacatgaaatgtattgggtatcaaatgcgtcaggtaatatcgtttcaagtgtaaatatgatcagtagaatgttgatcaataggtttacaatgagacataagaaagcaacatacgaaccggacgttgatctggggagcggaactagaaacataggcattgaatccgaaattccaaacttagatataattggcaaacggatagagaaaattaaacaagaacatgaaacgagttggcactatgaccaagaccacccatataaaacttgggcctatcatggaagttatgagacaaagcaaaccgggtctgcaagcagtatggtaaacggcgttgttagactactaactaagccgtgggatgttattccaatggtaactcaaatggccatgaccgatactacaccttttggacaacagcgtgtcttcaaggaaaaagttgatacaagaacgcaagaacctaaagaaggaaccaaaaagctaatgaaaattacagcagagtggctgtggaaagagctggggaaaaagaagacacctagaatgtgcactagggaagagttcacgagaaaagttcgttcaaacgcagcgctgggagcgatctttacagatgagaacaaatggaaatctgcacgagaagccgtagaggatagcgggttttgggaattagtagataaagaaaggaacctccatcttgaaggaaagtgtgaaacttgtgtatataatatgatgggtaagagagagaagaaactaggagagtttgggaaagccaagggaagcagggcgatttggtatatgtggcttggagcccgattcctcgagtttgaagcactgggttttcttaacgaagatcattggttctcgcgtgaaaattctttaagtggggtagaaggggaggggttgcacaaactaggatacatattacgagacgtatcaaagaaagagggtggcgctatgtatgcagacgatacagctgggtgggatacaaggataaccctagaagacttgaaaaatgaagaaatggtaactaatcacatggaaggcgaacacaagaaattggctgaagcaatatttaaacttacctaccagaataaagtagtacgcgtacagaggccgactccgcgaggaacagtgatggacataatttctagaagagatcaacgaggttcaggacaagtcgttacctatggtttgaacacttttacaaatatggaagcacagttaatcagacaaatggaaggggaaggggtttttaaatcgatccaacaattaacggtgaccgaagagatagcagttaaaaattggttggtaagggtcggaagagaacgtctttcgcggatggcaatttccggcgacgattgtgtagttaaaccattagatgatagattcgcatccgcattgacagctctaaacgatatggggaaagtaagaaaagatatacagcagtgggaacccagtagaggatggaatgattggacccaagtgccattttgctcacaccactttcatgagttgataatgaaagacggaagggtattagtggtaccttgtaggaatcaagacgaattaataggtcgagctaggatttcacaaggtgcggggtggtctttaagagaaacggcctgtttaggaaaaagctatgctcaaatgtggtcgctgatgtattttcacagaagggacctacgactagcggcaaacgctatctgttcagcagtcccctcccattgggtaccgacttcgaggacgacgtggagtatacatgcaacacacgaatggatgactacagaggacatgctcaccgtatggaaccgtgtatggattcaagaaaacccctggatggaagacaagactccggtagaaagctgggaagaaataccctacctaggtaaacgagaagatcaatggtgtggaagtttaataggactcacatcaagggcaacatgggctaagaacattcaaaccgcaattaaccaagtaagatcattaattggaaacgaggaatatacggattatatgccttccatgaaacgatttcgtcgagaagaagaagaggcgggcgtattatggtag

SEQ ID NO: 22855 - RNA, 9876 nt, synthetic construct
  misc_feature 1..9876: note = derived and/or modified CDS sequence (opt6) from DENV-2__KC762672__SS-prME
  source 1..9876: mol_type = other RNA
actgcagggattattataatgatgatccccactgtgatggcatttcatttaactacccggaacggggaaccgcatatgattgtaagtcgccaggaaaaaggaaaaagtctactatttaaaaccgaaaacggcgtgaacatgtgtaccctaatggctatggaccttggcgaactatgtgaagacactattacatacaactgccctttattaaggcaaaatgaaccagaagacatcgattgctggtgcaactccacatcaacctgggtaacttacggaacctgtacggcaacgggagaacaccgaagagaaaaacgtagcgttgcattagtaccacatgttggcatgggattagaaactagaacagaaacgtggatgagcagcgaaggtgcatggaaacatgctcagagaatagaaacatgggtattaagacatccggggttcacaatcatggcggcaatcctggcgtacacaataggaacaacatacttccagagagtattaatttttatactgctaactgcagtagctccttcgatgacaatgagatgtataggtatttcaaatcgcgatttcgtagaaggggtatcaggaggtagttgggttgatatagtactagaacacggaagctgcgtaacgaccatggccaaaaacaaacccacacttgattttgaacttatcaaaacagaagcaaaacatcccgcaactttacgaaaatactgtatagaagcaaaactcacaaacactacaacggctagtcgatgcccaactcaaggggagcctagtcttaatgaagaacaagataaaagatttgtttgtaaacattcaatggtagaccgaggatggggaaacggttgtggcttattcggaaaagggggtatagtaacatgtgccatgttcacttgtaagaaaaatatggagggtaaaatagtacaaccagaaaatcttgaatacacaatagtaataacaccccattcaggagaagaaaatgctgtagggaatgacactgggaagcacggaaaagaaataaaagtaaccccacaaagctctatcacagaagcggaacttaccggatatggcacagtaacaatggaatgtagtcccagaacaggtttagactttaatgaaatggtattattacaaatggaaaataaggcatggttggtacacagacaatggttcctcgacctacctttaccatggctgccaggcgctgatacccaaggctctaactggatacaaaaagaaacgttagttacgttcaaaaacccccatgccaaaaagcaggatgtagtagtattaggaagccaggaaggagcaatgcacaccgctttgactggagcaacagagatccagatgtcatcaggcaacttattattcacaggacatttgaaatgccgactacgaatggacaaattacagttaaaagggatgtcctattccatgtgcacgggaaaattcaaagtggttaaagagattgcggaaacgcaacatggaactatagtgattcgtgtacagtacgagggggatggatctccgtgcaaaatccctttcgaaataatggacctcgaaaaacgtcatgtactaggacgattgataacggtaaatccaatagtcacagagaaagattctccggtaaacattgaagcagagccaccatttggagattcgtatataataataggagtggaaccaggccaattaaaattgagctggttcaagaaaggttcatccataggtcaaatgttcgaaacaacgatgcgaggagctaaaagaatggcaatcctgggtgatactgcctgggattttggaagccttggaggagtttttacatcaatagggaaagcactgcatcaggtttttggagctatttacggcgccgctttcagcggcgttagctggactatgaaaattcttattggagtagttatcacgtggatcggcatgaactctaggtccacttcactatcggtgagcctagtcctagtgggggtagtaacactttacctaggtgtcatggtacaggctgactctggctgcgtcgtttcttgggaaaacaaagaattaaaatgtggtagtggtatctttatcacagacaacgttcatacctggacggaacaatacaaatttcagccagaatctccatcgaaattagcctcagctatacaaaaagcacatgaagagggtatatgtggtataagatcagttactaggttggaaaatctcatgtggaagcaaattactcccgagttaaatcatatcctaagtgaaaacgaagtgaaattaacaatcatgacaggagatataaaggggataatgcaagcaggtaaaagatcattaagacctcaaccaacagaactaaagtacagctggaaggcttggggaaaagcaaaaatgcttagcacagaactccacaatcacacttttctcattgacgggccagaaacggccgagtgccctaacacaaatcgagcatggaacagtctagaagttgaagactacggatttggggtctttactaccaatatttggctgaaacttaaagaaagacaggatgtgttctgtgactcgaaattaatgagtgcggcgattaaagatagtagggctgtacacgcagatatgggatattggattgaatcggctctaaatgacacatggaaaattgaaaaagcctcttttatagaagtaaaatcatgtcattggccgaaaagtcacactttatggtcaaatggtgtactagaatcagaaatgattattcccaaaaacttcgctggtccagtaagccaacacaactatcgtcctggctatcatactcagaccgccggaccctggcatctaggaagattagagatggattttgacttttgcgaaggaacgaccgttgttgtaacagaggattgtggtaatcgcggcccttctttacgaacaacaacagcctctggaaaactaataacggaatggtgttgcaggtcatgcactttaccacccttacgttatagaggggaagatggctgctggtatggaatggagataagaccgctaaaagaaaaagaagaaaacttggttaattcattggttacagctggtcacggacaaattgataacttctcactgggagtattaggaatggcattatttctagaggaaatgctccggactagagttggtactaagcacgcgatattattggttgctgttagctttgtaacgctcataacaggcaacatgagttttcgtgacctggggcgggtaatggttatggtgggagctacaatgacagatgatatagggatgggtgttacatacttagcactgctggcagcgtttaaagtacgaccaacttttgcagcaggtctactcctcaggaaactaacgtcgaaggagctgatgatgaccacaataggcatagttttactaagccaggcgacaataccagaaactatactagagttgacggacgccctcgcgttgggtatgatggttctaaaaattgttcgcaacatggaaaaatatcaactagctgttactattatggcaatcttatgtgtaccaaacgcagttattttacagaatgcatggaaagtatcgtgtactacactggcagtagtgtcagtttcaccactcctattaacaagtagccaacagaaagctgactggataccactagcattaaccataaagggcctaaacccaaccgctatatttctaacaactctaagccgcacatcaaagaaaagatcatggccacttaacgaagctataatggccgtaggaatggtttcaatactagcctcctcactcctcaaaaatgacatacctatgacagggccactcgtagcaggaggtttattgactgtttgttacgtgttaaccggtcgaagtgcagatctagaattagaaagagcagcggacgttagatgggaagaacaagcggaaatatcaggttcgtcaccaatactttcaataacgatatcagaagatgggtcaatgagtattaaaaacgaggaagaggaacaaacacttacaatattaataagaaccggcctactcgtcatatctggtttatttccagtaagtatacctataaccgcggcagcatggtatctttgggaagtcaagaaacaacgtgcaggggtactatgggatgttccatctcctcccccagtgggcaaggccgaattggaagacggggcatatcgaattaaacaaaaaggtattttaggttactcacaaataggcgccggtgtatataaagagggaacatttcataccatgtggcatgttacgcggggagctgttctcatgcataaaggaaaaagaatcgaaccatcatgggcagacgttaagaaagacctaatctcttatggtgggggatggaaactagaaggcgaatggaaagaaggcgaagaggtccaggtattagcattggaaccaggcaagaaccctagagcagtccaaacaaagcctggtctatttaaaacaaacacaggaacaataggcgccgtaagtctggatttttcacctggaacctcagggtcaccgatcgtagataagaaaggaaaagtagttggactttatggtaacggcgtagtaacaaggtcaggaacttacgtatcggctatagcacagaccgaaaagagtatagaagataatccggaaatcgaggatgacatctttaggaaaaagcgactgacaataatggatctccatcccggtgcggggaagacgaaacgctatttgccggcgatagttcgagaggctatcaagaggggactacgcactctaatactagcgccaacacgtgtagtcgcggctgaaatggaagaagccttaagagggctgcctatcagatatcaaacaccagctatacgagcggaacacaccggaagagaaattgtagatctaatgtgtcatgctactttcacgatgcgtttgctatcaccaattagagtaccaaattataacttaattatcatggacgaagcccatttcactgacccagcgtcaatagcagcccgcggatatattagcaccagagtcgaaatgggtgaggcggcgggcatattcatgacagccaccccgccaggatctagagacccgtttccacagagcaatgcacctatcatggatgaagaacgagaaatcccggagcggagttggaactcaggacatgaatgggtaacagattttaagggtaaaaccgtttggttcgttccatccatcaaagcaggaaatgatattgccgcatgtcttcgtaaaaatggcaagaaagttattcagttgtcaaggaagacttttgattttgaatacatcaagactagaactaacgactgggattttgtggtgacgacagacataagcgaaatgggtgctaattttaaagcggaaagagtaatagacccccgtagatgtatgaaaccagtaattctaaccgacggggaggaaagagtgatactggcaggacccatgccggtcacacattcctctgcggcacaaagaagaggccgagttgggagaaaccccaaaaacgagaatgaccagtatatctatatgggcgaaccgttagaaaatgatgaggattgcgcacattggaaagaggctaaaatgttacttgataatataaatacgccagagggtattataccaagtatgttcgaaccggaaagagaaaaggtagatgcgattgatggagaatatcgcttgagaggggaagcaagaaagactttcgtggatctcatgagacgaggagatttacccgtctggctcgcatatagagtagctgcggagggaataaattatgcagatcgaagatggtgttttgacggtgtcaaaaacaatcaaatcctagaagaaaatgtggaggttgaaatctggacaaaagagggggagaggaagaaactcaaaccaaggtggctagatgctcgcatttactcagacccactagctttaaaagagttcaaagaatttgctgcaggcagaaaaagtttaacgttaaatttaataacggaaatgggacgactacctacttttatgacacaaaaggcacgaaacgcgcttgataacttggccgtactgcataccgcagaagcagggggtagggcatacaaccatgcattgagtgaacttcctgaaacactggaaaccctattgctactaaccttattggctactgtaactggtggcatctttttgtttttgatgtccggaaagggaataggcaaaatgactctgggcatgtgctgcattataactgcaagcatccttttgtggtatgctcagattcaaccacattggatcgcagcatctattatattagagttctttctgatcgtattattaatcccagaacctgaaaagcagcgcacgcctcaagataatcaacttacttacgtcgtgatagctattttaactgtcgtagcggctacaatggcaaatgaaatgggctttctcgagaaaaccaagaaagattttggcttaggttccataaccactcagcaaccagaatctaatatacttgacatcgacctacgacctgccagtgcctggactctatatgctgtggccactacctttattacaccaatgttacgccacagcatagaaaattcaagcgtgaacgtatcattgactgccatagcaaatcaggcaactgtactaatggggctaggtaagggatggccgttgagtaaaatggacataggggtcccattgcttgcaataggctgttactcacaagttaatcctataacattaacagctgcattattattattagttgcccactatgcaataatagggccaggtctacaagcaaaggcgacaagggaagctcaaaaacgcgcagcagcgggaataatgaaaaaccccacagtagatggaattactgttatagatcttgatccaattccatacgatcctaaattcgagaaacaattaggacaagtaatgctgctagtcttgtgcgtaacacaagtactaatgatgagaacaacatgggccttatgtgaggctctaacgctagccacaggacctattagtacgttatgggagggtaaccccggcagattctggaacactacaattgccgtatcaatggcaaacatttttcgtggatcttatttggcaggagcaggtctcctatttagtataatgaaaaatacagcaaatacacgacgggggacaggtaatgcgggggaaactcttggtgaaaaatggaaaaatagactcaatgctctaggtaaatccgagttccagatttacaaaaagtctggaatacaggaagttgatagaacgctcgcaaaggaaggcataaaacgaggagaaacagaccaccatgcagtaagcagaggttccgctaagttacgatggtttgttgagagaaatttggtgacaccggaaggtaaagttgtagatttaggctgtggacgcggtggctggagttattactgtggaggtttaaagaacgtgaaagaggtgaagggattgacgaagggaggtcctggtcatgaggagccaattccaatgagtacgtatggatggaatttagtgagacttcagagcggcgtagacgtcttctttaccccaccagaaaaatgcgacactctattgtgtgacattggcgagtctagtccaaatccgacagtcgaggcgggaagaacacttagggtacttaacctcgtcgagaattggctgaacaacaatacacaattttgtattaaagtgttgaatccatatatgccttcggtcatagaaaagatggaagcgttgcaacggaagtacggaggcgctctggtaagaaatcccctttcaagaaacagtacccatgaaatgtactgggtaagtaatgcgagtggaaatatagttagtagcgtaaacatgataagcagaatgttaataaatagattcacaatgagacataagaaagctacttacgaacccgacgtagacctgggctcaggtacgagaaacattggtattgaatcggaaacaccaaatctagatattattggcaaaagaatcgagaagataaaacaagaacatgaaacaagctggcattatgaccaagatcatccttataagacctgggcatatcatggctcttacgaaaccaaacaaactggcagtgcaagttctatggtcaatggggtagtaagactactgacgaaaccttgggatgtcataccaatggtaacccaaatggctatgacggatactacaccttttggtcaacagagggtcttcaaggaaaaagtagatactaggacgcaagagccgaaagaaggtaccaagaaacttatgaaaataactgccgagtggttatggaaagaacttggcaaaaagaagacacctaggatgtgcaccagagaagaatttgcacgtaaagtgagatcaaacgctgcgctcggagccattttcacagatgaaaacaaatggaaatcagcaagagaagccgtagaagacagtggattttgggagctagtagacaaagaaagaaatcttcacctagaaggaaaatgcgaaacatgtgtgtataacatgatgggcaaaagagagaagaaacttggagaatttggcaaagcgaaaggaagtagggctatatggtatatgtggctcggtgcaaggtttttagagttcgaggctttaggatttttgaatgaggaccactggttttctcgagaaaacagcttgagtggagttgaaggtgaagggctacacaaattgggatatattttgcgggacgtcagtatgaaggaaggaggcgctatgtatgcggacgatacagccggatgggatacacgtattacattggaagatctcaaaaatgaggaaatggtaactaaccacatggaaggggaacataagaagctagccgaagctatatttaaattgacgtatcagaacaaagtggtgagagtacaacgaccgacaccacgcgggacagttatggatatcatcagtcgtcgagaccagcgaggctctggtcaagtcgtaacctacggtttaaatacatttactaatatggaggcacaactaatccgacaaatggaaggcgaaggtgtttttaagtcaatacagcaactaacagttaccgaagaaattgcagtcaaaaactggttagtgcgagtaggcagagaacgtcttagccgcatggcaatctccggcgatgattgcgtcgtcaaaccgcttgatgacaggttcgcatccgctcttacagcgttaaacgatatgggcaaagtacgtaaagacatccaacaatgggaaccaagtaggggttggaatgactggactcaagtccccttttgttcacatcacttccatgaactgattatgaaagacggtagagtactcgtagtaccatgtagaaatcaagacgaacttattggtagagccagaatatcgcaaggcgcgggttggagtctcagggagactgcgtgtctgggcaagtcatatgcccaaatgtggagtttaatgtacttccatcgcagagacttacgtctagcagcaaacgctatctgcagtgccgtaccgtcacactgggttccaacatcacgaacaacctggagtatacatgcaacgcatgaatggatgactaccgaggatatgctaactgtttggaatcgagtgtggatacaggagaatccttggatggaagacaaaacgcctgttgagagttgggaggaaattccatatttgggtaaacgagaagatcagtggtgcggatcgttaattggacttacgtcacgcgcaacatgggcgaaaaacatacaaacagctataaaccaggttagatccttaattggcaacgaagaatacaccgattatatgcccagtatgaaaaggttcagaagagaagaagaagaggcaggcgtactatggtga

SEQ ID NO: 22856 - RNA, 9876 nt, synthetic construct
  misc_feature 1..9876: note = derived and/or modified CDS sequence (opt6) from DENV-2__KC762667__SS-prME
  source 1..9876: mol_type = other RNA
acggcaggaataataataatgatgattcctaccgttatggcttttcacttgacaacacgaaatggagaaccacatatgatagtatccaggcaggaaaaaggaaaaagccttttatttaaaactgaaaatggagtaaatatgtgcacattaatggcaatggacctgggcgaattgtgcgaagataccataacttataactgtcctttactgaggcagaatgaaccagaagacattgattgttggtgtaactcaacatcaacatgggtaacttatgggacctgtacagctacaggagaacatagaagagagaaaagaagcgtagctcttgtaccacacgtgggtatgggattggaaacaagaactgaaacatggatgagtagcgaaggtgcatggaaacacgcacagcgcatagaaacgtgggtactaagacatcccggattcacaattatggcagccattcttgcatacacaatcggtactacatacttccaaagggtattgatatttattttattaacggcagtaacaccaagcatgacaatgagatgtataggaatcagtaatagggatttcgttgaaggagtgagtggtggctcttgggttgatatagttctggaacatggaagttgtgtgacaactatggccaaaaataaacctacattggatttcgaattaatcaaaactgaagctaaacatccagccaccctgaggaaatattgtatagaagcaaaattaactaatacaactaccgcttctcgttgccctacccagggtgaaccttctcttaatgaagaacaagacaaaaggtttgtgtgcaaacattctatggtggaccgaggatggggaaatggttgtggcttatttggaaaaggtggtattgttacttgcgctatgtttacatgtaagaaaaatatggaaggaaaaatcgttcagccagaaaaccttgaatacacaattgtaatcacccctcatagtggggaagagaatgcagtagggaatgatacgggaaaacatggaaaagagattaaagtaacaccgcaatcgtccattacagaggctgagctaactggatatgggaccgtgactatggaatgcagccctagaacaggtcttgactttaatgaaatggttttattacagatggaaaataaagcctggttagtgcatcgacagtggtttctagatctgcctctaccttggctaccaggggctgacactcaaggaagcaattggatacaaaaagaaacacttgtaacatttaaaaacccacatgcaaagaaacaagatgttgtggttctagggagtcaagagggcgcaatgcatacggcgctaacgggcgcgacagagatacaaatgagctctgggaatttactttttactggacatttaaaatgtagattacggatggataaacttcaattaaaaggaatgtcttacagtatgtgcacaggtaaatttaaagtggtgaaagagattgctgagacgcaacatggtacaattgtaataagagttcaatatgaaggtgatggatcaccatgtaaaataccatttgaaataatggaccttgagaaacgacatgtactagggaggctgatcacggttaacccaatagttaccgaaaaagacagccccgttaacattgaggcagaaccgccattcggtgatagttatatcataataggagttgaacctggccaattaaaactaagttggttcaagaaaggaagcagtataggacagatgttcgaaaccactatgagaggggcgaaacgaatggcaatattgggcgataccgcttgggacttcggctctctaggaggagtatttacaagtatcggaaaagcattacatcaggtgtttggggccatttacggagcggcgttttccggcgtaagttggacaatgaaaatattaatcggagtagtaattacatggatcggcatgaactcgcgatcgactagcctttcagtatcattagtgttggtgggagtcgttacactttacctgggagttatggtacaagccgactcaggatgcgttgttagttggaaaaacaaagaactcaaatgtggtagtggcatttttataacagataatgtgcatacatggacagagcaatacaaatttcaaccggaatcaccgtcaaaactcgccagcgcaatacaaaaagctcatgaagaaggaatatgtggaataagatcggtcacacgacttgaaaatcttatgtggaaacagatcacacccgaactcaatcatatattaagtgaaaatgaagtaaaactcaccattatgactggggacatcaaagggattatgcaagcaggaaaacggtcattacgacctcaacctacggagctaaaatatagttggaagacgtggggtaaagctaaaatgctttctacagaacttcacaatcatacgttcctaatagatgggccagagactgctgaatgtccaaacgcaaatagggcatggaactccttagaagtcgaggattatgggtttggggtattcacaacaaacatatggctaaaactaaaagaaagacaagatgcgttttgtgactcaaaattaatgtccgcagccataaaagataacagagctgtgcatgcagatatgggttattggattgagtctgcacttaatgatacttggaaaatagaaaaggcctcctttatcgaggttaaatcatgccactggccaaaatcacacacattatggagcaatggtgtccttgaaagtgaaatgattatacctaaaaattttgcaggtcccgtaagccaacataactataggcctggctatcatacccaaactgctggcccgtggcacctggggcgattagaaatggactttgatttttgtgaaggaactaccgtggtcgttactgaagattgcggaaatagaggacccagcttaagaacaaccacggcttcaggcaaactaattactgaatggtgttgcagaagctgtacacttcctcctctccggtatcggggagaagatggctgctggtatggtatggagatccgtccattgaaagagaaagaagaaaatctggtaaatagcttagtaacagcgggtcacgggcaaatagataacttctcacttggagtccttggcatggcactatttttggaggaaatgttgaggacacgcgttggcaccaaacacgccatcctgttggtagccgtctcatttgttactttaatcactgggaacatgagtttccgcgacttaggcagggttatggtaatggttggagccacaatgacggatgatatcggtatgggggtaacttacctagcattgttggcagcattcaaagttcgtccaacttttgcagctggcctcttacttagaaaattgacatccaaagagctcatgatgactactattggagttacgttactgagtcagtctacaatacctgagaccatattagagctaactgatgccctagcgctgggaatgatggttctaaaaatcgtcagaaacatggaaaaatatcaactcgcagtgaccatcatggcgatcctctgtgttccaaacgcagttatattacaaaatgcatggaaagtaagttgcactacacttgcagtagtaagtgtaagtccgttattacttacctcttcgcaacagaaagctgactggatacccctggcgttaaccataaaagggttaaacccgactgctatattcctcacgacactcagccgcacaagcaagaaacgaagttggccgttgaatgaggctatcatggcagtcggaatggtatcaatattggcaagcagcttattaaagaacgacataccaatgacagggcctctggtcgccggtggtttgctaacagtttgctatgtcctaaccggtcgttccgcagacctggagctagaacgcgctgcggatgtaagatgggaagaacaggcagaaatttctggcagttcaccaatacttagtattacaatatcggaagatggttctatgagtatcaagaatgaggaggaggaacaaaccttaacaatcttaataagaactggtctgctcgtaatatccggcctctttccggtcagtataccaataactgcagcagcatggtatctttgggaagtcaagaaacaaagagcaggagtcctatgggacgtaccaagtccgccgccggtaggcaaagcggagttagaagacggggcataccggatcaaacaaaaggggatcttaggatactcgcaaataggagccggtgtatataaagaagggacatttcatacaatgtggcacgtaacacgaggggcagtattgatgcacaagggtaagcgtatagaaccgtcctgggcagacgttaagaaagatttaataagctacggaggcggatggaaactcgaaggagagtggaaagaaggtgaagaagtgcaagtacttgcactagaaccaggtaaaaatcctcgggcagtacaaacaaaaccaggactgtttaaaacatcaactggtacaattggtgccgtatccttagatttttctccaggaacatcaggtagcccgattgtggacaagaaaggtaaagttgttgggttatatggaaacggagttgtaacgagatccggaacctacgtgtcggcaatcgcacagactgagaaaagtatagaagacaaccccgagatagaagatgatattttccgaaagaagagactaacgattatggatctgcatccaggtgccgggaagacaaaacgatacttgccagcgatcgtcagggaggctataaaaagaggtcttcgaacacttatcttagcgccgactagagtagttgcagcggaaatggaagaagcactccgaggattaccgataagatatcagacgcctgccataagagcagagcacactggaagagaaattgttgatttaatgtgtcatgccactttcacaatgaggttattgagtccaataagagtacccaactataatctgatcataatggacgaagcacattttacagacccagctagcatagcggctcgaggctatatctcaacaagggttgagatgggggaagctgctggaatatttatgaccgccacacctcctggcagtagagaccctttcccacagtcaaatgcacctataatggatgaagaacgggagataccagaaaggtcatggaactctggtcatgaatgggtaaccgatttcaaaggaaaaactgtgtggtttgtaccaagcattaaagccggcaacgatatagccgcatgtttacgcaaaaatggtaaaaaggtgatacaactaagtagaaagacattcgacttcgaatatataaaaaccaggacaaatgactgggattttgtcgtaactactgacatatcggaaatgggcgctaattttaaagcagagcgcgtaatagatccgcgcagatgcatgaaaccagtcattttaactgacggggaggaaagagtcatcctagctgggccgatgcctgtcacacattcatccgctgcacagcggaggggacgagtcggacgaaatcccaaaaatgagaatgaccaatatatatatatgggtgaaccactagaaaatgatgaagattgtgcacattggaaagaagctaaaatgttattggataatataaatacaccagaaggaattattccgagcatgtttgagccggaacgtgagaaagtagatgcgatagatggagaatatagacttagaggagaagctagaaagacttttgtggatctaatgagaaggggtgatttgccagtttggctagcgtatcgtgtggctgcagaagggattaattacgcagatagaaggtggtgtttcgacggagttaaaaacaatcaaatcctagaggaaaatgttgaagtagaaatctggacgaaggagggagaaagaaagaaattgaaacctagatggcttgatgctagaatctatagtgaccccctagcattaaaagagttcaaagaatttgcagcaggaagaaagtcactaaccctcaatctcattacagagatgggtcgattgccaacttttatgacacaaaaagcaagaaatgcattagataacttagcagtattacacactgcagaggcagggggtagagcatataaccacgcattgtcagaattacccgagacgctagaaactctccttttactaacactcttagccaccgttaccggcggcatatttctattcctaatgtctgggaaagggataggaaaaatgactctaggtatgtgctgcattattacagcaagcatactgttgtggtatgcacaaattcaaccacattggatagctgcttcgattatccttgagttcttcttaatcgttctattaatcccagaacccgaaaaacagcgaacgccacaagataaccaactaacatacgtagtaatagcaattttgactgttgtcgcagcaactatggccaatgaaatgggttttcttgagaaaaccaagaaagattttggtttgggttctataactacccaacaacccgaatcaaacatcttagatatcgacttaagaccagcgagtgcatggaccctatatgctgtagcgacaactttcattacacccatgctcaggcattcgatagaaaattcatcagtaaatgtttctttaaccgcaatagctaaccaagcaacggtactgatgggcttgggtaagggttggcccctatctaaaatggacattggagtacctctacttgcaatcgggtgttactctcaagtgaatcctattactctaactgcggcactcctacttttagttgcacattatgctataattggacctggtttacaagcgaaagcaacgcgtgaagcacaaaagcgagcagccgccggcattatgaaaaatcctacagtagatggaattacggtgatcgatctagacccaataccatatgatccaaagttcgaaaaacagctagggcaggtaatgctactggtcctatgtgttacacaagttttgatgatgcgtactacatgggcgctatgcgaggcactgacccttgcaactggaccaatttcaactttatgggaaggaaatcctggtaggttctggaataccacaattgcagtgtctatggctaatattttccgtggcagctacctagccggcgcgggattattattctctataatgaagaatacggccaatacgcgtcgaggcacgggtaacacaggagagacgctaggagaaaaatggaagaatagactcaatgcacttggaaaatctgagttccaaatatacaagaaaagtggtatacaagaagtcgatcgtaccttagccaaggaagggattaaaagaggggagacagaccatcatgcggtttcgcgtggatctgctaagttaagatggtttgtggaaaggaaccttgtgaccccagagggtaaagttgtagatctcggatgtggacgaggagggtggagttactactgcggaggactcaaaaatgtcaaagaagtaaagggactaacaaaaggaggtccgggacatgaagaaccaatacccatgtcaacttacggatggaaccttgttagattacaaagcggtgttgatgtatttttcacacccccagaaaaatgtgatacgttgttatgcgacattggagagtcgtctcctaatccaactgtcgaggcaggacgaactcttagagtacttaacttagtagagaattggctcaataataatacccaattttgtattaaagtactaaatccttatatgccttctgtaattgagaaaatggaggcattacaaagaaagtacggaggagcgctagtccgaaatccgttgtcccgaaatagtacacacgagatgtactgggtatccaatgcttccggaaacatcgtatctagcgtgaatatgatttcaagaatgttaatcaatcgattcactatgagacataaaaaggctacatatgaaccggacgtcgatctaggaagcggcaccaggaatattgggattgaaagtgagaccccaaatttagatatcattggaaaaagaatcgagaaaatcaaaagagaacatgagacgagctggcattatgatcaagatcacccatacaagacttgggcgtaccatggatcgtatgaaacgaaacaaactgggagcgcgtcctcaatggttaatggtgtcgttcgtctactcactaaaccttgggatgtcatacccatggttacacagatggctatgaccgacacaacgccgtttggtcaacaaagagtatttaaagaaaaagttgacacgagaacacaggaaccaaaagaaggaaccaagaaattaatgaagatcacagctgagtggttatggaaagaattaggaaagaagaaaactccccgaatgtgtacccgagaggaatttacccgaaaagtacgatctaatgcagctctaggagcaatatttacggatgaaaacaaatggaaatcggcgcgtgaagcagtcgaagactcaggattttgggaactggtagacaaagaacgaaacctacatttagaaggaaaatgtgagacttgtgtatataatatgatgggaaaacgagaaaagaaattaggggaatttggcaaagcaaaaggttccagagcaatatggtacatgtggttaggagccaggtttcttgagttcgaagcactaggtttcctaaatgaggatcattggttcagtcgtgaaaactcactatccggagttgaaggggaaggattacataaacttggatatatactcagggatgtgagcaagaaagaaggcggggccatgtatgcagatgacactgcgggatgggataccaggataacactggaagacttgaaaaatgaagaaatggtgaccaaccacatggagggggagcacaagaaattagcagaggctatcttcaaactgacttaccagaataaagtggttagggtgcaaagacctaccccacgtggtaccgttatggacataatctctcggcgagaccagagaggtagcggccaggtggtaacctacggactaaacacatttactaatatggaagcacaactgattagacaaatggaaggtgagggtgttttcaaaagcattcaacatcttacagttacggaagagatcgccgttaaaaattggcttgttagagtcggaagggagagattatcacgtatggccatatctggcgatgattgtgtagttaaaccattagacgacagatttgctagcgcactaacagcgttaaatgatatgggcaaagttaggaaagatattcaacagtgggaaccatccagaggatggaacgattggacacaggtaccattttgttcacatcactttcacgaactcataatgaaagacggccgagtattagtagtgccctgcaggaaccaggatgaacttataggacgtgcccgaatttcgcaaggagccggctggtctttacgcgaaacggcatgtcttggaaaatcttacgcacaaatgtggtccctcatgtactttcacagacgggatctccgcctagcggcaaatgccatctgctcagcggtcccatcccattgggtcccaacatcacggactacgtggtccattcatgcaacacatgaatggatgactaccgaagacatgcttacagtatggaaccgcgtttggatccaggaaaacccgtggatggaagacaaaactccggtcgaaagctgggaggagatcccatacctaggcaaacgtgaagaccaatggtgcgggagcttaataggcctaacctctagagcaacttgggcaaagaatatacaaactgctattaaccaggtaagaagtttaattggaaatgaagaatacacagactatatgcctagcatgaagagatttcgtcgtgaagaagaggaagccggagtattatggtaa

SEQ ID NO: 22857 - RNA, 9876 nt, synthetic construct
  misc_feature 1..9876: note = derived and/or modified CDS sequence (opt6) from DENV-2__KC762659__SS-prME
  source 1..9876: mol_type = other RNA
acagcaggtattataataatgatgatacctacagtaatggcattccatcttacgacaagaaatggagaaccccatatgatagtttcccgccaagaaaaaggtaaatcattgttattcaaaacagaaaatggagtaaacatgtgcaccttaatggcaatggatctaggagaattatgtgaagatacaataacatacaactgtccacttctaagacagaacgaaccagaagatatagattgttggtgtaattcgacttccacatgggtgacatatggaacatgtacggcaacaggagaacacagacgtgagaaaagatcagttgcacttgtgcctcatgtagggatgggactagaaacgcgaaccgaaacttggatgagctcagaaggggcatggaaacacgctcaacgtatagaaacgtgggtattgcgccacccaggttttaccataatggcagcaattcttgcgtataccataggaacaacctattttcaacgcgtactaatatttatattattaacagctgtaactccaagtatgaccatgagatgcatagggatctcaaatagagactttgtagaaggtgtcagcgggggatcatgggtagatatcgtattagaacacggatcttgtgtcaccacaatggccaaaaacaaaccgacacttgactttgaattaattaaaacagaagcgaaacatccagcaacactacgaaaatactgtattgaagcgaaattaactaacaccacaacggcgtcgcgttgcccaacacaaggagaaccatcgttaaatgaagaacaagacaaaagatttgtatgtaaacattcgatggtagatcgtggatgggggaatgggtgcggcctttttgggaaaggtggcattgtcacatgcgctatgtttacatgtaagaaaaatatggaaggcaaagtagttcaaccagaaaatttagaatatacaattgtcataaccccgcacagcggtgaggaaaacgcggtaggaaacgatacgggtaaacacggcaaagaaataaaagtaacgccgcaatcatccatcactgaagcagaacttacaggctacggaaccgtgacaatggaatgcagtccacgaactggtttggatttcaacgaaatggtattactacagatggaaaataaggcttggttggtgcacagacagtggtttttagatttgcctttaccctggctaccaggtgcagacactcaaggctcaaattggatccaaaaagaaacattagtaacgtttaaaaaccctcatgccaagaaacaagacgttgtggtactagggtcacaagagggtgctatgcatacagcattaacaggagcgactgaaatccaaatgtcaagcggaaacctgctgttcactgggcatttaaaatgtagattacggatggataaactacagttaaaaggaatgagctattctatgtgcaccggcaaattcaaagtggtaaaagagatagcagagacgcaacatgggacaattgtcatacgtgtccaatatgaaggtgacggatcaccgtgcaaaatacccttcgaaataatggatttggagaaaaggcatgttctgggccgacttataacggtgaacccaatagttacagaaaaagacagccccgtaaacatagaagcagaaccgccgtttggggactcttatataataataggagttgagccaggtcagttaaaattatcatggtttaagaaaggatcgtcgataggacaaatgttcgagactacaatgaggggcgcaaaacgaatggcgatactaggagatacagcatgggattttggctccttgggtggcgtcttcacttcaatcggcaaagctctacaccaagtctttggagctatttatggggcagcgttctcaggggtgtcttggacaatgaaaatacttataggagttgttattacgtggatcggtatgaacagccgatctacttcgttatcagtgagcttggtgttagtcggcgtcgtaacgttatatctgggagtaatggtgcaagcagatagcggctgtgtcgttagttggaaaaataaagaacttaaatgcggatctggcatttttattacagacaacgtacatacgtggacagagcagtataaattccaaccagaatccccatcgaaactggcaagtgcaattcaaaaagctcacgaagaaggcatatgtggaatacgtagtgtcactagactagagaatcttatgtggaaacagattacccctgagcttaatcacattctatctgaaaatgaagtaaaattaactataatgaccggcgatatcaaaggtataatgcaagcaggaaaacgatcattacgacctcaaccaactgaattaaaatacagttggaagacttggggtaaggcaaagatgctaagtactgagctgcacaatcatacatttttgatagacggaccagaaacggccgaatgcccaaatactaaccgtgcatggaactcactggaagtagaggattacggcttcggcgtatttacgacaaatatttggttgaaacttaaagaaagacaggacgtattctgtgactcgaaactaatgtctgcagctatcaaagacaacagagcagttcacgccgacatgggttactggatggaaagtgcgctaaacgatacatggaagatagaaaaggcttcgtttatagaggtcaaatcatgtcactggcctaaatctcacacactatggagtaatggtgtgctcgaaagtgagatgattatcccaaagaactttgcaggacccgtttcacaacataattacagacctggttaccacacgcaaactgccggcccttggcatttagggcgactcgaaatggacttcgacttttgcgaagggacaacagtagtagtaaccgaagactgtggtaaccgcgggccttcactccgaaccaccactgcatccgggaaacttataactgagtggtgttgtagaagctgtactctgcccccactaagatacagaggagaagatggctgttggtacggaatggaaataagaccgttaaaagaaaaagaagagaatcttgtaaacagtttagtaacggctggccatggacagattgataatttttccctaggggtccttggaatggcactattcctggaagagatgctacgtacccgcgttggtacgaaacatgcaatcctcttagttgcggtcagcttcgtaactcttataacgggtaacatgtcatttagagaccttggtcgtgtcatggtcatggtcggagcgactatgacagatgacattgggatgggagtaacctacttagctttactggctgcattcaaagtaagaccaacatttgccgcagggctattactgcgtcgactgacgtctaaggaattaatgatgacaacaataggcatagtgttactctcacaatccactattccagaaaccatattagaactaacagacgctctagccttaggaatgatggtactcaaaattgttaggaaaatggaaaagtatcaactggccgttacaattatggctatattgtgtgtacccaatgcggtaatactccaaaatgcgtggaaagtaagttgtacaactttggctgtcgtaagcgtaagtccccttcttctcacaagctctcaacaaaaagcggactggattccactagcccttacaataaagggtttgaatccgaccgctatattcctcacaacactcagcagaacctcaaagaaacggtcatggccactgaacgaagctataatggcggttggtatggtttcaatcttagcttcatcacttttaaagaatgacatacctatgaccggccctctagttgctggaggtttactaactgtttgctacgtgctgacaggaagatcagcggatctagaattagaacgagcggcagacgttagatgggaagaacaggcggaaatatcaggcagtagccccattctttcgatcacaattagcgaggacgggagcatgtcaatcaaaaatgaagaggaagaacaaacattaactattttaatacggacagggcttctagtaatttcagggttatttccagtgtcgataccaatcaccgctgctgcctggtatctatgggaagtcaagaaacaaagagcaggagtgctttgggacgtgcctagtccacccccagtgggtaaggctgaattagaagatggggcttatagaataaaacaaaagggtattctaggttatagtcagataggagcgggagtttataaagaaggcacatttcacacaatgtggcacgtaactagaggcgccgtcctaatgcacaagggaaaaagaatagagcctagttgggcagacgtcaagaaagatctgataagttatggaggaggatggaaattagaaggagaatggaaagaaggagaagaagtccaagttttagcactggaaccaggcaaaaacccaagggcggtgcagactaaacctgggttatttaaaacaaataccggcacgattggtgcagtgtcgcttgacttttcccctggtacgagtggttctccaattgtcgacaagaaaggtaaagtcgtcggactatacggtaatggcgttgtaacacgatctggaacttacgtatcggctatcgcccagactgagaaaagtatcgaggacaacccagaaatcgaagatgatatatttaggaagaaacgacttactattatggatctacatcccggcgcgggcaagacgaaacgttatctacctgctatagttcgcgaagcaataaaacgggggttgagaaccttaatactggctccaaccagagttgtagcagccgagatggaagaggctctccgaggtttacctatacggtatcaaacgcctgctatccgggcagaacataccggtagggaaatagtggatcttatgtgccatgcaacatttacgatgagattactatctccaattagagtacctaattacaacttaataatcatggacgaagcccacttcacagacccagcgtcaatagcagcaagagggtacatatcaacacgagtcgaaatgggagaagccgctggtatattcatgactgctaccccacctggttctagagacccattcccccaaagtaatgcacctataatggacgaagaaagggagataccggaaaggtcatggaacagcggacatgaatgggtcacagatttcaagggcaagacagtatggtttgtcccaagcatcaaagctggcaatgatatcgctgcatgtctgaggaagaacggcaagaaagtgattcaattatctcgaaaaacatttgacttcgaatacattaagacacggactaacgattgggactttgttgtgactactgacatatcggaaatgggagcaaactttaaagccgaaagagtaattgaccccagacggtgtatgaaacccgtcatactgactgatggagaagaacgggtcatacttgcaggacctatgcctgtaacccacagctcagcagcccagaggagaggtagagtcggtcgtaaccccaagaatgaaaatgatcagtacatatatatgggggaaccacttgagaatgatgaagattgtgcacattggaaagaagcgaagatgttactagacaatattaacacacctgaaggaataataccttccatgttcgaacctgagcgggaaaaggtagatgcaatagacggagagtaccgtttgcgaggtgaagcacgaaaaacatttgtagatctaatgcgacgaggagacctgcccgtgtggctcgcatacagagtggccgccgaaggaataaattatgcggaccgtcgttggtgtttcgacggtgttaaaaacaatcaaatactggaagaaaatgtcgaggtagaaatctggactaaagaaggtgaaagaaagaaattaaaaccaaggtggttggacgcaagaatatactcagatccattagctctaaaagaatttaaagaatttgccgcaggtcgaaaatcattaacattaaacttaataacagagatgggcaggttaccaacatttatgacccaaaaagcgagaaacgcactcgataatctcgcagtgctccatacggcggaggctggtggcagagcatacaatcatgccctctcggaacttcccgaaaccttagaaacacttctgcttctgactctgttagccacagtcaccggtggtatatttttgtttctaatgagtggtaaagggattgggaaaatgaccctaggcatgtgttgtattataaccgcaagtattttgttatggtacgcccaaatacaaccacactggatagccgcttcaatcattctagagtttttcttaattgttttattaataccagaacctgagaagcaacgaacaccacaagataatcagctcacttatgtagttatagcaatcctcaccgttgtggcagcgacaatggcaaacgagatgggattcttagagaaaactaagaaagattttggactgggtagcataaccacacagcaatctgaaagcaatattctcgacatagacctacggcccgcttcggcatggacgttatacgctgtggctacaacgtttataaccccaatgctacgtcactctatagagaactcctcagtgaatgtaagtctaacggcaatcgcaaatcaagcaacagttttaatgggcctcggtaagggttggccactatctaaaatggacataggtgtacctcttttagcaataggctgttacagccaggtgaaccctataaccctaactgcggcattattactcctagtagcacactacgcaataattgggccaggtttacaagccaaagcaactcgtgaagctcagaagagagcggctgcaggaataatgaaaaatcccacagtagacggaattaccgtcatcgacctggatccgataccatatgatccaaaattcgaaaaacaactgggtcaagtaatgctcctcgttctctgtgtcactcaagtcctaatgatgcgaactacatgggcgctttgcgaagcccttactctagcgacgggcccaatatcgactctgtgggaaggtaatccaggaagattttggaataccacaatagcggttagcatggcaaatatctttcgcggtagttatcttgcgggagcaggattactattcagtatcatgaaaaatacagctaacacacgcagaggaacaggtaatacaggggagactttaggagagaagtggaaaaaccggcttaacgctctaggcaaatcagaatttcaaatatataagaaatcagggatacaagaggtagataggacattagcaaaagaaggtataaaaagaggcgaaacagatcatcatgctgtatctcgaggatccgcaaaactacggtggtttgttgaaagaaatttagtaacacctgaaggaaaggtagtcgacctaggatgtgggaggggtggctggagctattattgcggaggactcaaaaacgtaaaagaagtcaaaggattaacaaaaggaggaccgggccatgaagaaccaatacccatgtcaacatatgggtggaatctagttcgtcttcaaagtggtgttgatgtctttttcacgccaccagagaaatgtgatactctactttgtgatataggtgaaagcagcccaaaccctacagtagaggccggaaggactctaagagtattaaacttagttgaaaactggttaaataacaatacacaattttgcattaaggtgttgaacccatacatgccatctgtaattgagaaaatggaagcactccagagaaagtacggtggagcactggtgaggaatcctctctccagaaacagtacacatgaaatgtattgggtaagtaatgcgtcaggtaacatagttagcagtgttaacatgattagtaggatgttaattaatagattcacaatgcgacacaagaaagctacgtatgagccggacgttgatttgggtagtggaacgagaaacataggtattgaaagtgaaacaccgaacctcgatatcattggaaaaaggatagagaaaataaaacaagaacacgaaacatcttggcattatgatcaagatcacccatataaaacgtgggcttatcatggtagttacgaaacaaaacagacaggctcggcttcaagtatggttaatggagtggtccggctactcaccaaaccttgggatgtaataccgatggtaacacaaatggctatgaccgatacaacacctttcggtcaacaaagggtatttaaagaaaaagtagacaccaggactcaagaacccaaagaaggaaccaagaaattaatgaaaataacagcagaatggctatggaaggagctaggtaagaagaaaacaccaagaatgtgtacaagagaagaatttacacggaaagtaagatccaatgctgcgctaggcgctatttttacagatgaaaacaaatggaaatccgcccgagaagcggtagaagattcaggtttttgggaattagtggacaaggaacgaaatctacatttagaagggaaatgtgagacttgcgtttataatatgatgggtaaaagagagaagaaattaggagagtttggtaaagcaaaaggttctcgagcgatttggtacatgtggttgggagcacgattcctcgaatttgaagcattaggttttctaaacgaagatcattggttctcaagagagaactcattgtcaggtgttgaaggtgaaggccttcataagttaggttatatactgagggatgtatcaaagaaagaagggggagcaatgtacgctgacgataccgccggttgggacaccagaataacactagaagatctcaagaacgaagaaatggtgactaaccacatggaaggagaacacaagaaattagcagaagctatattcaaattaacttatcaaaacaaagtagtaagagtacaacggccaacgccaaggggaacagtaatggatattatatcaagacgggaccaaaggggatctggtcaagtagtcacgtacggtttgaatacctttacaaatatggaagcacaattgatacgtcaaatggaaggagaaggagtattcaaaagtatccaacagcttacagccaccgaagaaattgcagtcaaaaactggctagtacgtgtaggaagagaaagactttctaggatggcaatatccggagatgattgcgttgtaaaaccactagatgatagattcgcaagcgcgttgactgcactcaacgatatgggtaaagtaagaaaagatatccaacaatgggagccttcacgcggctggaacgactggacacaggtacccttctgttcacaccatttccatgaacttatcatgaaggatggaagagtactcgtagttccatgccgaaatcaagacgaactgatagggagagctcgtatttctcaaggagccgggtggagtttaagagaaacggcttgtcttggaaagtcgtacgcccagatgtggtccttaatgtatttccataggagagacttgagactggcagcaaatgcaatatgctccgccgttccatcacattgggttcctacaagccgtacaacgtggtcaatacacgcaacacatgagtggatgaccacagaggatatgcttacagtttggaacagggtatggatacaagagaacccatggattgaggataaaactccagtcgagagttgggaagaaattccatacctcggcaaacgtgaagatcaatggtgcggcagcctcataggccttacgtctagagcaacttgggccaagaacattcaaaccgctataaaccaagtacgttcacttattggtaatgaagaatacaccgattatatgccatctatgaaacgttttcgcagagaagaggaagaagccggtgtgctttggtga

SEQ ID NO: 22858 - RNA, 9876 nt, synthetic construct
  misc_feature 1..9876: note = derived and/or modified CDS sequence (opt6) from DENV-2__KC762657__SS-prME
  source 1..9876: mol_type = other RNA
actgcgggaattataattatgatgataccaaccgtaatggtgtttcacttaactactagaaatggtgaaccgcacatgatcgtgagtcgtcaggaaaaaggtaaatcattacttttcaaaactgaaaatggagtaaatatgtgtaccttaatggcaatggacttaggagaattatgtgaagatacgataacttacaattgcccattacttcgacaaaacgaaccagaagacattgactgttggtgtaactcgacaagtacctgggttacatatggaacatgtacagcgaccggagaacatcgtagggagaagcggtcagtagcgttagtgccccacgttggaatgggattggaaacacgaactgaaacatggatgagtagtgaaggtgcttggaaacacgcacaacggatagaaacatgggttttaagacatccaggattcacaatcatggcagcaattcttgcatatacaattggaaccacctattttcagagagtcctaatatttatacttttaacggcagtaaccccaagcatgacaatgcgatgtataggtatatcaaatcgagatttcgttgaaggtgtaagtggtgggagttgggtagacatagtcttagaacacggttcatgtgttacgacgatggcgaaaaataaaccaaccttagatttcgaactaattaaaacagaagccaaacatcccgcaactttacgcaaatactgtattgaagccaaattaacaaatacgacaacagcatctcgttgtccaacacagggcgaaccttccctcaatgaagaacaggataaaaggttcgtttgcaaacattcaatggttgatagggggtgggggaatggatgtggcctgtttggaaaaggagggatagtaacatgcgctatgttcacatgcaaaaagaacatggaaggtaaagtagtgcagcccgaaaacctggaatatacaatagttataacacctcatagtggtgaagaaaacgctgtgggaaacgatactggaaaacatggtaaggaaataaaagtcactccccagtcaagcatcacagaagcagaacttaccggctatggaactgtaactatggaatgttcaccgagaaccggtctcgactttaacgaaatggtcttattacaaatggaaaacaaggcctggttagtgcacaggcaatggtttttagaccttccattgccttggctgcccggtgcagatacccaggggtcaaattggatacaaaaagaaactttagtaacttttaaaaatcctcacgccaagaaacaagatgtggtggtgctaggttcgcaagaaggtgcaatgcatacggcattgacgggagccacggaaatacagatgagctcagggaatttactcttcacgggtcacctaaaatgtcgattaagaatggataaactacaattaaagggcatgtcatattcaatgtgcacggggaagttcaaggttgtaaaggaaattgcagagacacaacacgggactatagtaattagagttcagtacgagggggatggatcaccatgtaaaataccttttgaaataatggatttagagaaacgacatgtccttggaagactgatcacagttaaccccatagtaactgaaaaagactcaccagtcaatatagaagcagaaccaccgttcggtgacagttatattataatcggcgtggaaccaggacagttaaaactatcctggttcaagaaaggctcgtccatcggccagatgttcgagacaaccatgcgaggtgcaaaacggatggcaatattgggagatacggcgtgggattttggaagtctcggaggtgttttcacaagtatagggaaagcgctgcaccaagtattcggcgcaatatatggggccgctttttcaggagtatcttggacaatgaaaatactcattggtgtggtaatcacttggattgggatgaactcaaggagcacgagtttgtccgtctctttagtcttagtcggtgtcgtaacactttacttaggggtgatggtacaagcggattcaggatgcgtagtatcatggaaaaataaggaattaaaatgtggctccggtatttttataactgataacgtacatacatggactgaacaatataagttccaacctgaaagtcccagtaagttggcatcagccatacaaaaagcccacgaagaaggcatatgtggcattcgttccgtgaccagattagaaaacctgatgtggaagcagataactccagaactaaatcacattttaagtgaaaatgaagtaaaactaacgataatgacgggcgatattaaaggtattatgcaagcaggtaaacgatcactgcgtcctcagccaactgaacttaaatacagttggaaaacctggggtaaagctaaaatgctgagtacagagctccataatcataccttccttatcgacggaccagaaacagctgaatgccctaacactaacagagcttggaactccttagaagttgaagattacggatttggcgtgttcacaacgaacatctggctgaaattaaaagaaaggcaagatgtcttttgtgattcaaaactgatgtcagcagctattaaggacaatagagcagtccacgcagacatgggatactggatggaaagtgcgctcaatgatacctggaaaatcgaaaaagcctctttcatagaggttaaaagttgtcattggcccaaatcacataccctatggtctaatggagtattagagtccgagatgattattcccaaaaatttcgcagggccggtgagtcaacacaactaccgcccaggatatcatacgcagacagcaggcccgtggcacttgggtagacttgaaatggattttgatttttgtgaagggacaacagtggtcgtaaccgaagattgcggcaacaggggcccctcattacggacgacgactgcttctgggaagttaataacagaatggtgttgtcgatcttgtacattacctcccctacgataccgaggtgaagatggctgttggtacggaatggaaattagaccgttaaaggaaaaagaagaaaacctagtaaattcactcgtaactgcaggtcacggccaaattgataatttttctcttggagttttgggaatggccttattcctcgaggagatgctaagaacaagagtaggtacaaaacatgcaattctattagttgcagtctcttttgtgacattaatcacaggaaatatgtctttcagagacctcggacgagtcatggtcatggtaggcgcgaccatgactgatgacataggtatgggggttacctatttagccttacttgccgcgtttaaagtaaggcctacatttgcagcgggtctgttgctaaggcgactgacatcgaaagaactgatgatgacgacaatcggtatcgtcttactttctcaatctaccatacccgaaacaatactagaactaacagacgcattagctcttggaatgatggtactcaagatagttaggaaaatggaaaagtatcagctagccgtaacgatcatggccatactctgcgttcccaacgccgtgattcttcaaaatgcatggaaggtatcttgcactacccttgctgttgtttctgtaagcccattgctacttacaagctctcagcaaaaagcagactggattccgcttgcattaactataaaaggtttaaatcctactgccatattcctaacaactctaagtagaacaagtaagaaaagatcctggcccttgaatgaagctataatggcagtcggtatggtatcaattctagcgtcctcgttgttgaaaaacgacatcccaatgactggccctctggtagcagggggactactaactgtttgctatgtactaactgggaggtcagctgatttggagttagaaagagcagcggacgtgagatgggaggaacaagcagaaatatccggatcatcaccaatactaagcattactatcagtgaggacggatcgatgagtatcaaaaatgaggaagaggaacaaactctcaccattctaattcgtactggacttttggtaatatcaggtctatttccagtatcaataccgataactgctgcagcctggtatttatgggaggtaaagaaacaacgagcgggggtattgtgggatgttccatctccgcctccagtaggaaaagcggaattagaagacggggcatacagaataaaacaaaaaggaatcttagggtattcgcaaataggggctggagtttacaaagaaggcacgttccacaccatgtggcatgtaacaagaggggcggttttgatgcacaaaggcaaaaggatagaaccgagttgggcggatgtaaagaaggatctcattagctatggagggggctggaaactcgaaggagagtggaaagaaggagaagaagtacaggtgttggcactagagccaggtaaaaatccacgtgcggttcagacaaaacctgggttgttcaaaacgaatactggaacgataggcgcagtctcattagacttctcaccaggcacctccgggtccccgatagtagacaagaagggtaaagtggtcggactatacggaaatggcgttgtgacgagaagtggaacgtacgtatcggcaatagctcaaactgaaaaatctatagaagataatccagaaattgaagatgatatttttcgaaagaaaagattaacaataatggatcttcatccgggtgctggaaaaactaaacgatacttacctgcaatcgtgagagaagcgatcaaacgtggactacgcacgttaattttagccccaacgcgagtcgtagcggctgagatggaggaagcattgcgaggattgcccatacgttatcaaactccagcgataagggctgaacacacggggagggagatagtggatttgatgtgtcatgcaacctttacgatgcgattgttatctccaatcagagtgccaaactataacctaataattatggacgaagcacatttcaccgatccagcaagcattgccgcaaggggatacatttcgactagagtggaaatgggagaagctgcaggtatatttatgacagctaccccacccggatcgcgagacccttttccacagtccaatgcccctataatggatgaagaaagagaaattcctgagaggagttggaactcaggtcacgaatgggttactgattttaagggaaaaactgtatggtttgtgccttcgataaaagcgggaaatgatatagcggcatgcttgagaaagaatggtaaaaaggtaattcaactgtcaaggaaaacattcgattttgaatatattaagactcgcacaaacgattgggactttgtggtcactacagacatatctgaaatgggcgcaaatttcaaagcagagagagttatagacccaaggagatgcatgaaacccgtgatactgacagatggagaagagagagtaattttagctgggcccatgcctgttacacatagttctgcggctcagaggagaggtagggttggccgcaatcctaaaaacgaaaacgaccaatatatctatatgggtgaacctcttgagaacgatgaggattgtgcacactggaaagaagctaaaatgttattggataacattaacacccccgaaggcataatacctagcatgttcgaaccagagagggagaaggtggatgctatagatggcgaataccgtttacgaggtgaagcgcgtaaaacatttgtggatctaatgcgacggggagatctaccagtgtggttggcatatagagtagcagcagaagggataaattatgcagatcgtagatggtgttttgatggggtcaaaaacaatcaaattctcgaagagaacgttgaagtagagatatggaccaaagagggtgaaagaaagaaattaaaaccacggtggctagacgcccgaatatattccgatcctttagcattaaaagaatttaaagagtttgcagctggacgaaaatcattgacacttaacctaataactgaaatgggtcgtctacccacattcatgacacagaaagctagaaatgcattggataacttagctgttttacatacagcggaagccgggggcagagcatacaatcatgcgttatcagaactaccagagacgctggaaaccttactgctcttaactttactggcaacagttacaggaggaatcttcttatttttgatgagtggtaaaggcataggaaaaatgacactagggatgtgctgcattataaccgcgagtatactactatggtacgcccaaatacaaccgcattggattgctgcgtcaataatactagagttctttctaattgttctgttgataccagaaccagagaaacagagaacaccgcaagataatcagttaacctatgtcgtgattgctatactaacagtggttgcagcaactatggcaaatgaaatgggcttcctcgagaaaacaaagaaagactttggtttaggaagtatcacgacacaacagagcgaaagcaatatacttgatatcgatttgaggccagcctctgcgtggactctatatgcggtcgcaaccaccttcataacaccaatgctaagacatagtatagaaaatagttctgttaatgttagtctaacagcaatagctaatcaagcaacagtgcttatgggactaggtaaaggatggccactttctaaaatggacataggcgtccccctgttggcaataggctgttactctcaagttaatccgataacgctgacagccgcattattattacttgttgcgcattacgcaatcatcggtccgggtctccaagcaaaggcaactcgcgaagctcaaaaacgtgcggcggctggtataatgaagaacccaacagtcgatggtattacggttattgacttggatcctataccttatgatcctaaatttgaaaagcaactaggacaggtaatgttattagttctatgtgttacacaggttttgatgatgagaacaacatgggctctatgcgaggccctaactctagccaccggacctatcagtactttatgggaaggcaatcctggaagattctggaatacaactatagctgttagtatggctaatatatttcgtggtagttacctagcaggagccggtctattattcagcattatgaagaacactgcaaatacgaggagaggaactggtaatacaggtgaaacacttggagagaaatggaaaaacagactaaatgcattgggaaagtcagaatttcaaatctataagaaatccggaatacaggaagtagataggaccttggctaaagagggtataaaaagaggtgaaacagatcaccacgctgtaagtagggggtcagcaaagctcagatggttcgttgaaagaaacctagtgacacctgagggaaaagtagtagaccttgggtgcggacgtggcgggtggagttactactgtgggggactgaaaaatgtcaaagaagtaaaaggactaacgaagggtggtcccggtcatgaagaaccgatcccgatgtcgacctatggatggaacctagtaaggttacaaagtggtgttgatgtattcttcacccctccagagaaatgtgatactttgttgtgtgatataggagagtcttcacctaatccaacagtggaagctgggcggacattacgagtcttaaatttagttgaaaactggttaaacaacaatacacagttttgcataaaagtcttaaatccttatatgccaagtgtgatcgagaaaatggaagcgcttcagcggaaatacggcggtgccttagtaagaaaccctcttagcagaaattctacacacgaaatgtattgggtaagcaacgcgagcgggaatatcgtgtcaagcgtgaatatgattagtcggatgctgataaaccgattcacaatgagacataagaaggcgacatatgaacctgatgtcgatctaggaagtggtacaaggaatatagggatcgagtcagaaaccccaaatcttgacataatcggtaaaaggattgagaaaataaaacaggagcatgagacaagttggcattatgatcaagaccatccatacaagacatgggcttaccatggaagctatgaaactaaacagactggatcagcatccagcatggttaatggagtagtaagattattgacaaagccatgggacgtaattccaatggtaacccagatggcgatgactgatactaccccgttcggtcaacaacgcgtattcaaggagaaagttgatacaaggacacaggaaccaaaagaaggtacgaaaaagctaatgaaaattacagctgaatggctttggaaagagctaggcaagaagaaaacaccacgaatgtgtactagagaggaatttacgcgaaaagtaaggtccaacgcagcattaggggccatatttacagacgaaaacaaatggaaatccgcacgcgaagcggtagaggattctggtttttgggagttagttgataaagaacgaaatctgcatttagaggggaaatgcgagacctgcgtatataatatgatgggaaagcgtgagaagaaacttggagaatttgggaaagcaaaaggatcaagagcaatctggtacatgtggttaggcgcgagatttcttgagttcgaagcattaggtttcttaaatgaggaccattggttctcccgcgaaaactctcttagtggggtcgaaggggagggattacataaacttggatatatattacgagatgttagcaagaaagaaggaggtgccatgtacgccgacgatactgcaggatgggatacacgcattacattagaagatcttaaaaatgaagaaatggtaacgaaccatatggaaggcgaacataagaaactagcagaggccatttttaaactaacataccaaaataaggtagtacgggtacagaggcctacgccacgaggaactgtgatggatatcatttcacgtcgagatcaacgtggatcaggccaagtagtaacatatggcttaaatacattcaccaatatggaagcccaattaattagacaaatggaaggagaaggagtcttcaagtccatacaacatttgaccgctacagaagaaatagcagtaaagaactggttagtgagggtggggcgcgaaagattaagtagaatggctatcagtggagacgattgtgtcgtaaaacccctggatgatagatttgcttcggccctaacggcactgaacgacatgggcaaggtaagaaaagatatacagcaatgggaaccgtctaggggatggaatgactggactcaagtacctttttgcagtcatcatttccacgaacttattatgaaagacggtcgagtgttggttgtaccatgtcgaaaccaggatgagcttattggtagagcgagaatctcccaaggtgctggatggagcttacgcgaaacagcatgtttaggtaaaagttatgcacaaatgtggtccctaatgtacttccatcgaagagatctaagattagcggctaatgcaatttgtagcgcagtgccgtcgcactgggtacctacaagtaggacaacatggtctatacacgcgacacatgaatggatgaccacagaggatatgctaacagtatggaaccgtgtgtggattcaagaaaatccctggatagaagacaagacgcccgtcgaatcctgggaggagataccttatctcggaaagagggaggaccaatggtgcggcagtttgattggcctaacttctagggcgacgtgggccaaaaatattcagacggctatcaaccaagtaagatctctaattggtaacgaggaatatacagattacatgccaagtatgaagcggttcagaagagaggaagaggaagccggtgtactctggtaa

SEQ ID NO: 22859 - RNA, 9876 nt, synthetic construct
  misc_feature 1..9876: note = derived and/or modified CDS sequence (opt6) from DENV-2__KC762666__SS-prME
  source 1..9876: mol_type = other RNA
acagcgggaataataattatgatgataccaactgtaatggcgttccatctgaccacccgcaatggagaaccacatatgatagtatccaggcaagaaaaaggtaaatctctattgttcaaaacagaaaacggagtaaacatgtgtaccttaatggcgatggacttgggtgaattatgcgaagatacaatcacctacaattgtcctctattgaggcaaaacgaacctgaagatatagattgttggtgcaatagcacatccacatgggtaacatatggcacttgtactgctacaggagaacatagaagggaaaaacgatcggtggcacttgtaccacatgttggtatggggctagaaacacgaactgaaacatggatgtcatcagaaggtgcttggaaacacgcacaaagaatagaaacatgggtactccgccatccgggattcactataatggcagcaatcttagcgtacacaataggaactacgtatttccaacgagtcctaatattcatacttcttactgcggtaacaccatccatgaccatgaggtgtatcggcataagtaaccgcgactttgttgaaggggtatcagggggctcatgggtagacattgtactggaacatggttcctgtgtgacaacgatggctaaaaacaaaccaacgctagattttgaactaataaaaaccgaagcaaaacacccggcgactttaaggaaatattgcatagaagcaaaattgaccaatacaacgacagcgagtcgatgccctacccagggtgaaccaagccttaatgaggagcaagataaacgcttcgtatgtaaacactctatggtcgatcggggatggggaaatggttgtggtctattcgggaaagggggaatagtgacctgtgcaatgttcacatgtaagaaaaacatggaaggaaaaatcgtccagccagagaatttggaatataccatagtaataactccacattctggtgaggaaaatgctgtaggaaatgatactgggaaacatggcaaagaaatcaaagtaacaccacaaagctcaataacagaggctgaactaaccggctacggcacagtaacaatggaatgttcacctaggacaggactggacttcaacgaaatggttttactccagatggaaaataaagcgtggcttgttcatagacaatggttcttagatttgccattaccttggcttccgggtgcagatacacaaggttcaaattggatacaaaaagaaacattagtcacattcaaaaacccacacgcaaagaaacaagatgtcgtcgtcttaggcagtcaagaaggtgcaatgcatacggctttaaccggtgctacagaaattcaaatgtcatcaggaaatttactcttcacaggacacctaaaatgccgacttaggatggacaaacttcaattaaaaggaatgagttactccatgtgtacgggaaaattcaaagttgtaaaagaaatcgcagaaacacaacacggcacaatcgtaataagggtacaatatgagggagatggttcaccatgtaaaattccatttgaaataatggacctggaaaaacgacacgttttgggccgtttaattacagtaaacccgatagtcacagagaaagacagtccagtaaatatagaggctgagccaccattcggagactcctatattatcattggcgtagaaccaggacaattaaaactatcttggttcaagaaaggttcctctataggacaaatgtttgaaacaaccatgagaggggctaaaaggatggcaatactcggcgatacagcgtgggatttcggtagccttggaggggtcttcactagcatcggaaaagcactccatcaagtattcggggccatatatggagcagcattttcaggagtcagttggaccatgaaaattttgatcggtgtagtcataacttggatagggatgaactctagatctactagcttaagcgtatctttagtgttggtaggcgtcgttacattatatctgggagtgatggtacaggcagacagcggctgcgtagtgtcttggaagaataaggaactaaaatgtggatctggaatattcataaccgacaacgtccacacatggacggagcaatataaattccaaccagaatcacctagtaaattggcatcggctatacaaaaagcccatgaagaaggaatatgcggaattagaagtgtaacgcgattagaaaatttaatgtggaaacaaattacgcctgagttgaatcatattctatccgaaaatgaagtgaaactgacaattatgaccggggatattaaaggaatcatgcaagccgggaagcgctcattacgaccacaaccaacagaattaaagtattcatggaaaacttgggggaaagccaagatgctatctactgaattgcataatcacacattcctgattgacggacccgagacagccgagtgtcctaatgcaaatagagcgtggaactcgctagaagtagaagattatggatttggggtgttcactaccaatatatggctaaaactaaaagaacgccaggacgctttttgtgactccaaactaatgagcgcagcaataaaggacaatagagcagtacatgcagatatgggatactggatcgagagcgctttaaacgatacctggaagattgaaaaggcatcgtttatcgaagtgaaatcctgtcactggccaaagtcacacactctatggtcgaatggtgtcctcgagagtgaaatgattatacccaaaaatttcgcaggcccagtctcacagcataattaccgaccgggttatcatactcaaaccgcaggtccatggcacctaggtcgattagagatggattttgatttttgtgaggggacaacagtcgtagtaactgaagattgcggcaaccgaggaccatccctacgaacaactactgctagcggcaagctgattacggaatggtgttgccgatcatgcactttaccccctctaaggtatcgaggagaggacggatgctggtatggaatggagattagacctcttaaagagaaagaagaaaacttagtcaattctttagttaccgctggacatggtcaaatagataatttcagcctaggggtcctaggtatggcactgttcctggaggaaatgttaagaacaagagttggaacaaaacatgcaatactattagtagcagtatcattcgtgactctcataacaggtaacatgtcatttagggacctgggaagagtcatggtaatggtcggggcaaccatgacagatgatataggaatgggtgttacatatttagccctgttagcagcatttaaagtgcgccctacattcgccgcaggattgttacttagaaaattaaccagcaaagaactaatgatgacaacaataggaataacgttactcagtcaaagcactataccagagaccatcttggaactaactgatgcactggcgcttggaatgatggttttaaaaatcgtaagaaacatggaaaaataccagttggcagttacaatcatggcaatcctctgcgtaccaaatgcagttatcttgcagaacgcatggaaagtttcatgcactactttagcggtcgtttcggtctcaccactactactaacgtccagtcagcaaaaagcagattggatacccttagctcttactataaaggggttgaatccaacagccatttttctaacaactcttagtagaacgagtaagaaaagaagctggccactcaacgaagcaatcatggcggtcgggatggtaagcattttagcaagctctctacttaaaaacgatataccaatgactggaccattggtcgccggtgggctattaactgtatgttacgtgttaacgggtagaagtgcagatttagaacttgaaagggccgcagatgtacggtgggaggaacaagcggaaataagtggtagtagccctatattaagtataacaataagcgaggacggctcaatgtccatcaaaaatgaagaagaagaacaaaccctgactatcttgatcagaacgggactattagtaatttcggggttgttccctgtatctatccccataacagcagcagcctggtacttgtgggaagtgaagaaacaaagagccggagttctatgggacgtaccatcaccaccccctgttgggaaagcggagttggaagatggtgcttatagaataaaacagaaaggaatattaggatatagccaaattggtgctggggtatacaaagaaggaacttttcacactatgtggcatgttacgcgaggggctgtgttaatgcataaggggaagcgaatcgaaccctcgtgggctgacgttaagaaagatttaatatcgtacgggggaggatggaaactagaaggggaatggaaagaaggggaagaagttcaggtacttgctctagaacctggtaagaatccaagggccgttcaaactaaaccaggattatttaaaactagcaccggtacaataggggcggtcagcctagatttctcccccggaacatccggaagcccaattgttgataagaaagggaaagtcgtaggcctgtacggaaatggggtagtaactagaagcggaacatatgtaagcgcaatagcgcagacagaaaaatctatagaagataacccagaaatagaggacgatatttttcgaaagaagcgcctaaccatcatggacctccacccaggggccggaaaaacgaaaagatatttgcccgctatagttagagaggcaatcaaacgaggcttacgaacattaattctagcaccaacaagggtcgttgctgcggaaatggaagaagcgctccggggtctaccaattagataccaaacccccgctatcagagcagaacacacaggaagggagatcgtagatttaatgtgccacgcaaccttcaccatgagattactatcaccgattagggtcccaaattacaatcttataattatggacgaggcacacttcacagatccagcttctatagctgcacgcggttacataagcacccgggtcgagatgggggaagccgccggcatctttatgactgcaactccgccagggagtagagatccatttccgcaatctaacgcgcctataatggatgaggaaagggagataccagagcgttcttggaactcaggccacgaatgggtcacagattttaaaggtaaaaccgtttggtttgtcccaagcatcaaggcaggtaatgatatagcagcttgtctacgaaagaacggcaagaaagtaattcaacttagcaggaaaacttttgacttcgaatatataaaaactcgaacgaacgattgggattttgttgtaactaccgatatctccgagatgggggctaactttaaagcagaacgtgtcatagatccaagacgctgcatgaaacccgttatattaactgacggagaagaaagagtaatactagccggacccatgccagtgacccacagttcagcagctcagcgcagaggaagggtcggacgtaatcccaaaaatgaaaacgatcaatatatttatatgggagagccattagaaaatgatgaagattgtgcacattggaaggaggcaaaaatgctattagataatattaacactcccgaaggtattataccctccatgtttgaacctgaaagggaaaaggtagacgcaatagatggagagtatcggttaagaggagaggcgagaaaaacattcgtggatctcatgcgcagaggggatttaccagtatggttagcatacagagtagctgcagaaggaattaattatgcggatcgacgatggtgcttcgatggtgtcaaaaataaccaaatattagaagaaaacgtggaggttgaaatatggaccaaggaaggggagcggaagaaacttaagccacggtggttggatgctaggatttattcggatccactagcactgaaagagtttaaagagttcgcggcaggacgaaaaagccttacattaaacctaattacagagatgggcagactacccacgttcatgacccagaaggcacgaaatgctctggataacttggctgttcttcacacagcagaagctggagggcgcgcttataaccacgctctatctgagttgcctgaaacacttgaaacactcttactcctaactctacttgctaccgtgacaggcggtatatttctctttctaatgtcgggtaagggaataggtaagatgacgctaggaatgtgttgcataatcacggcatcaatactactgtggtacgctcaaatccaaccgcattggatcgcagcttcaattatactggagttctttctaattgtactcttaatcccagaaccggaaaaacaaagaacaccacaagacaaccagctgacatatgtcgtgatagccatactgacggttgtagcggctactatggcgaacgaaatgggatttctagagaaaactaagaaagattttggtctgggttcaataacaactcaacaaccggagtctaatatcttggatatcgatttgcggccagcaagcgcgtggacattatacgctgtagcgacaacgtttataaccccgatgttacgacactctatagaaaattcgtcagttaatgtatctttaactgcaatcgctaatcaagcaactgttctgatggggcttggaaaaggctggcctctttccaaaatggatatcggagtacctttgcttgcaataggctgctactcacaggtaaacccaatcacacttactgcggcactattattgctggtggctcactacgctataattggtccaggactacaagctaaagccaccagagaagcacagaaaagagcggcagcgggcattatgaaaaatccaacagtagatggaattacagttatcgacctagacccaatcccatacgatcctaaattcgaaaaacaactaggccaagtaatgttattagtattatgtgtaacccaagttctaatgatgagaaccacatgggccctgtgtgaagccttgacactagcaactggaccaatatcaactttatgggaaggtaacccaggacgcttttggaacacaacaatcgcggtatctatggcgaatatatttcgtggtagttacttagcgggtgcaggactgttgtttagtatcatgaaaaacactgctaacactcgtcgcggcaccggtaatactggagaaacgttaggtgagaaatggaaaaacagactgaatgcactcggtaagtctgaatttcagatatacaagaaatccggaatacaagaggtagaccgtaccctagcaaaggaaggaataaaacgaggagaaaccgaccaccacgcagttagtagaggatctgctaaactacgatggtttgtagaaagaaatctagtaacgcctgaaggtaaggtggtcgatttgggttgtggaagaggaggttggtcatactattgcggaggtctcaaaaatgtaaaggaagtgaaagggctcaccaagggaggaccgggccatgaagaacctataccaatgtcgacatacggatggaacctagtaaggcttcaaagcggagttgacgtcttctttacaccaccagaaaaatgcgacactttattatgtgatataggcgaaagtagtcctaatccgacggttgaggcaggtcgcacattgagagttctcaatttagttgaaaattggcttaacaataatacacaattctgtataaaagtcttgaacccatatatgccctcagtaattgagaaaatggaagcactgcaacgtaagtatggcggggcattagtaaggaaccctttaagtagaaatagtacacacgaaatgtattgggtctctaatgcttccggtaatatagtatcttcagtgaacatgatatcaagaatgcttataaatcgttttacgatgagacacaagaaagcaacgtatgaaccagacgtagatttaggttcagggacgagaaacattggcatcgagagtgagactccgaatctagatataatcgggaaaagaatcgagaaaatcaaaagagagcatgagacaagttggcattacgatcaagaccatccgtataaaacatgggcatatcacggatcttacgaaaccaagcaaactggatcagctagtagcatggtcaatggtgtagttaggttactcacaaagccatgggatgtaatccccatggtaactcaaatggcaatgactgatacgactccttttggacaacagagagtatttaaggaaaaggtggatactaggacacaagaaccaaaggaaggaacaaagaaattgatgaaaattacagcagagtggttgtggaaagaattaggcaagaagaaaactccccgaatgtgcacacgtgaagaatttacacgtaaggtccgttcaaatgcagcgctaggagcaatctttacagatgaaaacaagtggaagtctgcaagagaagcagtggaagactcaggcttctgggagctcgttgataaagaacgtaatctacaccttgagggaaaatgtgaaacatgtgtttataatatgatgggaaagagagagaagaaactaggtgagttcggaaaagctaaagggtcaagggcaatatggtacatgtggttaggcgcgagatttttagaatttgaagccctggggttcttaaatgaagatcactggttttcacgtgaaaatagcttatcaggtgtagaaggtgaagggttacacaaactaggatatattttaagagacgtaagtaagaaggaaggaggggctatgtatgcggatgacacagctgggtgggatacacgaataacattagaagacctcaaaaacgaagaaatggtaacaaatcatatggaaggggaacacaagaaactagcagaagcaattttcaaattgacttatcaaaacaaagtagtgagggtccaaagaccaacaccccgaggtaccgtaatggatataatatcccggagggatcagagaggtagtggacaagtagttacatatggactcaatacgttcacaaatatggaagcacaacttattcgccaaatggaaggagaaggagtctttaaaagtatacaacaattaacggttactgaagaaatcgcagtcaaaaattggctggtaagagtgggacgagaacggttaagccgcatggccataagcggagacgattgcgtagtcaaacccctagacgatcgctttgcttcggcactaacggctctaaacgatatgggcaaagttcgaaaggacattcaacaatgggaaccaagtcgcggatggaatgactggactcaagttccgttctgtagccaccactttcacgagttaattatgaaagatggtcgcgtattggtcgtaccttgcagaaaccaagatgagcttataggacgtgctcgcatatcacaaggcgctggatggagtctacgagagacggcttgcttaggtaagtcatacgcccagatgtggtctttgatgtacttccaccgcagagaccttagattagcagctaacgcaatctgcagtgctgtgcctagccactgggttccaacatcccgaactacttggtccatacatgctacccacgaatggatgacgacagaggatatgttaacagtttggaaccgcgtttggatacaagaaaatccatggatggaagataagacaccagttgaatcttgggaagagatcccttaccttggaaagagagaagaccaatggtgtggaagcctcattggattaaccagtagagcaacgtgggccaaaaatattcaaacagcaataaatcaagtcaggtcgctaatagggaatgaagagtacacagattatatgccatcgatgaaaaggttcagaagagaagaggaagaagccggtgttctatggtga
